United States Patent
Apuya et al.

(10) Patent No.: US 9,441,233 B2
(45) Date of Patent: Sep. 13, 2016

(54) TRANSGENIC PLANTS HAVING INCREASED BIOMASS

(75) Inventors: Nestor Apuya, Culver City, CA (US); Vijay Sharma, Wildwood, MO (US); Chuan-Yin Wu, Newbury Park, CA (US)

(73) Assignee: Ceres, Inc., Thousand Oaks, CA (US)

( * ) Notice: Subject to any disclaimer, the term of this patent is extended or adjusted under 35 U.S.C. 154(b) by 595 days.

(21) Appl. No.: 13/696,506

(22) PCT Filed: May 5, 2011

(86) PCT No.: PCT/US2011/035345
§ 371 (c)(1),
(2), (4) Date: Jan. 28, 2013

(87) PCT Pub. No.: WO2011/140329
PCT Pub. Date: Nov. 10, 2011

(65) Prior Publication Data
US 2013/0125263 A1    May 16, 2013

Related U.S. Application Data

(60) Provisional application No. 61/331,984, filed on May 6, 2010, provisional application No. 61/378,477, filed on Aug. 31, 2010.

(51) Int. Cl.
| C12N 15/82 | (2006.01) |
| C07K 14/415 | (2006.01) |
| C12N 9/10 | (2006.01) |
| C12Q 1/68 | (2006.01) |

(52) U.S. Cl.
CPC ......... *C12N 15/8242* (2013.01); *C07K 14/415* (2013.01); *C12N 9/1048* (2013.01); *C12N 15/8261* (2013.01); *C12Q 1/6895* (2013.01); *C12Q 2600/13* (2013.01)

(58) Field of Classification Search
None
See application file for complete search history.

(56) References Cited

U.S. PATENT DOCUMENTS

| 4,987,071 A | 1/1991 | Cech et al. |
| 5,034,323 A | 7/1991 | Jorgensen et al. |
| 5,204,253 A | 4/1993 | Sanford et al. |
| 5,231,020 A | 7/1993 | Jorgensen et al. |
| 5,254,678 A | 10/1993 | Haseloff et al. |
| 5,538,880 A | 7/1996 | Lundquist et al. |
| 5,766,847 A | 6/1998 | Jackle et al. |
| 5,878,215 A | 3/1999 | Kling et al. |
| 6,013,863 A | 1/2000 | Lundquist et al. |
| 6,326,527 B1 | 12/2001 | Kirihara et al. |
| 6,329,571 B1 | 12/2001 | Hiei |
| 6,423,885 B1 | 7/2002 | Waterhouse et al. |
| PP13,008 P2 | 9/2002 | Walsh |
| 6,452,067 B1 | 9/2002 | Bedbrook et al. |
| 6,573,099 B2 | 6/2003 | Graham |
| PP14,743 P2 | 5/2004 | Speichert et al. |
| 6,753,139 B1 | 6/2004 | Baulcombe et al. |
| 6,777,588 B2 | 8/2004 | Waterhouse et al. |
| PP15,193 P2 | 9/2004 | Smith et al. |
| 6,906,244 B2 | 6/2005 | Fischer et al. |
| PP16,176 P3 | 1/2006 | Cosner et al. |
| PP18,161 P2 | 10/2007 | Probst |
| 7,396,979 B2 | 7/2008 | Alexandrov et al. |
| 2003/0175783 A1 | 9/2003 | Waterhouse et al. |
| 2003/0175965 A1 | 9/2003 | Lowe et al. |
| 2003/0180945 A1 | 9/2003 | Wang et al. |
| 2004/0123343 A1 | 6/2004 | La Rosa et al. |
| 2004/0214330 A1 | 10/2004 | Waterhouse et al. |
| 2005/0011105 A1 | 1/2005 | Cameron et al. |
| 2005/0023639 A1 | 2/2005 | Yeh et al. |
| 2005/0032221 A1 | 2/2005 | Chang et al. |
| 2005/0034308 A1 | 2/2005 | Palmowski |
| 2005/0034343 A1 | 2/2005 | Weisbart |
| 2005/0223422 A1 | 10/2005 | Cook et al. |
| 2005/0246785 A1 | 11/2005 | Cook |
| 2006/0015970 A1 | 1/2006 | Pannell et al. |
| 2006/0021083 A1 | 1/2006 | Cook et al. |
| 2006/0038236 A1 | 2/2006 | Yamamoto |
| 2006/0040572 A1 | 2/2006 | Mizuguchi |
| 2006/0041952 A1 | 2/2006 | Cook |
| 2006/0090216 A1 | 4/2006 | Apuya |
| 2006/0107345 A1* | 5/2006 | Alexandrov et al. ......... 800/278 |
| 2006/0112445 A1 | 5/2006 | Dang |
| 2006/0260004 A1 | 11/2006 | Fang |
| 2006/0265777 A1 | 11/2006 | Apuya |
| 2006/0265788 A1 | 11/2006 | Rommens |

(Continued)

FOREIGN PATENT DOCUMENTS

| EP | 0 534 858 | 4/2000 |
| WO | WO 97/01952 | 1/1997 |

(Continued)

OTHER PUBLICATIONS

Jain et al., 2006, Funct. Integr. Genomics 6: 47-59.*
Liscum and Reed, 2002, Plant Molecular Biology 49: 387-400.*
GenBank sequence with Accession No. NM_201661.1, published May 22, 2008.*
Yi et al., 2005, Plant Physiology 138: 2087-2096.*
U.S. Appl. No. 60/637,140, filed Dec. 16, 2004, Feldmann.
U.S. Appl. No. 60/612,891, filed Sep. 23, 2004, Kwok.
U.S. Appl. No. 60/583,691, filed Jun 30, 2004, Alexandrov et al.
U.S. Appl. No. 60/583,609, filed Jun. 30, 2004, Alexandrov.
U.S. Appl. No. 60/558,869, filed Apr. 1, 2004, Cook et al.
U.S. Appl. No. 60/544,771, filed Feb. 13, 2004, Cook et al.
U.S. Appl. No. 60/518,075, filed Nov. 6, 2003, Pennell et al.
U.S. Appl. No. 60/505,689, filed Sep. 23, 2003, Cook et al.

(Continued)

*Primary Examiner* — David T Fox
*Assistant Examiner* — Bratislav Stankovic
(74) *Attorney, Agent, or Firm* — Fish & Richardson P.C.

(57) ABSTRACT

Methods and materials for modulating biomass levels in plants are disclosed. For example, nucleic acids encoding biomass-modulating polypeptides are disclosed as well as methods for using such nucleic acids to transform plant cells. Also disclosed are plants having increased biomass levels and plant products produced from plants having increased biomass levels.

9 Claims, 144 Drawing Sheets

(56) References Cited

U.S. PATENT DOCUMENTS

| | | | |
|---|---|---|---|
| 2007/0006335 | A1 | 1/2007 | Cook et al. |
| 2007/0006337 | A1 | 1/2007 | Cook |
| 2007/0042387 | A1 | 2/2007 | Pennell |
| 2007/0056058 | A1 | 3/2007 | Olivier et al. |
| 2007/0062762 | A1 | 3/2007 | Ach |
| 2008/0072340 | A1 | 3/2008 | Troukhan et al. |
| 2009/0094717 | A1 | 4/2009 | Troukhan et al. |
| 2010/0146663 | A1 | 6/2010 | Schneeberger et al. |
| 2011/0167514 | A1 | 7/2011 | Brover et al. |
| 2011/0179529 | A1 | 7/2011 | Kwok et al. |

FOREIGN PATENT DOCUMENTS

| | | | |
|---|---|---|---|
| WO | WO 98/36083 | | 8/1998 |
| WO | WO 98/53083 | | 11/1998 |
| WO | WO 99/32619 | | 7/1999 |
| WO | WO 02/46449 | | 6/2002 |
| WO | WO 2007/120989 | | 10/2007 |
| WO | WO 2007/127501 | | 11/2007 |
| WO | WO 2008/069878 | | 6/2008 |
| WO | WO 2010/034681 | * | 4/2010 |
| WO | WO 2011/044254 | | 4/2011 |

OTHER PUBLICATIONS

Aasland et al., "The SANT domain: a putative DNA-binding domain in the SWI-SNF and ADA complexes, the transcriptional co-repressor N-CoR and TFIIIB," Trends Biochem Sci. Mar. 1996;21(3):87-8.

Abler and Scandalios, "Isolation and characterization of a genomic sequence encoding the maize Cat3 catalase gene," Plant Molecular Biology, 1993, 22:1031-1038.

Akashi et al., "Gene Discovery by Ribozyme and siRNA Libraries," Nature Reviews Mol. Cell Biology, May 2005, 6:413-422.

Alberto et al., "The three-dimensional structure of invertase (beta-fructosidase) fromThermotoga maritime reveals a bimodular arrangement and an evolutionary relationship between retaining and inverting glycosidases," J Biol Chem., Feb. 2004, 79(18):18903-10.

Alonso-Blanco et al. "Arabidopsis Protocols," Methods in Molecular Biology, 1998, 82:137-146.

Anantharaman and Aravind, "The Gold domain, a novel protein module involved in Golgi function and secretion," Genome Biol. 2002; 3(5):1-7, Epub Apr. 24, 2002.

Annunen et al., "Cloning of the Human Prolyl 4-Hydroxylase a Subunit Isoform a(II) and Characterization of the Type II Enzyme Tetramer," J Biol Chem, Jul. 1997, 272:17342-17348.

Aravind and Koonin, "The DNA-repair protein AlkB, EGL-9, and leprecan define new families of 2-oxoglutarate- and iron-dependent dioxygenases," Genome Biol., Feb. 2001, 2:RESEARCH0007.

Baerson et al., "Developmental regulation of an acyl carrier protein gene promoter in vegetative and reproductive tissues," Plant Mol. Biol., 1993, 22(2):255-267.

Barral et al., "A Major Allergen from Pollen Defines a Novel Family of Plant Proteins and Shows Intra- and Interspecie Cross-Reactivity," The Journal of Immunology, 2004, 172:3644-3651.

Bateman et al., "Pfam 3.1: 1313 multiple alignments and profile HMMs match the majority of proteins," Nucl. Acids Res., 1999, 27:260-262.

Bechtold, N. et al., "In planta Agrobacterium mediated gene transfer by infiltration of adult Arabidopsis thaliana plants," C.R. Acad. Sci. Paris, 1993, 316:1194-1199.

Borden and Freemont, "The Ring finger domain: a recent example of a sequence-structure family," Curr Opin Struct Biol, Jun. 1996, 6:395-401.

Braga et al., "Expression of the CrylAb Protein in Genetically Modified Sugarcane for the Control of Diatraea saccharalis (Lepidoptera: Crambidae)," Journal of New Seeds, 2003, 5:209-221.

Burr et al., "Gene Mapping with Recombinant Inbreds in Maize," Genetics, 1998, 118: 519-526.

Burr et al., "Mapping Genes with Recombinant Inbreds," The Maize Handbook, 1994, pp. 249-254.

Bustos et al., "Regulation of B-Glucuronidase Expression in Transgenic Tobacco Plants by an A/T-Rich, cis-Acting Sequence Found Upstream of a French Bean B-Phaseolin Gene," The Plant Cell, 1989, 1(9):839-853.

Cerdan et al., "A 146 bp fragment of the tobacco Lhcbl*2 promoter confers very-low-fluence and high-irradiance responses of phytochrome to a minimal CaMV 35S promoter," Plant Mol. Biol., 1997, 33:245-255.

Chen et al., "Functional analysis of regulatory elements in a plant embryo-specific gene," Proc. Natl. Acad. Sci. USA, 1986, 83:8560-8564.

Chenna et al., "Multiple sequence alignment with the Clustal series of programs," Nucleic Acids Res., 2003, 31(13):3497-500.

Conceicao, "A cotyledon regulatory region is responsible for the different spatial expression patterns of Arabidopsis 2S albumin genes," The Plant Journal, 1994, 5:493-505.

Conkling et al., "Isolation of Transcriptionally Regulated Root-Specific Genes from Tobacco," Plant Physiol., 1990, 93:1203-1211.

Dai et al., "RF2b, a rice bZIP transcription activator, interacts with RF2a and is involved in symptom development of rice tungro disease," Proc. Natl. Acad. Sci. USA, 2004, 101(2):687-692.

de Feyter and Gaudron, "Expressing Ribozymes in Plants," Methods in Molecular Biology, 74(43).

DeBant et al., "The multidomain protein Trio binds the LAR transmembrane tyrosine phosphatase, contains a protein kinase domain, and has separate rac-specific and rho-specific guanine nucleotide exchange factor domains," Proc Natl Acad Sci U S A., May 1996, 93(11):5466-71.

Dieffenbach and Dveksler, eds., "PCR Primer: A Laboratory Manual," Cold Spring Harbor Laboratory Press, 1995.

Do et al., "ProbCons: Probabilistic consistency-based multiple sequence alignment," Genome Res., 2005, 15(2):330-40.

Durbin et al., Biological Sequence Analysis: Probabilistic Models of Proteins and Nucleic Acids, Cambridge University Press, Cambridge, UK (1998).

Fejes et al., "A 268 bp upstream sequence mediates the circadian clock-regulated transcription of the wheat Cab-1 gene in transgenic plants," Plant Mol. Biol., 1990, 15:921-932.

Fromm et al., An Octopine Synthase Enhancer Element Directs Tissue-Specific Expression and Binds ASF-1, a Factor from Tobacco Nuclear Extracts, The Plant Cell, 1989, 1:977-984.

Gardiner et al., "Development of a Core RFLP Map in Maize Using an Immortalized F2 Population," Genetics Society of America, 1993, 134: 917-930.

GenBank No. AF096096, 1999, 2 pages.
GenBank No. AF129516, 1999, 2 pages.
GenBank No. L05934, 1993, 3 pages.
GenBank No. U93215, 2002, 42 pages.

Green et al., "Binding site requirements for pea nuclear protein factor GT-1 correlate with sequences required for light-dependent transcriptional activation of the rbcS-3A gene," The EMBO J., 1988, 7:4035-4044.

Helaakoski et al., "Cloning, baculovirus expression, and characterization of a second mouse prolyl 4-hydroxylase a-subunit isoform: Formation of an a2B2 tetramer with the protein disulfide-isomerase/B subunit," Proc Natl Acad Sci USA, May 1995, 92:4427-4431.

Henrissat and Davies, "Glycoside Hydrolases and Glycosyltransferases. Families, Modules, and Implications for Genomics," Plant Physiol., Dec. 2000, 124:1515-1519.

Henrissat et al., "A census of carbohydrate-active enzymes in the genome of Arabidopsis thaliana," Plant Mol Biol., 2001, 47:55-72.

Hong et al., "Promoter sequences from two different Brassica napus tapetal oleosin-like genes direct tapetal expression of B-glucuronidase in transgenic Brassica plants," Plant Mol. Biol., 1997, 34(3):549-555.

Hurst., "Transcription factors 1: bZIP proteins," Protein Profile, 1995, 2(2):101-68.

Hwang et al., "Aleurone- and embryo-specific expression of the B-glucuronidase gene controlled by the barley Chi26 and Ltpl promoters in transgenic rice," Plant Cell Rep, 2001, 20:647-654.

(56) References Cited

OTHER PUBLICATIONS

Hyrup et al., "Peptide Nucleic Acids (PNA): Synthesis, Properties and Potential Applications," Bioorganic & Medicinal Chemistry, 1996, 4(1):5-23.
Jordano et al., "A Sunflower Helianthinin Gene Upstream Sequence Ensemble Contains an Enhancer and Sites of Nuclear Protein Interaction," The Plant Cell, 1989, 1:855-866.
Kasuga et al., "Improving plant drought, salt, and freezing tolerance by gene transfer of a single stress-inducible transcription factor," Nature Biotechnology, 1999, 17: 287-291.
Keller and Baumgartner, "Vascular-Specific Expression of the Bean GRP 1.8 Gene is Negatively Regulated," The Plant Cell, 1991, 3(10):1051-1061.
Kulaeva and Prokoptseva, "Recent advances in the study of mechanisms of action of phytohormones," Biochemistry (Mosc), Mar. 2004, 69(3):233-47.
Lam et al., "Site-specific mutations alter in vitro factor binding and change promoter expression pattern in transgenic plants," Proc. Natl. Acad. Sci. USA, 1989, 86:7890-7894.
Li et al., "Small dsRNAs induce transcriptional activation in human cells," Proc Natl Acad Sci USA, 2006, 103(46):17337-42.
Lloyd et al., "Targeted mutagenesis using zinc-finger nucleases in Arabidopsis," Proc. Natl. Acad. Sci. USA, Feb. 2005, 102:2232-2237.
Luan et al., A Rice cab Gene Promoter Contains Separate cis-Acting Elements That Regulate Expression in Dicot and Monocot Plants, The Plant Cell, Aug. 1992, 4:971-981.
Lubberstedt et al., "Promoters from Genes for Plastid Proteins Possess Regions with Different Sensitivities toward Red and Blue Light," Plant Physiol., 1994, 104:997-1006.
Marini et al., "A Family of Ammonium Transporters in *Saccharomyces cerevisiae*," Mol Cell Biol, Aug. 1997, 17:4282-4293.
Marini et al., "The Rh (rhesus) blood group polypeptides are related to NH4+ transporters," Trends Biochem Sci, Dec. 1997, 22:460-461.
Matsuoka et al., "Tissue-specific light-regulated expression directed by the promoter of a C4 gene, maize pyruvate, orthophosphate dikinase, in a C3 plant, rice," Proc. Natl. Acad. Sci. USA, Oct. 1993, 90:9586-9590.
Matzke and Birchler, "RNAi-Mediated Pathways in the Nucleus," Nature Reviews Genetics, Jan. 2005, 6:24-35.
McCallum et al., "Targeted screening for induced mutations," Nature Biotechnology, Apr. 2000, 18: 455-457.
Medberry et al., "The Commelina Yellow Mottle Virus Promoter Is a Strong Promoter in Vascular and Reproductive Tissues," The Plant Cell, Feb. 1992, 4(2):185-192.
Meier et al., "Elicitor-Inducible and Constitutive in Vivo DNA Footprints Indicate Novel cis-Acting Elements in the Promoter of a Parsley Gene Encoding Pathogenesis-Related Protein 1," The Plant Cell, Mar. 1991, 3:309-316.
Mittal, "Improving the Efficiency of RNA Interference in Mammals," Nature Reviews Genetics, May 2004, 5:355-365.
Nature.Com, "Nature Reviews RNA interference collection," Oct. 2005, [retrieved on Apr. 12, 2012]. Retrieved from Internet: URL http://www.nature.com/focus/rnai/index.html. 2 pages.
Paulsen and Skurray, "The POT family of transport proteins," Trends Biochem Sci, 1994, 19:404-404.
Pellegrini et al., "Structure of serum response factor core bound to DNA," Nature, 1995, 376:490-8.
Perriman et al., "Effective ribozyme delivery in plant cells," Proc. Natl. Acad. Sci. USA, Jun. 1995, 92(13):6175-6179.
Raetz and Whitfield, "Lipopolysaccharide Endotoxins," Annu Rev Biochem., 2002, 71:635-700.
Rhoads and Friedberg, "Sequence motifs for calmodulin recognition," FASEB J., 1997, 11(5):331-40.
Riggs et al., "Cotyledon Nuclear Proteins Bind to DNA Fragments Harboring Regulatory Elements of Phytohemagglutinin Genes," The Plant Cell, Jun. 1989, 1(6):609-621.
Rivera et al., "Genomic evidence for two functionally distinct gene classes," Proc. Natl. Acad. Sci. USA, May 1998, 95:6239-6244.
Roach et al., "Crystal structure of isopenicillin N synthase is the first from a new structural family of enzymes," Nature, 1995, 375:700-704.
Roudier et al., "COBRA, an Arabidopsis Extracellular Glycosyl-Phosphatidyl Inositol-Anchored Protein, Specifically Controls Highly Anisotropic Expansion through Its Involvement in Cellulose Microfibril Orientation," The Plant Cell, Jun. 2005, 17(6):1749-63.
Sheridan et al., "The macl Gene: Controlling the Commitment to the Meiotic Pathway in Maize," Genetics, 1996, 142:1009-1020.
Shibuya et al., "RNA-directed DNA methylation induces transcriptional activation in plants," Proc Natl Acad Sci USA, Feb. 2009,106(5):1660-1665.
Shimofurutani et al., "Functional analyses of the Dof domain, a zinc finger DNA-binding domain, in a pumpkin DNA-binding protein AOBP," FEBS Letters, 1998, 430:251-256.
Slocombe et al., "Temporal and Tissue-Specific Regulation of a Brassica napus Stearoyl-Acyl Carrier Protein Desaturase Gene," Plant Physiol., 1994, 104(4):167-176.
Sonnhammer et al., "Pfam: A Comprehensive Database of Protein Domain Families Based on Seed Alignments," Proteins, 1997, 28:405-420.
Sonnhammer et al., "Pfam: multiple sequence alignments and HMM-profiles of protein domains," Nucl. Acids Res., 1998, 26:320-322.
Stemple, "TILLING—a high-throughput harvest for functional genomics," Nat Rev Genet, Feb. 2004, 5(2):145-50.
Strayer et al., "Cloning of the Arabidopsis Clock Gene TOC1, an Autoregulatory Response Regulator Homolog," Science, 2000, 289:768-771.
Summerton and Weller, "Morpholino Antisense Oligomers: Design, Preparation, and Properties," Antisense Nucleic Acid Drug Dev., 1997, 7:187-195.
Tovkach et al., "A toolbox and procedural notes for characterizing novel zinc finger nucleases for genome editing in plant cells," The Plant Journal, 2009, 57:747-757.
Townsend et al., "High-frequency modification of plant genes using engineered zinc-finger nucleases," Nature, May 2009, 459:442-445.
Truernit et al., "The promoter of the Arabidopsis thaliana SUC2 sucrose-H+ symporter gene directs expression of B-glucuronidase to the phloem: Evidence for phloem loading and unloading by SUC2," Planta, 1995, 196:564-570.
Refseth et al., "Hybridization capture of microsatellites directly from genomic DNA," Electrophoresis, 1997, 18: 1519-1523.
Urao et al, "Molecular cloning and characterization of a gene that encodes a MYC-related protein in Arabidopsis," Plant Mol. Biol., 1996, 32:571-57.
Weigel et al., "Activation Tagging in Arabidopsis," Plant Physiology, Apr. 2000, 122:1003-1013.
Yamamoto et al., "The Promoter of a Pine Photosynthetic Gene Allows Expression of a B-Glucuronidase Reporter Gene in Transgenic Rice Plants in a Light-Independent but Tissue-Specific Manner," Plant Cell Physiol., 1994, 35:773-778.
Yan et al., "New Construct Approaches for Efficient Gene Silencing in Plants," Plant Physiol., Aug. 2006, 141:1508-1518.
Zhang et al., "DNA Sequences That Activate Isocitrate Lyase Gene Expression during Late Embryogenesis and during Postgerminative Growth," Plant Physiology, 1996, 110:1069-1079.
Zhang et al., "From Laboratory to Field. Using Information from Arabidopsis to Engineer Salt, Cold, and Drought Tolerance in Crops," Plant Physiol., Jun. 2004, 135:612-621.
Zheng et al., "SPK1 Is an Essential S-Phase-Specific Gene of *Saccharomyces cerevisiae* That Encodes a Nuclear Serine/Threonine/Tyrosine Kinase," Mol. Cell Biol., Sep. 1993, 13:5829-5842.

* cited by examiner

| | | |
|---|---|---|
| SEQ_ID_NO_253 | T | 485 |
| SEQ_ID_NO_255 | S | 484 |
| SEQ_ID_NO_257 | R | 482 |
| SEQ_ID_NO_258 | . | 476 |
| SEQ_ID_NO_260 | D K | 480 |
| SEQ_ID_NO_261 | H | 483 |
| SEQ_ID_NO_262 | A | 485 |
| SEQ_ID_NO_264 | E | 483 |
| SEQ_ID_NO_265 | Y | 481 |
| SEQ_ID_NO_267 | K | 485 |
| SEQ_ID_NO_268 | D | 479 |
| SEQ_ID_NO_269 | K | 483 |
| SEQ_ID_NO_270 | | 491 |

| SEQ_ID_NO_1541 | ADHSRSQGFR | FDTQAQALLA | NAPLSY | 308 |
| SEQ_ID_NO_1542 | ADHSRSQGFK | YDTQAQALLA | NAPAGY | 309 |
| SEQ_ID_NO_1544 | ADHSRSQGFK | YDTQAQALLA | NAPAGY | 310 |
| SEQ_ID_NO_1545 | ADHSRSQGFK | YETESQALLA | NATSY | 307 |
| SEQ_ID_NO_1547 | ADHSRNQGFK | YETQSQALLT | DATTY | 314 |
| SEQ_ID_NO_1548 | ADDSKADGFR | YEKEAQEVLA | SF----PN | 304 |
| SEQ_ID_NO_1550 | ADDSKANGFS | YEKQSQDLLV | T----AN | 308 |
| SEQ_ID_NO_1552 | ADDSKAQGFR | YEKQSQALLA | I----PH | 301 |
| SEQ_ID_NO_1553 | ADMSKANGFK | YELESQDLLA | -----S | 280 |
| SEQ_ID_NO_1555 | ADDSKADGFL | YEKQFQEIL | -----D | 301 |

| SEQ_ID | | | | | | | | | |
|---|---|---|---|---|---|---|---|---|---|
| SEQ_ID_NO_663 | PFLNDVKPRV | LLVTGSSPKP | CENPVGDHYL | LKSIKNKIDY | CRVHGI EIFY | 180 |
| SEQ_ID_NO_665 | PFLNDIKPRV | LLVTGSSPKP | CENPVGDHYL | LKSIKNKMDY | CRVHGI EVFY | 180 |
| SEQ_ID_NO_667 | PFLNDIKPRV | LLVTGSAPKP | CENPVGDHYL | LKSIKNKMDY | CRVHGI EVFY | 181 |
| SEQ_ID_NO_668 | PFVNDVKPRV | LLVTGSSPKP | CENPVGDHYL | LKSIKNKIDY | CRLHGLEIFY | 181 |
| SEQ_ID_NO_669 | NFIGPNKPRV | LLVTGSSPKP | CENPVGDHYL | LKSIKNKIDY | CRLHGI EIFY | 192 |
| SEQ_ID_NO_670 | NFIGPNKPRV | LLVTGSSPKP | CENPVGDHYL | LKSIKNKIDY | CRLHGI EIFY | 185 |
| SEQ_ID_NO_672 | NFIGANKPRV | LLVTGSSPKP | CENPVGDHYL | LKSIKNKIDY | CRLHGI EIFY | 192 |
| SEQ_ID_NO_674 | NFIGPNKPRV | LLVTGSSPKP | CENPVGDHYL | LKSIKNKIDY | CRLHGI EIFY | 192 |
| SEQ_ID_NO_675 | NFVAPNKPRV | LLVTGSSPKP | CENPVGDHYL | LKSIKNKIDY | CRLHGI EIFY | 193 |

| SEQ_ID | | | | | | | | | |
|---|---|---|---|---|---|---|---|---|---|
| SEQ_ID_NO_663 | NMALLDAEMA | GFWAKLPLIR | ALLLAHPEVE | FLVWMDSDAM | FTDMAFELPW | 230 |
| SEQ_ID_NO_665 | NMALLDAEMA | GFWAKLPLLR | ALLLAHPEFE | FIVWMDSDAM | FTDMAFELPW | 230 |
| SEQ_ID_NO_667 | NMALLDAEMA | GFWAKLPLMR | ALLLAHPEVE | FLVWMDSDAM | FTDMAFELPW | 231 |
| SEQ_ID_NO_668 | NMALLDAEMA | GFWAKLPLIR | ALLLAHPEVE | FLVWMDSDAM | FSDMAFELPW | 231 |
| SEQ_ID_NO_669 | NMALLDAEMA | GFWAKLPLIR | ALLLAHPEIE | FLVWMDSDAM | FTDMAFELPW | 242 |
| SEQ_ID_NO_670 | NMALLDAEMA | GFWAKLPLIR | KLLLSHPEVE | FLVWMDSDAM | FTDMAFEVPW | 235 |
| SEQ_ID_NO_672 | NMALLDAEMA | GFWAKLPLIR | KLLISHPEVE | FLVWMDSDAM | FTDMAFELPW | 242 |
| SEQ_ID_NO_674 | NMALLDAEMA | GFWAKLPLIR | KLLLSHPEVE | FLVWMDSDAM | FTDMAFEVPW | 242 |
| SEQ_ID_NO_675 | NFALLDAEMS | GFWAKLPLIR | KLLLSHPEVE | FLVWMDSDAM | FTDMAFELPW | 243 |

| SEQ_ID | | | | | | | | | |
|---|---|---|---|---|---|---|---|---|---|
| SEQ_ID_NO_663 | ERYGPYNLVM | HGWDEMVYDD | KNWGLNTGS | FLLRNCQWSL | DMLDTWAPMG | 280 |
| SEQ_ID_NO_665 | ERYGPYNLIM | HGWDEMVYDD | KNWGLNTGS | FLLRNCQWSL | DMLDTWAPMG | 280 |
| SEQ_ID_NO_667 | ERYGPYNLIM | HGWDEMVYDD | KNWGLNTGS | FLLRNCQWSL | DMLDTWAPMG | 281 |
| SEQ_ID_NO_668 | ERYGPYNLVM | HGWDEMVYDD | KNWGLNTGS | FLLRNCQWSL | DELDTWAPMG | 281 |
| SEQ_ID_NO_669 | ERYKDYNLVM | HGWNEMVYDQ | KNWGLNTGS | FLLRNQWAL | DLDTWAPMG | 292 |
| SEQ_ID_NO_670 | ERYKDSNFVM | HGWNEMVYDQ | KNWGLNTGS | FLLRNCQWSL | DILDAWAPMG | 285 |
| SEQ_ID_NO_672 | ERYKDSNFVM | HGWNEMVYDQ | KNWGLNTGS | FLLRNGQWSL | DILDAWAPMG | 292 |
| SEQ_ID_NO_674 | ERYKDSNFVM | HGWNEMVYDQ | KNWGLNTGS | FLLRNCQWSL | DLLDAWSPMG | 292 |
| SEQ_ID_NO_675 | ERYKDHNFVM | HGWNEMVYDQ | RNWGLNTGS | FLLRNCQWSL | DILDTWAPMG | 293 |

FIG. 7C

| SEQ ID NO | Sequence | Position |
|---|---|---|
| SEQ_ID_NO_663 | PKGPVRIEAG KVLTKSLKDR PVFEADDQSA MVYILATQRE KWGDKVYYLEN | 330 |
| SEQ_ID_NO_665 | PKGPVRIEAG KVLTKSLKDR PVFEADDQSA MVYILATQRE KWGDKVYYLEN | 330 |
| SEQ_ID_NO_667 | PKGPVRIEAG KVLTKSLKDR PVFEADDQSA MVYILATQRE KWGDKVYYLEN | 331 |
| SEQ_ID_NO_668 | PKGPVRIEAG KVLTKYLKDR PVFEADDQSA MVYILATQRE KWGDKVYYLEN | 331 |
| SEQ_ID_NO_669 | PKGKIREEAG KVLTRELKDR PVFEADDQSA MVYILATERE AMGNKVYYLES | 342 |
| SEQ_ID_NO_670 | RTEAG KILTRELKDR PVFEADDQSA MVYLLATQRD TWGGKVYYLES | 335 |
| SEQ_ID_NO_672 | PKGKIREEAG KVLTRELKNR PVFEADDQSA MVYLLATQRE KWGDKVYYLEN | 342 |
| SEQ_ID_NO_674 | PKGKIRDEAG KVLTRELKDR PVFEADDQSA MVYLLATQRD KWGDKVYYLEN | 342 |
| SEQ_ID_NO_675 | PKGKIRDEAG ELLTRELKDR PVFEADDQSA MVYILTTQRE KWAGKVYLES | 343 |

| SEQ ID NO | Sequence | Position |
|---|---|---|
| SEQ_ID_NO_663 | GYYLHGYWGI LVDRYEEMLE NYKPGLGDHR WPLVTHFVGC KPCGKFGDYP | 380 |
| SEQ_ID_NO_665 | GYYLHGYWGI LVDRYEEMLE NYKPGLGDHR WPLVTHFVGC KPCGKFGDYP | 380 |
| SEQ_ID_NO_667 | GYYLHGYWGI LVDRYEEMLE NYKPGLGDHR WPLVTHFVGC KPCGKFGDYP | 381 |
| SEQ_ID_NO_668 | GYYLHGYWGI LVDRYEEMLE NYHPGLGDHR WPLVTHFVGC KPCGKFGDYP | 381 |
| SEQ_ID_NO_669 | AYYLHGYWGI LVDRYEEMIE NYHPGLGDHR WPLVTHFVGC KPCGKFGDYP | 392 |
| SEQ_ID_NO_670 | SYYLHGYWGI LVDRYEEMIE NYHPGLGDHR WPLVTHFVGC KPCGKFGDYP | 385 |
| SEQ_ID_NO_672 | AYYLHGYWGI LVDRYEEMIE NYHPGLGDHR WPLVTHFVGC KPCGKFGDYS | 392 |
| SEQ_ID_NO_674 | AYYLHGYWGI LVDRYEEMIE NYHPGLGDHR WPLVTHFVGC KPCGKFGDYS | 392 |
| SEQ_ID_NO_675 | AYYLHGYWGI LVDRYEEMIE NYHPGLGDHR WPLVTHFVGC KPCGKFGDYS | 393 |

| SEQ ID NO | Sequence | Position |
|---|---|---|
| SEQ_ID_NO_663 | VERCLKQMDR AFNFGDNQIL QMYGFTHKSL ASRRVKRIRN ETSNPLEMKD | 430 |
| SEQ_ID_NO_665 | VERCLKNMDR AFNFGDNQIL QMYGFTHKSL ASRRVKRIRN ETSNPLETKD | 430 |
| SEQ_ID_NO_667 | VERCLKNMDR AFNFGDNQIL QMYGFTHKSL ASRRVKRIRN ETSNPLETKD | 431 |
| SEQ_ID_NO_668 | VERCLKQMER AFNFGDNQIL QIYGFTHKSL GSRKVKRIRN ETSNPLDVKD | 431 |
| SEQ_ID_NO_669 | VERCLKQMDR AFNFGDNQIL QIYGFTHKSL ASRKVKRVRN DTNNPLEMKD | 442 |
| SEQ_ID_NO_670 | VERCLKQMER AFNFGDNQVL QIYGFTHKSL GSRRVKRTRN ETSNPLEVKD | 435 |
| SEQ_ID_NO_672 | VERCLKQMDR AFNFGDNQIL QIYGFTHKSL ASRKVKRVRN ETGNPLEAKD | 442 |
| SEQ_ID_NO_674 | VERCLKQMDR AHNFADNQIL QIYGFTHKSL ASRKVKRVRN ETGNPLEAKD | 442 |
| SEQ_ID_NO_675 | VERCLKQMDR AFNFGDNQIL QMYGFTHKSL ASRKVKRTRN ETSNPLEVQD | 443 |

| | | | | |
|---|---|---|---|---|
| SEQ_ID_NO_663 | ELGLLHPAFK | AVKT- - | ST | 446 |
| SEQ_ID_NO_665 | ELGLLHPAFK | AVKT- - | ST | 446 |
| SEQ_ID_NO_667 | ELGLLHPAFK | AVKT- - | ST | 447 |
| SEQ_ID_NO_668 | ELGLLHPAFK | AMKTT- | ST | 448 |
| SEQ_ID_NO_669 | ELGLLHPAFK | AVKVQT | NQV | 461 |
| SEQ_ID_NO_670 | ELGLLHPAFK | AVKVS- | SS | 452 |
| SEQ_ID_NO_672 | ELGLLHPAFK | AVKVS- | SS | 459 |
| SEQ_ID_NO_674 | ELGLLHPAFK | AVKVS- | AS | 459 |
| SEQ_ID_NO_675 | ELGLLHPAFK | AVKVS- | AS | 460 |

| | | | |
|---|---|---|---|
| SEQ_ID_NO_1366 | VNRTLQEAKS | SSNTCRQ | 425 |
| SEQ_ID_NO_1368 | VNRTLEEAKS | GSNSCRR | 421 |
| SEQ_ID_NO_1370 | VNRTLEEAKS | SSNSCRR | 421 |
| SEQ_ID_NO_1371 | NRALEGGEF | GSKSCRR | 406 |
| SEQ_ID_NO_1372 | VTNLLEGSNS | QSNQC-K | 409 |
| SEQ_ID_NO_1374 | KNLLDEWNS | QMNQC-K | 398 |
| SEQ_ID_NO_1375 | TNELDDLNS | QSNQC-K | 395 |
| SEQ_ID_NO_1377 | SSLLSNEKF | RPRQC-V | 421 |
| SEQ_ID_NO_1378 | VTSLLSEEKF | HPRQC-K | 425 |

| | | | |
|---|---|---|---|
| SEQ_ID_NO_928 | SAL F L L A L L | L A P | 445 |
| SEQ_ID_NO_930 | -AASAF L L A L | L V A | 446 |
| SEQ_ID_NO_932 | -AASAF L L L L | L V A | 450 |
| SEQ_ID_NO_933 | -AASAI L V V L | L V A | 441 |
| SEQ_ID_NO_935 | ST C L V L L L L | L A A | 449 |
| SEQ_ID_NO_936 | -AAS L L L L L L | S M G | 453 |
| SEQ_ID_NO_937 | L A L L L L L M I | S I W | 440 |
| SEQ_ID_NO_938 | AAP L L L M L L | Y T I W | 462 |
| SEQ_ID_NO_940 | L F T I L L L L F | S I W | 431 |
| SEQ_ID_NO_941 | V F I T M L V M | A L W | 463 |
| SEQ_ID_NO_943 | AFM L L F F L | A V W | 431 |
| SEQ_ID_NO_944 | F I SSV I F L L | V T V W | 460 |

| SEQ_ID_NO | | | | | | |
|---|---|---|---|---|---|---|
| SEQ_ID_NO_1215 | LSRVYPSIAV | GKDAHLYVFN | NGEADIKVSH | LTAWEMKKPL | MNGAEVTDG | 586 |
| SEQ_ID_NO_1217 | LSRVYPSIAI | GKEAHLYVFN | NGDVDVKVSS | LTAWEMKKPL | MN------- | 579 |
| SEQ_ID_NO_1218 | LSRVYPSIAV | GKDAHLYVFN | NGEVDVTVSG | LTAWEMKKPL | MN------- | 588 |
| SEQ_ID_NO_1219 | LSRVYPSIAV | GQNAHLYVFN | NGEADIKVSH | LTAWEMKKPL | MN------- | 574 |
| SEQ_ID_NO_1220 | LSRVYPSMAI | GDKAHLYVFN | NGEADIKISH | LKAWEMKKPL | MN------- | 575 |
| SEQ_ID_NO_1221 | LSRVYPSMAL | GKDAHLYVFN | NGETDIKVSK | LTAWEMKRPL | MN------- | 581 |
| SEQ_ID_NO_1223 | LSRVYPSMAL | GKDNARLHVFN | NGVTDIKVSV | LTAWEMKKPA | MN------- | 579 |
| SEQ_ID_NO_1224 | LSRVYPTLAL | GKNARLHVFN | NGKVDIKVSE | LKAWEIRRPL | LMN------ | 566 |
| SEQ_ID_NO_1225 | LSRVYPSLAV | YENAHLYVFN | NGSADVKVSE | LDAWSMKKPL | MN------- | 584 |
| SEQ_ID_NO_1226 | SSRVYPTLAV | EEKAHLFVFN | NGSETITVEN | LDAWSMKMPV | R-------- | 590 |
| SEQ_ID_NO_1227 | TSRVYPTLAV | SKKAHLYAFN | NGSETVTVES | LNAWTMHRPQ | MNVP----- | 581 |
| SEQ_ID_NO_1228 | TSRVYPTLAI | NDEAHLFAFN | NGTEAVTIKK | LDAWSMGKAK | MN------- | 572 |
| SEQ_ID_NO_1230 | TSRVYPTLAI | FDKAHLFAFN | NGTEPVTIES | LNAWSMADAK | IQ------- | 582 |
| SEQ_ID_NO_1231 | TSRVYPTLAI | GEKAHLFVFN | NGTEAITIET | LNAVSMADAK | L-------- | 579 |
| SEQ_ID_NO_1233 | TSRVYPTKAV | | NGSQPVTVES | LNAVMQKPL | KMNQ----- | 587 |

| SEQ_ID_NO | | | |
|---|---|---|---|
| SEQ_ID_NO_1215 | NDVWEMKKLL | VMNGA | 601 |
| SEQ_ID_NO_1217 | | GA | 581 |
| SEQ_ID_NO_1218 | | GA | 590 |
| SEQ_ID_NO_1219 | | GA | 576 |
| SEQ_ID_NO_1220 | | GA | 577 |
| SEQ_ID_NO_1221 | | GA | 583 |
| SEQ_ID_NO_1223 | | GA | 581 |
| SEQ_ID_NO_1224 | | GA | 568 |
| SEQ_ID_NO_1225 | | GS | 586 |
| SEQ_ID_NO_1226 | | MN | 592 |
| SEQ_ID_NO_1227 | | VKS | 584 |
| SEQ_ID_NO_1228 | | Y | 572 |
| SEQ_ID_NO_1230 | | H | 583 |
| SEQ_ID_NO_1231 | | | 580 |
| SEQ_ID_NO_1233 | | GAK | 590 |

| | | | | | | |
|---|---|---|---|---|---|---|
| SEQ_ID_NO_580 | GVSAKDWPSV | AKKGKVDMME | LELKKLEETI | KNIHEEMFYL | REREEEMQDL | 189 |
| SEQ_ID_NO_582 | GVSAKDYPSV | AKKGKVDMME | LELKKLEETI | KNIHEEMFYL | REREEEMQDL | 189 |
| SEQ_ID_NO_584 | GVSAKDYPSV | AKKGKVDMME | LELKKLEETI | RNIHEEMFYL | REREEEMQDL | 189 |
| SEQ_ID_NO_585 | GVAAKDWSNV | AKKGQVDMME | LELKKLEETI | KSIHEEMFYL | REREEQMQNI | 190 |
| SEQ_ID_NO_587 | GVTAKDWSNV | AKKGKVDVME | MELKKLEDTI | TSIQEEMNYL | REREEDMQDL | 188 |
| SEQ_ID_NO_589 | GVAAKDWSNV | AKKGQVDMME | MELKKMYDTV | TSIHEEMFYL | REREEEMQEL | 176 |
| SEQ_ID_NO_591 | GVAAKDWSNV | AKKGQVEVME | LELKKLQDTV | TSIHEEMFYL | REREEEMQEL | 181 |
| SEQ_ID_NO_592 | GVAAKDWSKV | AKKGQVEVME | LELRKLEETV | NSIHEEMFYL | REREEEMQNL | 170 |
| SEQ_ID_NO_594 | GVQSKSMSSV | AKKSQVEVME | FDVKRLYDTV | TSIHDEMYL | REREEEMQEL | 174 |
| SEQ_ID_NO_595 | GVEAKDWTKI | AKRDKIDGME | LELRKLEEYM | LFLHDEMFYL | RAREEEMQDL | 188 |
| SEQ_ID_NO_596 | GVAAKDWYKI | AKKDQIDVME | SELQRLYDTV | KIFFERKKLL | RGREEEMQDL | 172 |
| SEQ_ID_NO_580 | NRRTNSRMAW | LGFLSLGICL | SVAGLQLWHL | KTFFERKKLL | | 229 |
| SEQ_ID_NO_582 | NRRTNSRMAW | LGFLSLGICL | SVAGLQLWHL | KTFFERKKLL | | 229 |
| SEQ_ID_NO_584 | NRRTNSRMAW | LGFLSLGICL | SVAGLQLWHL | KTFFERKKLL | | 229 |
| SEQ_ID_NO_585 | NKQTNSRMAW | SFLSLGICL | SVAGLQLWHL | KTFFQKKKLI | | 230 |
| SEQ_ID_NO_587 | NRQTNSRMGW | SFLSIIVCL | SVAGLQVWHL | KTFFERKKLI | | 228 |
| SEQ_ID_NO_589 | NTSTNVKMAW | SLLSLFVCL | SVAGMQLWHL | KTFFERKKLL | | 216 |
| SEQ_ID_NO_591 | NRTTNSRMFW | SFLSLFVCL | SVAGMQLWHL | KTFFERKKLL | | 221 |
| SEQ_ID_NO_592 | NRATNSKMAT | SFLSLLVCL | SVAGMQFVHL | KTFFERKKVI | | 210 |
| SEQ_ID_NO_594 | NASTNSKMAW | FGLMSFLVCL | SVAAGMQLWHL | KSFFEKKKVI | | 214 |
| SEQ_ID_NO_595 | NREITDRRMFT | EFCSIICL | SVAGMQLWHL | KIFFERKKLL | | 228 |
| SEQ_ID_NO_596 | | | | | | 212 |

| | | | | | | | |
|---|---|---|---|---|---|---|---|
| SEQ_ID_NO_154 | MPFTPGPYSG | VSTLALVARA | SAFGVGVVYG | SIKLSILKAT | - -K- -PL | KKEEE | 46 |
| SEQ_ID_NO_156 | MPFTPGPYSG | VSTLALVARA | SAFSVGVVYG | SIKLSILKAT | - -K- -PL | KKEEE | 46 |
| SEQ_ID_NO_158 | MPFTPGPYSG | VSTLALVARA | SMFGFGVVYG | SIKLSILKAT | - -K- -PL | KKEEE | 46 |
| SEQ_ID_NO_159 | MPFTPGPYSG | VSTLALVARV | SALGVGVVYG | AVKLSILKAT | - -K- -PL | PNKKEA | 47 |
| SEQ_ID_NO_161 | MPFTPGPYSG | KSTLALVARA | SAVGVGVVYG | SVKLGLKMT | - -K- -PL | KKEEA | 46 |
| SEQ_ID_NO_163 | MAL-PGPYSG | VSTLAEVARA | SAFAFGVVYG | SVKLSYLQVK | AKF- -H- | KKEEE | 47 |
| SEQ_ID_NO_165 | MTLPPGPYSG | ASALALVARA | SAFSFGLVYG | SVKLKILKMK | ANS- -H- | KKAE | 48 |
| SEQ_ID_NO_167 | MAIPPGLYSG | TSSLALVARA | SAFSVGLLYG | SMKLKVLKMT | - -KKP- | HKVE | 47 |
| SEQ_ID_NO_168 | MAPPPGPYSG | TSTLALVARV | SAFSAGLVYG | SIKLKYLKSK | AKS-Q- | KKAE | 48 |

| | | |
|---|---|---|
| SEQ_ID_NO_154 | AHAHH | 51 |
| SEQ_ID_NO_156 | AHAHH | 51 |
| SEQ_ID_NO_158 | AHAHH | 51 |
| SEQ_ID_NO_159 | ANAHH | 52 |
| SEQ_ID_NO_161 | AAAHH | 51 |
| SEQ_ID_NO_163 | AKGHH | 52 |
| SEQ_ID_NO_165 | AKAHH | 53 |
| SEQ_ID_NO_167 | ATAHH | 52 |
| SEQ_ID_NO_168 | AKSHH | 53 |

| | | | | |
|---|---|---|---|---|
| SEQ_ID_NO_187 | QEI TAASPEF | VSSVRDLSLS | C RLD | 286 |
| SEQ_ID_NO_188 | - - - SVAGESR | - - - - - - - - - - | VLPAI | 217 |
| SEQ_ID_NO_190 | - - - SAAAEER | - - - - - - - - - - | - SSGE | 163 |
| SEQ_ID_NO_192 | - - - - - - - - - - | - - - - - - - - - - | - - - - - | 151 |

| SEQ_ID_NO | | | | | | |
|---|---|---|---|---|---|---|
| SEQ_ID_NO_1592 | | | | MYCSDPPHPL | HLVASDKQQK | DHKLIILSWKK | ::MDPNTPAD | 8 |
| SEQ_ID_NO_1580 | | | | | | | PTMDSDPLGV | 40 |
| SEQ_ID_NO_2622 | | | | | | | ::MDSDQHGV | 8 |
| SEQ_ID_NO_1585 | | | | | | | ::MDSNSSEY | 8 |
| SEQ_ID_NO_2621 | | | | | | | ::MESNTSRF | 8 |
| SEQ_ID_NO_2623 | | | | | | | ::MDSNASGF | 8 |

| SEQ_ID_NO_1592 | FFKGSS | KFHT | --KKG | GGVI DLGLSL | RTI QHETYLP | 46 |
| SEQ_ID_NO_1580 | FPNLSP | KYHP | YYSQT--TEF | GGVI DLGLSL | RTI QHELYHS | 77 |
| SEQ_ID_NO_2622 | FPSLSP | KYHP | YYPQN--TEC | GGVI DLGLSL | RTI QHELYHT | 45 |
| SEQ_ID_NO_1585 | LLNHAT | TLPS | VYQTNNKEN | GNFI DLGLSL | RALQPEAYYP | 48 |
| SEQ_ID_NO_2621 | LLN-SS | TLHS | VFYQE--KQD | DGII DLGLSL | GTVRHEAYHS | 45 |
| SEQ_ID_NO_2623 | LLN-PP | ALHS | TYYQP--RED | DGII DLGLSL | RTLKPEAYHP | 45 |

| SEQ_ID_NO_1592 | PARMI GLDGY | GELIDWSQPS | YNSI TQLKSE | DTGHQRLAQG | 86 |
| SEQ_ID_NO_1580 | SGQR- | | | | 81 |
| SEQ_ID_NO_2622 | SGQK- | | | | 49 |
| SEQ_ID_NO_1585 | STHG------GY | DELIDWQHLH | PQLSKNSRSE | YPTNFN--NY | 82 |
| SEQ_ID_NO_2621 | SIANL-----YD | EELMDWPHSN | LNLKNSRTMH | SRSVHQ--NF | 79 |
| SEQ_ID_NO_2623 | SGHR- | | | | 49 |

| SEQ_ID_NO_1592 | YYNNEGLESR | GKYAYVKVNL | DGLVVGRKVC | LVDQGAYATL | 125 |
| SEQ_ID_NO_1580 | YCSNEGY--R | RKWGYVKVTM | DGLVVGRKVC | VLDHGSYSTL | 119 |
| SEQ_ID_NO_2622 | YCSNEGY--R | RNMGYVKVTM | DGFVVGRKVC | MLDHGYSTL | 87 |
| SEQ_ID_NO_1585 | DDESEGI QSK | ERWEYVKVNM | DGVIVGRKIC | LLEHSSYSSL | 122 |
| SEQ_ID_NO_2621 | DEEIEGVQSN | ERWAYVKVNM | DGVTIGRKIC | VLDHGGYSSL | 119 |
| SEQ_ID_NO_2623 | MPLAEGVQSK | DRWAYVKVNM | DGVIVGRKIC | MLDHGGYSSL | 89 |

| SEQ_ID_NO_1592 | ALQLNDMFGM | QTVSGLRLFQ | TESEFSLVYR | DREGIWRNVG | 165 |
| --- | --- | --- | --- | --- | --- |
| SEQ_ID_NO_1580 | AHQLEDMFGM | QSVSGLRLFQ | MESEFCLVYR | DEEGLWRNAG | 159 |
| SEQ_ID_NO_2622 | AHQLEDMFGM | QSVSGLRLFQ | MESEFCLVYR | DEEGIWRNVG | 127 |
| SEQ_ID_NO_1585 | ATQLEDMFGK | QNMDGLRLFQ | DGSEFSLFYK | DRNDQWRIVG | 162 |
| SEQ_ID_NO_2621 | ALQLEDMFGS | QSVSGLRLFQ | SGSEYSLFYK | DRQDNWRPVG | 159 |
| SEQ_ID_NO_2623 | ALQLEDMFGR | QSASGLRLFQ | AGSEFCLFYK | DREENWRITVG | 129 |

| SEQ_ID_NO_1592 | DVPWKEFVES | VDRMRIARRN | DALLPF---- | ---- | 191 |
| --- | --- | --- | --- | --- | --- |
| SEQ_ID_NO_1580 | DVPWNEFIES | VERLRITRRN | DAVLPF---- | ---- | 185 |
| SEQ_ID_NO_2622 | DVPWNEFIET | VERLRITRRN | DVLLPF---- | ---- | 153 |
| SEQ_ID_NO_1585 | DVPWNEFADR | VKRLRIMRKD | EAFFPN---- | ---T | 188 |
| SEQ_ID_NO_2621 | DVPWNEFIEC | VKRLRIARKN | SGIVSYSSRC | ---S | 190 |
| SEQ_ID_NO_2623 | DVPWKEFVES | VKRLRIARKS | EPLLPYSPAF | | 160 |

| | | | | | | |
|---|---|---|---|---|---|---|
| SEQ_ID_NO_851 | : : : : : : : : SKVEK TPEKE KE : : : : : : : : : : : : : : : : : : : : : : : : : : : : : : : : | | | | | 145 |
| SEQ_ID_NO_853 | ENVKP TPNPT : : : : : : : : : : : : : : : : : : : : : : : : : : : : : : : : : : : : : : : : : : | | | | | 209 |
| SEQ_ID_NO_854 | : : : : : : : : : : : : : : : : : : : : : : : : : : : : : : : : : : : : : : : : : : : : : : : : : | | | | | 174 |
| SEQ_ID_NO_856 | : : : : : : : : : : : : : : : : : : : : : : : : : : : : : : : : : : : : : : : : : : : : : : : : : | | | | | 78 |
| SEQ_ID_NO_857 | AKIEA EPEAK KEETVLEVVE KIATSTEEDG AKTVEAI QES IVSVTVTDGE | | | | | 242 |

| | | | | | | |
|---|---|---|---|---|---|---|
| SEQ_ID_NO_851 | : : : : : : : : : : | : : : : : : : : : : | : : : : : : : : : : | TPEEVKI WG | PLLEDDRSD | VVLLKFLRAR | 174 |
| SEQ_ID_NO_853 | QE | VAKEE QKVAS | SSPEEVPI | PLLKDDRSD | VVLLKFLRAR | | 251 |
| SEQ_ID_NO_854 | ES | LLKHE | PLQEDVSI WG | PLLKDERSD | MILLKFLRAR | | 212 |
| SEQ_ID_NO_856 | : : : : : : : : : : | : : : : : : : : : : | EEVSI WG | VPLF KDDRTD | VILLKFLRAR | | 105 |
| SEQ_ID_NO_857 | QPVTETVGEA | VAVAE MEVTP | TTPEEVEI WG | PLLIA DERSD | VILLKFLRAR | | 292 |

| | | | | | | |
|---|---|---|---|---|---|---|
| SEQ_ID_NO_851 | EFKVKDSFAM | LKNTI KWRKE | FKI DELVEED | LMDDLDKVVF | MHGHDREGHP | | 224 |
| SEQ_ID_NO_853 | DFKVRDAFVM | IKNTI QWRRD | FKI DELVDED | LGDDLEKVVF | MHGYDREGHP | | 301 |
| SEQ_ID_NO_854 | EFKVKEAFAM | LKNTI FMRKE | FGI DALVDDD | LGEHLEKVVF | MHGFDRDGHP | | 262 |
| SEQ_ID_NO_856 | ELKVKDALVM | FQNTL RWRKD | DALLDED | LGDHLEKVVF | MHGHGREGHP | | 155 |
| SEQ_ID_NO_857 | DFKVKEAYTM | KQTVI WRKE | FGI EALLQED | LGTDMDKVVF | TDGYDKEGHP | | 342 |

| | | | | | | |
|---|---|---|---|---|---|---|
| SEQ_ID_NO_851 | VCYNVYGEFQ | NKELYNKTFS | DEEEKRKHFLR | TRI QFLERSI | RKLDFSS- GG | | 273 |
| SEQ_ID_NO_853 | VCYNVYGEFQ | NKELYQKTFS | DEEEKRLKFLR | WRI QFLERSI | RKLDFSPI GG | | 350 |
| SEQ_ID_NO_854 | VCYNVVGEFQ | NKELYQKTFS | DEEEKRMKFLR | WRI QFLERSI | RKLDFTPI GG | | 311 |
| SEQ_ID_NO_856 | VCYNVYGEFQ | NKDLYHIKAFS | SQDNRNKFLR | WRI QLLERSI | RHLDFTPSSG | | 205 |
| SEQ_ID_NO_857 | VYYNVF GEFE | NKELYQNTFS | DDEEKRTKFI R | WRI QSLEKSI | RKLDFTPI SG | | 391 |

| | | | | | | |
|---|---|---|---|---|---|---|
| SEQ_ID_NO_851 | VSTI FQVNDM | KNSPGL GKKE | LRSATKQAVE | LLQDNYPEFV | FKQAFI NVPW | | 323 |
| SEQ_ID_NO_853 | ISTI FQVNDL | KNSPGPGKRE | RLATKQALQ | SLQDNYPEFV | AKQVFI NVPW | | 400 |
| SEQ_ID_NO_854 | VNTI FQVNDL | KNSPGPGKME | LRQATKQALQ | LLQDNYPEFV | AKQVFI NVPW | | 361 |
| SEQ_ID_NO_856 | : : : : : : : : : : | KNSPGPGKAE | RLATKQALQ | LLQDNYPEFV | RHLDFTPSSG | | 255 |
| SEQ_ID_NO_857 | ISTI MQVNDL | KNSPGL GKKE | LRQATNKALQ | LLQDNYPEFV | AKQVFI NVPW | | 441 |

FIG. 24B

| | | | | | | |
|---|---|---|---|---|---|---|
| SEQ_ID_NO_851 | WYL VFYTVI G | PFMT PRSKSK | L VFAGPSRSA | ETL FKYI SPE | QVPVQYGGLS | 373 |
| SEQ_ID_NO_853 | WYLAFYTVMS | PFMTQRTKSK | FVFAGPSNSA | ETLFKYI SPE | QVPI QYGGLC | 450 |
| SEQ_ID_NO_854 | WYLAFYTMI N | PFLTQRTKSK | FVFAS PAKSA | KTLFKYI SPE | QVPI QYGGLS | 411 |
| SEQ_ID_NO_856 | WYLAFYTMI S | PFLTS RTKSK | FVFAGPSKSP | DTLFKYI FPE | QVPVQYGGLS | 305 |
| SEQ_ID_NO_857 | WYLAFS RFLS | AF LTQRTKSK | FVFAGPSKSA | DTLFKYI APE | QVPVQYGGLS | 491 |
| | | | | | | |
| SEQ_ID_NO_851 | VDP CDCNPDF | SL EDSASEI T | VKPQ TKQTVE | I I YEKC LV | WEI RV L GWEV | 423 |
| SEQ_ID_NO_853 | VDFCDCNPEF | TI ADPATDI T | VKPATKQTVE | I I YEKCI LV | RVV GWEV | 500 |
| SEQ_ID_NO_854 | VDYCDCNPDF | GI ADPVTEI T | VKPSTKQTVE | LVSEQCVI V | WEVRVVGWEV | 461 |
| SEQ_ID_NO_856 | VDFCDCNPDF | TMSDPVTEI P | I KPTI TKQTVE | A YEKCI I V | WEL RVVGWEV | 355 |
| SEQ_ID_NO_857 | RI E - - GEQEF | I T ADPATEVT | NRKVAPA DE T | FPL SEK S TLV | WEVRV DMSM | 538 |
| | | | | | | |
| SEQ_ID_NO_851 | SYK AEFVPEE | KDAYTVVI QK | PRKMR PSDEP | VLTHSFKVNE | LGKVLLTVDN | 473 |
| SEQ_ID_NO_853 | SYS AEFMPEA | KDAYTI I I TK | PTKMSPTDEP | VVSNSFKVGE | LGKI LLTVDN | 550 |
| SEQ_ID_NO_854 | AYG AEFI PDA | EDE YTVVVQK | ATKMSPTDDP | VM C NSFKI KE | LGKi VI TI DN | 511 |
| SEQ_ID_NO_856 | SYN AEFI PDA | KDAYTVI I QK | A TKMSPTDEP | VVSNSFKVE | LGKL LLTI DN | 405 |
| SEQ_ID_NO_857 | NYG AEFVPS A | EDGYTVI I QK | NRKVAPA DE T | I SNTFKI GE | P GKVI LTI DN | 588 |
| | | | | | | |
| SEQ_ID_NO_851 | PTSKKKKLVY | RFN VKP | | | | 489 |
| SEQ_ID_NO_853 | PTSKKKKLLY | RFKI NP | | | | 566 |
| SEQ_ID_NO_854 | PTSKKKKLLY | RFKTPECHI E | VQFNI QSAED | YTTHSNRVYA | TRLASLHSSG | 561 |
| SEQ_ID_NO_856 | PTL KKRLLY | RFKI KP | | | | 421 |
| SEQ_ID_NO_857 | Q S SKKKKLLY | RS KT P | | | | 604 |
| | | | | | | |
| SEQ_ID_NO_851 | | | | | | 490 |
| SEQ_ID_NO_853 | | | | L FSD | | 569 |
| SEQ_ID_NO_854 | DI SKI RRRLT | AGGDRDLTYS | HSGPRI ACW E | | | 591 |
| SEQ_ID_NO_856 | | | | YSD | | 424 |
| SEQ_ID_NO_857 | | | | I SE | | 607 |

|  |  |  |  |  |  |
|---|---|---|---|---|---|
| SEQ_ID_NO_1016 | G-EERMCS- | KSMEEDRGYN | KGEDIPIYAEV | SL------SKS | KSCKALDMRL | 277 |
| SEQ_ID_NO_1018 | GGEEKLCF--- | KSMEED---NR | G-EDMSYTQV | SG------GKS | KSCKALDMRL | 255 |
| SEQ_ID_NO_1020 | A-EERPCSYM | KSLVEEREYA | L-EECSSMSI | SEPGF---NEE | KACRVLNMNI | 258 |
| SEQ_ID_NO_1021 | T-EERPCL--- | LVDERDYR | L-EECSSMGI | SEPGF---NEE | KACRVLNMNI | 250 |
| SEQ_ID_NO_1023 | P-EERSCSYM | KSLVDEREYL | L-EECSSMGI | SEHEF---NRE | KSCRVLNMNL | 225 |
| SEQ_ID_NO_1024 | S-EDRPCSYM | KSLVDERDYQ | D-EECSSIGA | PETEFNHDNN | KPCRVLNMNP | 258 |

|  |  |  |
|---|---|---|
| SEQ_ID_NO_1016 | CL----EK | 280 |
| SEQ_ID_NO_1018 | CL----ER | 258 |
| SEQ_ID_NO_1020 | KGDGSGV | 265 |
| SEQ_ID_NO_1021 | KGEEPGD | 257 |
| SEQ_ID_NO_1023 | ------- | 225 |
| SEQ_ID_NO_1024 | KAADSGG | 265 |

| | | | | | |
|---|---|---|---|---|---|
| SEQ_ID_NO_2150 | AVS- | C--- | --- | DI W- | --- | P | 277 |
| SEQ_ID_NO_2152 | AAS- | C--- | --- | NI W- | --- | S | 339 |
| SEQ_ID_NO_2154 | AVS- | S--- | IT- | SMW- | --- | P | 313 |
| SEQ_ID_NO_2155 | AMS- | CL-- | MT- | TMW- | --- | P | 303 |
| SEQ_ID_NO_2157 | VTS- | CGGA | GV | DVWPWD- | --- | | 359 |
| SEQ_ID_NO_2159 | VTS- | CGGP | GV | DVWPWD- | HSN | GGLSK | 320 |
| SEQ_ID_NO_2160 | VTS- | CGGP | GV | DVWPWDH | HSN | GGLSK | 331 |
| SEQ_ID_NO_2161 | ---- | GGGE | VG | DAMGWDN | NHSN | GGLSK | 298 |
| SEQ_ID_NO_2163 | MQHG | GGA | DAV | DVWGWDS | SSN | GAMSK | 311 |

FIG. 29E

| SEQ_ID_NO | | | | | | |
|---|---|---|---|---|---|---|
| SEQ_ID_NO_2196 | MSG----AITCS | AADLATLLG | PNATA----AA | DYICGQLGTV | 34 |
| SEQ_ID_NO_2197 | MSG----AITCS | AADLATLLG | PNATA----AA | DYICGQLGTV | 34 |
| SEQ_ID_NO_2199 | MAA----SMTCS | AGDLAQLLG | SNVTNSTGAA | DFICSQFNTA | 36 |
| SEQ_ID_NO_2200 | MAA---LPECS | AANLAQLG | PNATDAAAVA | GFICDQFIAV | 37 |
| SEQ_ID_NO_2201 | MARATSLSCS | ADLLAGFLLG | PNATNASSAAA | SLICSQLEAI | 39 |
| SEQ_ID_NO_2202 | MAS---LNCS | AEQLAQLLG | PNGTA----AA | SFICDRFSAV | 33 |
| SEQ_ID_NO_2204 | MAF------- | ANLAPLLG | PNITT--AVAAA | SYICNQFSGM | 33 |
| SEQ_ID_NO_2206 | MT-------- | VDILAPFLG | VNGTG----AA | DYICSKL--- | 26 |
| SEQ_ID_NO_2207 | MAS---TLGCS | AITDLVPHLTG | VN-NATAVA | DFICGRLDAV | 36 |
| SEQ_ID_NO_2208 | MS-----TC- | AADLAPLLG | PAAAN----AT | DYLCG----- | 25 |
| SEQ_ID_NO_2210 | MS-----TC- | AADLAPLLG | PAAAN----AT | DYLCG----- | 25 |
| SEQ_ID_NO_2211 | MA-----TC- | AADLGPLLG | PVAAN----AT | DYLCN----- | 25 |
| SEQ_ID_NO_2212 | MSA----TC- | AADSLAPLLG | AAAAN----AT | DYLCN----- | 26 |
| SEQ_ID_NO_2214 | MA-----TC- | AASLAPLLG | AAAAN----AT | DYLCN----- | 25 |

| SEQ_ID_NO | | | | | | |
|---|---|---|---|---|---|---|
| SEQ_ID_NO_2196 | NNKFTDAAFA | IDNTYLLFSA | YLVFAMQLGF | AMLCAGSVRA | 74 |
| SEQ_ID_NO_2197 | NNKFTDAAFA | IDNTYLLFSA | YLVFAMQLGF | AMLCAGSVRA | 74 |
| SEQ_ID_NO_2199 | ADNFSATQYA | VDNTYLLFSA | YLVFSMQLGF | AMLCAGSVRA | 76 |
| SEQ_ID_NO_2200 | GQRFSDTAFA | VDSTYLLFSA | YLVFSMQLGF | AMLCAGSVRA | 77 |
| SEQ_ID_NO_2201 | NNKFTDTAYA | VDSTYLLFSA | YLVFAMQLGF | AMLCAGSVRA | 79 |
| SEQ_ID_NO_2202 | SNNFTDTNYA | VDNTYLLFSA | YLVFSMQLGF | AMLCAGSVRA | 73 |
| SEQ_ID_NO_2204 | SDRFVDTGYA | IDSTYLLFSA | YLVFAMQLGF | AMLCAGSVRA | 73 |
| SEQ_ID_NO_2206 | ---FSDASYA | VDNTYLLFSA | YLVFAMQLGF | AMLCAGSVRA | 63 |
| SEQ_ID_NO_2207 | SITKLSDTTYA | VDATYLLFSA | YLVFSMQLGF | AMLCAGSVRA | 76 |
| SEQ_ID_NO_2208 | ----QFADTASA | VDATYLLFSA | YLVFAMQLGF | AMLCAGSVRA | 63 |
| SEQ_ID_NO_2210 | ----QFADTASA | VDATYLLFSA | YLVFAMQLGF | AMLCAGSVRA | 63 |
| SEQ_ID_NO_2211 | ----RFADTTSA | VDSTYLLFSA | YLVFAMQLGF | AMLCAGSVRA | 63 |
| SEQ_ID_NO_2212 | ----READTTSA | VDSTYLLFSA | YLVFAMQIGF | AMLCAGSVRA | 64 |
| SEQ_ID_NO_2214 | ----READTISA | VDSTYLLFSA | YLVFAMQIGF | AMLCAGSVRA | 63 |

| SEQ_ID_NO | | | | | | | |
|---|---|---|---|---|---|---|---|
| SEQ_ID_NO_2196 | KNTMNI | MLTN | VLDAAAGGLF | YYLFGYAFAF | GG- - - | SSEGFI | | 112 |
| SEQ_ID_NO_2197 | KNTMNI | MLTN | VLDAAAGGEF | YYLFGFAFAF | GG- - - | SSEGFI | | 112 |
| SEQ_ID_NO_2199 | KNTMNI | MLTN | VLDAAAGGLF | YYLFGFAFAF | GT- - - | PSNGFI | | 114 |
| SEQ_ID_NO_2200 | KNTMNI | MLTN | VLDAAAGGLF | YYLFGFAFAF | GI - - - L | PSNGFI | | 115 |
| SEQ_ID_NO_2201 | KNTMNI | KLTN | VLDAATGGLF | YYLFGFAFAF | GA - - - | PSNGFI | | 117 |
| SEQ_ID_NO_2202 | KNTMNI | MLTN | VLDAAAGGLF | YYLFGFAFAF | GT- - - | PSNGFI | | 111 |
| SEQ_ID_NO_2204 | KNTMNI | MLTN | VLDAATGGLF | YYLFGFAFAW | GS- - - | PSNGFI | | 111 |
| SEQ_ID_NO_2206 | KNTMNI | MLTN | VLDAAAGGLS | YYLFGFAFAF | GS- - - | PSNGFI | | 101 |
| SEQ_ID_NO_2207 | KNTMNI | MLTN | VLDAAAGALF | YYLFGFAFAF | GSRSNAF | | | 116 |
| SEQ_ID_NO_2208 | KNTMNI | MLTN | VLDAAAGALF | YYLFGFAFAF | GT- - - | PSNGFI | | 101 |
| SEQ_ID_NO_2210 | KNTMNI | MLTN | VLDAAAGALF | YYLFGFAFAF | GT- - - | PSNGFI | | 101 |
| SEQ_ID_NO_2211 | KNTMNI | MLTN | VLDAAAGALF | YYLFGFAFAF | GT- - - | PSNGFI | | 101 |
| SEQ_ID_NO_2212 | KNTMNI | MLTN | VLDAAAGALF | YYLFGFAFAF | GT- - - | PSNGFI | | 102 |
| SEQ_ID_NO_2214 | KNTMNI | MLTN | VLDAAAGALF | YYLFGFAFAY | GT- - - | PSNGFI | | 101 |

| SEQ_ID_NO | | | | | | | |
|---|---|---|---|---|---|---|---|
| SEQ_ID_NO_2196 | GRHNFAL | RDF | PTPTADYSFF | LYQWAFAIAA | AGI | TSGSI | AE | 152 |
| SEQ_ID_NO_2197 | GRHNFAL | RDF | PTPTADYSFF | LYQWAFAIAA | AGI | TSGSI | AE | 152 |
| SEQ_ID_NO_2199 | GKHNFGL | KNF | PSSSFDYSYF | LYQWAFAIAA | AGI | TSGSI | AE | 154 |
| SEQ_ID_NO_2200 | GRHFFGL | KDV | PTVAFDYSYF | LYQWAFAIAA | AGI | TSGSI | AE | 155 |
| SEQ_ID_NO_2201 | GRHNFAL | KSF | PTSNFDYSNF | LYQWAFAIAA | AGI | TSGSI | AE | 157 |
| SEQ_ID_NO_2202 | GKHFFAL | KSI | PTKTFDYSNF | LYQWAFAIAA | AGI | TSGSI | AE | 151 |
| SEQ_ID_NO_2204 | GRHFFGL | KEI | PSNSFDYSNF | LYQWAFAIAA | AGI | TSGSI | AE | 151 |
| SEQ_ID_NO_2206 | GRHNFAL | ESI | PSSEDYSNF | LYQWAFAIAA | AGI | TSGSI | AE | 141 |
| SEQ_ID_NO_2207 | GHYSFAL | TGV | PSAHDYSFF | LYQWAFAIAA | AGI | TSGSI | AE | 156 |
| SEQ_ID_NO_2208 | GKQFFGL | KHL | PRTGFDYFFF | LYQWAFAIAA | AGI | TSGSI | AE | 141 |
| SEQ_ID_NO_2210 | GKQFFGL | QHL | PKITGFDYFFF | LYQWAFAIAA | AGI | TSGSI | AE | 141 |
| SEQ_ID_NO_2211 | GKQFFGL | KHM | PQTGFDYSFF | LFQWAFAIAA | AGI | TSGSI | AE | 141 |
| SEQ_ID_NO_2212 | GKHFFGL | KDM | PQTGFDYSFF | FQWAFAVAA | AGI | TSGSI | AE | 142 |
| SEQ_ID_NO_2214 | GKQFFGL | KRL | PQVGFDYDFF | FQWAFAIAA | AGI | TSGSI | AE | 141 |

| SEQ_ID_NO_2196 | - - - - - - - - - - - - - - - - - - - - - - - - - - - - - - | 496 |
|---|---|---|
| SEQ_ID_NO_2197 | - - - - - - - - - - - - - - - - - - - - - - - - - - - - - - | 517 |
| SEQ_ID_NO_2199 | EFLPSAAAAA ACDAIYIVGT GKGVI FRQPV LEELTLVLNA | 603 |
| SEQ_ID_NO_2200 | - - - - - - - - - - - - - - - - - - - - - - - - - - - - - - | 500 |
| SEQ_ID_NO_2201 | - - - - - - - - - - - - - - - - - - - - - - - - - - - - - - | 500 |
| SEQ_ID_NO_2202 | - - - - - - - - - - - - - - - - - - - - - - - - - - - - - - | 500 |
| SEQ_ID_NO_2204 | - - - - - - - - - - - - - - - - - - - - - - - - - - - - - - | 488 |
| SEQ_ID_NO_2206 | - - - - - - - - - - - - - - - - - - - - - - - - - - - - - - | 471 |
| SEQ_ID_NO_2207 | - - - - - - - - - - - - - - - - - - - - - - - - - - - - - - | 511 |
| SEQ_ID_NO_2208 | - - - - - - - - - - - - - - - - - - - - - - - - - - - - - - | 496 |
| SEQ_ID_NO_2210 | - - - - - - - - - - - - - - - - - - - - - - - - - - - - - - | 494 |
| SEQ_ID_NO_2211 | - - - - - - - - - - - - - - - - - - - - - - - - - - - - - - | 530 |
| SEQ_ID_NO_2212 | - - - - - - - - - - - - - - - - - - - - - - - - - - - - - - | 492 |
| SEQ_ID_NO_2214 | - - - - - - - - - - - - - - - - - - - - - - - - - - - - - - | 487 |

| SEQ_ID_NO_2196 | - - - - - - - - - - - - - - - - - - - - - - - - - - - - - - | 496 |
|---|---|---|
| SEQ_ID_NO_2197 | - - - - - - - - - - - - - - - - - - - - - - - - - - - - - - | 517 |
| SEQ_ID_NO_2199 | QCRGYPCGKP KKGCQSNLNF RLESKARAKG PVFCGKEKSK | 643 |
| SEQ_ID_NO_2200 | - - - - - - - - - - - - - - - - - - - - - - - - - - - - - - | 500 |
| SEQ_ID_NO_2201 | - - - - - - - - - - - - - - - - - - - - - - - - - - - - - - | 500 |
| SEQ_ID_NO_2202 | - - - - - - - - - - - - - - - - - - - - - - - - - - - - - - | 500 |
| SEQ_ID_NO_2204 | - - - - - - - - - - - - - - - - - - - - - - - - - - - - - - | 488 |
| SEQ_ID_NO_2206 | - - - - - - - - - - - - - - - - - - - - - - - - - - - - - - | 471 |
| SEQ_ID_NO_2207 | - - - - - - - - - - - - - - - - - - - - - - - - - - - - - - | 511 |
| SEQ_ID_NO_2208 | - - - - - - - - - - - - - - - - - - - - - - - - - - - - - - | 496 |
| SEQ_ID_NO_2210 | - - - - - - - - - - - - - - - - - - - - - - - - - - - - - - | 494 |
| SEQ_ID_NO_2211 | - - - - - - - - - - - - - - - - - - - - - - - - - - - - - - | 530 |
| SEQ_ID_NO_2212 | - - - - - - - - - - - - - - - - - - - - - - - - - - - - - - | 492 |
| SEQ_ID_NO_2214 | - - - - - - - - - - - - - - - - - - - - - - - - - - - - - - | 487 |

FIG. 30I

| SEQ_ID_NO_2196 | --- | --- | --- | --- | --- | 496 |
|---|---|---|---|---|---|---|
| SEQ_ID_NO_2197 | RGL NRYFPW | I I AKYRRCYA | GVAVPQLDWT | PEPPVDLLIL | - - - | 517 |
| SEQ_ID_NO_2199 | --- | --- | --- | --- | --- | 683 |
| SEQ_ID_NO_2200 | --- | --- | --- | --- | --- | 500 |
| SEQ_ID_NO_2201 | --- | --- | --- | --- | --- | 500 |
| SEQ_ID_NO_2202 | --- | --- | --- | --- | --- | 500 |
| SEQ_ID_NO_2204 | --- | --- | --- | --- | --- | 488 |
| SEQ_ID_NO_2206 | --- | --- | --- | --- | --- | 471 |
| SEQ_ID_NO_2207 | --- | --- | --- | --- | --- | 511 |
| SEQ_ID_NO_2208 | --- | --- | --- | --- | --- | 496 |
| SEQ_ID_NO_2210 | --- | --- | --- | --- | --- | 494 |
| SEQ_ID_NO_2211 | --- | --- | --- | --- | --- | 530 |
| SEQ_ID_NO_2212 | --- | --- | --- | --- | --- | 492 |
| SEQ_ID_NO_2214 | --- | --- | --- | --- | --- | 487 |

| SEQ_ID_NO_2196 | --- | --- | --- | --- | --- | 496 |
|---|---|---|---|---|---|---|
| SEQ_ID_NO_2197 | --- | --- | --- | --- | --- | 517 |
| SEQ_ID_NO_2199 | FGLDKGVI VY | I CDSRGVRDL | NETDFYELPV | VMKALMI QPD | --- | 723 |
| SEQ_ID_NO_2200 | --- | --- | --- | --- | --- | 500 |
| SEQ_ID_NO_2201 | --- | --- | --- | --- | --- | 500 |
| SEQ_ID_NO_2202 | --- | --- | --- | --- | --- | 500 |
| SEQ_ID_NO_2204 | --- | --- | --- | --- | --- | 488 |
| SEQ_ID_NO_2206 | --- | --- | --- | --- | --- | 471 |
| SEQ_ID_NO_2207 | --- | --- | --- | --- | --- | 511 |
| SEQ_ID_NO_2208 | --- | --- | --- | --- | --- | 496 |
| SEQ_ID_NO_2210 | --- | --- | --- | --- | --- | 494 |
| SEQ_ID_NO_2211 | --- | --- | --- | --- | --- | 530 |
| SEQ_ID_NO_2212 | --- | --- | --- | --- | --- | 492 |
| SEQ_ID_NO_2214 | --- | --- | --- | --- | --- | 487 |

FIG. 30J

| | | | | | | |
|---|---|---|---|---|---|---|
| SEQ_ID_NO_2196 | - - - - - - - | - - - - - - - | - - - - - - - | - - - - - - - | - - - - - - - | 496 |
| SEQ_ID_NO_2197 | - - - - - - - | - - - - - - - | - - - - - - - | - - - - - - - | - - - - - - - | 517 |
| SEQ_ID_NO_2199 | VFSVCDQASA | NFFILTICSP | VVNKGTASAS | EILAGALKDN | - - - - - - - | 763 |
| SEQ_ID_NO_2200 | - - - - - - - | - - - - - - - | - - - - - - - | - - - - - - - | - - - - - - - | 500 |
| SEQ_ID_NO_2201 | - - - - - - - | - - - - - - - | - - - - - - - | - - - - - - - | - - - - - - - | 500 |
| SEQ_ID_NO_2202 | - - - - - - - | - - - - - - - | - - - - - - - | - - - - - - - | - - - - - - - | 500 |
| SEQ_ID_NO_2204 | - - - - - - - | - - - - - - - | - - - - - - - | - - - - - - - | - - - - - - - | 488 |
| SEQ_ID_NO_2206 | - - - - - - - | - - - - - - - | - - - - - - - | - - - - - - - | - - - - - - - | 471 |
| SEQ_ID_NO_2207 | - - - - - - - | - - - - - - - | - - - - - - - | - - - - - - - | - - - - - - - | 511 |
| SEQ_ID_NO_2208 | - - - - - - - | - - - - - - - | - - - - - - - | - - - - - - - | - - - - - - - | 496 |
| SEQ_ID_NO_2210 | - - - - - - - | - - - - - - - | - - - - - - - | - - - - - - - | - - - - - - - | 494 |
| SEQ_ID_NO_2211 | - - - - - - - | - - - - - - - | - - - - - - - | - - - - - - - | - - - - - - - | 530 |
| SEQ_ID_NO_2212 | - - - - - - - | - - - - - - - | - - - - - - - | - - - - - - - | - - - - - - - | 492 |
| SEQ_ID_NO_2214 | - - - - - - - | - - - - - - - | - - - - - - - | - - - - - - - | - - - - - - - | 487 |

| | | | | | | |
|---|---|---|---|---|---|---|
| SEQ_ID_NO_2196 | - - - - - - - | - - - - - - - | - - - - - - - | - - - - - - - | - - - - - - - | 496 |
| SEQ_ID_NO_2197 | - - - - - - - | - - - - - - - | - - - - - - - | - - - - - - - | - - - - - - - | 517 |
| SEQ_ID_NO_2199 | KRAVLYGEPT | FWKGKIQSVF | QLSDGSGLAV | TVARYETPAH | - - - - - - - | 803 |
| SEQ_ID_NO_2200 | - - - - - - - | - - - - - - - | - - - - - - - | - - - - - - - | - - - - - - - | 500 |
| SEQ_ID_NO_2201 | - - - - - - - | - - - - - - - | - - - - - - - | - - - - - - - | - - - - - - - | 500 |
| SEQ_ID_NO_2202 | - - - - - - - | - - - - - - - | - - - - - - - | - - - - - - - | - - - - - - - | 500 |
| SEQ_ID_NO_2204 | - - - - - - - | - - - - - - - | - - - - - - - | - - - - - - - | - - - - - - - | 488 |
| SEQ_ID_NO_2206 | - - - - - - - | - - - - - - - | - - - - - - - | - - - - - - - | - - - - - - - | 471 |
| SEQ_ID_NO_2207 | - - - - - - - | - - - - - - - | - - - - - - - | - - - - - - - | - - - - - - - | 511 |
| SEQ_ID_NO_2208 | - - - - - - - | - - - - - - - | - - - - - - - | - - - - - - - | - - - - - - - | 496 |
| SEQ_ID_NO_2210 | - - - - - - - | - - - - - - - | - - - - - - - | - - - - - - - | - - - - - - - | 494 |
| SEQ_ID_NO_2211 | - - - - - - - | - - - - - - - | - - - - - - - | - - - - - - - | - - - - - - - | 530 |
| SEQ_ID_NO_2212 | - - - - - - - | - - - - - - - | - - - - - - - | - - - - - - - | - - - - - - - | 492 |
| SEQ_ID_NO_2214 | - - - - - - - | - - - - - - - | - - - - - - - | - - - - - - - | - - - - - - - | 487 |

| SEQ_ID_NO_2493 | NPSMLNLQAN | PNQFIWPDD | EKPISI-N- | VL | ELDVPLIDLQ | 67 |
|---|---|---|---|---|---|---|
| SEQ_ID_NO_2494 | DASLLRHQLN | LPKQFIWPDD | EKPCM-N- | VP | ELVVPLIDLR | 70 |
| SEQ_ID_NO_2495 | DASVLKHQTQ | LPKQFIWPDD | EKPCV-N- | AP | ELQVPLIDLG | 67 |
| SEQ_ID_NO_2496 | DASFLKNQLN | LPKRFIWPDD | EKPCM-N- | VP | ELDVPLIDFK | 68 |
| SEQ_ID_NO_2497 | DASFLKNQLN | LPKQFIWPDE | EKPCM-N- | VP | ELDVPLIDLR | 68 |
| SEQ_ID_NO_2498 | DASVLRHQTN | LPQQFIWPDE | EKPRA-N- | AP | ELQVPLIDFK | 67 |
| SEQ_ID_NO_2499 | DAQVLRHQTN | LPQQFIWPDH | EKPNI-N- | VP | ELVVPLVDLG | 72 |
| SEQ_ID_NO_2500 | DASLLRYEHN | LPKQFIWPDE | EKPNL-N- | AP | ELEVPLIDLG | 70 |
| SEQ_ID_NO_2501 | DASVLQHEGN | LPQQFIWPDA | EKPNTQK | PP | ELPVPLIDLG | 65 |
| SEQ_ID_NO_2502 | DASQMKREYN | LPTQFIWPDD | EKPRA-V- | SK | ELSMPLIDLG | 65 |
| SEQ_ID_NO_2503 | DASVLRHQSN | LPKQFIWPDH | EKPGD-KI | AR | ELVVPLVDLG | 67 |
| SEQ_ID_NO_2504 | DSLILQHETN | LPQQFIWPDH | EKPNLQK- | AT | ELAMPLVDLR | 64 |
| SEQ_ID_NO_2505 | DSLLLQHETN | LPEQFIWPDD | EKPNSQK- | TK | QLHVPLIDLR | 57 |
| SEQ_ID_NO_2506 | DASHMKRESN | LPTQFIWPDD | EKPCAFL- | AK | ELEVPVIDME | 61 |
| SEQ_ID_NO_2507 | DSKILRNQAS | LPKEFIWPDD | EKPDH-E- | VQ | ECPVPVIDLA | 62 |
| SEQ_ID_NO_2508 | DSSVLRHETN | LPTEFVWPEH | EKPGSIYA- | AA | ELEVPVIDME | 62 |
| SEQ_ID_NO_2509 | DAAVLSGRAD | LPSQFIWPEG | ESPITP- | AP | ELHVPLIDIG | 45 |
| SEQ_ID_NO_2510 | | | DAAE | | | |

FIG. 31B

| | | | | | |
|---|---|---|---|---|---|
| SEQ_ID_NO_2493 | NLLSLDPSST | LDASRLISEA | CKKHGFFLVV | NHGISEELIS | 106 |
| SEQ_ID_NO_2494 | GFLSGDPVAT | MEAARMVGEA | CQKHGFFLVV | NHGIDANLIS | 110 |
| SEQ_ID_NO_2495 | GFLSGDDPVAA | KEASRLVGEA | CRKHGFFLVV | NHGVDSSLIA | 107 |
| SEQ_ID_NO_2496 | NFLSGDPFAA | MEASKTIGEA | CEKHGFFLVV | NHGIDTKLIE | 108 |
| SEQ_ID_NO_2497 | NFLSGDPFAA | MEASKTIGEA | CEKHGFFLVV | NHGIDTKLIE | 108 |
| SEQ_ID_NO_2498 | GFLSGDPITAA | NEASSLVGKA | CQKHGFFLVV | NHGVDDKLIA | 107 |
| SEQ_ID_NO_2499 | DFLSGNPVAA | VEASRLVGEA | CQKHGFFLVV | NHGVDKTLIS | 112 |
| SEQ_ID_NO_2500 | GFLSGDPVAA | METSKLVSEA | CRKHGFFLVT | NHGIDSRLIA | 110 |
| SEQ_ID_NO_2501 | GFLSGDPVAA | KKASNLVGEA | CQKHGFFLVV | NHGVDENLIS | 105 |
| SEQ_ID_NO_2502 | GFLSGHSCST | QQASRLVGEA | CRNHGFFLVV | NHGVNANLIS | 105 |
| SEQ_ID_NO_2503 | GFLSGDPVAA | MEATRLVREA | CQKHGFFLVV | NHGVDDKLIY | 107 |
| SEQ_ID_NO_2504 | GFLSGDPAAA | KEASLVVGDA | CKKHGFFLVT | NHGVDASLIA | 104 |
| SEQ_ID_NO_2505 | GFLSGRPSSA | KEASVVVGEA | CKKHGFFLVK | NHGVDASLIV | 97 |
| SEQ_ID_NO_2506 | GFLSGRASSA | QQASELVGEA | CRGHGFFLVV | NHGVDANLIS | 101 |
| SEQ_ID_NO_2507 | GFCREETKST | NNASKLVNEA | FMKHGFFLVK | NHGVEAELIK | 102 |
| SEQ_ID_NO_2508 | AFRSGDPAAV | AETLKLVNEA | CKKHGFFLVV | NHGVDPDRIS | 102 |
| SEQ_ID_NO_2509 | GMLSGDPRAT | AEVTRLVGEA | CERHGFFQVV | NHGIDAELLA | 85 |

FIG. 31C

| | | | | | |
|---|---|---|---|---|---|
| SEQ_ID_NO_2493 | DAHEYTSRFF | DMPLSEKQRV | LRKSGESVGY | ASSFTGRFST | 146 |
| SEQ_ID_NO_2494 | HAHSYMDDFF | EVPLTQKQRA | QRKTGEHCGY | ASSFTGRFSS | 150 |
| SEQ_ID_NO_2495 | DAHRYMDHFF | ELPLNEKQRA | RRKLGEHCGY | ASSFTGRFSS | 147 |
| SEQ_ID_NO_2496 | HAHSYMNDFF | EVPLSQKQRC | QRKTGEHCGY | ASSFTGRFSS | 148 |
| SEQ_ID_NO_2497 | HAHSYMNDFF | EVPLSQKQRC | QRKVGEHCGY | ASSFTGRFSF | 148 |
| SEQ_ID_NO_2498 | HAHQYIDYF | ELPMSAKQRA | QRKTGESCGY | ASSFTGRFSS | 147 |
| SEQ_ID_NO_2499 | HAHNYMDTFF | ELPLSEKQRA | QRKIGESCGY | ASSFTGRFSS | 152 |
| SEQ_ID_NO_2500 | HAHRFMDDFF | ELPLSQKQRA | QRKAGEHCGY | ASSFTSRFSS | 150 |
| SEQ_ID_NO_2501 | DAHQYMDLFF | DLPLSEKQRA | QRKLEEHCGY | ASSFTGRFSS | 145 |
| SEQ_ID_NO_2502 | NAHRYMDMF | GLPLAKKQRA | QRKLGEHCGY | ASSFTGRFSS | 145 |
| SEQ_ID_NO_2503 | KAHQYMDSF | ELPLSDKQRV | QRKIGESCGY | ASSFTGRFSS | 147 |
| SEQ_ID_NO_2504 | DAHRYMDLFF | ELPFDKQRV | QRKIGEHCGY | ASSFTGRFTS | 144 |
| SEQ_ID_NO_2505 | NAHRYMDTFF | ELPLLEKQKA | QRKLGESCGY | ASSFTGRFSS | 137 |
| SEQ_ID_NO_2506 | HTHKYMREFF | ELPLVEKQRV | QRKLGEHCGY | ASSFTRRFSC | 141 |
| SEQ_ID_NO_2507 | DALRHMDRFF | DLPLSSKEKA | LRKVGEHCGY | ASSFTGRFSA | 142 |
| SEQ_ID_NO_2508 | DAHRCVDAFF | TMPLPEKQRA | LRRPGESCGY | ASSFIGRFAS | 125 |

| SEQ ID | | | | | | |
|---|---|---|---|---|---|---|
| SEQ_ID_NO_2493 | KLPWKETLSF | RFCDDM- | R | SKSVQDYFCD | ALGHGFQPFG | 184 |
| SEQ_ID_NO_2494 | KLPWKETLSF | QFSAEEK | S | STIVKDYLCN | TLGQEFEQFG | 188 |
| SEQ_ID_NO_2495 | KLPWKETLSF | RYSAEKI | S L S | NNIVEDYLLN | TMGDEFKQFG | 186 |
| SEQ_ID_NO_2496 | NLPWKETLSF | QFSDEKI | N | SNIVKDYLSN | TLGEDFQQFG | 186 |
| SEQ_ID_NO_2497 | NLPWKETLSF | QFSDEKI | P | SHIVQDYLSN | TLGEDFQQFG | 186 |
| SEQ_ID_NO_2498 | KLPWKETLSF | RSSAQP | S | SNIVQDYLCN | TMGEDFKPFG | 185 |
| SEQ_ID_NO_2499 | KLPWKETLSF | RYTAEKI | D | SKHIEEYFHN | RMGEDFAEFG | 190 |
| SEQ_ID_NO_2500 | KLPWKETLSF | QFSADKI | N | QNLVKDYLCE | KVGHEFEQFG | 188 |
| SEQ_ID_NO_2501 | KLPWKETLSF | QYSADEI | S | SDIVKDYFKD | KMGEEFIRLG | 183 |
| SEQ_ID_NO_2502 | KLPWKETLSF | RYSAEEI | N | SHLVEEYFQN | TMGESFSHLG | 183 |
| SEQ_ID_NO_2503 | KLPWKETLSF | SYSAEKI | D | SNAVQEYFLN | KMGEDFSEFG | 185 |
| SEQ_ID_NO_2504 | KLPWKETLSF | QFSGEKI | S | ANGVKDYFEN | TLGKEFIRLG | 182 |
| SEQ_ID_NO_2505 | KLPWKETLSF | QFSGEKI | K | SKIVEEYFEK | TMGKEFARLG | 175 |
| SEQ_ID_NO_2506 | KLPWKETLSF | RYSAKKI | S | SHIVEEYFQS | TLGESFNHLG | 179 |
| SEQ_ID_NO_2507 | KLPWKETLSF | PYSPEEAN | E | TKVVEEYFNS | KMTKDFAHMG | 181 |
| SEQ_ID_NO_2508 | KLPWKETLSF | RYSAQKI | C | SHIVEEYFQE | SLGQEFAHLG | 180 |
| SEQ_ID_NO_2509 | KLPWKETLSF | RSCPS-- | D | PALVMDYIVA | TLGEDHRRLG | 161 |
| SEQ_ID_NO_2510 | | | | | | |

FIG. 31F

| SEQ ID NO | Sequence | Position |
|---|---|---|
| SEQ_ID_NO_2493 | KVYQEYCEAM SSLSLKI MEL LGLSLGV KRD YFREFFEEND | 224 |
| SEQ_ID_NO_2494 | RVYQDYCDAM SNLSLGI MEL LGMSLGV GKA CFREFFEEND | 228 |
| SEQ_ID_NO_2495 | RVYQEYCESM SRLSLGI MEL LAI SLGV GRA HFKEFFEEND | 226 |
| SEQ_ID_NO_2496 | EVYQEYCEAM SKLSLGI MEL LGMSLGV GKE CFRDFFEENK | 226 |
| SEQ_ID_NO_2497 | EVYQEYCEAM SKLSLGI MEL LGMSLGV GKE CFRDFFEENE | 226 |
| SEQ_ID_NO_2498 | SVYQDYCDAM STLSLGI MEL LGMSLGV SQG HYREFFEEND | 225 |
| SEQ_ID_NO_2499 | MVYQEYCEAM STLSLVI MEL LGMSLGV SRE HFREFFDEND | 230 |
| SEQ_ID_NO_2500 | NVYQDYCNAM SNLSLGI MEL LGMSLGV GRT CFREFFDKNN | 228 |
| SEQ_ID_NO_2501 | NVYQEYCNAM NRLSLGI MEL LGMSLGV GRE HFKEFFQEND | 223 |
| SEQ_ID_NO_2502 | QVYQEYCEAM STLSLVI MEL LGMSLGI GGA HFREFFEENE | 223 |
| SEQ_ID_NO_2503 | KVYQEYCEAM STLSLGI MEL LGMSLGV HRA HFKEFFEEND | 225 |
| SEQ_ID_NO_2504 | KVYQEYCEAM SRLSLGI MEL LGMSLGV EQS HFKEFFEEND | 222 |
| SEQ_ID_NO_2505 | NVYQEYCNAM SRLSLGI MEL LGMSLGV EKS HFKEFFKEND | 215 |
| SEQ_ID_NO_2506 | KLYQEYCEAM NTLSLGI MEL LGLSLGV GRQ YFRDYFQEND | 219 |
| SEQ_ID_NO_2507 | LVYQKYSNEM SKLALEI MEV LGMGLGV NRK HFSDFQEND | 221 |
| SEQ_ID_NO_2508 | EVYARYCSEM SRLSLEI MEV LGESLGV GRA HYRRFFEGND | 220 |
| SEQ_ID_NO_2509 | | 201 |

| | | | | | | |
|---|---|---|---|---|---|---|
| SEQ_ID_NO_2493 | SIMRLNYYPP | CLKPDLTLGT | GPHCDPTSLT | LHQDH-VNG | 263 |
| SEQ_ID_NO_2494 | SIMRLNYYPP | CQKPDLTLGT | GPHCDPTSLT | LHQDQ-VGG | 267 |
| SEQ_ID_NO_2495 | SIMRLNYYPP | CQKPELTLGT | GPHCDPTSLT | LHQDQ-VGG | 265 |
| SEQ_ID_NO_2496 | SIMRLNYYPP | CQKPDLTLGT | GPHCDPTSLT | LHQDQ-VGG | 265 |
| SEQ_ID_NO_2497 | SIMRLNYYPP | CQKPDLTLGT | GPHCDPTSLT | LHQDQ-VGG | 265 |
| SEQ_ID_NO_2498 | SIMRLNYYPP | CQKPDLTLGT | GPHCDPTSLT | LHQDK-VGG | 264 |
| SEQ_ID_NO_2500 | SIMRLNYYPP | CQKPDLTLGT | GPHCDPTSLT | LHQDN-VGG | 269 |
| SEQ_ID_NO_2501 | SIMRLNYYPP | CQKPDLTLGT | GPHCDPTSLT | LHQDQ-VGG | 267 |
| SEQ_ID_NO_2502 | SIMRLNYYPP | CQKPDLTLGT | GPHCDPTSLT | LHQDS-VGG | 262 |
| SEQ_ID_NO_2503 | SIMRLNYYPR | CQKPDLTLGT | GPHCDPTSLT | LHQDQ-VGG | 262 |
| SEQ_ID_NO_2504 | SIMRLNYYPP | CLKPDLTLGT | GPHCDPTSLT | LHQDS|-VGG | 264 |
| SEQ_ID_NO_2505 | SIMRLNYYPP | CQKPDLQTLGT | GPHCDPTSLT | LHQD|T- | 261 |
| SEQ_ID_NO_2506 | SVMRLNYYPP | CQEPELALGT | GPHCDPTSLT | LHQDC--VGG | 254 |
| SEQ_ID_NO_2507 | SVMRLNY|CPP | CQKPELALGT | GPHCDPTSLT | LHQDH-VGG | 258 |
| SEQ_ID_NO_2508 | SIMRLNYYPP | CQKPELTLGT | GPHCDPTSLT | LHQDH-VNG | 260 |
| SEQ_ID_NO_2509 | | CQRP|ME|TLGT | GPHCDPTSLT | LHQDN|S-VGG | 260 |
| SEQ_ID_NO_2510 | SIMRLNYYPP | | GPHCDPTSLT | LHQDN-VGG | 240 |

FIG. 31G

| SEQ ID | Sequence | | | | Length |
|---|---|---|---|---|---|
| SEQ_ID_NO_2493 | LQVFVENQWR | SIRPNPKAFV | VNIGDTFMAL | SNDRYKSCLH | 303 |
| SEQ_ID_NO_2494 | LQVFVDNEWH | SINPNFNAFV | VNIGDTFMAL | SNGRYKSCLH | 307 |
| SEQ_ID_NO_2495 | LQVFVDNEWH | SISPNFEAFV | VNIGDTFMAL | SNGRYKSCLH | 305 |
| SEQ_ID_NO_2496 | LQVFVDNEWH | SIRPNFNAFV | VNIGDTFMAL | SNGRYKSCLH | 305 |
| SEQ_ID_NO_2497 | LQVFVDNEWH | SIRPNFNAFV | VNIGDTFMAL | SNGRYKSCLH | 305 |
| SEQ_ID_NO_2498 | LQVFVDNEWH | SITPNFNAFV | VNIGDTFMAL | SNGRYKSCLH | 305 |
| SEQ_ID_NO_2499 | LQVFVDNEWH | SISPNFDAFV | VNIGDTFMAL | SNGIYKSCLH | 304 |
| SEQ_ID_NO_2500 | LQVFVDNEWH | SITPNFNAFV | VNIGDTFMAL | SNGRYKSCLH | 309 |
| SEQ_ID_NO_2501 | LQVYVDNEWH | SIAPNSQAFV | VNIGDTFMAL | SNGRYKSCLH | 307 |
| SEQ_ID_NO_2502 | EVFVDNEWR | SVSPNFNAFV | VNIGDTFMAL | SNGRYKSCLH | 302 |
| SEQ_ID_NO_2503 | LQVFVDDKWW | SISPNFDAFV | VNIGDTFMAL | SNGRYKSCLH | 302 |
| SEQ_ID_NO_2504 | LEVFIDNEWR | SIAPNSNAFV | VNIGDTFMAL | SNGRYKSCLH | 304 |
| SEQ_ID_NO_2505 | LEVFIDNEWR | SIAPNLNTFV | VNIGDTFMAL | SNGRYKSCLH | 301 |
| SEQ_ID_NO_2506 | LQVFVDDEWR | SISPNFNAFV | VNIGDTFMAL | SNGQYRSCLH | 294 |
| SEQ_ID_NO_2507 | LQVFVDGEWR | FIYPRFDTFV | VNIGDTFMAL | SNGKYKSCLH | 298 |
| SEQ_ID_NO_2508 | LQVCVDNEWR | SVSPSPNAFV | VNIGDTFMAL | SNGIYKSCLH | 300 |
| SEQ_ID_NO_2509 | LQVHTEGRMR | SIRPRADAFV | VNIGDTFMAL | SNGRYKSCLH | 300 |
| SEQ_ID_NO_2510 | | | | | 280 |

FIG. 31H

| | | | | | | |
|---|---|---|---|---|---|---|
| SEQ_ID_NO_2493 | RAVVNSESER | KSLAFFLCPK | KDRVVTPPPRE | LLDS- | ITSRR | 342 |
| SEQ_ID_NO_2494 | RAVVNSKTTR | KSLAFFLCPK | GDKVVSPPPSE | LVDD- | LTPRL | 346 |
| SEQ_ID_NO_2495 | RAVVNSQTTR | KSLAFFLCPK | NDKVVSPPPSE | LVDTY | SSPRI | 345 |
| SEQ_ID_NO_2496 | RAVVNNKTTR | KSLAFFLCPK | GDKVVSPPPSE | LVND- | LTPRI | 344 |
| SEQ_ID_NO_2497 | RAVVNNKTTR | KSLAFFLCPK | GDKVVSPPPSE | LVND- | LTPRI | 344 |
| SEQ_ID_NO_2498 | RAVVNSKTPR | KSLAFFLCPK | NDKMVTPPPSE | LVDS- | LCPRV | 343 |
| SEQ_ID_NO_2500 | RAVVNSQTPR | KSLAFFLCPG | DDKVVTPPPSE | LVDT- | CNPRI | 348 |
| SEQ_ID_NO_2501 | RAVVNSQTTR | KSLAFFLCPK | KDKVVSPPPEK | LVDH- | VSPRI | 346 |
| SEQ_ID_NO_2502 | RAVVNSKTPR | KSLAFFLCPE | KDKVVVSPPNE | LVDQ- | KNPRI | 341 |
| SEQ_ID_NO_2503 | RAVVNRIHR | KSLAFFLCPK | KDKVVRPPTE | LVDT- | NNPRI | 341 |
| SEQ_ID_NO_2504 | RAVVNNKIHR | KSLAFFLCPK | KDKVVSPPPDE | LVDE- | NSPRI | 343 |
| SEQ_ID_NO_2505 | RAVVNSKTPR | KSLAFFLCPN | KDKVVSPPNE | LVDT- | KNPRI | 340 |
| SEQ_ID_NO_2506 | RAVVNSKTPR | KSLAFFLCPK | KDKVVSPPPDE | LVDE- | NNPRI | 333 |
| SEQ_ID_NO_2507 | RAVVNDTSPR | KSLAFFLCPH | EDLVCPPPNE | LVDS- | SSPRV | 337 |
| SEQ_ID_NO_2508 | RAVVNSTLTR | KSMAFFLCPH | EDKVVTPPPE | LVNE- | THPRL | 339 |
| SEQ_ID_NO_2509 | RAVVNSKVPR | KSLAFFLCPE | MDKVVAPPIGT | LVDA- | ANPRA | 319 |

FIG. 31I

| SEQ_ID | Sequence | | | | End |
|---|---|---|---|---|---|
| SEQ_ID_NO_2493 | YPDFTWSMFL | EFTQKHYRAD | MNTLQAFSDW | LTKP------ | 376 |
| SEQ_ID_NO_2494 | YPDFTWPMLL | EFTQKHYRAD | MKTLEAFTNW | LQQKR----- | 381 |
| SEQ_ID_NO_2495 | YPDFTWPMLL | EFTQKHYRAD | MKTLEAFTNW | LQQKKQ---- | 381 |
| SEQ_ID_NO_2496 | YPDFTWPMLL | EFTQKHYRAD | MRTLEAFTKW | LQQKQ----- | 379 |
| SEQ_ID_NO_2497 | YPDFTWPMLL | EFTQKHYRAD | MRTLEAFTKW | LQQKQ----- | 379 |
| SEQ_ID_NO_2498 | YPDFTWPMLL | EFTQKHYRAD | VKTLEVFSNW | LQQKN----- | 378 |
| SEQ_ID_NO_2499 | YPDFTWPMLL | EFTQKHYRAD | MKTLEVFTNW | LHQQS----- | 383 |
| SEQ_ID_NO_2500 | YPDFTWPMLL | EFTQKHYRAD | MNTLEQFANW | VQRNK----- | 381 |
| SEQ_ID_NO_2501 | YPDFTWSTFL | EFTQKHYRAD | MNTLKAFSNW | VQQETS---- | 377 |
| SEQ_ID_NO_2502 | YPDFTWPTLL | EFTQKHYRAD | MNTLQTFSNW | LKQKTA---- | 377 |
| SEQ_ID_NO_2503 | YPDFTWSNLL | EFTQKHYRAD | MKTLEVFSSW | LQQKTA---- | 379 |
| SEQ_ID_NO_2504 | YPDFTWSTFL | EFTQKHYRAD | MNTLQAFSNW | LQQKN----- | 375 |
| SEQ_ID_NO_2505 | YPDFTWPTLL | EFTQKHYRAD | MNTLQAFTNW | QQKN------ | 368 |
| SEQ_ID_NO_2506 | YPDFTWPIFL | EFTQKHYRAD | MNTLQTFSNW | HDQHNT---- | 374 |
| SEQ_ID_NO_2507 | YPDFTWPIFL | EFTQKHYRAD | TDTLLNFSRW | VRERNQVQS- | 379 |
| SEQ_ID_NO_2508 | YPDFKMPTLL | EFTQKHYRSD | TDTLLSFSAM | LQQNQTP--- | 376 |
| SEQ_ID_NO_2509 | YPDFTWRSLL | DFTQKHYRAD | MKTLEVFSSW | VQQQGQ---- | 357 |
| SEQ_ID_NO_2510 | YPDFTWRSLL | DFTQKHYRAD | MKTLEVFSSW | VQQQGQ---- | 357 |

| SEQ_ID_NO | | | | | | |
|---|---|---|---|---|---|---|
| SEQ_ID_NO_2271 | MDSTS- | G | GAT- | -A-P | GPNSG- | EPCP | SAATAG | SSSA | 30 |
| SEQ_ID_NO_2273 | MDSAS- | G | EAP- | P-PP | QPTSVE | APPP | SGSSA | PATSA | 32 |
| SEQ_ID_NO_2274 | MDSAS- | G | GGA- | -A- | DPSS- | GEGP | SA- | - | 20 |
| SEQ_ID_NO_2276 | MDSAS- | G | GSD- | -N- | SIK- | EAIP | ATASALL | SAA | 27 |
| SEQ_ID_NO_2278 | MEPGPDAPAG | G | GGGGGTSIS | | EPAEA- | GPSP | SSSSAAAAS | | 39 |
| SEQ_ID_NO_2280 | MEPGPDAPRG | G | EGA- | -S- | APE- | ESGP | SSSSV | AVEKA | 31 |
| SEQ_ID_NO_2281 | MEPSP- | G | APR- | -A- | GAAE- | QPGP | SSSASAP- | | 26 |
| SEQ_ID_NO_2283 | MESAD- | S | GRS- | | DPVK- | GDDP | G- | | 18 |

| SEQ_ID_NO | | | | | | |
|---|---|---|---|---|---|---|
| SEQ_ID_NO_2271 | S- | | | | QPQQQPE | | 38 |
| SEQ_ID_NO_2273 | | | | | PAPTQP | | 38 |
| SEQ_ID_NO_2274 | | | | | GAA | | 27 |
| SEQ_ID_NO_2276 | S- | Q | -G- | -GGG- | GGGSE | | 37 |
| SEQ_ID_NO_2278 | S- | SSRQQ | OG- | -G- | AQAQPQPQH | | 75 |
| SEQ_ID_NO_2280 | EEPQAQAQ | AEQEAQQQQG | AQQREQPAVR | EHLQPQPLSQ | | 61 |
| SEQ_ID_NO_2281 | APAASSN- | PPEGGGQQV | ALQ- | QEAQPQPLAQ | | 57 |
| SEQ_ID_NO_2283 | | EEEGRHQSQ | AQQQV- | PSF | | 21 |

| SEQ_ID_NO | | | | | |
|---|---|---|---|---|---|
| SEQ_ID_NO_2271 | GSSPPAPPSR | YESQKRRDWN | TFLQYI KNHK | PPLTLARCSG | 78 |
| SEQ_ID_NO_2273 | EGSSPAPPSR | YESQKRRDWN | TFLQYL QNHR | PPLTLARCSG | 78 |
| SEQ_ID_NO_2274 | EGSSPAPPSR | YESQKRRDWN | TFLQYL KNHK | PPLTLARCSG | 67 |
| SEQ_ID_NO_2276 | SSPSPAPPSR | YESQKRRDWN | TFLQYL NHK | PPLTLARCSG | 77 |
| SEQ_ID_NO_2278 | QQQPPAGLSR | YESQKRRDWN | TFLQYL RNHK | PPLTLARCSG | 115 |
| SEQ_ID_NO_2280 | QDPVRAGLSR | YESQKRRDWN | TFLQYL RNHK | PPLTLARCSG | 101 |
| SEQ_ID_NO_2281 | QAPAAAGLSR | YESQKRRDWN | TFLQYL RNHK | PPLILPRCSG | 97 |
| SEQ_ID_NO_2283 | VSSPPATPSR | YESQKRRDWN | TFLQYL KNHK | PPLALSRCSG | 61 |

FIG. 32A

| SEQ_ID_NO_2271 | AHVIEFLKYL | DQFGKTKVHI | TGCPYFGHPN | PPAPCSCPLK | 118 |
| --- | --- | --- | --- | --- | --- |
| SEQ_ID_NO_2273 | AHVIEFLKYL | DQFGKTKVHV | TGCPYFGHPN | PPAPCTCPLK | 118 |
| SEQ_ID_NO_2274 | AHVIEFLKYL | DQFGKTKVHI | SGCPYFGHPN | PPAPCACPLK | 107 |
| SEQ_ID_NO_2276 | AHVIEFLRYL | DQFGKTKVHI | DCPYFGHVN  | PPAPCTCPLR | 117 |
| SEQ_ID_NO_2278 | AHVIEFLKYL | DQFGKTKVHA | EGCAYFGQPN | PPAPCACPLR | 155 |
| SEQ_ID_NO_2280 | AHVIEFLKYL | DQFGKTKVHA | DGCAYFGQPN | PPAPCACPLR | 141 |
| SEQ_ID_NO_2281 | AHVIEFLKYL | DQFGKTKVHA | DGCAYFGEPN | PPAPCACPLR | 137 |
| SEQ_ID_NO_2283 | AHVIEFLKYL | DQFGKTKVHV | AACPYFGHQQ | PPSPCSCPLK | 101 |

| SEQ_ID_NO_2271 | QAWGSLDALI | GRLRAAYEEN | GGLPESNPFG | ARAVRIYLRE | 158 |
| --- | --- | --- | --- | --- | --- |
| SEQ_ID_NO_2273 | QAWGSLDALI | GRLRAAYEEN | GGRPESNPFG | ARAVRIYLRE | 158 |
| SEQ_ID_NO_2274 | QAWGSLDALI | GRLRAAYEEN | GGRPESNPFG | ARAVRITCLRE | 147 |
| SEQ_ID_NO_2276 | QAWGSLDALI | GRLRAAYEEN | GGRPESNPFG | ARAVRIYLRE | 157 |
| SEQ_ID_NO_2278 | QAWGSLDALI | GRLRAAYEES | GGRPESNPFA | AKAVRIYLRD | 195 |
| SEQ_ID_NO_2280 | QAWGSLDALI | GRLRAAYEES | GGRPESNPFA | ARAVRIYLRE | 181 |
| SEQ_ID_NO_2281 | QAWGSLDALI | GRLRAAYEES | GGRPESNPFA | ARAVRIYLRE | 177 |
| SEQ_ID_NO_2283 | QAWGSLDALI | GRLRAAYEEN | GGRPDSNPFA | ARAVRIYLRE | 141 |

| SEQ_ID_NO_2271 | VREGQAKARG | PYEKKKRK   | RPI-NVAVSVA | ----SVI---  | 189 |
| --- | --- | --- | --- | --- | --- |
| SEQ_ID_NO_2273 | VREGQAKARG | PYEKKKRK   | RT--TMTVSAV | ----SIS---  | 188 |
| SEQ_ID_NO_2274 | VREGQAKARG | PYEKKKRK   | RPI-TVTATAV | ----VAAT    | 179 |
| SEQ_ID_NO_2276 | VREGQAKARG | PYEKKKRK   | RPI-TVTTTAV | ----GVI---  | 187 |
| SEQ_ID_NO_2278 | VREAQAKARG | PYEKKKRK   | RG--SAAAPV  | --APPI---   | 226 |
| SEQ_ID_NO_2280 | VREAQAKARG | PYEKKKE-RK | RG--STSAPAA | --APPI---   | 211 |
| SEQ_ID_NO_2281 | VREAQAKARG | PYEKKKRK   | RG--AAAAAA  | PPVVAPPI--- | 212 |
| SEQ_ID_NO_2283 | VRESQAKARG | PYEKKKRK   | RPP-TVTTVRV | ----DVI---  | 172 |

| SEQ_ID_NO_1741 | | | | | | 257 |
|---|---|---|---|---|---|---|
| SEQ_ID_NO_1743 | CFDI | DFCR-S | KLSAF- | TY-P | SQSVSHSVST | SSIEYGVVPD | 257 |
| SEQ_ID_NO_1745 | CFDI | DFCR-S | KLISF-SY | P-Q | SQSLSHSVSS | SSLDVGVVPD | 269 |
| SEQ_ID_NO_1747 | CFDVDFCR-S | KFPTF-SY | P | TKSQSHSVSS | SSLEVGVVPD | 249 |
| SEQ_ID_NO_1748 | CFDVDFCR-S | KLSSF-NY | | SNSLSQSVSS | SSLDVGVVPD | 261 |
| SEQ_ID_NO_1749 | HFEIDFTQ-S | HIKSY-NT | | --PSLISVSS | SSLDVGIVPD | 267 |
| SEQ_ID_NO_1750 | SFEIDFSAAS | KPYVY-GF-H | AQCLSQSVSS | SSMDVSVVPD | 248 |
| SEQ_ID_NO_1751 | SFELDFSAGS | KPFVY-GYHH | ARCLSQSVSS | SSMDISVVPD | 246 |
| SEQ_ID_NO_1752 | TYELDFTIG-S | KPYMY-NF-T | SQSISQSVSS | SSLDVGVVPD | 260 |
| SEQ_ID_NO_1753 | CFDITEK | -ATY-SYTT | TTSLSHSVSS | SSLDVGVVPD | 286 |
| SEQ_ID_NO_1754 | LFGMEC-E-T | KLSEY-NY- | NTSISHSVSV | SSLDVGVVPE | 260 |
| | DINNDFST-S | KPFTY-NY- | NHSVSS | PSLEVGVVPD | 220 |

| SEQ_ID_NO_1741 | GNT- | NNSVNR | S-TI | TYTDPSMPI | TLSSTTGGDH | 278 |
|---|---|---|---|---|---|---|
| SEQ_ID_NO_1743 | GNS- | MSDISY | P-FGRSM--N | DPSA-PIWAA | SGSTINQAAA | 304 |
| SEQ_ID_NO_1745 | GNS- | VSDISY | T-FGRTM--G | DSSG-LVMV | TANNQAPPQA | 284 |
| SEQ_ID_NO_1747 | GNT- | VSDMSY | S-FGRNS--N | NSNS-SIDL- | SGNSVGQGAT | 295 |
| SEQ_ID_NO_1748 | GSS- | ISEISY | P-YIRTM--S | AA | SF-NSANHQE | 300 |
| SEQ_ID_NO_1749 | GNT- | MTDVCD | B-YTKSM-AA | | VESTHQAV | 275 |
| SEQ_ID_NO_1750 | GNA- | VT | | AAAG- | VETSQPAV | 261 |
| SEQ_ID_NO_1751 | HSA- | MTDVSN | T-FVMNS--S | EL | TGTDTEAVPN | 290 |
| SEQ_ID_NO_1752 | A--T- | LSDMSR | PI-LNRGV--F | G--- | ANPGVNVGI | 313 |
| SEQ_ID_NO_1753 | S--T- | MSDMSV | S-HSRPP--K | | FSSTPMQVPT | 290 |
| SEQ_ID_NO_1754 | GNV- | MSEMSY | CGYGR | TIDL- | -----TEIAV | 238 |

| | | |
|---|---|---|
| SEQ_ID_NO_1741 | HAQYGVVPTF -- | 355 |
| SEQ_ID_NO_1743 | DTHYGVVPSF -- | 384 |
| SEQ_ID_NO_1745 | DNQYGIVPSF -- | 368 |
| SEQ_ID_NO_1747 | DTPYGVVPSF LT | 374 |
| SEQ_ID_NO_1748 | ESRYGVVPSF -- | 386 |
| SEQ_ID_NO_1749 | LCRYGVVPSF -- | 343 |
| SEQ_ID_NO_1750 | MCRYGVVPSF -- | 329 |
| SEQ_ID_NO_1751 | DASYGVVPSF -- | 360 |
| SEQ_ID_NO_1752 | ELSYGLVPSF -- | 384 |
| SEQ_ID_NO_1753 | DGGYGIVPSF -- | 362 |
| SEQ_ID_NO_1754 | YDGYGVVPSC -- | 312 |

FIG. 33G

| SEQ_ID_NO_1980 | MSITFLLRIL | -LP------LLI | IAMTLPRRSE | AESEQWCIAD | 34 |
|---|---|---|---|---|---|
| SEQ_ID_NO_1982 | MPILVKRTM | -LA------LLL | LSIAPRKSD | GELEQWCIAD | 33 |
| SEQ_ID_NO_1984 | MATEMLKLV | -LP------LLF | LEMPPKTAY | AEFEQWCVAD | 34 |
| SEQ_ID_NO_1985 | MPIALLRIV | -LG------LLL | LVSTGTKSA | GEFEQWCIAD | 33 |
| SEQ_ID_NO_1986 | MATTTATILLW | PLPLLLVLMI | FVSAANLTE | GAVAQWCIAD | 39 |

| SEQ_ID_NO_1980 | EQTPDDELQA | ALDWACGKGG | ADCSKMQEN | QPCFLPNTIR | 74 |
|---|---|---|---|---|---|
| SEQ_ID_NO_1982 | EQTPDDELQL | ALDWACGKGG | ADCSKIQ-VN | QPCYLPNTVR | 72 |
| SEQ_ID_NO_1984 | EQTIESELQA | ALDWACGKGG | ADCSKIQ-VN | QPCYLPNTLK | 73 |
| SEQ_ID_NO_1985 | EQTPDDELQA | GIDWACGEGG | ADCSKIQ-VN | KPCYLPNTVR | 72 |
| SEQ_ID_NO_1986 | PQAPDDMLQS | ALDWVCGYGG | ADCSKTQ-PN | QECFLPDNLA | 78 |

| SEQ_ID_NO_1980 | DHASFAFNSY | YQIYKNKGGS | CYFKGAAMIT | ELDPSHGS- | 112 |
|---|---|---|---|---|---|
| SEQ_ID_NO_1982 | DHASYAFNNY | FQKFKHKGGS | CYFKGAAILT | ELDPSHSS- | 110 |
| SEQ_ID_NO_1984 | DHASYAFNSY | YQKFKHSGGS | CYFRGAAILT | EVDPSHGS- | 111 |
| SEQ_ID_NO_1985 | DHASYAFNSY | YQKFKNKGGT | CYFNGAAMIT | ELDPLTFGMA | 112 |
| SEQ_ID_NO_1986 | SHASTAFNSY | MQKTKHQGAS | CYEDSAALVT | ESDPSHDG- | 116 |

| SEQ_ID_NO_1980 | -------- | -------- | -------- | -CQY-EYN | 118 |
|---|---|---|---|---|---|
| SEQ_ID_NO_1982 | -------- | -------- | -------- | -CQY-EFH | 116 |
| SEQ_ID_NO_1984 | -------- | -------- | -------- | -CHY-EFJ | 117 |
| SEQ_ID_NO_1985 | KSHTADQIIE | SDLDQSHQRW | HHSHLTWYFF | CKYSMFVQAT | 152 |
| SEQ_ID_NO_1986 | -------- | -------- | -------- | -CEY-DEV | 122 |

| SEQ_ID_NO_1980 | P | 119 |
|---|---|---|
| SEQ_ID_NO_1982 | P | 117 |
| SEQ_ID_NO_1984 | P | 118 |
| SEQ_ID_NO_1985 | P | 153 |
| SEQ_ID_NO_1986 | A | 123 |

FIG. 34

| SEQ_ID_NO_1812 | M-VFVKSTKS | NAYFKRYQVK | FRRRRDGKTD | YRARIRLINQ | 39 |
|---|---|---|---|---|---|
| SEQ_ID_NO_1814 | M-VFVKPSKS | NAYFKRYQVK | FRRRRDGKTD | YRARIRLINQ | 39 |
| SEQ_ID_NO_1815 | M-AFAKAQKS | RAYFKRYQVK | FKRRRAGKTD | YRARIRLINQ | 39 |
| SEQ_ID_NO_1817 | M-VYVKAQKS | KAYFKRYQVK | FKRRREGKTD | YRARIRLINQ | 39 |
| SEQ_ID_NO_1819 | ML-AFVKAQKT | KAYFKRFQVP | YKRRRAGKTD | YRARIRLINQ | 39 |
| SEQ_ID_NO_1821 | MGGFVKTHKT | NAYFKRFQVK | FKRRREGKTD | YRARIRLINQ | 40 |
| SEQ_ID_NO_1822 | MJAFAKAQKT | KAYSKRFQVK | FKRRRAGKTD | YRARIRLINQ | 39 |
| SEQ_ID_NO_1824 | MGGFVKTQKT | SAYSKRFQVK | FKRRRAGKTD | YRARIRLINQ | 40 |
| SEQ_ID_NO_1826 | M-VFVKNQKT | RAYSKRFQVK | FKRRRQGKTD | YRARIRLTNQ | 39 |
| SEQ_ID_NO_1827 | MLAFI-KVQKT | RAYFKRFQVK | FKRRREGKTD | YRARINRLINQ | 39 |
| SEQ_ID_NO_1828 | MGGFVKTQKT | NAYYKRFQVK | FKRRRQGKTD | YRARIRLTNQ | 40 |
| SEQ_ID_NO_1829 | M-VFVKAQKT | RAYFKRFQVK | FKRRREGKID | YRARIRLLNQ | 39 |

| SEQ_ID_NO_1812 | DKNKYNTPKY | RFVVRFTNKD | VAQIVSASI | AGDIVKASAY | 79 |
|---|---|---|---|---|---|
| SEQ_ID_NO_1814 | DKNKYNTPKY | RFVVRFTNKD | VAQIYSASI | AGDIVKASAY | 79 |
| SEQ_ID_NO_1815 | DKNKYNTPKY | RFVVRFSNKD | LAQIASASI | AGDIVLAAAY | 79 |
| SEQ_ID_NO_1817 | DKNKYNTPKY | RFVVRFSNKD | I-SASI | AGDIVLAAAY | 79 |
| SEQ_ID_NO_1819 | DKNKYNTPKY | RFVVRFSNKD | VAQIVSSANI | AGDMVLASAY | 79 |
| SEQ_ID_NO_1821 | DKNKYNTPKY | RFVVRETNKD | TAQI-SASI | AGDMVLASAY | 80 |
| SEQ_ID_NO_1822 | DKNKYNTPKY | RFVVRTSNKD | TAQIVSASI | AGDLVLASAY | 79 |
| SEQ_ID_NO_1824 | DKNKYNTPKY | RFVVRFTNKD | TAQIVSASI | AGDMVLAAAY | 80 |
| SEQ_ID_NO_1826 | DKNKYNTPKY | RFVVRFTNKD | VAQIVYATI | AGDIVMAAAY | 79 |
| SEQ_ID_NO_1827 | DKNKYNTPKY | RFVVRFTNRD | I-AQIVSASI | AGDIVMAAAY | 79 |
| SEQ_ID_NO_1828 | DKNKYNTPKY | RFVVRFSNKD | ITAQIVYATI | AGDMILASAY | 80 |
| SEQ_ID_NO_1829 | DKNKYNTPKY | RLVVRFSNKD | VVAQILYATL | AGDVVMAAAY | 79 |

FIG. 35A

| | | | | | |
|---|---|---|---|---|---|
| SEQ_ID_NO_1812 | AHELPQYGLT | VGLTNYAAAY | CTGLLLARRV | LKMLEMDDEY | 119 |
| SEQ_ID_NO_1814 | AHELPQYGLT | VGLTNYAAAY | CTGLLLARRV | LKMLEMDDEY | 119 |
| SEQ_ID_NO_1815 | AHELPRYGLE | AGLTNYAAAY | CTGLLLARRV | LKMLEMDDEY | 119 |
| SEQ_ID_NO_1817 | AHELPRYGLE | VGLTNYAAAY | CTGLLLARRV | LKTLEMDDEY | 119 |
| SEQ_ID_NO_1819 | SHELPRYGLE | VGLTNYAAAY | CTGLLLGRRV | LKIRGLDKEY | 119 |
| SEQ_ID_NO_1821 | SHELPQYGLE | VGLTNYAAAY | CTGLLLARRV | LKMLEMDAEY | 120 |
| SEQ_ID_NO_1822 | SHELPRYGLE | VGLTNYAAAY | CTGLLLARRV | LKMLEMDAEY | 119 |
| SEQ_ID_NO_1824 | SHELPRYGLE | VGLTNYAAAY | CTGLLLARRV | LKLRDLDQEY | 120 |
| SEQ_ID_NO_1826 | ASELPHFGLK | VGLTNYAAAY | CTGLLLARRV | LKQRDLDQEY | 119 |
| SEQ_ID_NO_1827 | SHELPRYGLE | VGLTNYAAAY | CTGLLLARRV | LKKLEMDEEY | 119 |
| SEQ_ID_NO_1828 | SHELPRYGLE | VGLTNYAAAY | CTGLLLARRV | LKLRGLDQEY | 120 |
| SEQ_ID_NO_1829 | SRELPRYGLE | VGLTNYAAAY | CTGLLLARRV | LKQLEMDEEY | 119 |

| | | | | | |
|---|---|---|---|---|---|
| SEQ_ID_NO_1812 | EGNVEATGED | FSVEPTDSRR | PFRALLDVGL | RTTTGNRVF | 159 |
| SEQ_ID_NO_1814 | EGNLEATGED | FSVEPTESRR | PFRALLDVGL | RTTTGNRVF | 159 |
| SEQ_ID_NO_1815 | EGNVEATGED | FSVEPADSRR | PFRALLDVGL | RTTTGNRVF | 159 |
| SEQ_ID_NO_1817 | EGNVEATGED | FSVEPAESRR | PFRALLDVGL | RTTTGNRVF | 159 |
| SEQ_ID_NO_1819 | QGNVEATGED | FSVEPTDTRR | PFRALLDVGL | RTTTGNRVF | 159 |
| SEQ_ID_NO_1821 | EGNVEATGED | FSVEPADERR | PFRALLDVGL | RTTTGNRVF | 160 |
| SEQ_ID_NO_1822 | EGNVEATGED | YSVEPADTRR | PFRALLDVGL | RTTTGNRVF | 159 |
| SEQ_ID_NO_1824 | EGNVEATGED | FSVEPADERR | PFRALLDVGL | RTTTGNRVF | 160 |
| SEQ_ID_NO_1826 | EGNVEAIGED | FSVEPADERR | PFRALLDVGL | RTTTGNRVF | 159 |
| SEQ_ID_NO_1827 | QGNLDVNGED | YSVEPAESRR | PFRALLDVGL | RTTTGNRVF | 159 |
| SEQ_ID_NO_1828 | EGNLEASGED | YMVEPADERR | PFRALLDVGL | VRTTTGNRVF | 160 |
| SEQ_ID_NO_1829 | VGNEEASGED | YSVEPNDARR | PFRALLDVGL | VRTTTGNRVF | 159 |

FIG. 35B

| SEQ_ID_NO_1812 | GALKGALDGG | LDI PHSDKRF | AGFHKENKQL | DAEI HRNYI Y | 199 |
| --- | --- | --- | --- | --- | --- |
| SEQ_ID_NO_1814 | GALKGALDGG | LDI PHSDKRF | AGFNKENKQL | DAEI HRNYI Y | 199 |
| SEQ_ID_NO_1815 | GALKGALDGG | LDI PHSDKRF | AGFAKDNKQL | DAEVHRKYI Y | 199 |
| SEQ_ID_NO_1817 | GALKGALDGG | LDI PHSDKRF | AGFDKEKKEL | DAEVHRKYVF | 199 |
| SEQ_ID_NO_1819 | GALKGALDAG | LDI PHSDKRF | AGFSKDNKQL | DAEVHSKYI Y | 199 |
| SEQ_ID_NO_1821 | GALKGALDGG | LDI PHSDKRF | AGFKKDDKQL | DADTHRRYI F | 200 |
| SEQ_ID_NO_1822 | GALKGALDGG | LDI PHSEKRF | AGYAKNGQQL | DVEVHRKYI Y | 199 |
| SEQ_ID_NO_1824 | GALKGALDGG | LDI PHSDKRF | AGFKKDEKQL | DAEI HRKYI Y | 200 |
| SEQ_ID_NO_1826 | GALKGALDGG | LDI PHSDKRF | AGFKKDEKQL | DAEVHRKFI Y | 199 |
| SEQ_ID_NO_1827 | GALKGALDGG | LDI PHSEKRF | AGYSKDSKQL | DSDI HRKYI Y | 199 |
| SEQ_ID_NO_1828 | GALKGALDGG | LDI PHSDKRF | AGFKKDEKQL | DADLHRKYI Y | 200 |
| SEQ_ID_NO_1829 | GALKGALDGG | LDI PHSDKRF | AGYNKESKSL | DADLHRKYI L | 199 |

| SEQ_ID_NO_1812 | GGHVSNYMKL | LGEDEPEKLQ | THFSAYI KKG | VEAESI EELY | 239 |
| --- | --- | --- | --- | --- | --- |
| SEQ_ID_NO_1814 | GGHVSNYMKM | LNEDEPEKFQ | THFSQYLKKG | VDAESMEELY | 239 |
| SEQ_ID_NO_1815 | GGHVAAYMRT | LMEDEPEKYQ | SHFSEYLKRG | DADGMEALY | 239 |
| SEQ_ID_NO_1817 | GGHVAAYMKL | LAEDEPEKYQ | HFSEYI KRG | EADGI EALY | 239 |
| SEQ_ID_NO_1819 | GGHVAAYMRT | LMEDEPEKYQ | HFSEYI KKG | EADNI ESLY | 239 |
| SEQ_ID_NO_1821 | GGHVADYMKN | LAEEEPEKYQ | AHFSDYI KKG | VEAEEI EALY | 240 |
| SEQ_ID_NO_1822 | GGHVAAYMRT | LMEDEPEKYQ | SHFSEYI KKG | EADELEGLY | 239 |
| SEQ_ID_NO_1824 | GGHVAEYMRT | LAEEEPEKYQ | SHFSDYI KKG | EADDMEALY | 240 |
| SEQ_ID_NO_1826 | GGHVADYMKS | LADEEPEKYQ | SHFSEYI KKG | EADNLEEMY | 239 |
| SEQ_ID_NO_1827 | GGHVTAYMNT | LMEDEPEKYQ | THFSLYI KAG | DADGMEALY | 239 |
| SEQ_ID_NO_1828 | GGHVADYMRS | MAEEEPEKFQ | AHFSEYLKKG | LEPENLEELY | 240 |
| SEQ_ID_NO_1829 | GGHVAAYMKT | LREDEPEKYQ | SQFSEYHKKG | LEPENLEELY | 239 |

FIG. 35C

| | | | | | |
|---|---|---|---|---|---|
| SEQ_ID_NO_1812 | KKVHAAI RAD | PNPXKTVKPA | PKQHKRYNLK | KLTYEERKNK | 279 |
| SEQ_ID_NO_1814 | KKVHAAI RAD | PNPKKTEKPA | PKTHNRYNLK | KLTYEERKNK | 279 |
| SEQ_ID_NO_1815 | KKVHAAI RAD | PTAKKSEKQP | PKEHKRYNLK | KLTYEERKAK | 279 |
| SEQ_ID_NO_1817 | KKVHAAI RAD | PTLKKSDKQT | PKQHKRFNLK | KLTYEERKNK | 279 |
| SEQ_ID_NO_1819 | KNVHAAI RAD | PTAKKTEKEP | PKEHKRYNLK | KLTYEERKAK | 280 |
| SEQ_ID_NO_1821 | KKVHAAI RAD | PSVVKSTKQP | PKAHKRYNLK | KLTYDERKAR | 279 |
| SEQ_ID_NO_1822 | KKVHAAI RAN | PLAKKSDKPQ | PKEHKRYNPK | KLTYEQRKAS | 280 |
| SEQ_ID_NO_1824 | KKVHAAI RAD | PTMAKSTKQP | PKTHKRYNPK | KLTYEQRKAS | 279 |
| SEQ_ID_NO_1826 | KKVHAAI RAD | PKKSGKQP | PKTHKRYNLK | KLTYEQRKAS | 279 |
| SEQ_ID_NO_1827 | KKVHAAI RAD | PTMAKSTKKE | PAIHKRYNLK | KLTYEERKAK | 279 |
| SEQ_ID_NO_1828 | KKVHAAI RAD | PTIKMSEKHV | PKIVQKHYLTR | KLTYEERKNK | 280 |
| SEQ_ID_NO_1829 | KKVHAAI RAD | | | | 279 |

| | | | | |
|---|---|---|---|---|
| SEQ_ID_NO_1812 | LI ERVR- | AAGDDDD- | -H | 286 |
| SEQ_ID_NO_1814 | LI ERVKALNG | AAL--- | EDEE | 302 |
| SEQ_ID_NO_1815 | LVERLNALNS | AAD-N- | DEDDE | 297 |
| SEQ_ID_NO_1817 | LI SRVAALNS | AAGL-D- | SEEED | 298 |
| SEQ_ID_NO_1819 | LI ERLHTLNA | SGGADD-L | DEDDE | 298 |
| SEQ_ID_NO_1821 | LI ERLNQLNS | AADGDDDD | DEDDE | 302 |
| SEQ_ID_NO_1822 | LVERLNALNS | SGGADDDD | DEDDE | 302 |
| SEQ_ID_NO_1824 | LI ERLNALNS | SAGADV-D | EDDDD | 303 |
| SEQ_ID_NO_1826 | LVERLNALNS | AGGNDDDD- | DEDDE | 301 |
| SEQ_ID_NO_1827 | LI ERLNALNA | SAGADF-DDE | EEDDD | 302 |
| SEQ_ID_NO_1828 | LVERLNALNS | GA------D- | EEDDE | 304 |
| SEQ_ID_NO_1829 | LARLNALNA | | EEDDE | 297 |

| SEQ_ID_NO_2124 | DRSAMYRVGC | LFYAIYFIVS | FPMFFRMDEK | STDEWDLSRV | 236 |
| --- | --- | --- | --- | --- | --- |
| SEQ_ID_NO_2126 | DRASMYKVGS | LFYAIYFEVS | FPMFLRIDEK | PGDLWELPRV | 243 |
| SEQ_ID_NO_2128 | DRDSMYKVGS | LFYAIYFIVS | FPMFLRIDEK | PGDKWDLPRV | 236 |
| SEQ_ID_NO_2129 | DRASMYKVGS | LFYAIYFIVS | FPMFLRIDEK | PGNTWDLPRV | 238 |
| SEQ_ID_NO_2131 | DRDIMYKVGS | LFYAIYFIVS | FPMFSRIDEK | DFEKWSLSRV | 248 |
| SEQ_ID_NO_2133 | DRDIMYKVGS | LFYAIYFIVS | FPMFSRIDEK | DFEKWDLSRV | 251 |
| SEQ_ID_NO_2135 | DRDIMYKVGS | LFYAIYFIVS | FPMFSRIDEK | A-EKWDLPRV | 248 |
| SEQ_ID_NO_2136 | DRDIMYKVGS | LFYAIYFIVS | FPMFSRIDEN | E-EKWNLSRV | 277 |

| SEQ_ID_NO_2124 | AVDALGAAML | VTIILDLWRL | FLGPIVPLPE | GQNCLQSGLP | 276 |
| --- | --- | --- | --- | --- | --- |
| SEQ_ID_NO_2126 | AVDSLGAAML | VTIILDLWRI | FLGPIVPLPV | TKQCLQQGLP | 283 |
| SEQ_ID_NO_2128 | DRDSMYKVGS | VTIILDLWRI | FLGPIVPIAD | TKQCPQVGLP | 276 |
| SEQ_ID_NO_2129 | AVDSLGAAML | VTIILDLWRI | FLGPIVLIPE | SNQCHQPGLP | 278 |
| SEQ_ID_NO_2131 | AVDALGAAML | VTIILDLWRI | FLGPIVPVPE | SRQCGQPGLA | 288 |
| SEQ_ID_NO_2133 | AVDALGAAML | VTIILDLWRI | FLGPIVPIPE | SRRCGQPGLA | 291 |
| SEQ_ID_NO_2135 | AVDALGAAML | VTIILDLWRI | FLGPIVPIPE | SRRCAQPGLA | 288 |
| SEQ_ID_NO_2136 | AVDALGAAML | VTIILDLWRI | FLGPIVPIPE | SRRCGQPGLA | 317 |

| SEQ_ID_NO_2124 | WFS----N | 280 |
| --- | --- | --- |
| SEQ_ID_NO_2126 | WFPGHATQT | 292 |
| SEQ_ID_NO_2128 | WFTGHANLK | 285 |
| SEQ_ID_NO_2129 | WFPGHGPKA | 287 |
| SEQ_ID_NO_2131 | WFQAQNGST | 297 |
| SEQ_ID_NO_2133 | WFHAQL--N | 297 |
| SEQ_ID_NO_2135 | WFHAQNESV | 297 |
| SEQ_ID_NO_2136 | WFQVQKESV | 326 |

| SEQ ID NO | | | | | | | |
|---|---|---|---|---|---|---|---|
| SEQ_ID_NO_2035 | TAI RGAI I LA | KLSVVPVRRG | YWGNKI GKPH | TVPCKVTGKC | 181 |
| SEQ_ID_NO_2037 | TAI RGGI I LA | KLSVI PVRRG | YWGNKI GKPH | TVPCKVTGKC | 181 |
| SEQ_ID_NO_2039 | TAI RGAI I LA | KLSVI PVRRG | YWGNKI GKPH | TVPCKVTGKC | 173 |
| SEQ_ID_NO_2041 | TAI RGAI I LA | KLSVVPVRRG | YWGNKI GKPH | TVPCKVTGKC | 167 |
| SEQ_ID_NO_2043 | TAI RGAI I LA | KLSVI PVRRG | YWGNKI GQPH | TVPCKVTGKC | 176 |
| SEQ_ID_NO_2045 | TAI RGAI I LA | KLSVVPVRRG | YWGNKI GKPH | TVPCKVTGKC | 176 |
| SEQ_ID_NO_2047 | TAI RGAI I LA | KLSVI PVRRG | YWGNKI GQPH | TVPCKVTGKC | 176 |
| SEQ_ID_NO_2048 | TAI RGAI I LA | KLSVVPVRRG | YWGNKI GKPH | TVPCKVTGKC | 171 |
| SEQ_ID_NO_2049 | TAI RGAI I LA | KLSVI PVRRG | YWGNKI GLPH | TVPCKVTGKC | 174 |
| SEQ_ID_NO_2051 | TAI RGAI I LA | KLSVI PVRRG | YWGNKI GKPH | TVPCKVTGKC | 175 |
| SEQ_ID_NO_2052 | TAI RGAI I LA | KMSVVPVRRG | YWGNKI GKVH | TVPCKVTGKC | 177 |
| SEQ_ID_NO_2053 | TAI RGAI I QA | KLSVI PVRRG | YWGNKI GKPH | TVPVKVTGKC | 177 |
| SEQ_ID_NO_2054 | HSLQGSMI LA | KLNVVPVRRG | YWGSKLGAPH | TVPTKVI GKC | 174 |
| SEQ_ID_NO_2055 | | | | TI PTKVHGKC | 176 |

| SEQ ID NO | | | | | | | |
|---|---|---|---|---|---|---|---|
| SEQ_ID_NO_2035 | GSVTVRMVPA | PRGSGI VAAR | VPKKVLQFAG | DDVFTSSRG | 221 |
| SEQ_ID_NO_2037 | GSVTVRMVPA | PRGAGI VAAR | VPKKVLQFAG | DDVFTSSRG | 221 |
| SEQ_ID_NO_2039 | GSVTVRMVPA | PRGSGI VAAR | VPKKVLQFAG | DDVFTSSRG | 213 |
| SEQ_ID_NO_2041 | GSVTVRMVPA | PRGAGI VAAR | VPKKVLQFAG | EDVFTSSRG | 207 |
| SEQ_ID_NO_2043 | GSVTVRMVPA | PRGSGI VAAR | VPKKVLQFAG | EDVFTSSRG | 216 |
| SEQ_ID_NO_2045 | GSVTVRMVPA | PRGSGI VAAR | VPKKVLQFAG | DDVFTSSRG | 216 |
| SEQ_ID_NO_2047 | GSVTVRMVPA | PRGAGI VAAR | VPKKVLQFAG | EDVFTSSRG | 216 |
| SEQ_ID_NO_2048 | GSVTVRMVPA | PRGSGI VAAH | VPKKVLQFAG | EDVFTSSRG | 211 |
| SEQ_ID_NO_2049 | GSVTVRMVPA | PRGAGI VAAR | VPKKVLQFAG | DDVFTSSRG | 214 |
| SEQ_ID_NO_2051 | GSVTVRMVPA | PRGSGI VAAR | VPKKVLQFAG | EDVFTSSRG | 215 |
| SEQ_ID_NO_2052 | GSVTVRLVPA | PRGAGI VAAR | VPKKVLQFAG | EDVFTSSRG | 217 |
| SEQ_ID_NO_2053 | GSVTVRMVPA | PRGAGI VAAR | TPKKVLMAG | EDCYTSSRG | 217 |
| SEQ_ID_NO_2054 | GSVI RLTPA | PRGAGI VAAR | VPKKVLQFAG | EDVFTSSRG | 214 |
| SEQ_ID_NO_2055 | GSVMVRLI PA | PRGAGI VASG | MKKVLAMAG | LHDVYTCSRG | 216 |

| | | | | | | |
|---|---|---|---|---|---|---|
| SEQ_ID_NO_2425 | P----- | -HLDL- | ----- ELN- | ----- | ----- | ----- | 552 |
| SEQ_ID_NO_2426 | ----- | --HDL- | RANSV | NCGV | FCVRVRDKPT | WRKAVSLTIR | 615 |
| SEQ_ID_NO_2428 | KGYGDDH- | ELH- | ----- | ----- | ----- | 630 |
| SEQ_ID_NO_2430 | PDYHHHQPG | TANTI | ----- | ----- | ----- | 593 |
| SEQ_ID_NO_2431 | ----- | ----- | ----- | ----- | ----- | 583 |
| SEQ_ID_NO_2433 | ----- | ----- | ----- | ----- | ----- | 591 |

| | | |
|---|---|---|
| SEQ_ID_NO_2425 | ---NEQ | 555 |
| SEQ_ID_NO_2426 | --QLKH | 619 |
| SEQ_ID_NO_2428 | HQRCGND | 637 |
| SEQ_ID_NO_2430 | ---DMKY | 597 |
| SEQ_ID_NO_2431 | ---ASKV | 587 |
| SEQ_ID_NO_2433 | ----SN | 593 |

FIG. 38E

TRANSGENIC PLANTS HAVING INCREASED BIOMASS

CROSS-REFERENCE TO RELATED APPLICATIONS

This Application is a National Stage application under 35 U.S.C. 371 of International Application No. PCT/US2011/035345, having an International Filing Date of May 5, 2011, which claims priority under 35 U.S.C. 119(e) to U.S. Provisional Application No. 61/331,984, filed May 6, 2010, and to U.S. Provisional Application No. 61/378,477, filed Aug. 31, 2010, which are incorporated herein by reference in their entirety.

STATEMENT AS TO FEDERALLY SPONSORED RESEARCH

This invention was made in part with government support under Grant No. CALW-2009-00426 awarded by the National Institute of Food and Agriculture. The government has certain rights in the invention.

TECHNICAL FIELD

This document relates to methods and materials involved in modulating biomass levels in plants. For example, this document provides plants having increased biomass levels as well as materials and methods for making plants and plant products having increased biomass levels.

INCORPORATION-BY-REFERENCE OF SEQUENCE LISTING

The material in the accompanying sequence listing is hereby incorporated by reference into this application. The accompanying file, named 60645683.txt was created on Apr. 25, 2011, and is 7.97 MB. The file can be accessed using Microsoft Word on a computer that uses Windows OS.

BACKGROUND

The present invention relates to methods of increasing biomass in plants and plants generated thereby. Plants having increased and/or improved biomass are useful for agriculture, horticulture, biomass to energy conversion, paper production, plant product production, and other industries. In particular, there is a need for increases in biomass for dedicated energy crops such as *Panicum virgatum* L. (switchgrass), *Miscanthus×gigantus* (miscanthus), *Sorghum* sp., and *Saccharum* sp. (sugar cane). Throughout human history, access to plant biomass for both food and fuel has been essential to maintaining and increasing population levels. Scientists are continually striving to improve biomass in agricultural crops. The large amount of research related to increasing plant biomass, particularly for dedicated energy crops, indicates the level of importance placed on providing sustainable sources of energy for the population. The urgency of developing sustainable and stable sources of plant biomass for energy is underscored by current events, such as rising oil prices. The amount of biomass produced by plants is a quantitative trait affected by a number of biochemical pathways. There is a need for molecular genetic approaches to more rapidly produce plants having increased biomass. There is also a need to produce plant species that grow more efficiently and produce more biomass in various geographic and/or climatic environments. It would be desirable for such approaches to be applicable to multiple plant species (Zhang et al., *Plant Physiol.* 135: 615-621 (2004)). Despite some progress in molecular genetic approaches, there is also a need to identify specific genes and/or sequences that can be used to effectively increase biomass in plants.

SUMMARY

This document provides methods and materials related to plants having modulated levels of biomass. For example, this document provides transgenic plants and plant cells having increased levels of biomass, nucleic acids used to generate transgenic plants and plant cells having increased levels of biomass, methods for making plants having increased levels of biomass, and methods for making plant cells that can be used to generate plants having increased levels of biomass. Such plants and plant cells can be grown to produce, for example, plants having increased height, increased tiller number, or increased dry weight. Plants having increased biomass levels may be useful to produce biomass for food and feed, which may benefit both humans and animals. Plants having increased biomass levels may be useful in converting such biomass to a liquid fuel (e.g., ethanol), or other chemicals, or may be useful as a thermochemical fuel.

This document features a method of producing a plant. The method includes growing a plant cell comprising an exogenous nucleic acid, the exogenous nucleic acid comprising a regulatory region operably linked to a nucleotide sequence encoding a polypeptide, wherein the HMM bit score of the amino acid sequence of the polypeptide is greater than about 65, wherein the HMM is based on the amino acid sequences depicted in one of FIGS. 1-38, and wherein the plant has a difference in the level of biomass as compared to the corresponding level of a control plant that does not comprise the nucleic acid. For example, the plant can have an increased level of biomass relative to the control plant.

This document also features a method of producing a plant. The method includes growing a plant cell comprising an exogenous nucleic acid, the exogenous nucleic acid comprising a regulatory region operably linked to a nucleotide sequence encoding a polypeptide having 80 percent or greater sequence identity to an amino acid sequence selected from the group consisting of SEQ ID NOs: 2, 4, 6-9, 11, 13-15, 17, 18, 20-27, 29, 31-33, 35, 36, 38-51, 53, 54, 56-61, 63-67, 69, 70, 72-76, 78, 80-83, 85, 86, 88-91, 93-97, 99-103, 105, 107, 109, 110, 112, 113, 115, 117, 119-152, 154, 156, 158, 159, 161, 163, 165, 167, 168, 170, 172, 174, 176, 178, 180-185, 187, 188, 190, 192-194, 196, 198, 200, 202, 203, 205, 207-211, 213-251, 253, 255, 257, 258, 260-262, 264, 265, 267-272, 274-279, 281-283, 285, 287-292, 294, 295-297, 299, 301, 303-305, 307, 309, 310, 312, 314, 316-318, 320, 321, 323, 325, 327-329, 331, 332, 334, 335, 337-339, 341, 342, 344, 345, 347, 349, 351, 353, 355, 357, 359, 361-366, 368, 370, 372, 373, 375-378, 380, 382-387, 389, 391, 393, 395, 396, 398-404, 406-414, 416, 418, 420, 421, 423, 425, 427, 429, 431, 433, 435, 437, 439, 441, 443, 445, 447, 449, 451, 453, 455, 457, 459, 461, 463, 465, 467, 469, 471, 473, 475, 477, 479, 481, 483, 485, 487, 489, 491, 493, 495, 497-502, 504, 506, 508, 509, 511-517, 519, 521, 522, 524-527, 529, 530, 532, 533, 535, 536, 537, 539, 541, 543, 545, 546, 548, 550, 552-555, 557, 558, 560, 562, 564, 566, 568, 570-578, 580, 582, 584, 585, 587, 589, 591, 592, 594-596, 598, 600, 601, 603, 604, 606-608, 610, 611, 613, 615, 617, 619, 621, 623, 625, 626, 628-632, 634, 636, 638, 640, 642, 643, 645, 647, 649, 651, 653, 655, 657, 659, 661, 663, 665, 667-670, 672, 674, 675, 677, 679-682, 684, 685, 687, 689-692, 694-698, 700-704, 706, 707, 709-718, 720, 722, 724, 726-728, 730, 731, 733-739, 741, 743, 745, 746, 748, 750, 752, 754, 756, 758, 760-764, 766, 768, 770, 772, 774, 776, 778, 780, 782, 784, 785, 787, 789, 791, 793-795, 797, 799, 801, 803, 805, 806, 808, 810, 812, 814, 816, 818-820, 822-824, 826, 828, 830, 832, 834, 836, 838-840, 842, 843, 845-847, 849, 851, 853, 854, 856-858, 860, 862, 863, 865, 866, 868, 870-873, 875-878, 880-882, 884-886, 888, 890, 892, 893, 895, 897, 899, 900, 902, 903, 905, 907, 909, 911, 912, 913, 915, 917, 919, 921, 923, 925, 926, 928, 930, 932, 933, 935, 936-938, 940, 941, 943-945, 947, 949, 950, 952-955, 957-961, 963, 965-969, 971, 972, 974, 975, 977, 978, 980, 982, 984, 986, 988, 990, 992, 994, 996, 998, 1000-1014, 1016, 1018, 1020, 1021, 1023, 1024, 1026, 1027, 1029, 1030, 1032, 1033, 1035, 1037, 1038, 1040, 1042, 1043, 1045, 1047, 1049, 1051, 1053, 1055, 1057, 1059, 1061-1063, 1065, 1067, 1069, 1070, 1072, 1073, 1075, 1076, 1078-1080, 1082, 1083, 1085, 1087, 1089, 1091, 1093, 1095, 1096, 1098, 1100, 1101, 1103, 1105, 1106, 1108, 1110, 1112, 1114-1116, 1118, 1120-1123, 1125, 1127-1131, 1133, 1134, 1136, 1137, 1139-1145, 1147-1156, 1158-1161, 1163, 1165-1178, 1180-1188, 1190, 1191, 1193-1202, 1204, 1205-1207, 1209-1213, 1215, 1217-1221, 1223-1228, 1230, 1231, 1233-1241, 1243, 1245, 1247, 1249-1252, 1254, 1255, 1257-1259, 1261, 1263, 1264, 1266-1272, 1274-1276, 1278, 1280, 1282-1286, 1288, 1289, 1291-1331, 1333-1337, 1339, 1341, 1343, 1345, 1347-1350, 1352, 1354, 1356, 1358, 1360, 1362, 1364, 1366, 1368, 1370-1372, 1374, 1375, 1377-1379, 1381, 1383, 1384, 1386, 1388-1390, 1392-1397, 1399, 1400, 1402, 1403, 1405, 1407-1410, 1412-1418, 1420, 1422, 1424, 1426, 1428, 1430, 1432-1436, 1438, 1440, 1442-1444, 1446, 1447, 1449, 1450, 1452-1454, 1456, 1457, 1459, 1460, 1462, 1463, 1465-1468, 1470, 1471, 1473, 1475, 1477-1483, 1485, 1487, 1489, 1491-1493, 1495, 1496, 1498, 1499, 1501, 1503, 1504, 1506, 1508, 1510, 1511, 1513, 1514, 1516-1521, 1523, 1524, 1526, 1528-1532, 1534, 1536-1539, 1541, 1542, 1544, 1545, 1547, 1548, 1550, 1552, 1553, 1555-1559, 1561, 1563-1565, 1567, 1568, 1570, 1571, 1573, 1575, 1576, 1578, 1580, 1582, 1583, 1585, 1587, 1589, 1590, 1592, 1593, 1595, 1597, 1599, 1600, 1602-1606, 1608-1613, 1615, 1616, 1618-1626, 1628, 1629, 1631, 1633, 1634, 1636, 1637, 1639-1643, 1645, 1646-1739, 1741, 1743, 1745, 1747-1756, 1758, 1760, 1762-1764, 1766, 1767, 1769, 1770, 1772-1774, 1776, 1778-1783, 1785-1792, 1794, 1796, 1798, 1799, 1801, 1802, 1804, 1806, 1808-1810, 1812, 1814, 1815, 1817, 1819, 1821, 1822, 1824, 1826-1830, 1832, 1834, 1835, 1837, 1839-1841, 1843, 1844, 1846, 1847, 1849, 1851, 1852, 1854, 1856, 1858, 1860-1863, 1865-1953, 1955-1958, 1960, 1962, 1964, 1966-1968, 1970, 1972-1976, 1978, 1980, 1982, 1984-1986, 1988, 1990, 1991, 1993, 1995, 1997, 1999, 2001, 2003, 2005, 2007, 2009, 2011, 2013, 2015, 2017, 2019, 2021, 2023-2027, 2029, 2031, 2033, 2035, 2037, 2039, 2041, 2043, 2045, 2047-2049, 2051-2057, 2059, 2061, 2063, 2065, 2067, 2069, 2071, 2073, 2075, 2077, 2079, 2080, 2082, 2084, 2086, 2088, 2090, 2092, 2093, 2095, 2097, 2098, 2100-2122, 2124, 2126, 2128, 2129, 2131, 2133, 2135-2137, 2139, 2141, 2142, 2144-2148, 2150, 2152, 2154, 2155, 2157, 2159-2161, 2163, 2165, 2166, 2168, 2170, 2172-2175, 2177, 2179, 2181, 2183, 2184, 2186, 2188, 2189, 2191-2194, 2196, 2197, 2199-2202, 2204, 2206-2208, 2210-2212, 2214, 2215, 2217-2220, 2222, 2224-2226, 2228, 2230-2232, 2234-2242, 2244-2254, 2256-2269, 2271, 2273, 2274, 2276, 2278, 2280, 2281, 2283, 2285, 2286, 2288, 2290, 2292, 2294, 2296, 2297, 2299, 2301, 2303, 2305, 2307, 2309, 2311, 2313, 2314, 2316-2318, 2320, 2322, 2324, 2326, 2327, 2329, 2331, 2333, 2335, 2337, 2339, 2341, 2342, 2344, 2345, 2347-2349, 2351, 2353, 2355, 2357, 2359, 2361, 2363, 2365, 2367-2369, 2371, 2373, 2375, 2377, 2379, 2381, 2383, 2385, 2386, 2388, 2390, 2391, 2393, 2395, 2397, 2399, 2400, 2402, 2404, 2405, 2407, 2409, 2411, 2413, 2415, 2417, 2419, 2421, 2423, 2425, 2426, 2428, 2430, 2431, 2433, 2435, 2437, 2438-2440, 2442, 2444, 2445, 2447, 2449, 2451, 2453, 2455, 2457, 2459, 2461, 2463-2468, 2470, 2472, 2474, 2476, 2478, 2479, 2481, 2482, 2484, 2485, 2487-2491, 2493-2498, 2500-2510, 2512-2515, 2517-2531, 2533-2536, 2538-2542, 2544-2548, 2550, 2551, 2553, 2555-2558, 2560, 2562, 2564, 2566-2573, 2575-2579, 2581, 2583-2585, 2587-2602, 2604-2611, 2613, 2615, 2617, and 2619-2623. A plant produced from the plant cell has a difference in the level of biomass as compared to the corresponding level of a control plant that does not include the nucleic acid. For example, the plant can have an increased level of biomass relative to the control plant.

This document also features a method of producing a plant. The method includes growing a plant cell comprising an exogenous nucleic acid, the exogenous nucleic acid comprising a regulatory region operably linked to a nucleotide sequence having 80 percent or greater sequence identity to a nucleotide sequence selected from the group consisting of SEQ ID NO: 1, 3, 5, 10, 12, 16, 19, 28, 30, 34, 37, 52, 55, 62, 68, 71, 77, 79, 84, 87, 92, 98, 104, 106, 108, 111, 114, 116, 118, 153, 155, 157, 160, 162, 164, 166, 169, 171, 173, 175, 177, 179, 186, 189, 191, 195, 197, 199, 201, 204, 206, 212, 252, 254, 256, 259, 263, 266, 273, 280, 284, 286, 293, 298, 300, 302, 306, 308, 311, 313, 315, 319, 322, 324, 326, 330, 333, 336, 340, 343, 346, 348, 350, 352, 354, 356, 358, 360, 367, 369, 371, 374, 379, 381, 388, 390, 392, 394, 397, 405, 415, 417, 419, 422, 424, 426, 428, 430, 432, 434, 436, 438, 440, 442, 444, 446, 448, 450, 452, 454, 456, 458, 460, 462, 464, 466, 468, 470, 472, 474, 476, 478, 480, 482, 484, 486, 488, 490, 492, 494, 496, 503, 505, 507, 510, 518, 520, 523, 528, 531, 534, 538, 540, 542, 544, 547, 549, 551, 556, 559, 561, 563, 565, 567, 569, 579, 581, 583, 586, 588, 590, 593, 597, 599, 602, 605, 609, 612, 614, 616, 618, 620, 622, 624, 627, 633, 635, 637, 639, 641, 644, 646, 648, 650, 652, 654, 656, 658, 660, 662, 664, 666, 671, 673, 676, 678, 683, 686, 688, 693, 699, 705, 708, 719, 721, 723, 725, 729, 732, 740, 742, 744, 747, 749, 751, 753, 755, 757, 759, 765, 767, 769, 771, 773, 775, 777, 779, 781, 783, 786, 788, 790, 792, 796, 798, 800, 802, 804, 807, 809, 811, 813, 815, 817, 821, 825, 827, 829, 831, 833, 835, 837, 841, 844, 848, 850, 852, 855, 859, 861, 864, 867, 869, 874, 879, 883, 887, 889, 891, 894, 896, 898, 901, 904, 906, 908, 910, 914, 916, 918, 920, 922, 924, 927, 929, 931, 934, 939, 942, 946, 948, 951, 956, 962, 964, 970, 973, 976, 979, 981, 983, 985, 987, 989, 991, 993, 995, 997, 999, 1015, 1017, 1019, 1022, 1025, 1028, 1031, 1034, 1036, 1039, 1041, 1044, 1046, 1048, 1050, 1052, 1054, 1056, 1058, 1060, 1064, 1066, 1068, 1071, 1074, 1077, 1081, 1084, 1086, 1088, 1090, 1092, 1094, 1097, 1099, 1102, 1104, 1107, 1109, 1111, 1113, 1117, 1119, 1124, 1126, 1132, 1135, 1138, 1146, 1157, 1162, 1164, 1179, 1189, 1192, 1203, 1208, 1214, 1216, 1222, 1229, 1232, 1242, 1244, 1246, 1248, 1253, 1256, 1260, 1262, 1265, 1273, 1277, 1279, 1281, 1287, 1290, 1332, 1338, 1340, 1342, 1344, 1346, 1351, 1353, 1355, 1357, 1359, 1361, 1363, 1365, 1367, 1369, 1373, 1376, 1380, 1382, 1385, 1387, 1391, 1398, 1401, 1404, 1406, 1411, 1419, 1421, 1423, 1425, 1427, 1429, 1431, 1437, 1439, 1441, 1445, 1448, 1451, 1455, 1458, 1461, 1464, 1469, 1472, 1474, 1476, 1484, 1486, 1488, 1490, 1494, 1497, 1500, 1502, 1505, 1507, 1509, 1512, 1515, 1522, 1525, 1527, 1533, 1535, 1540, 1543, 1546, 1549, 1551, 1554, 1560, 1562, 1566, 1569, 1572, 1574, 1577, 1579, 1581, 1584, 1586, 1588, 1591, 1594, 1596, 1598, 1601, 1607, 1614, 1617, 1627, 1630, 1632, 1635, 1638, 1644, 1740, 1742, 1744, 1746, 1757, 1759, 1761, 1765, 1768, 1771, 1775, 1777, 1784, 1793, 1795, 1797, 1800, 1803, 1805, 1807, 1811, 1813, 1816, 1818, 1820, 1823, 1825, 1831, 1833, 1836, 1838, 1842, 1845, 1848, 1850, 1853, 1855, 1857, 1859, 1864, 1954, 1959, 1961, 1963, 1965, 1969, 1971, 1977, 1979, 1981, 1983, 1987, 1989, 1992, 1994, 1996, 1998, 2000, 2002, 2004, 2006, 2008, 2010, 2012, 2014, 2016, 2018, 2020, 2022, 2028, 2030, 2032, 2034, 2036, 2038, 2040, 2042, 2044, 2046, 2050, 2058, 2060, 2062, 2064, 2066, 2068, 2070, 2072, 2074, 2076, 2078, 2081, 2083, 2085, 2087, 2089, 2091, 2094, 2096, 2099, 2123, 2125, 2127, 2130, 2132, 2134, 2138, 2140, 2143, 2149, 2151, 2153, 2156, 2158, 2162, 2164, 2167, 2169, 2171, 2176, 2178, 2180, 2182, 2185, 2187, 2190, 2195, 2198, 2203, 2205, 2209, 2213, 2216, 2221, 2223, 2227, 2229, 2233, 2243, 2255, 2270, 2272, 2275, 2277, 2279, 2282, 2284, 2287, 2289, 2291, 2293, 2295, 2298, 2300, 2302, 2304, 2306, 2308, 2310, 2312, 2315, 2319, 2321, 2323, 2325, 2328, 2330, 2332, 2334, 2336, 2338, 2340, 2343, 2346, 2350, 2352, 2354, 2356, 2358, 2360, 2362, 2364, 2366, 2370, 2372, 2374, 2376, 2378, 2380, 2382, 2384, 2387, 2389, 2392, 2394, 2396, 2398, 2401, 2403, 2406, 2408, 2410, 2412, 2414, 2416, 2418, 2420, 2422, 2424, 2427, 2429, 2432, 2434, 2436, 2441, 2443, 2446, 2448, 2450, 2452, 2454, 2456, 2458, 2460, 2462, 2469, 2471, 2473, 2475, 2477, 2480, 2483, 2486, 2492, 2499, 2511, 2516, 2532, 2537, 2543, 2549, 2552, 2554, 2559, 2561, 2563, 2565, 2574, 2580, 2582, 2586, 2603, 2612, 2614, 2616, and 2618, or a fragment thereof. A plant produced from the plant cell has a difference in the level of biomass as compared to the corresponding level of a control plant that does not include the nucleic acid. For example, the plant can have an increased level of biomass relative to the control plant.

This document also features a method of producing a plant. The method includes growing a plant cell comprising an exogenous nucleic acid, the exogenous nucleic acid effective for downregulating an endogenous nucleic acid in the plant cell, wherein the endogenous nucleic acid encodes a polypeptide and wherein the HMM bit score of the amino acid sequence of the polypeptide is greater than about 65, the HMM based on the amino acid sequences depicted in one of FIGS. 1-38.

In another aspect, this document features a method of modulating the level of biomass in a plant. The method includes introducing into a plant cell an exogenous nucleic acid, the exogenous nucleic acid including a regulatory region operably linked to a nucleotide sequence encoding a polypeptide, wherein the HMM bit score of the amino acid sequence of the polypeptide is greater than about 65, the HMM based on the amino acid sequences depicted in one of FIGS. 1-38, and wherein a plant produced from the plant cell has a difference in the level of biomass as compared to the corresponding level of a control plant that does not include the exogenous nucleic acid. For example, the plant can have an increased level of biomass relative to the control plant.

This document also features a method of modulating the level of biomass in a plant. The method includes introducing into a plant cell an exogenous nucleic acid, the exogenous nucleic acid comprising a regulatory region operably linked to a nucleotide sequence encoding a polypeptide having 80 percent or greater sequence identity to an amino acid sequence selected from the group consisting of SEQ ID NOs: 2, 4, 6-9, 11, 13-15, 17, 18, 20-27, 29, 31-33, 35, 36, 38-51, 53, 54, 56-61, 63-67, 69, 70, 72-76, 78, 80-83, 85, 86, 88-91, 93-97, 99-103, 105, 107, 109, 110, 112, 113, 115, 117, 119-152, 154, 156, 158, 159, 161, 163, 165, 167, 168, 170, 172, 174, 176, 178, 180-185, 187, 188, 190, 192-194, 196, 198, 200, 202, 203, 205, 207-211, 213-251, 253, 255, 257, 258, 260-262, 264, 265, 267-272, 274-279, 281-283, 285, 287-292, 294, 295-297, 299, 301, 303-305, 307, 309, 310, 312, 314, 316-318, 320, 321, 323, 325, 327-329, 331, 332, 334, 335, 337-339, 341, 342, 344, 345, 347, 349, 351, 353, 355, 357, 359, 361-366, 368, 370, 372, 373, 375-378, 380, 382-387, 389, 391, 393, 395, 396, 398-404, 406-414, 416, 418, 420, 421, 423, 425, 427, 429, 431, 433, 435, 437, 439, 441, 443, 445, 447, 449, 451, 453, 455, 457, 459, 461, 463, 465, 467, 469, 471, 473, 475, 477, 479, 481, 483, 485, 487, 489, 491, 493, 495, 497-502, 504, 506, 508, 509, 511-517, 519, 521, 522, 524-527, 529, 530, 532, 533, 535, 536, 537, 539, 541, 543, 545, 546, 548, 550, 552-555, 557, 558, 560, 562, 564, 566, 568, 570-578, 580, 582, 584, 585, 587, 589, 591, 592, 594-596, 598, 600, 601, 603, 604, 606-608, 610, 611, 613, 615, 617, 619, 621, 623, 625, 626, 628-632, 634, 636, 638, 640, 642, 643, 645, 647, 649, 651, 653, 655, 657, 659, 661, 663, 665, 667-670, 672, 674, 675, 677, 679-682, 684, 685, 687, 689-692, 694-698, 700-704, 706, 707, 709-718, 720, 722, 724, 726-728, 730, 731, 733-739, 741, 743, 745, 746, 748, 750, 752, 754, 756, 758, 760-764, 766, 768, 770, 772, 774, 776, 778, 780, 782, 784, 785, 787, 789, 791, 793-795, 797, 799, 801, 803, 805, 806, 808, 810, 812, 814, 816, 818-820, 822-824, 826, 828, 830, 832, 834, 836, 838-840, 842, 843, 845-847, 849, 851, 853, 854, 856-858, 860, 862, 863, 865, 866, 868, 870-873, 875-878, 880-882, 884-886, 888, 890, 892, 893, 895, 897, 899, 900, 902, 903, 905, 907, 909, 911, 912, 913, 915, 917, 919, 921, 923, 925, 926, 928, 930, 932, 933, 935, 936-938, 940, 941, 943-945, 947, 949, 950, 952-955, 957-961, 963, 965-969, 971, 972, 974, 975, 977, 978, 980, 982, 984, 986, 988, 990, 992, 994, 996, 998, 1000-1014, 1016, 1018, 1020, 1021, 1023, 1024, 1026, 1027, 1029, 1030, 1032, 1033, 1035, 1037, 1038, 1040, 1042, 1043, 1045, 1047, 1049, 1051, 1053, 1055, 1057, 1059, 1061-1063, 1065, 1067, 1069, 1070, 1072, 1073, 1075, 1076, 1078-1080, 1082, 1083, 1085, 1087, 1089, 1091, 1093, 1095, 1096, 1098, 1100, 1101, 1103, 1105, 1106, 1108, 1110, 1112, 1114-1116, 1118, 1120-1123, 1125, 1127-1131, 1133, 1134, 1136, 1137, 1139-1145, 1147-1156, 1158-1161, 1163, 1165-1178, 1180-1188, 1190, 1191, 1193-1202, 1204, 1205-1207, 1209-1213, 1215, 1217-1221, 1223-1228, 1230, 1231, 1233-1241, 1243, 1245, 1247, 1249-1252, 1254, 1255, 1257-1259, 1261, 1263, 1264, 1266-1272, 1274-1276, 1278, 1280, 1282-1286, 1288, 1289, 1291-1331, 1333-1337, 1339, 1341, 1343, 1345, 1347-1350, 1352, 1354, 1356, 1358, 1360, 1362, 1364, 1366, 1368, 1370-1372, 1374, 1375, 1377-1379, 1381, 1383, 1384, 1386, 1388-1390, 1392-1397, 1399, 1400, 1402, 1403, 1405, 1407-1410, 1412-1418, 1420, 1422, 1424, 1426, 1428, 1430, 1432-1436, 1438, 1440, 1442-1444, 1446, 1447, 1449, 1450, 1452-1454, 1456, 1457, 1459, 1460, 1462, 1463, 1465-1468, 1470, 1471, 1473, 1475, 1477-1483, 1485, 1487, 1489, 1491-1493, 1495, 1496, 1498, 1499, 1501, 1503, 1504, 1506, 1508, 1510, 1511, 1513, 1514, 1516-1521, 1523, 1524, 1526, 1528-1532, 1534, 1536-1539, 1541, 1542, 1544, 1545, 1547, 1548, 1550, 1552, 1553, 1555-1559, 1561, 1563-1565, 1567, 1568, 1570, 1571, 1573, 1575, 1576, 1578, 1580, 1582, 1583, 1585, 1587, 1589, 1590, 1592, 1593, 1595, 1597, 1599, 1600, 1602-1606, 1608-1613, 1615, 1616, 1618-1626, 1628, 1629, 1631, 1633, 1634, 1636, 1637, 1639-1643, 1645, 1646-1739, 1741, 1743, 1745, 1747-1756, 1758, 1760, 1762-1764, 1766, 1767, 1769, 1770, 1772-1774, 1776, 1778-1783, 1785-1792, 1794, 1796, 1798, 1799, 1801, 1802, 1804, 1806, 1808-1810, 1812, 1814, 1815, 1817, 1819, 1821, 1822, 1824, 1826-1830, 1832, 1834, 1835, 1837, 1839-1841, 1843, 1844, 1846, 1847, 1849, 1851, 1852, 1854, 1856, 1858, 1860-1863, 1865-1953, 1955-1958, 1960, 1962, 1964, 1966-1968, 1970, 1972-1976, 1978, 1980, 1982, 1984-1986, 1988, 1990, 1991, 1993, 1995, 1997, 1999, 2001, 2003, 2005, 2007, 2009, 2011, 2013, 2015, 2017, 2019, 2021, 2023-2027, 2029, 2031, 2033, 2035, 2037, 2039, 2041, 2043, 2045, 2047-2049, 2051-2057, 2059, 2061, 2063, 2065, 2067, 2069, 2071, 2073, 2075, 2077, 2079, 2080, 2082, 2084, 2086, 2088, 2090, 2092, 2093, 2095, 2097, 2098, 2100-2122, 2124, 2126, 2128, 2129, 2131, 2133, 2135-2137, 2139, 2141, 2142, 2144-2148, 2150, 2152, 2154, 2155, 2157, 2159-2161, 2163, 2165, 2166, 2168, 2170, 2172-2175, 2177, 2179, 2181, 2183, 2184, 2186, 2188, 2189, 2191-2194, 2196, 2197, 2199-2202, 2204, 2206-2208, 2210-2212, 2214, 2215, 2217-2220, 2222, 2224-2226, 2228, 2230-2232, 2234-2242, 2244-2254, 2256-2269, 2271, 2273, 2274, 2276, 2278, 2280, 2281, 2283, 2285, 2286, 2288, 2290, 2292, 2294, 2296, 2297, 2299, 2301, 2303, 2305, 2307, 2309, 2311, 2313, 2314, 2316-2318, 2320, 2322, 2324, 2326, 2327, 2329, 2331, 2333, 2335, 2337, 2339, 2341, 2342, 2344, 2345, 2347-2349, 2351, 2353, 2355, 2357, 2359, 2361, 2363, 2365, 2367-2369, 2371, 2373, 2375, 2377, 2379, 2381, 2383, 2385, 2386, 2388, 2390, 2391, 2393, 2395, 2397, 2399, 2400, 2402, 2404, 2405, 2407, 2409, 2411, 2413, 2415, 2417, 2419, 2421, 2423, 2425, 2426, 2428, 2430, 2431, 2433, 2435, 2437, 2438-2440, 2442, 2444, 2445, 2447, 2449, 2451, 2453, 2455, 2457, 2459, 2461, 2463-2468, 2470, 2472, 2474, 2476, 2478, 2479, 2481, 2482, 2484, 2485, 2487-2491, 2493-2498, 2500-2510, 2512-2515, 2517-2531, 2533-2536, 2538-2542, 2544-2548, 2550, 2551, 2553, 2555-2558, 2560, 2562, 2564, 2566-2573, 2575-2579, 2581, 2583-2585, 2587-2602, 2604-2611, 2613, 2615, 2617, and 2619-2623. A plant produced from the plant cell has a difference in the level of biomass as compared to the corresponding level of a control plant that does not include the nucleic acid. For example, the plant can have an increased level of biomass relative to the control plant.

In the methods described herein, a polypeptide can include an O-methyltransferase domain having 60 percent or greater sequence identity to the O-methyltransferase domain of residues 92 to 139 of SEQ ID NO: 1333 and a dimerization domain having 60 percent or greater sequence identity to the dimerization domain of residues 31 to 83 of SEQ ID NO: 1333.

In the methods described herein, a polypeptide can include a glycosyl transferase family 8 domain having 60 percent or greater sequence identity to the glycosyl transferase family 8 domain of residues 314 to 525 of SEQ ID NO: 1489.

In the methods described herein, a polypeptide can include a raffinose synthase domain having 60 percent or greater sequence identity to the raffinose synthase domain of residues 2 to 727 of SEQ ID NO: 504.

In the methods described herein, a polypeptide can include an LpxC domain having 60 percent or greater sequence identity to the LpxC domain of residues 24 to 315 of SEQ ID NO: 198.

In the methods described herein, a polypeptide can include an UDPGT domain having 60 percent or greater sequence identity to the UDPGT domain of residues 11 to 480 of SEQ ID NO: 253.

In the methods described herein, a polypeptide can include a glycosyl hydrolases family 18 domain having 60 percent or greater sequence identity to the glycosyl hydrolases family 18 domain of residues 36 to 287 of SEQ ID NO: 1541.

In the methods described herein, a polypeptide can include a Glyco_transf_34 domain having 60 percent or greater sequence identity to the Glyco_transf_34 domain of residues 136 to 380 of SEQ ID NO: 663.

In the methods described herein, a polypeptide can include a branch domain having 60 percent or greater sequence identity to the branch domain of residues 77 to 303 of SEQ ID NO: 1366.

In the methods described herein, a polypeptide can include a COBRA domain having 60 percent or greater sequence identity to the COBRA domain of residues 51 to 215 of SEQ ID NO: 928.

In the methods described herein, a polypeptide can include a Glyco_transf_34 N terminal domain having 60 percent or greater sequence identity to the Glyco_transf_34 N terminal domain of residues 57 to 374 of SEQ ID NO: 1215 and a Glyco_transf_34 C terminal domain having 60 percent or greater sequence identity to the Glyco_transf_34 C terminal domain of residues 415 to 533 of SEQ ID NO: 1215.

In the methods described herein, a polypeptide can include an Alpha-L-AF_C domain having 60 percent or greater sequence identity to the Alpha-L-AF_C domain of residues 454 to 639 of SEQ ID NO: 4 and a CBM_4_9 domain having 60 percent or greater sequence identity to the CBM_4_9 domain of residues 71 to 229 of SEQ ID NO: 4.

In the methods described herein, a polypeptide can include a EMP24_GP25L domain having 60 percent or greater sequence identity to the EMP24_GP25L domain of residues 36 to 224 of SEQ ID NO: 580.

In the methods described herein, a polypeptide can include a Methyltransf_3 domain having 60 percent or greater sequence identity to the Methyltransf_3 domain of residues 34 to 246 of SEQ ID NO: 53.

In the methods described herein, a polypeptide can include a SRF-TF domain having 60 percent or greater sequence identity to the SRF-TF domain of residues 11 to 61 of SEQ ID NO: 1112 and a K box domain having 60 percent or greater sequence identity to the K box domain of residues 79 to 179 of SEQ ID NO: 1112.

In the methods described herein, a polypeptide can include a zf-C3HC4 domain having 60 percent or greater sequence identity to the zf-C3HC4 domain of residues 95 to 136 of SEQ ID NO: 634 or residues 132 to 173 of SEQ ID NO:187.

In the methods described herein, a polypeptide comprises an epimerase domain having 60 percent or greater sequence identity to the epimerase domain of residues 5 to 244 of SEQ ID NO: 368.

In the methods described herein, a polypeptide can include an UDPGP domain having 60 percent or greater sequence identity to the UDPGP domain of residues 31 to 442 of SEQ ID NO: 1599.

In the methods described herein, a polypeptide can include an IQ domain having 60 percent or greater sequence identity to the IQ domain of residues 115 to 135 of SEQ ID NO: 1065.

In the methods described herein, a polypeptide can include an AUX_IAA domain having 60 percent or greater sequence identity to the AUX_IAA domain of residues 10 to 184 of SEQ ID NO: 1580 or residues 32 to 190 of SEQ ID NO:1592.

In the methods described herein, a polypeptide can include a CRAL_TRIO domain having 60 percent or greater sequence identity to the CRAL_TRIO domain of residues 212 to 391 of SEQ ID NO: 851 and CRAL_TRIO_N domain having 60 percent or greater sequence identity to the CRAL_TRIO_N domain of residues 114 to 200 of SEQ ID NO:851.

In some embodiments, a polypeptide is selected from the group consisting of SEQ ID NOs: 2, 4, 6-9, 11, 13-15, 17, 18, 20-27, 29, 31-33, 35, 36, 38-51, 53, 54, 56-61, 63-67, 69, 70, 72-76, 78, 80-83, 85, 86, 88-91, 93-97, 99-103, 105, 107, 109, 110, 112, 113, 115, 117, 119-152, 154, 156, 158, 159, 161, 163, 165, 167, 168, 170, 172, 174, 176, 178, 180-185, 187, 188, 190, 192-194, 196, 198, 200, 202, 203, 205, 207-211, 213-251, 253, 255, 257, 258, 260-262, 264, 265, 267-272, 274-279, 281-283, 285, 287-292, 294, 295-297, 299, 301, 303-305, 307, 309, 310, 312, 314, 316-318, 320, 321, 323, 325, 327-329, 331, 332, 334, 335, 337-339, 341, 342, 344, 345, 347, 349, 351, 353, 355, 357, 359, 361-366, 368, 370, 372, 373, 375-378, 380, 382-387, 389, 391, 393, 395, 396, 398-404, 406-414, 416, 418, 420, 421, 423, 425, 427, 429, 431, 433, 435, 437, 439, 441, 443, 445, 447, 449, 451, 453, 455, 457, 459, 461, 463, 465, 467, 469, 471, 473, 475, 477, 479, 481, 483, 485, 487, 489, 491, 493, 495, 497-502, 504, 506, 508, 509, 511-517, 519, 521, 522, 524-527, 529, 530, 532, 533, 535, 536, 537, 539, 541, 543, 545, 546, 548, 550, 552-555, 557, 558, 560, 562, 564, 566, 568, 570-578, 580, 582, 584, 585, 587, 589, 591, 592, 594-596, 598, 600, 601, 603, 604, 606-608, 610, 611, 613, 615, 617, 619, 621, 623, 625, 626, 628-632, 634, 636, 638, 640, 642, 643, 645, 647, 649, 651, 653, 655, 657, 659, 661, 663, 665, 667-670, 672, 674, 675, 677, 679-682, 684, 685, 687, 689-692, 694-698, 700-704, 706, 707, 709-718, 720, 722, 724, 726-728, 730, 731, 733-739, 741, 743, 745, 746, 748, 750, 752, 754, 756, 758, 760-764, 766, 768, 770, 772, 774, 776, 778, 780, 782, 784, 785, 787, 789, 791, 793-795, 797, 799, 801, 803, 805, 806, 808, 810, 812, 814, 816, 818-820, 822-824, 826, 828, 830, 832, 834, 836, 838-840, 842, 843, 845-847, 849, 851, 853, 854, 856-858, 860, 862, 863, 865, 866, 868, 870-873, 875-878, 880-882, 884-886, 888, 890, 892, 893, 895, 897, 899, 900, 902, 903, 905, 907, 909, 911, 912, 913, 915, 917, 919, 921, 923, 925, 926, 928, 930, 932, 933, 935, 936-938, 940, 941, 943-945, 947, 949, 950, 952-955, 957-961, 963, 965-969, 971, 972, 974, 975, 977, 978, 980, 982, 984, 986, 988, 990, 992, 994, 996, 998, 1000-1014, 1016, 1018, 1020, 1021, 1023, 1024, 1026, 1027, 1029, 1030, 1032, 1033, 1035, 1037, 1038, 1040, 1042, 1043, 1045, 1047, 1049, 1051, 1053, 1055, 1057, 1059, 1061-1063, 1065, 1067, 1069, 1070, 1072, 1073, 1075, 1076, 1078-1080, 1082, 1083, 1085, 1087, 1089, 1091, 1093, 1095, 1096, 1098, 1100, 1101, 1103, 1105, 1106, 1108, 1110, 1112, 1114-1116, 1118, 1120-1123, 1125, 1127-1131, 1133, 1134, 1136, 1137, 1139-1145, 1147-1156, 1158-1161, 1163, 1165-1178, 1180-1188, 1190, 1191, 1193-1202, 1204, 1205-1207, 1209-1213, 1215, 1217-1221, 1223-1228, 1230, 1231, 1233-1241, 1243, 1245, 1247, 1249-1252, 1254, 1255, 1257-1259, 1261, 1263, 1264, 1266-1272, 1274-1276, 1278, 1280, 1282-1286, 1288, 1289, 1291-1331, 1333-1337, 1339, 1341, 1343, 1345, 1347-1350, 1352, 1354, 1356, 1358, 1360, 1362, 1364, 1366, 1368, 1370-1372, 1374, 1375, 1377-1379, 1381, 1383, 1384, 1386, 1388-1390, 1392-1397, 1399, 1400, 1402, 1403, 1405, 1407-1410, 1412-1418, 1420, 1422, 1424, 1426, 1428, 1430, 1432-1436, 1438, 1440, 1442-1444, 1446, 1447, 1449, 1450, 1452-1454, 1456, 1457, 1459, 1460, 1462, 1463, 1465-1468, 1470, 1471, 1473, 1475, 1477-1483, 1485, 1487, 1489, 1491-1493, 1495, 1496, 1498, 1499, 1501, 1503, 1504, 1506, 1508, 1510, 1511, 1513, 1514, 1516-1521, 1523, 1524, 1526, 1528-1532, 1534, 1536-1539, 1541, 1542, 1544, 1545, 1547, 1548, 1550, 1552, 1553, 1555-1559, 1561, 1563-1565, 1567, 1568, 1570, 1571, 1573, 1575, 1576, 1578, 1580, 1582, 1583, 1585, 1587, 1589, 1590, 1592, 1593, 1595, 1597, 1599, 1600, 1602-1606, 1608-1613, 1615, 1616, 1618-1626, 1628, 1629, 1631, 1633, 1634, 1636, 1637, 1639-1643, 1645, 1646-1739, 1741, 1743, 1745, 1747-1756, 1758, 1760, 1762-1764, 1766, 1767, 1769, 1770, 1772-1774, 1776, 1778-1783, 1785-1792, 1794, 1796, 1798, 1799, 1801, 1802, 1804, 1806, 1808-1810, 1812, 1814, 1815, 1817, 1819, 1821, 1822, 1824, 1826-1830, 1832, 1834, 1835, 1837, 1839-1841, 1843, 1844, 1846, 1847, 1849, 1851, 1852, 1854, 1856, 1858, 1860-1863, 1865-1953, 1955-1958, 1960, 1962, 1964, 1966-1968, 1970, 1972-1976, 1978, 1980, 1982, 1984-1986, 1988, 1990, 1991, 1993, 1995, 1997, 1999, 2001, 2003, 2005, 2007, 2009, 2011, 2013, 2015, 2017, 2019, 2021, 2023-2027, 2029, 2031, 2033, 2035, 2037, 2039, 2041, 2043, 2045, 2047-2049, 2051-2057, 2059, 2061, 2063, 2065, 2067, 2069, 2071, 2073, 2075, 2077, 2079, 2080, 2082, 2084, 2086, 2088, 2090, 2092, 2093, 2095, 2097, 2098, 2100-2122, 2124, 2126, 2128, 2129, 2131, 2133, 2135-2137, 2139, 2141, 2142, 2144-2148, 2150, 2152, 2154, 2155, 2157, 2159-2161, 2163, 2165, 2166, 2168, 2170, 2172-2175, 2177, 2179, 2181, 2183, 2184, 2186, 2188, 2189, 2191-2194, 2196, 2197, 2199-2202, 2204, 2206-2208, 2210-2212, 2214, 2215, 2217-2220, 2222, 2224-2226, 2228, 2230-2232, 2234-2242, 2244-2254, 2256-2269, 2271, 2273, 2274, 2276, 2278, 2280, 2281, 2283, 2285, 2286, 2288, 2290, 2292, 2294, 2296, 2297, 2299, 2301, 2303, 2305, 2307, 2309, 2311, 2313, 2314, 2316-2318, 2320, 2322, 2324, 2326, 2327, 2329, 2331, 2333, 2335, 2337, 2339, 2341, 2342, 2344, 2345, 2347-2349, 2351, 2353, 2355, 2357, 2359, 2361, 2363, 2365, 2367-2369, 2371, 2373, 2375, 2377, 2379, 2381, 2383, 2385, 2386, 2388, 2390, 2391, 2393, 2395, 2397, 2399, 2400, 2402, 2404, 2405, 2407, 2409, 2411, 2413, 2415, 2417, 2419, 2421, 2423, 2425, 2426, 2428, 2430, 2431, 2433, 2435, 2437, 2438-2440, 2442, 2444, 2445, 2447, 2449, 2451, 2453, 2455, 2457, 2459, 2461, 2463-2468, 2470, 2472, 2474, 2476, 2478, 2479, 2481, 2482, 2484, 2485, 2487-2491, 2493-2498, 2500-2510, 2512-2515, 2517-2531, 2533-2536, 2538-2542, 2544-2548, 2550, 2551, 2553, 2555-2558, 2560, 2562, 2564, 2566-2573, 2575-2579, 2581, 2583-2585, 2587-2602, 2604-2611, 2613, 2615, 2617, and 2619-2623.

This document also features a method of modulating the level of biomass in a plant. The method includes introducing into a plant cell an exogenous nucleic acid, the exogenous nucleic acid comprising a regulatory region operably linked to a nucleotide sequence having 80 percent or greater sequence identity to a nucleotide sequence selected from the group consisting of SEQ ID NO: 1, 3, 5, 10, 12, 16, 19, 28, 30, 34, 37, 52, 55, 62, 68, 71, 77, 79, 84, 87, 92, 98, 104, 106, 108, 111, 114, 116, 118, 153, 155, 157, 160, 162, 164, 166, 169, 171, 173, 175, 177, 179, 186, 189, 191, 195, 197, 199, 201, 204, 206, 212, 252, 254, 256, 259, 263, 266, 273, 280, 284, 286, 293, 298, 300, 302, 306, 308, 311, 313, 315, 319, 322, 324, 326, 330, 333, 336, 340, 343, 346, 348, 350, 352, 354, 356, 358, 360, 367, 369, 371, 374, 379, 381, 388, 390, 392, 394, 397, 405, 415, 417, 419, 422, 424, 426, 428, 430, 432, 434, 436, 438, 440, 442, 444, 446, 448, 450, 452, 454, 456, 458, 460, 462, 464, 466, 468, 470, 472, 474, 476, 478, 480, 482, 484, 486, 488, 490, 492, 494, 496, 503, 505, 507, 510, 518, 520, 523, 528, 531, 534, 538, 540, 542, 544, 547, 549, 551, 556, 559, 561, 563, 565, 567, 569, 579, 581, 583, 586, 588, 590, 593, 597, 599, 602, 605, 609, 612, 614, 616, 618, 620, 622, 624, 627, 633, 635, 637, 639, 641, 644, 646, 648, 650, 652, 654, 656, 658, 660, 662, 664, 666, 671, 673, 676, 678, 683, 686, 688, 693, 699, 705, 708, 719, 721, 723, 725, 729, 732, 740, 742, 744, 747, 749, 751, 753, 755, 757, 759, 765, 767, 769, 771, 773, 775, 777, 779, 781, 783, 786, 788, 790, 792, 796, 798, 800, 802, 804, 807, 809, 811, 813, 815, 817, 821, 825, 827, 829, 831, 833, 835, 837, 841, 844, 848, 850, 852, 855, 859, 861, 864, 867, 869, 874, 879, 883, 887, 889, 891, 894, 896, 898, 901, 904, 906, 908, 910, 914, 916, 918, 920, 922, 924, 927, 929, 931, 934, 939, 942, 946, 948, 951, 956, 962, 964, 970, 973, 976, 979, 981, 983, 985, 987, 989, 991, 993, 995, 997, 999, 1015, 1017, 1019, 1022, 1025, 1028, 1031, 1034, 1036, 1039, 1041, 1044, 1046, 1048, 1050, 1052, 1054, 1056, 1058, 1060, 1064, 1066, 1068, 1071, 1074, 1077, 1081, 1084, 1086, 1088, 1090, 1092, 1094, 1097, 1099, 1102, 1104, 1107, 1109, 1111, 1113, 1117, 1119, 1124, 1126, 1132, 1135, 1138, 1146, 1157, 1162, 1164, 1179, 1189, 1192, 1203, 1208, 1214, 1216, 1222, 1229, 1232, 1242, 1244, 1246, 1248, 1253, 1256, 1260, 1262, 1265, 1273, 1277, 1279, 1281, 1287, 1290, 1332, 1338, 1340, 1342, 1344, 1346, 1351, 1353, 1355, 1357, 1359, 1361, 1363, 1365, 1367, 1369, 1373, 1376, 1380, 1382, 1385, 1387, 1391, 1398, 1401, 1404, 1406, 1411, 1419, 1421, 1423, 1425, 1427, 1429, 1431, 1437, 1439, 1441, 1445, 1448, 1451, 1455, 1458, 1461, 1464, 1469, 1472, 1474, 1476, 1484, 1486, 1488, 1490, 1494, 1497, 1500, 1502, 1505, 1507, 1509, 1512, 1515, 1522, 1525, 1527, 1533, 1535, 1540, 1543, 1546, 1549, 1551, 1554, 1560, 1562, 1566, 1569, 1572, 1574, 1577, 1579, 1581, 1584, 1586, 1588, 1591, 1594, 1596, 1598, 1601, 1607, 1614, 1617, 1627, 1630, 1632, 1635, 1638, 1644, 1740, 1742, 1744, 1746, 1757, 1759, 1761, 1765, 1768, 1771, 1775, 1777, 1784, 1793, 1795, 1797, 1800, 1803, 1805, 1807, 1811, 1813, 1816, 1818, 1820, 1823, 1825, 1831, 1833, 1836, 1838, 1842, 1845, 1848, 1850, 1853, 1855, 1857, 1859, 1864, 1954, 1959, 1961, 1963, 1965, 1969, 1971, 1977, 1979, 1981, 1983, 1987, 1989, 1992, 1994, 1996, 1998, 2000, 2002, 2004, 2006, 2008, 2010, 2012, 2014, 2016, 2018, 2020, 2022, 2028, 2030, 2032, 2034, 2036, 2038, 2040, 2042, 2044, 2046, 2050, 2058, 2060, 2062, 2064, 2066, 2068, 2070, 2072, 2074, 2076, 2078, 2081, 2083, 2085, 2087, 2089, 2091, 2094, 2096, 2099, 2123, 2125, 2127, 2130, 2132, 2134, 2138, 2140, 2143, 2149, 2151, 2153, 2156, 2158, 2162, 2164, 2167, 2169, 2171, 2176, 2178, 2180, 2182, 2185, 2187, 2190, 2195, 2198, 2203, 2205, 2209, 2213, 2216, 2221, 2223, 2227, 2229, 2233, 2243, 2255, 2270, 2272, 2275, 2277, 2279, 2282, 2284, 2287, 2289, 2291, 2293, 2295, 2298, 2300, 2302, 2304, 2306, 2308, 2310, 2312, 2315, 2319, 2321, 2323, 2325, 2328, 2330, 2332, 2334, 2336, 2338, 2340, 2343, 2346, 2350, 2352, 2354, 2356, 2358, 2360, 2362, 2364, 2366, 2370, 2372, 2374, 2376, 2378, 2380, 2382, 2384, 2387, 2389, 2392, 2394, 2396, 2398, 2401, 2403, 2406, 2408, 2410, 2412, 2414, 2416, 2418, 2420, 2422, 2424, 2427, 2429, 2432, 2434, 2436, 2441, 2443, 2446, 2448, 2450, 2452, 2454, 2456, 2458, 2460, 2462, 2469, 2471, 2473, 2475, 2477, 2480, 2483, 2486, 2492, 2499, 2511, 2516, 2532, 2537, 2543, 2549, 2552, 2554, 2559, 2561, 2563, 2565, 2574, 2580, 2582, 2586, 2603, 2612, 2614, 2616, and 2618, or a fragment thereof. A plant produced from the plant cell has a difference in the level of biomass as compared to the corresponding level of a control plant that does not include the nucleic acid.

This document also features a plant cell that includes an exogenous nucleic acid, the exogenous nucleic acid comprising a regulatory region operably linked to a nucleotide sequence encoding a polypeptide, wherein the HMM bit score of the amino acid sequence of the polypeptide is greater than about 65, the HMM based on the amino acid sequences depicted in one of FIGS. 1-38, and wherein the plant has a difference in the level of biomass as compared to the corresponding level of a control plant that does not include the nucleic acid. For example, the plant can have an increased level of biomass relative to the control plant.

In another aspect, this document features a plant cell that includes an exogenous nucleic acid. The exogenous nucleic acid includes a regulatory region operably linked to a nucleotide sequence encoding a polypeptide having 80 percent or greater sequence identity to an amino acid sequence selected from the group consisting of SEQ ID NO: 2, 4, 6-9, 11, 13-15, 17, 18, 20-27, 29, 31-33, 35, 36, 38-51, 53, 54, 56-61, 63-67, 69, 70, 72-76, 78, 80-83, 85, 86, 88-91, 93-97, 99-103, 105, 107, 109, 110, 112, 113, 115, 117, 119-152, 154, 156, 158, 159, 161, 163, 165, 167, 168, 170, 172, 174, 176, 178, 180-185, 187, 188, 190, 192-194, 196, 198, 200, 202, 203, 205, 207-211, 213-251, 253, 255, 257, 258, 260-262, 264, 265, 267-272, 274-279, 281-283, 285, 287-292, 294, 295-297, 299, 301, 303-305, 307, 309, 310, 312, 314, 316-318, 320, 321, 323, 325, 327-329, 331, 332, 334, 335, 337-339, 341, 342, 344, 345, 347, 349, 351, 353, 355, 357, 359, 361-366, 368, 370, 372, 373, 375-378, 380, 382-387, 389, 391, 393, 395, 396, 398-404, 406-414, 416, 418, 420, 421, 423, 425, 427, 429, 431, 433, 435, 437, 439, 441, 443, 445, 447, 449, 451, 453, 455, 457, 459, 461, 463, 465, 467, 469, 471, 473, 475, 477, 479, 481, 483, 485, 487, 489, 491, 493, 495, 497-502, 504, 506, 508, 509, 511-517, 519, 521, 522, 524-527, 529, 530, 532, 533, 535, 536, 537, 539, 541, 543, 545, 546, 548, 550, 552-555, 557, 558, 560, 562, 564, 566, 568, 570-578, 580, 582, 584, 585, 587, 589, 591, 592, 594-596, 598, 600, 601, 603, 604, 606-608, 610, 611, 613, 615, 617, 619, 621, 623, 625, 626, 628-632, 634, 636, 638, 640, 642, 643, 645, 647, 649, 651, 653, 655, 657, 659, 661, 663, 665, 667-670, 672, 674, 675, 677, 679-682, 684, 685, 687, 689-692, 694-698, 700-704, 706, 707, 709-718, 720, 722, 724, 726-728, 730, 731, 733-739, 741, 743, 745, 746, 748, 750, 752, 754, 756, 758, 760-764, 766, 768, 770, 772, 774, 776, 778, 780, 782, 784, 785, 787, 789, 791, 793-795, 797, 799, 801, 803, 805, 806, 808, 810, 812, 814, 816, 818-820, 822-824, 826, 828, 830, 832, 834, 836, 838-840, 842, 843, 845-847, 849, 851, 853, 854, 856-858, 860, 862, 863, 865, 866, 868, 870-873, 875-878, 880-882, 884-886, 888, 890, 892, 893, 895, 897, 899, 900, 902, 903, 905, 907, 909, 911, 912, 913, 915, 917, 919, 921, 923, 925, 926, 928, 930, 932, 933, 935, 936-938, 940, 941, 943-945, 947, 949, 950, 952-955, 957-961, 963, 965-969, 971, 972, 974, 975, 977, 978, 980, 982, 984, 986, 988, 990, 992, 994, 996, 998, 1000-1014, 1016, 1018, 1020, 1021, 1023, 1024, 1026, 1027, 1029, 1030, 1032, 1033, 1035, 1037, 1038, 1040, 1042, 1043, 1045, 1047, 1049, 1051, 1053, 1055, 1057, 1059, 1061-1063, 1065, 1067, 1069, 1070, 1072, 1073, 1075, 1076, 1078-1080, 1082, 1083, 1085, 1087, 1089, 1091, 1093, 1095, 1096, 1098, 1100, 1101, 1103, 1105, 1106, 1108, 1110, 1112, 1114-1116, 1118, 1120-1123, 1125, 1127-1131, 1133, 1134, 1136, 1137, 1139-1145, 1147-1156, 1158-1161, 1163, 1165-1178, 1180-1188, 1190, 1191, 1193-1202, 1204, 1205-1207, 1209-1213, 1215, 1217-1221, 1223-1228, 1230, 1231, 1233-1241, 1243, 1245, 1247, 1249-1252, 1254, 1255, 1257-1259, 1261, 1263, 1264, 1266-1272, 1274-1276, 1278, 1280, 1282-1286, 1288, 1289, 1291-1331, 1333-1337, 1339, 1341, 1343, 1345, 1347-1350, 1352, 1354, 1356, 1358, 1360, 1362, 1364, 1366, 1368, 1370-1372, 1374, 1375, 1377-1379, 1381, 1383, 1384, 1386, 1388-1390, 1392-1397, 1399, 1400, 1402, 1403, 1405, 1407-1410, 1412-1418, 1420, 1422, 1424, 1426, 1428, 1430, 1432-1436, 1438, 1440, 1442-1444, 1446, 1447, 1449, 1450, 1452-1454, 1456, 1457, 1459, 1460, 1462, 1463, 1465-1468, 1470, 1471, 1473, 1475, 1477-1483, 1485, 1487, 1489, 1491-1493, 1495, 1496, 1498, 1499, 1501, 1503, 1504, 1506, 1508, 1510, 1511, 1513, 1514, 1516-1521, 1523, 1524, 1526, 1528-1532, 1534, 1536-1539, 1541, 1542, 1544, 1545, 1547, 1548, 1550, 1552, 1553, 1555-1559, 1561, 1563-1565, 1567, 1568, 1570, 1571, 1573, 1575, 1576, 1578, 1580, 1582, 1583, 1585, 1587, 1589, 1590, 1592, 1593, 1595, 1597, 1599, 1600, 1602-1606, 1608-1613, 1615, 1616, 1618-1626, 1628, 1629, 1631, 1633, 1634, 1636, 1637, 1639-1643, 1645, 1646-1739, 1741, 1743, 1745, 1747-1756, 1758, 1760, 1762-1764, 1766, 1767, 1769, 1770, 1772-1774, 1776, 1778-1783, 1785-1792, 1794, 1796, 1798, 1799, 1801, 1802, 1804, 1806, 1808-1810, 1812, 1814, 1815, 1817, 1819, 1821, 1822, 1824, 1826-1830, 1832, 1834, 1835, 1837, 1839-1841, 1843, 1844, 1846, 1847, 1849, 1851, 1852, 1854, 1856, 1858, 1860-1863, 1865-1953, 1955-1958, 1960, 1962, 1964, 1966-1968, 1970, 1972-1976, 1978, 1980, 1982, 1984-1986, 1988, 1990, 1991, 1993, 1995, 1997, 1999, 2001, 2003, 2005, 2007, 2009, 2011, 2013, 2015, 2017, 2019, 2021, 2023-2027, 2029, 2031, 2033, 2035, 2037, 2039, 2041, 2043, 2045, 2047-2049, 2051-2057, 2059, 2061, 2063, 2065, 2067, 2069, 2071, 2073, 2075, 2077, 2079, 2080, 2082, 2084, 2086, 2088, 2090, 2092, 2093, 2095, 2097, 2098, 2100-2122, 2124, 2126, 2128, 2129, 2131, 2133, 2135-2137, 2139, 2141, 2142, 2144-2148, 2150, 2152, 2154, 2155, 2157, 2159-2161, 2163, 2165, 2166, 2168, 2170, 2172-2175, 2177, 2179, 2181, 2183, 2184, 2186, 2188, 2189, 2191-2194, 2196, 2197, 2199-2202, 2204, 2206-2208, 2210-2212, 2214, 2215, 2217-2220, 2222, 2224-2226, 2228, 2230-2232, 2234-2242, 2244-2254, 2256-2269, 2271, 2273, 2274, 2276, 2278, 2280, 2281, 2283, 2285, 2286, 2288, 2290, 2292, 2294, 2296, 2297, 2299, 2301, 2303, 2305, 2307, 2309, 2311, 2313, 2314, 2316-2318, 2320, 2322, 2324, 2326, 2327, 2329, 2331, 2333, 2335, 2337, 2339, 2341, 2342, 2344, 2345, 2347-2349, 2351, 2353, 2355, 2357, 2359, 2361, 2363, 2365, 2367-2369, 2371, 2373, 2375, 2377, 2379, 2381, 2383, 2385, 2386, 2388, 2390, 2391, 2393, 2395, 2397, 2399, 2400, 2402, 2404, 2405, 2407, 2409, 2411, 2413, 2415, 2417, 2419, 2421, 2423, 2425, 2426, 2428, 2430, 2431, 2433, 2435, 2437, 2438-2440, 2442, 2444, 2445, 2447, 2449, 2451, 2453, 2455, 2457, 2459, 2461, 2463-2468, 2470, 2472, 2474, 2476, 2478, 2479, 2481, 2482, 2484, 2485, 2487-2491, 2493-2498, 2500-2510, 2512-2515, 2517-2531, 2533-2536, 2538-2542, 2544-2548, 2550, 2551, 2553, 2555-2558, 2560, 2562, 2564, 2566-2573, 2575-2579, 2581, 2583-2585, 2587-2602, 2604-2611, 2613, 2615, 2617, and 2619-2623, wherein a plant produced from said plant cell has a difference in the level of biomass as compared to the corresponding level of a control plant that does not comprise said nucleic acid. For example, the plant can have an increased level of biomass relative to the control plant.

This document also features a plant cell that includes an exogenous nucleic acid. The exogenous nucleic acid includes a regulatory region operably linked to a nucleotide sequence having 80 percent or greater sequence identity to a nucleotide sequence selected from the group consisting of SEQ ID NO: 1, 3, 5, 10, 12, 16, 19, 28, 30, 34, 37, 52, 55, 62, 68, 71, 77, 79, 84, 87, 92, 98, 104, 106, 108, 111, 114, 116, 118, 153, 155, 157, 160, 162, 164, 166, 169, 171, 173, 175, 177, 179, 186, 189, 191, 195, 197, 199, 201, 204, 206, 212, 252, 254, 256, 259, 263, 266, 273, 280, 284, 286, 293, 298, 300, 302, 306, 308, 311, 313, 315, 319, 322, 324, 326, 330, 333, 336, 340, 343, 346, 348, 350, 352, 354, 356, 358, 360, 367, 369, 371, 374, 379, 381, 388, 390, 392, 394, 397, 405, 415, 417, 419, 422, 424, 426, 428, 430, 432, 434, 436, 438, 440, 442, 444, 446, 448, 450, 452, 454, 456, 458, 460, 462, 464, 466, 468, 470, 472, 474, 476, 478, 480, 482, 484, 486, 488, 490, 492, 494, 496, 503, 505, 507, 510, 518, 520, 523, 528, 531, 534, 538, 540, 542, 544, 547, 549, 551, 556, 559, 561, 563, 565, 567, 569, 579, 581, 583, 586, 588, 590, 593, 597, 599, 602, 605, 609, 612, 614, 616, 618, 620, 622, 624, 627, 633, 635, 637, 639, 641, 644, 646, 648, 650, 652, 654, 656, 658, 660, 662, 664, 666, 671, 673, 676, 678, 683, 686, 688, 693, 699, 705, 708, 719, 721, 723, 725, 729, 732, 740, 742, 744, 747, 749, 751, 753, 755, 757, 759, 765, 767, 769, 771, 773, 775, 777, 779, 781, 783, 786, 788, 790, 792, 796, 798, 800, 802, 804, 807, 809, 811, 813, 815, 817, 821, 825, 827, 829, 831, 833, 835, 837, 841, 844, 848, 850, 852, 855, 859, 861, 864, 867, 869, 874, 879, 883, 887, 889, 891, 894, 896, 898, 901, 904, 906, 908, 910, 914, 916, 918, 920, 922, 924, 927, 929, 931, 934, 939, 942, 946, 948, 951, 956, 962, 964, 970, 973, 976, 979, 981, 983, 985, 987, 989, 991, 993, 995, 997, 999, 1015, 1017, 1019, 1022, 1025, 1028, 1031, 1034, 1036, 1039, 1041, 1044, 1046, 1048, 1050, 1052, 1054, 1056, 1058, 1060, 1064, 1066, 1068, 1071, 1074, 1077, 1081, 1084, 1086, 1088, 1090, 1092, 1094, 1097, 1099, 1102, 1104, 1107, 1109, 1111, 1113, 1117, 1119, 1124, 1126, 1132, 1135, 1138, 1146, 1157, 1162, 1164, 1179, 1189, 1192, 1203, 1208, 1214, 1216, 1222, 1229, 1232, 1242, 1244, 1246, 1248, 1253, 1256, 1260, 1262, 1265, 1273, 1277, 1279, 1281, 1287, 1290, 1332, 1338, 1340, 1342, 1344, 1346, 1351, 1353, 1355, 1357, 1359, 1361, 1363, 1365, 1367, 1369, 1373, 1376, 1380, 1382, 1385, 1387, 1391, 1398, 1401, 1404, 1406, 1411, 1419, 1421, 1423, 1425, 1427, 1429, 1431, 1437, 1439, 1441, 1445, 1448, 1451, 1455, 1458, 1461, 1464, 1469, 1472, 1474, 1476, 1484, 1486, 1488, 1490, 1494, 1497, 1500, 1502, 1505, 1507, 1509, 1512, 1515, 1522, 1525, 1527, 1533, 1535, 1540, 1543, 1546, 1549, 1551, 1554, 1560, 1562, 1566, 1569, 1572, 1574, 1577, 1579, 1581, 1584, 1586, 1588, 1591, 1594, 1596, 1598, 1601, 1607, 1614, 1617, 1627, 1630, 1632, 1635, 1638, 1644, 1740, 1742, 1744, 1746, 1757, 1759, 1761, 1765, 1768, 1771, 1775, 1777, 1784, 1793, 1795, 1797, 1800, 1803, 1805, 1807, 1811, 1813, 1816, 1818, 1820, 1823, 1825, 1831, 1833, 1836, 1838, 1842, 1845, 1848, 1850, 1853, 1855, 1857, 1859, 1864, 1954, 1959, 1961, 1963, 1965, 1969, 1971, 1977, 1979, 1981, 1983, 1987, 1989, 1992, 1994, 1996, 1998, 2000, 2002, 2004, 2006, 2008, 2010, 2012, 2014, 2016, 2018, 2020, 2022, 2028, 2030, 2032, 2034, 2036, 2038, 2040, 2042, 2044, 2046, 2050, 2058, 2060, 2062, 2064, 2066, 2068, 2070, 2072, 2074, 2076, 2078, 2081, 2083, 2085, 2087, 2089, 2091, 2094, 2096, 2099, 2123, 2125, 2127, 2130, 2132, 2134, 2138, 2140, 2143, 2149, 2151, 2153, 2156, 2158, 2162, 2164, 2167, 2169, 2171, 2176, 2178, 2180, 2182, 2185, 2187, 2190, 2195, 2198, 2203, 2205, 2209, 2213, 2216, 2221, 2223, 2227, 2229, 2233, 2243, 2255, 2270, 2272, 2275, 2277, 2279, 2282, 2284, 2287, 2289, 2291, 2293, 2295, 2298, 2300, 2302, 2304, 2306, 2308, 2310, 2312, 2315, 2319, 2321, 2323, 2325, 2328, 2330, 2332, 2334, 2336, 2338, 2340, 2343, 2346, 2350, 2352, 2354, 2356, 2358, 2360, 2362, 2364, 2366, 2370, 2372, 2374, 2376, 2378, 2380, 2382, 2384, 2387, 2389, 2392, 2394, 2396, 2398, 2401, 2403, 2406, 2408, 2410, 2412, 2414, 2416, 2418, 2420, 2422, 2424, 2427, 2429, 2432, 2434, 2436, 2441, 2443, 2446, 2448, 2450, 2452, 2454, 2456, 2458, 2460, 2462, 2469, 2471, 2473, 2475, 2477, 2480, 2483, 2486, 2492, 2499, 2511, 2516, 2532, 2537, 2543, 2549, 2552, 2554, 2559, 2561, 2563, 2565, 2574, 2580, 2582, 2586, 2603, 2612, 2614, 2616, and 2618, or a fragment thereof. A plant produced from the plant cell has a difference in the level of biomass as compared to the corresponding level of a control plant that does not include the nucleic acid. For example, the plant can have an increased level of biomass relative to the control plant.

This document also features a transgenic plant that includes any of the plant cells described herein and seed product comprising embryonic tissue from such a transgenic plant. The plant can be a member of a species selected from the group consisting of *Panicum virgatum* (switchgrass), *Sorghum bicolor* (sorghum, sudangrass), *Miscanthus giganteus* (miscanthus), *Saccharum* sp. (energycane), *Populus balsamifera* (poplar), *Zea mays* (corn), *Glycine max* (soybean), *Brassica napus* (canola), *Triticum aestivum* (wheat), *Gossypium hirsutum* (cotton), *Oryza sativa* (rice), *Helianthus annuus* (sunflower), *Medicago sativa* (alfalfa), *Beta vulgaris* (sugarbeet), or *Pennisetum glaucum* (pearl millet).

In another aspect, this document features an isolated nucleic acid comprising a nucleotide sequence having 85% or greater sequence identity to the nucleotide sequence set forth in SEQ ID NO: 1, 10, 30, 34, 55, 71, 84, 87, 92, 98, 162, 164, 171, 173, 179, 191, 206, 212, 259, 263, 273, 280, 284, 286, 298, 302, 306, 311, 326, 330, 340, 343, 348, 354, 374, 379, 390, 392, 394, 397, 417, 424, 452, 462, 470, 484, 496, 507, 510, 518, 540, 544, 549, 556, 561, 565, 567, 569, 588, 599, 614, 618, 646, 671, 673, 683, 688, 693, 848, 869, 894, 896, 920, 922, 1034, 1039, 1041, 1044, 1048, 1050, 1056, 1157, 1229, 1260, 1262, 1265, 1273, 1281, 1373, 1406, 1421, 1423, 1427, 1431, 1439, 1448, 1458, 1469, 1472, 1474, 1494, 1502, 1505, 1522, 1525, 1527, 1535, 1551, 1554, 1560, 1569, 1574, 1577, 1581, 1584, 1614, 1632, or 1635.

This document also features an isolated nucleic acid that includes a nucleotide sequence encoding a polypeptide having 80% or greater sequence identity to the amino acid sequence set forth in SEQ ID NO: 2, 8, 9, 11, 14, 15, 18, 21, 22, 23, 24, 25, 26, 27, 31, 32, 35, 40, 41, 47, 48, 49, 50, 51, 56, 72, 83, 99, 100, 102, 121, 129, 132, 135, 137, 139, 140, 141, 142, 143, 144, 145, 146, 147, 152, 159, 163, 165, 168, 172, 174, 180, 181, 184, 185, 192, 193, 207, 208, 209, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 258, 260, 261, 262, 264, 268, 269, 270, 274, 275, 276, 277, 278, 279, 281, 282, 283, 285, 287, 288, 289, 290, 291, 295, 296, 299, 303, 305, 307, 312, 317, 327, 331, 338, 339, 341, 342, 344, 349, 355, 362, 366, 373, 375, 376, 377, 378, 380, 384, 386, 387, 391, 393, 395, 396, 398, 399, 400, 401, 402, 403, 404, 407, 408, 409, 410, 411, 412, 414, 418, 421, 425, 453, 463, 471, 485, 497, 501, 511, 512, 514, 516, 519, 522, 525, 533, 536, 537, 541, 545, 546, 550, 553, 554, 557, 558, 562, 566, 568, 570, 573, 575, 576, 578, 589, 592, 595, 596, 601, 607, 608, 611, 615, 619, 626, 629, 668, 670, 672, 674, 675, 680, 682, 684, 685, 689, 690, 691, 692, 694, 695, 696, 698, 701, 702, 703, 704, 710, 713, 715, 727, 728, 731, 737, 738, 739, 787, 849, 866, 868, 870, 881, 895, 897, 900, 923, 926, 978, 1004, 1006, 1008, 1009, 1013, 1030, 1033, 1035, 1038, 1040, 1042, 1043, 1045, 1049, 1051, 1057, 1061, 1063, 1083, 1096, 1115, 1121, 1122, 1123, 1144, 1152, 1153, 1156, 1166, 1167, 1168, 1169, 1170, 1176, 1177, 1178, 1184, 1191, 1194, 1195, 1199, 1202, 1206, 1207, 1219, 1221, 1224, 1225, 1226, 1227, 1228, 1230, 1231, 1237, 1238, 1239, 1240, 1241, 1258, 1259, 1261, 1263, 1264, 1266, 1267, 1269, 1270, 1271, 1272, 1274, 1276, 1282, 1284, 1285, 1286, 1289, 1292, 1293, 1294, 1295, 1296, 1297, 1298, 1299, 1300, 1301, 1302, 1303, 1304, 1305, 1311, 1314, 1319, 1322, 1323, 1327, 1329, 1371, 1372, 1374, 1378, 1384, 1390, 1393, 1395, 1396, 1400, 1403, 1407, 1408, 1409, 1410, 1413, 1414, 1415, 1416, 1417, 1422, 1424, 1428, 1432, 1433, 1434, 1435, 1436, 1440, 1443, 1444, 1449, 1450, 1457, 1459, 1467, 1468, 1470, 1473, 1475, 1479, 1480, 1481, 1482, 1483, 1492, 1495, 1496, 1499, 1503, 1506, 1518, 1519, 1521, 1523, 1524, 1526, 1528, 1529, 1530, 1532, 1536, 1537, 1548, 1552, 1553, 1555, 1557, 1558, 1559, 1561, 1570, 1575, 1576, 1578, 1582, 1583, 1585, 1593, 1603, 1604, 1609, 1610, 1611, 1612, 1613, 1615, 1616, 1622, 1623, 1624, 1625, 1626, 1629, 1633, 1634, 1636, 1641, 1642, 1643, 1646, 1647, 1648, 1651, 1652, 1653, 1654, 1655, 1656, 1657, 1658, 1659, 1660, 1661, 1662, 1663, 1664, 1665, 1666, 1667, 1668, 1669, 1670, 1671, 1672, 1673, 1674, 1675, 1676, 1677, 1678, 1679, 1680, 1681, 1682, 1683, 1684, 1685, 1687, 1688, 1689, 1690, 1691, 1692, 1693, 1694, 1695, 1696, 1697, 1698, 1699, 1700, 1701, 1702, 1703, 1704, 1705, 1706, 1707, 1708, 1709, 1710, 1711, 1712, 1713, 1714, 1715, 1716, 1717, 1718, 1719, 1720, 1721, 1722, 1723, 1724, 1725, 1726, 1727, 1728, 1729, 1730, or 1731.

This document also features an isolated nucleic acid that includes a nucleotide sequence encoding a polypeptide having 80% or greater sequence identity to the amino acid sequence set forth in SEQ ID NO: 599, 1759, 1765, 1797, 1807, 1818, 1833, 1836, 1845, 1853, 1855, 1857, 1959, 1963, 1965, 1994, 1996, 2000, 2004, 2040, 2064, 2066, 2070, 2072, 2081, 2083, 2085, 2091, 2151, 2164, 2176, 2190, 2198, 2203, 2205, 2221, 2223, 2227, 2229, 2255, 2291, 2300, 2310, 2325, 2330, 2334, 2338, 2346, 2354, 2376, 2389, 2394, 2396, 2429, 2432, 2436, 2443, 2450, 2452, 2456, 2458, 2469, 2473, 2475, 2477, 2480, 2483, 2499, 2532, 2543, 2549, 2552, or 2574.

In some embodiments, this document features an isolated nucleic acid that includes a nucleotide sequence encoding a polypeptide having 80% or greater sequence identity to the amino acid sequence set forth in SEQ ID NO:1061, 1593, 1751, 1815, 1819, 1822, 1827, 1829, 1834, 1837, 1840, 1841, 1846, 1852, 1854, 1856, 1858, 1861, 1862, 1863, 1866, 1867, 1868, 1869 1870, 1871, 1872, 1873, 1874, 1875, 1876, 1877, 1878, 1879, 1880, 1881, 1882, 1883, 1884, 1885, 1886, 1887, 1888, 1889, 1890, 1891, 1892, 1893, 1894, 1895, 1896, 1897, 1898, 1899, 1900, 1901, 1902, 1903, 1904, 1905, 1906, 1907, 1908, 1909, 1910, 1911, 1912, 1913, 1914, 1915, 1916, 1917, 1918, 1919, 1920, 1921, 1922, 1923, 1924, 1925, 1926, 1927, 1928, 1929, 1930, 1931, 1932, 1933, 1934, 1935, 1936, 1937, 1938, 1939, 1940, 1941, 1942, 1943, 1944, 1945, 1946, 1947, 1948, 1949, 1950, 1951, 1952, 1953, 1960, 1964, 1966, 1974, 1975, 1985, 1986, 1995, 2001, 2005, 2007, 2024, 2026, 2052, 2054, 2055, 2092, 2098, 2101, 2102, 2103, 2104, 2105, 2106, 2107, 2109, 2110, 2111, 2112, 2113, 2114, 2115, 2116, 2117, 2118, 2119, 2120, 2121, 2122, 2129, 2145, 2146, 2147, 2148, 2152, 2155, 2165, 2177, 2189, 2192, 2194, 2199, 2200, 2201, 2202, 2206, 2218, 2219, 2222, 2224, 2230, 2232, 2235, 2245, 2246, 2248, 2249, 2250, 2251, 2252, 2253, 2254, 2256, 2257, 2258, 2259, 2260, 2261, 2262, 2263, 2264, 2265, 2266, 2267, 2268, 2269, 2274, 2281, 2286, 2292, 2301, 2311, 2314, 2317, 2326, 2327, 2331, 2335, 2339, 2349, 2377, 2390, 2395, 2397, 2405, 2426, 2430, 2431, 2433, 2437, 2440, 2444, 2445, 2451, 2453, 2457, 2459, 2470, 2474, 2476, 2478, 2481, 2482, 2484, 2491, 2494, 2495, 2496, 2497, 2498, 2500, 2501, 2502, 2503, 2504, 2505, 2506, 2507, 2508, 2509, 2518, 2519, 2520, 2521, 2522, 2523, 2524, 2525, 2526, 2527, 2528, 2529, 2530, 2531, 2533, 2534, 2535, 2536, 2539, 2540, 2541, 2542, 2544, 2545, 2546, 2547, 2548, 2550, 2551, 2553, 2556, 2557, 2558, 2568, 2569, 2570, 2576, or 2577.

In another aspect, this document features a method of identifying whether a polymorphism is associated with variation in a trait (e.g., dry matter yield). The method includes determining whether one or more genetic polymorphisms in a population of plants (e.g., switchgrass plants) is associated with the locus for a polypeptide selected from the group consisting of the polypeptides depicted in FIGS. 1-38 and functional homologs thereof; and measuring the correlation between variation in the trait in plants of the population and the presence of the one or more genetic polymorphisms in plants of the population, thereby identifying whether or not the one or more genetic polymorphisms are associated with variation in the trait.

A method of making a plant line also is featured. The method includes determining whether one or more genetic polymorphisms in a population of plants (e.g., switchgrass plants) is associated with the locus for a polypeptide selected from the group consisting of the polypeptides depicted in FIGS. 1-38 and functional homologs thereof; identifying one or more plants in the population in which the presence of at least one of the genetic polymorphisms is associated with variation in a biomass trait (e.g., dry matter yield); crossing one or more of the identified plants with itself or a different plant to produce seed; crossing at least one progeny plant grown from the seed with itself or a different plant; and repeating the crossing steps for an additional 0-5 generations to make the plant line, wherein at least one of the genetic polymorphisms is present in the plant line.

This document also features a method of producing a plant. The method includes growing a plant cell comprising an exogenous nucleic acid, the exogenous nucleic acid comprising a regulatory region operably linked to a nucleotide sequence encoding a polypeptide, wherein the HMM bit score of the amino acid sequence of the polypeptide is greater than about 65, the HMM based on the amino acid sequences depicted in one of FIG. 15, 16, 18, 19, 23, 24, or 25, and wherein the plant has an increase in panicle weight as compared to the corresponding level of a control plant that does not comprise the nucleic acid.

A method of producing a plant also is featured. The method includes growing a plant cell comprising an exogenous nucleic acid, the exogenous nucleic acid comprising a regulatory region operably linked to a nucleotide sequence encoding a polypeptide having 80 percent or greater sequence identity to an amino acid sequence selected from the group consisting of SEQ ID NOs:154, 368, 634, 851, 1016, 1035, 1580, and 1592, wherein a plant produced from the plant cell has an increase in panicle weight as compared to the corresponding level of a control plant that does not include the nucleic acid.

This document also features a method of producing a plant that includes growing a plant cell comprising an exogenous nucleic acid, the exogenous nucleic acid comprising a regulatory region operably linked to a nucleotide sequence having 80 percent or greater sequence identity to a nucleotide sequence selected from the group consisting of SEQ ID NOs: 153, 367, 633, 850, 1015, 1034, 1579, 1591, or a fragment thereof, wherein a plant produced from the plant cell has an increased in panicle weight as compared to the corresponding level of a control plant that does not include the nucleic acid.

In another aspect, this document features a method of altering the level of biomass in a plant. The method includes modifying an endogenous biomass-modulating nucleic acid, the nucleic acid comprising a nucleotide sequence with an open reading frame having 80 percent or greater sequence identity (e.g., 90% or 95% sequence identity) to the nucleotide sequence selected from the group consisting of SEQ ID NO: 1, 3, 5, 10, 12, 16, 19, 28, 30, 34, 37, 52, 55, 62, 68, 71, 77, 79, 84, 87, 92, 98, 104, 106, 108, 111, 114, 116, 118, 153, 155, 157, 160, 162, 164, 166, 169, 171, 173, 175, 177, 179, 186, 189, 191, 195, 197, 199, 201, 204, 206, 212, 252, 254, 256, 259, 263, 266, 273, 280, 284, 286, 293, 298, 300, 302, 306, 308, 311, 313, 315, 319, 322, 324, 326, 330, 333, 336, 340, 343, 346, 348, 350, 352, 354, 356, 358, 360, 367, 369, 371, 374, 379, 381, 388, 390, 392, 394, 397, 405, 415, 417, 419, 422, 424, 426, 428, 430, 432, 434, 436, 438, 440, 442, 444, 446, 448, 450, 452, 454, 456, 458, 460, 462, 464, 466, 468, 470, 472, 474, 476, 478, 480, 482, 484, 486, 488, 490, 492, 494, 496, 503, 505, 507, 510, 518, 520, 523, 528, 531, 534, 538, 540, 542, 544, 547, 549, 551, 556, 559, 561, 563, 565, 567, 569, 579, 581, 583, 586, 588, 590, 593, 597, 599, 602, 605, 609, 612, 614, 616, 618, 620, 622, 624, 627, 633, 635, 637, 639, 641, 644, 646, 648, 650, 652, 654, 656, 658, 660, 662, 664, 666, 671, 673, 676, 678, 683, 686, 688, 693, 699, 705, 708, 719, 721, 723, 725, 729, 732, 740, 742, 744, 747, 749, 751, 753, 755, 757, 759, 765, 767, 769, 771, 773, 775, 777, 779, 781, 783, 786, 788, 790, 792, 796, 798, 800, 802, 804, 807, 809, 811, 813, 815, 817, 821, 825, 827, 829, 831, 833, 835, 837, 841, 844, 848, 850, 852, 855, 859, 861, 864, 867, 869, 874, 879, 883, 887, 889, 891, 894, 896, 898, 901, 904, 906, 908, 910, 914, 916, 918, 920, 922, 924, 927, 929, 931, 934, 939, 942, 946, 948, 951, 956, 962, 964, 970, 973, 976, 979, 981, 983, 985, 987, 989, 991, 993, 995, 997, 999, 1015, 1017, 1019, 1022, 1025, 1028, 1031, 1034, 1036, 1039, 1041, 1044, 1046, 1048, 1050, 1052, 1054, 1056, 1058, 1060, 1064, 1066, 1068, 1071, 1074, 1077, 1081, 1084, 1086, 1088, 1090, 1092, 1094, 1097, 1099, 1102, 1104, 1107, 1109, 1111, 1113, 1117, 1119, 1124, 1126, 1132, 1135, 1138, 1146, 1157, 1162, 1164, 1179, 1189, 1192, 1203, 1208, 1214, 1216, 1222, 1229, 1232, 1242, 1244, 1246, 1248, 1253, 1256, 1260, 1262, 1265, 1273, 1277, 1279, 1281, 1287, 1290, 1332, 1338, 1340, 1342, 1344, 1346, 1351, 1353, 1355, 1357, 1359, 1361, 1363, 1365, 1367, 1369, 1373, 1376, 1380, 1382, 1385, 1387, 1391, 1398, 1401, 1404, 1406, 1411, 1419, 1421, 1423, 1425, 1427, 1429, 1431, 1437, 1439, 1441, 1445, 1448, 1451, 1455, 1458, 1461, 1464, 1469, 1472, 1474, 1476, 1484, 1486, 1488, 1490, 1494, 1497, 1500, 1502, 1505, 1507, 1509, 1512, 1515, 1522, 1525, 1527, 1533, 1535, 1540, 1543, 1546, 1549, 1551, 1554, 1560, 1562, 1566, 1569, 1572, 1574, 1577, 1579, 1581, 1584, 1586, 1588, 1591, 1594, 1596, 1598, 1601, 1607, 1614, 1617, 1627, 1630, 1632, 1635, 1638, 1644, 1740, 1742, 1744, 1746, 1757, 1759, 1761, 1765, 1768, 1771, 1775, 1777, 1784, 1793, 1795, 1797, 1800, 1803, 1805, 1807, 1811, 1813, 1816, 1818, 1820, 1823, 1825, 1831, 1833, 1836, 1838, 1842, 1845, 1848, 1850, 1853, 1855, 1857, 1859, 1864, 1954, 1959, 1961, 1963, 1965, 1969, 1971, 1977, 1979, 1981, 1983, 1987, 1989, 1992, 1994, 1996, 1998, 2000, 2002, 2004, 2006, 2008, 2010, 2012, 2014, 2016, 2018, 2020, 2022, 2028, 2030, 2032, 2034, 2036, 2038, 2040, 2042, 2044, 2046, 2050, 2058, 2060, 2062, 2064, 2066, 2068, 2070, 2072, 2074, 2076, 2078, 2081, 2083, 2085, 2087, 2089, 2091, 2094, 2096, 2099, 2123, 2125, 2127, 2130, 2132, 2134, 2138, 2140, 2143, 2149, 2151, 2153, 2156, 2158, 2162, 2164, 2167, 2169, 2171, 2176, 2178, 2180, 2182, 2185, 2187, 2190, 2195, 2198, 2203, 2205, 2209, 2213, 2216, 2221, 2223, 2227, 2229, 2233, 2243, 2255, 2270, 2272, 2275, 2277, 2279, 2282, 2284, 2287, 2289, 2291, 2293, 2295, 2298, 2300, 2302, 2304, 2306, 2308, 2310, 2312, 2315, 2319, 2321, 2323, 2325, 2328, 2330, 2332, 2334, 2336, 2338, 2340, 2343, 2346, 2350, 2352, 2354, 2356, 2358, 2360, 2362, 2364, 2366, 2370, 2372, 2374, 2376, 2378, 2380, 2382, 2384, 2387, 2389, 2392, 2394, 2396, 2398, 2401, 2403, 2406, 2408, 2410, 2412, 2414, 2416, 2418, 2420, 2422, 2424, 2427, 2429, 2432, 2434, 2436, 2441, 2443, 2446, 2448, 2450, 2452, 2454, 2456, 2458, 2460, 2462, 2469, 2471, 2473, 2475, 2477, 2480, 2483, 2486, 2492, 2499, 2511, 2516, 2532, 2537, 2543, 2549, 2552, 2554, 2559, 2561, 2563, 2565, 2574, 2580, 2582, 2586, 2603, 2612, 2614, 2616, and 2618. The plant has a difference in the level of biomass as compared to the corresponding level of a control plant where the nucleic acid has not been modified. The modification can be effected by introducing a genetic modification in the locus comprising the nucleic acid. The method further can include selecting for plants having altered biomass.

The endogenous nucleic acid can encode a polypeptide having 80 percent or greater sequence identity to an amino acid sequence selected from the group consisting of SEQ ID NO: 2, 4, 6-9, 11, 13-15, 17, 18, 20-27, 29, 31-33, 35, 36, 38-51, 53, 54, 56-61, 63-67, 69, 70, 72-76, 78, 80-83, 85, 86, 88-91, 93-97, 99-103, 105, 107, 109, 110, 112, 113, 115, 117, 119-152, 154, 156, 158, 159, 161, 163, 165, 167, 168, 170, 172, 174, 176, 178, 180-185, 187, 188, 190, 192-194, 196, 198, 200, 202, 203, 205, 207-211, 213-251, 253, 255, 257, 258, 260-262, 264, 265, 267-272, 274-279, 281-283, 285, 287-292, 294, 295-297, 299, 301, 303-305, 307, 309, 310, 312, 314, 316-318, 320, 321, 323, 325, 327-329, 331, 332, 334, 335, 337-339, 341, 342, 344, 345, 347, 349, 351, 353, 355, 357, 359, 361-366, 368, 370, 372, 373, 375-378, 380, 382-387, 389, 391, 393, 395, 396, 398-404, 406-414, 416, 418, 420, 421, 423, 425, 427, 429, 431, 433, 435, 437, 439, 441, 443, 445, 447, 449, 451, 453, 455, 457, 459, 461, 463, 465, 467, 469, 471, 473, 475, 477, 479, 481, 483, 485, 487, 489, 491, 493, 495, 497-502, 504, 506, 508, 509, 511-517, 519, 521, 522, 524-527, 529, 530, 532, 533, 535, 536, 537, 539, 541, 543, 545, 546, 548, 550, 552-555, 557, 558, 560, 562, 564, 566, 568, 570-578, 580, 582, 584, 585, 587, 589, 591, 592, 594-596, 598, 600, 601, 603, 604, 606-608, 610, 611, 613, 615, 617, 619, 621, 623, 625, 626, 628-632, 634, 636, 638, 640, 642, 643, 645, 647, 649, 651, 653, 655, 657, 659, 661, 663, 665, 667-670, 672, 674, 675, 677, 679-682, 684, 685, 687, 689-692, 694-698, 700-704, 706, 707, 709-718, 720, 722, 724, 726-728, 730, 731, 733-739, 741, 743, 745, 746, 748, 750, 752, 754, 756, 758, 760-764, 766, 768, 770, 772, 774, 776, 778, 780, 782, 784, 785, 787, 789, 791, 793-795, 797, 799, 801, 803, 805, 806, 808, 810, 812, 814, 816, 818-820, 822-824, 826, 828, 830, 832, 834, 836, 838-840, 842, 843, 845-847, 849, 851, 853, 854, 856-858, 860, 862, 863, 865, 866, 868, 870-873, 875-878, 880-882, 884-886, 888, 890, 892, 893, 895, 897, 899, 900, 902, 903, 905, 907, 909, 911, 912, 913, 915, 917, 919, 921, 923, 925, 926, 928, 930, 932, 933, 935, 936-938, 940, 941, 943-945, 947, 949, 950, 952-955, 957-961, 963, 965-969, 971, 972, 974, 975, 977, 978, 980, 982, 984, 986, 988, 990, 992, 994, 996, 998, 1000-1014, 1016, 1018, 1020, 1021, 1023, 1024, 1026, 1027, 1029, 1030, 1032, 1033, 1035, 1037, 1038, 1040, 1042, 1043, 1045, 1047, 1049, 1051, 1053, 1055, 1057, 1059, 1061-1063, 1065, 1067, 1069, 1070, 1072, 1073, 1075, 1076, 1078-1080, 1082, 1083, 1085, 1087, 1089, 1091, 1093, 1095, 1096, 1098, 1100, 1101, 1103, 1105, 1106, 1108, 1110, 1112, 1114-1116, 1118, 1120-1123, 1125, 1127-1131, 1133, 1134, 1136, 1137, 1139-1145, 1147-1156, 1158-1161, 1163, 1165-1178, 1180-1188, 1190, 1191, 1193-1202, 1204, 1205-1207, 1209-1213, 1215, 1217-1221, 1223-1228, 1230, 1231, 1233-1241, 1243, 1245, 1247, 1249-1252, 1254, 1255, 1257-1259, 1261, 1263, 1264, 1266-1272, 1274-1276, 1278, 1280, 1282-1286, 1288, 1289, 1291-1331, 1333-1337, 1339, 1341, 1343, 1345, 1347-1350, 1352, 1354, 1356, 1358, 1360, 1362, 1364, 1366, 1368, 1370-1372, 1374, 1375, 1377-1379, 1381, 1383, 1384, 1386, 1388-1390, 1392-1397, 1399, 1400, 1402, 1403, 1405, 1407-1410, 1412-1418, 1420, 1422, 1424, 1426, 1428, 1430, 1432-1436, 1438, 1440, 1442-1444, 1446, 1447, 1449, 1450, 1452-1454, 1456, 1457, 1459, 1460, 1462, 1463, 1465-1468, 1470, 1471, 1473, 1475, 1477-1483, 1485, 1487, 1489, 1491-1493, 1495, 1496, 1498, 1499, 1501, 1503, 1504, 1506, 1508, 1510, 1511, 1513, 1514, 1516-1521, 1523, 1524, 1526, 1528-1532, 1534, 1536-1539, 1541, 1542, 1544, 1545, 1547, 1548, 1550, 1552, 1553, 1555-1559, 1561, 1563-1565, 1567, 1568, 1570, 1571, 1573, 1575, 1576, 1578, 1580, 1582, 1583, 1585, 1587, 1589, 1590, 1592, 1593, 1595, 1597, 1599, 1600, 1602-1606, 1608-1613, 1615, 1616, 1618-1626, 1628, 1629, 1631, 1633, 1634, 1636, 1637, 1639-1643, 1645, 1646-1739, 1741, 1743, 1745, 1747-1756, 1758, 1760, 1762-1764, 1766, 1767, 1769, 1770, 1772-1774, 1776, 1778-1783, 1785-1792, 1794, 1796, 1798, 1799, 1801, 1802, 1804, 1806, 1808-1810, 1812, 1814, 1815, 1817, 1819, 1821, 1822, 1824, 1826-1830, 1832, 1834, 1835, 1837, 1839-1841, 1843, 1844, 1846, 1847, 1849, 1851, 1852, 1854, 1856, 1858, 1860-1863, 1865-1953, 1955-1958, 1960, 1962, 1964, 1966-1968, 1970, 1972-1976, 1978, 1980, 1982, 1984-1986, 1988, 1990, 1991, 1993, 1995, 1997, 1999, 2001, 2003, 2005, 2007, 2009, 2011, 2013, 2015, 2017, 2019, 2021, 2023-2027, 2029, 2031, 2033, 2035, 2037, 2039, 2041, 2043, 2045, 2047-2049, 2051-2057, 2059, 2061, 2063, 2065, 2067, 2069, 2071, 2073, 2075, 2077, 2079, 2080, 2082, 2084, 2086, 2088, 2090, 2092, 2093, 2095, 2097, 2098, 2100-2122, 2124, 2126, 2128, 2129, 2131, 2133, 2135-2137, 2139, 2141, 2142, 2144-2148, 2150, 2152, 2154, 2155, 2157, 2159-2161, 2163, 2165, 2166, 2168, 2170, 2172-2175, 2177, 2179, 2181, 2183, 2184, 2186, 2188, 2189, 2191-2194, 2196, 2197, 2199-2202, 2204, 2206-2208, 2210-2212, 2214, 2215, 2217-2220, 2222, 2224-2226, 2228, 2230-2232, 2234-2242, 2244-2254, 2256-2269, 2271, 2273, 2274, 2276, 2278, 2280, 2281, 2283, 2285, 2286, 2288, 2290, 2292, 2294, 2296, 2297, 2299, 2301, 2303, 2305, 2307, 2309, 2311, 2313, 2314, 2316-2318, 2320, 2322, 2324, 2326, 2327, 2329, 2331, 2333, 2335, 2337, 2339, 2341, 2342, 2344, 2345, 2347-2349, 2351, 2353, 2355, 2357, 2359, 2361, 2363, 2365, 2367-2369, 2371, 2373, 2375, 2377, 2379, 2381, 2383, 2385, 2386, 2388, 2390, 2391, 2393, 2395, 2397, 2399, 2400, 2402, 2404, 2405, 2407, 2409, 2411, 2413, 2415, 2417, 2419, 2421, 2423, 2425, 2426, 2428, 2430, 2431, 2433, 2435, 2437, 2438-2440, 2442, 2444, 2445, 2447, 2449, 2451, 2453, 2455, 2457, 2459, 2461, 2463-2468, 2470, 2472, 2474, 2476, 2478, 2479, 2481, 2482, 2484, 2485, 2487-2491, 2493-2498, 2500-2510, 2512-2515, 2517-2531, 2533-2536, 2538-2542, 2544-2548, 2550, 2551, 2553, 2555-2558, 2560, 2562, 2564, 2566-2573, 2575-2579, 2581, 2583-2585, 2587-2602, 2604-2611, 2613, 2615, 2617, and 2619-2623.

This document also features a method of producing a plant. The method includes growing a plant cell containing a modified endogenous nucleic acid encoding a polypeptide, wherein the HMM bit score of the amino acid sequence of the polypeptide is greater than about 65, the HMM based on the amino acid sequences depicted in one of FIGS. 1-38. The plant has a difference in the level of biomass as compared to the corresponding level of a control plant where the nucleic acid has not been modified.

In another aspect, this document features a plant cell containing a modified endogenous nucleic acid encoding a polypeptide, wherein the HMM bit score of the amino acid sequence of the polypeptide is greater than about 65, the HMM based on the amino acid sequences depicted in one of FIGS. 1-38. A plant produced from the plant cell has a difference in the level of biomass as compared to the corresponding level of a control plant where said nucleic acid has not been modified.

A plant cell also is featured that contains a modified biomass-modulating endogenous nucleic acid. The nucleic acid includes a nucleotide sequence with an open reading frame having 80 percent or greater sequence identity to the nucleotide sequence selected from the group consisting of SEQ ID NO: 1, 3, 5, 10, 12, 16, 19, 28, 30, 34, 37, 52, 55, 62, 68, 71, 77, 79, 84, 87, 92, 98, 104, 106, 108, 111, 114, 116, 118, 153, 155, 157, 160, 162, 164, 166, 169, 171, 173, 175, 177, 179, 186, 189, 191, 195, 197, 199, 201, 204, 206, 212, 252, 254, 256, 259, 263, 266, 273, 280, 284, 286, 293, 298, 300, 302, 306, 308, 311, 313, 315, 319, 322, 324, 326, 330, 333, 336, 340, 343, 346, 348, 350, 352, 354, 356, 358, 360, 367, 369, 371, 374, 379, 381, 388, 390, 392, 394, 397, 405, 415, 417, 419, 422, 424, 426, 428, 430, 432, 434, 436, 438, 440, 442, 444, 446, 448, 450, 452, 454, 456, 458, 460, 462, 464, 466, 468, 470, 472, 474, 476, 478, 480, 482, 484, 486, 488, 490, 492, 494, 496, 503, 505, 507, 510, 518, 520, 523, 528, 531, 534, 538, 540, 542, 544, 547, 549, 551, 556, 559, 561, 563, 565, 567, 569, 579, 581, 583, 586, 588, 590, 593, 597, 599, 602, 605, 609, 612, 614, 616, 618, 620, 622, 624, 627, 633, 635, 637, 639, 641, 644, 646, 648, 650, 652, 654, 656, 658, 660, 662, 664, 666, 671, 673, 676, 678, 683, 686, 688, 693, 699, 705, 708, 719, 721, 723, 725, 729, 732, 740, 742, 744, 747, 749, 751, 753, 755, 757, 759, 765, 767, 769, 771, 773, 775, 777, 779, 781, 783, 786, 788, 790, 792, 796, 798, 800, 802, 804, 807, 809, 811, 813, 815, 817, 821, 825, 827, 829, 831, 833, 835, 837, 841, 844, 848, 850, 852, 855, 859, 861, 864, 867, 869, 874, 879, 883, 887, 889, 891, 894, 896, 898, 901, 904, 906, 908, 910, 914, 916, 918, 920, 922, 924, 927, 929, 931, 934, 939, 942, 946, 948, 951, 956, 962, 964, 970, 973, 976, 979, 981, 983, 985, 987, 989, 991, 993, 995, 997, 999, 1015, 1017, 1019, 1022, 1025, 1028, 1031, 1034, 1036, 1039, 1041, 1044, 1046, 1048, 1050, 1052, 1054, 1056, 1058, 1060, 1064, 1066, 1068, 1071, 1074, 1077, 1081, 1084, 1086, 1088, 1090, 1092, 1094, 1097, 1099, 1102, 1104, 1107, 1109, 1111, 1113, 1117, 1119, 1124, 1126, 1132, 1135, 1138, 1146, 1157, 1162, 1164, 1179, 1189, 1192, 1203, 1208, 1214, 1216, 1222, 1229, 1232, 1242, 1244, 1246, 1248, 1253, 1256, 1260, 1262, 1265, 1273, 1277, 1279, 1281, 1287, 1290, 1332, 1338, 1340, 1342, 1344, 1346, 1351, 1353, 1355, 1357, 1359, 1361, 1363, 1365, 1367, 1369, 1373, 1376, 1380, 1382, 1385, 1387, 1391, 1398, 1401, 1404, 1406, 1411, 1419, 1421, 1423, 1425, 1427, 1429, 1431, 1437, 1439, 1441, 1445, 1448, 1451, 1455, 1458, 1461, 1464, 1469, 1472, 1474, 1476, 1484, 1486, 1488, 1490, 1494, 1497, 1500, 1502, 1505, 1507, 1509, 1512, 1515, 1522, 1525, 1527, 1533, 1535, 1540, 1543, 1546, 1549, 1551, 1554, 1560, 1562, 1566, 1569, 1572, 1574, 1577, 1579, 1581, 1584, 1586, 1588, 1591, 1594, 1596, 1598, 1601, 1607, 1614, 1617, 1627, 1630, 1632, 1635, 1638, 1644, 1740, 1742, 1744, 1746, 1757, 1759, 1761, 1765, 1768, 1771, 1775, 1777, 1784, 1793, 1795, 1797, 1800, 1803, 1805, 1807, 1811, 1813, 1816, 1818, 1820, 1823, 1825, 1831, 1833, 1836, 1838, 1842, 1845, 1848, 1850, 1853, 1855, 1857, 1859, 1864, 1954, 1959, 1961, 1963, 1965, 1969, 1971, 1977, 1979, 1981, 1983, 1987, 1989, 1992, 1994, 1996, 1998, 2000, 2002, 2004, 2006, 2008, 2010, 2012, 2014, 2016, 2018, 2020, 2022, 2028, 2030, 2032, 2034, 2036, 2038, 2040, 2042, 2044, 2046, 2050, 2058, 2060, 2062, 2064, 2066, 2068, 2070, 2072, 2074, 2076, 2078, 2081, 2083, 2085, 2087, 2089, 2091, 2094, 2096, 2099, 2123, 2125, 2127, 2130, 2132, 2134, 2138, 2140, 2143, 2149, 2151, 2153, 2156, 2158, 2162, 2164, 2167, 2169, 2171, 2176, 2178, 2180, 2182, 2185, 2187, 2190, 2195, 2198, 2203, 2205, 2209, 2213, 2216, 2221, 2223, 2227, 2229, 2233, 2243, 2255, 2270, 2272, 2275, 2277, 2279, 2282, 2284, 2287, 2289, 2291, 2293, 2295, 2298, 2300, 2302, 2304, 2306, 2308, 2310, 2312, 2315, 2319, 2321, 2323, 2325, 2328, 2330, 2332, 2334, 2336, 2338, 2340, 2343, 2346, 2350, 2352, 2354, 2356, 2358, 2360, 2362, 2364, 2366, 2370, 2372, 2374, 2376, 2378, 2380, 2382, 2384, 2387, 2389, 2392, 2394, 2396, 2398, 2401, 2403, 2406, 2408, 2410, 2412, 2414, 2416, 2418, 2420, 2422, 2424, 2427, 2429, 2432, 2434, 2436, 2441, 2443, 2446, 2448, 2450, 2452, 2454, 2456, 2458, 2460, 2462, 2469, 2471, 2473, 2475, 2477, 2480, 2483, 2486, 2492, 2499, 2511, 2516, 2532, 2537, 2543, 2549, 2552, 2554, 2559, 2561, 2563, 2565, 2574, 2580, 2582, 2586, 2603, 2612, 2614, 2616, and 2618, and wherein a plant produced from said plant cell has a difference in the level of biomass as compared to the corresponding level of a control plant where said nucleic acid has not been modified.

The endogenous nucleic acid can encode a polypeptide having 80 percent or greater sequence identity to an amino acid sequence selected from the group consisting of SEQ ID NO: 2, 4, 6-9, 11, 13-15, 17, 18, 20-27, 29, 31-33, 35, 36, 38-51, 53, 54, 56-61, 63-67, 69, 70, 72-76, 78, 80-83, 85, 86, 88-91, 93-97, 99-103, 105, 107, 109, 110, 112, 113, 115, 117, 119-152, 154, 156, 158, 159, 161, 163, 165, 167, 168, 170, 172, 174, 176, 178, 180-185, 187, 188, 190, 192-194, 196, 198, 200, 202, 203, 205, 207-211, 213-251, 253, 255, 257, 258, 260-262, 264, 265, 267-272, 274-279, 281-283, 285, 287-292, 294, 295-297, 299, 301, 303-305, 307, 309, 310, 312, 314, 316-318, 320, 321, 323, 325, 327-329, 331, 332, 334, 335, 337-339, 341, 342, 344, 345, 347, 349, 351, 353, 355, 357, 359, 361-366, 368, 370, 372, 373, 375-378, 380, 382-387, 389, 391, 393, 395, 396, 398-404, 406-414, 416, 418, 420, 421, 423, 425, 427, 429, 431, 433, 435, 437, 439, 441, 443, 445, 447, 449, 451, 453, 455, 457, 459, 461, 463, 465, 467, 469, 471, 473, 475, 477, 479, 481, 483, 485, 487, 489, 491, 493, 495, 497-502, 504, 506, 508, 509, 511-517, 519, 521, 522, 524-527, 529, 530, 532, 533, 535, 536, 537, 539, 541, 543, 545, 546, 548, 550, 552-555, 557, 558, 560, 562, 564, 566, 568, 570-578, 580, 582, 584, 585, 587, 589, 591, 592, 594-596, 598, 600, 601, 603, 604, 606-608, 610, 611, 613, 615, 617, 619, 621, 623, 625, 626, 628-632, 634, 636, 638, 640, 642, 643, 645, 647, 649, 651, 653, 655, 657, 659, 661, 663, 665, 667-670, 672, 674, 675, 677, 679-682, 684, 685, 687, 689-692, 694-698, 700-704, 706, 707, 709-718, 720, 722, 724, 726-728, 730, 731, 733-739, 741, 743, 745, 746, 748, 750, 752, 754, 756, 758, 760-764, 766, 768, 770, 772, 774, 776, 778, 780, 782, 784, 785, 787, 789, 791, 793-795, 797, 799, 801, 803, 805, 806, 808, 810, 812, 814, 816, 818-820, 822-824, 826, 828, 830, 832, 834, 836, 838-840, 842, 843, 845-847, 849, 851, 853, 854, 856-858, 860, 862, 863, 865, 866, 868, 870-873, 875-878, 880-882, 884-886, 888, 890, 892, 893, 895, 897, 899, 900, 902, 903, 905, 907, 909, 911, 912, 913, 915, 917, 919, 921, 923, 925, 926, 928, 930, 932, 933, 935, 936-938, 940, 941, 943-945, 947, 949, 950, 952-955, 957-961, 963, 965-969, 971, 972, 974, 975, 977, 978, 980, 982, 984, 986, 988, 990, 992, 994, 996, 998, 1000-1014, 1016, 1018, 1020, 1021, 1023, 1024, 1026, 1027, 1029, 1030, 1032, 1033, 1035, 1037, 1038, 1040, 1042, 1043, 1045, 1047, 1049, 1051, 1053, 1055, 1057, 1059, 1061-1063, 1065, 1067, 1069, 1070, 1072, 1073, 1075, 1076, 1078-1080, 1082, 1083, 1085, 1087, 1089, 1091, 1093, 1095, 1096, 1098, 1100, 1101, 1103, 1105, 1106, 1108, 1110, 1112, 1114-1116, 1118, 1120-1123, 1125, 1127-1131, 1133, 1134, 1136, 1137, 1139-1145, 1147-1156, 1158-1161, 1163, 1165-1178, 1180-1188, 1190, 1191, 1193-1202, 1204, 1205-1207, 1209-1213, 1215, 1217-1221, 1223-1228, 1230, 1231, 1233-1241, 1243, 1245, 1247, 1249-1252, 1254, 1255, 1257-1259, 1261, 1263, 1264, 1266-1272, 1274-1276, 1278, 1280, 1282-1286, 1288, 1289, 1291-1331, 1333-1337, 1339, 1341, 1343, 1345, 1347-1350, 1352, 1354, 1356, 1358, 1360, 1362, 1364, 1366, 1368, 1370-1372, 1374, 1375, 1377-1379, 1381, 1383, 1384, 1386, 1388-1390, 1392-1397, 1399, 1400, 1402, 1403, 1405, 1407-1410, 1412-1418, 1420, 1422, 1424, 1426, 1428, 1430, 1432-1436, 1438, 1440, 1442-1444, 1446, 1447, 1449, 1450, 1452-1454, 1456, 1457, 1459, 1460, 1462, 1463, 1465-1468, 1470, 1471, 1473, 1475, 1477-1483, 1485, 1487, 1489, 1491-1493, 1495, 1496, 1498, 1499, 1501, 1503, 1504, 1506, 1508, 1510, 1511, 1513, 1514, 1516-1521, 1523, 1524, 1526, 1528-1532, 1534, 1536-1539, 1541, 1542, 1544, 1545, 1547, 1548, 1550, 1552, 1553, 1555-1559, 1561, 1563-1565, 1567, 1568, 1570, 1571, 1573, 1575, 1576, 1578, 1580, 1582, 1583, 1585, 1587, 1589, 1590, 1592, 1593, 1595, 1597, 1599, 1600, 1602-1606, 1608-1613, 1615, 1616, 1618-1626, 1628, 1629, 1631, 1633, 1634, 1636, 1637, 1639-1643, 1645, 1646-1739, 1741, 1743, 1745, 1747-1756, 1758, 1760, 1762-1764, 1766, 1767, 1769, 1770, 1772-1774, 1776, 1778-1783, 1785-1792, 1794, 1796, 1798, 1799, 1801, 1802, 1804, 1806, 1808-1810, 1812, 1814, 1815, 1817, 1819, 1821, 1822, 1824, 1826-1830, 1832, 1834, 1835, 1837, 1839-1841, 1843, 1844, 1846, 1847, 1849, 1851, 1852, 1854, 1856, 1858, 1860-1863, 1865-1953, 1955-1958, 1960, 1962, 1964, 1966-1968, 1970, 1972-1976, 1978, 1980, 1982, 1984-1986, 1988, 1990, 1991, 1993, 1995, 1997, 1999, 2001, 2003, 2005, 2007, 2009, 2011, 2013, 2015, 2017, 2019, 2021, 2023-2027, 2029, 2031, 2033, 2035, 2037, 2039, 2041, 2043, 2045, 2047-2049, 2051-2057, 2059, 2061, 2063, 2065, 2067, 2069, 2071, 2073, 2075, 2077, 2079, 2080, 2082, 2084, 2086, 2088, 2090, 2092, 2093, 2095, 2097, 2098, 2100-2122, 2124, 2126, 2128, 2129, 2131, 2133, 2135-2137, 2139, 2141, 2142, 2144-2148, 2150, 2152, 2154, 2155, 2157, 2159-2161, 2163, 2165, 2166, 2168, 2170, 2172-2175, 2177, 2179, 2181, 2183, 2184, 2186, 2188, 2189, 2191-2194, 2196, 2197, 2199-2202, 2204, 2206-2208, 2210-2212, 2214, 2215, 2217-2220, 2222, 2224-2226, 2228, 2230-2232, 2234-2242, 2244-2254, 2256-2269, 2271, 2273, 2274, 2276, 2278, 2280, 2281, 2283, 2285, 2286, 2288, 2290, 2292, 2294, 2296, 2297, 2299, 2301, 2303, 2305, 2307, 2309, 2311, 2313, 2314, 2316-2318, 2320, 2322, 2324, 2326, 2327, 2329, 2331, 2333, 2335, 2337, 2339, 2341, 2342, 2344, 2345, 2347-2349, 2351, 2353, 2355, 2357, 2359, 2361, 2363, 2365, 2367-2369, 2371, 2373, 2375, 2377, 2379, 2381, 2383, 2385, 2386, 2388, 2390, 2391, 2393, 2395, 2397, 2399, 2400, 2402, 2404, 2405, 2407, 2409, 2411, 2413, 2415, 2417, 2419, 2421, 2423, 2425, 2426, 2428, 2430, 2431, 2433, 2435, 2437, 2438-2440, 2442, 2444, 2445, 2447, 2449, 2451, 2453, 2455, 2457, 2459, 2461, 2463-2468, 2470, 2472, 2474, 2476, 2478, 2479, 2481, 2482, 2484, 2485, 2487-2491, 2493-2498, 2500-2510, 2512-2515, 2517-2531, 2533-2536, 2538-2542, 2544-2548, 2550, 2551, 2553, 2555-2558, 2560, 2562, 2564, 2566-2573, 2575-2579, 2581, 2583-2585, 2587-2602, 2604-2611, 2613, 2615, 2617, and 2619-2623. A plant produced from the plant cell has a difference in the level of biomass as compared to the corresponding level of a control plant where the nucleic acid has not been modified.

Unless otherwise defined, all technical and scientific terms used herein have the same meaning as commonly understood by one of ordinary skill in the art to which this invention pertains. Although methods and materials similar or equivalent to those described herein can be used to practice the invention, suitable methods and materials are described below. All publications, patent applications, patents, and other references mentioned herein are incorporated by reference in their entirety. In case of conflict, the present specification, including definitions, will control. In addition, the materials, methods, and examples are illustrative only and not intended to be limiting.

The details of one or more embodiments of the invention are set forth in the accompanying drawings and the description below. Other features, objects, and advantages of the invention will be apparent from the description and drawings, and from the claims. The word "comprising" in the claims may be replaced by "consisting essentially of" or with "consisting of," according to standard practice in patent law.

DESCRIPTION OF DRAWINGS

FIGS. 1A-1B are an alignment of the amino acid sequence of CeresClone:1871521 (SEQ ID NO: 1333) with homologous and/or orthologous amino acid sequences. In all the alignment figures shown herein, a dash in an aligned sequence represents a gap, i.e., a lack of an amino acid at that position. Identical amino acids or conserved amino acid substitutions among aligned sequences are identified by boxes. FIG. 1 and the other alignment figures provided herein were generated using the program MUSCLE version 3.52.

Figure 2C:
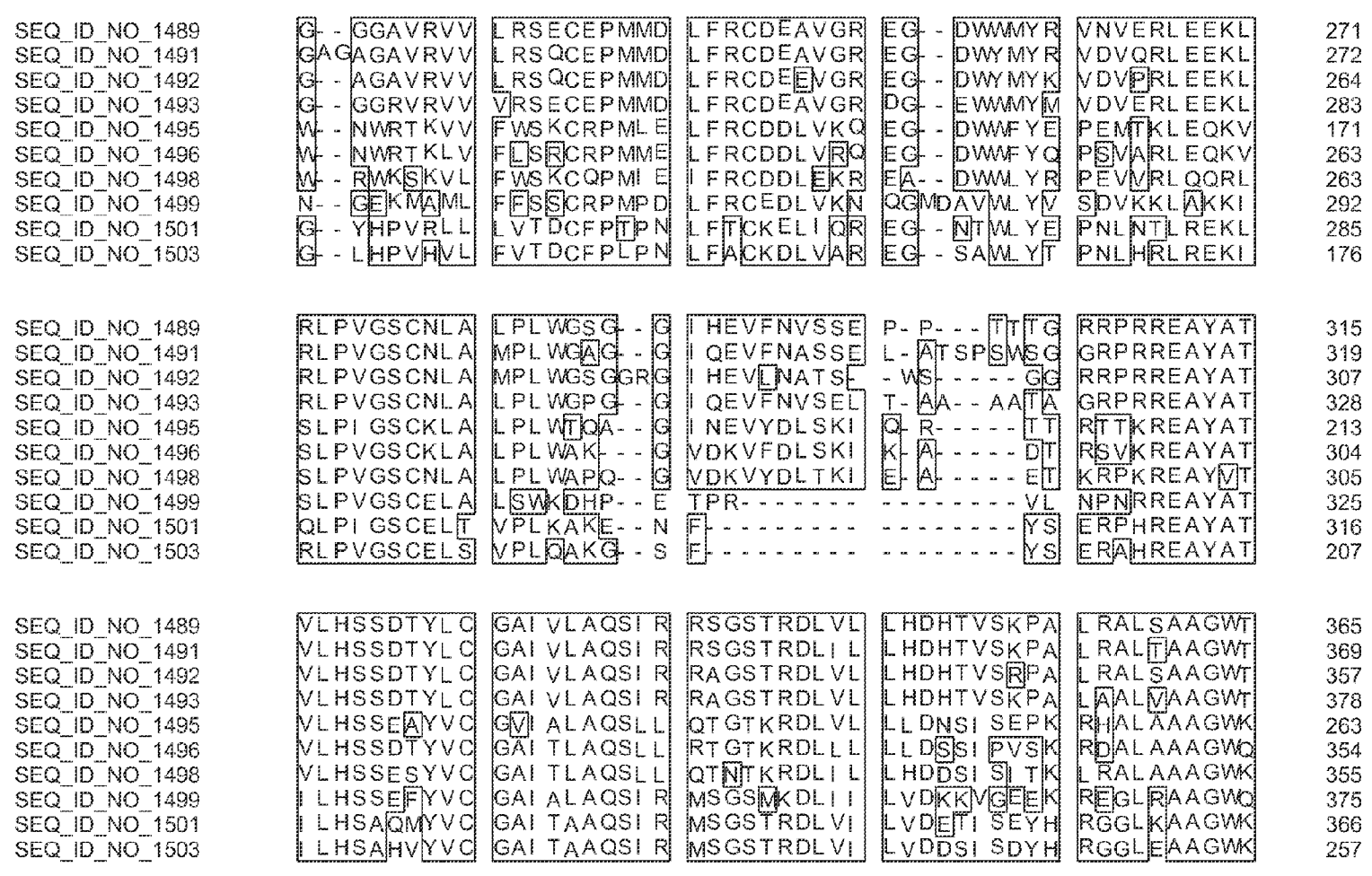
Figure 2D:
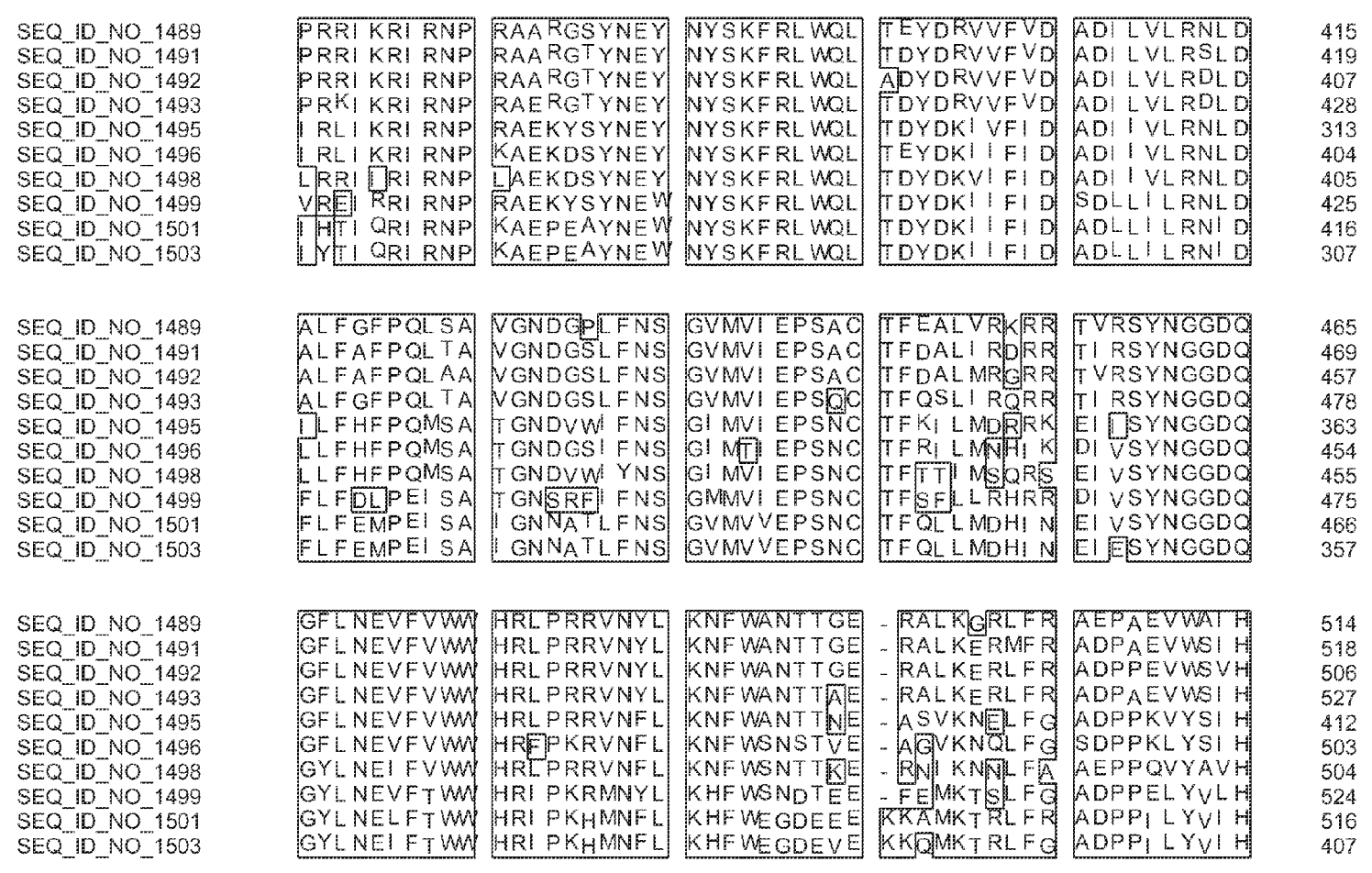
Figure 2E:
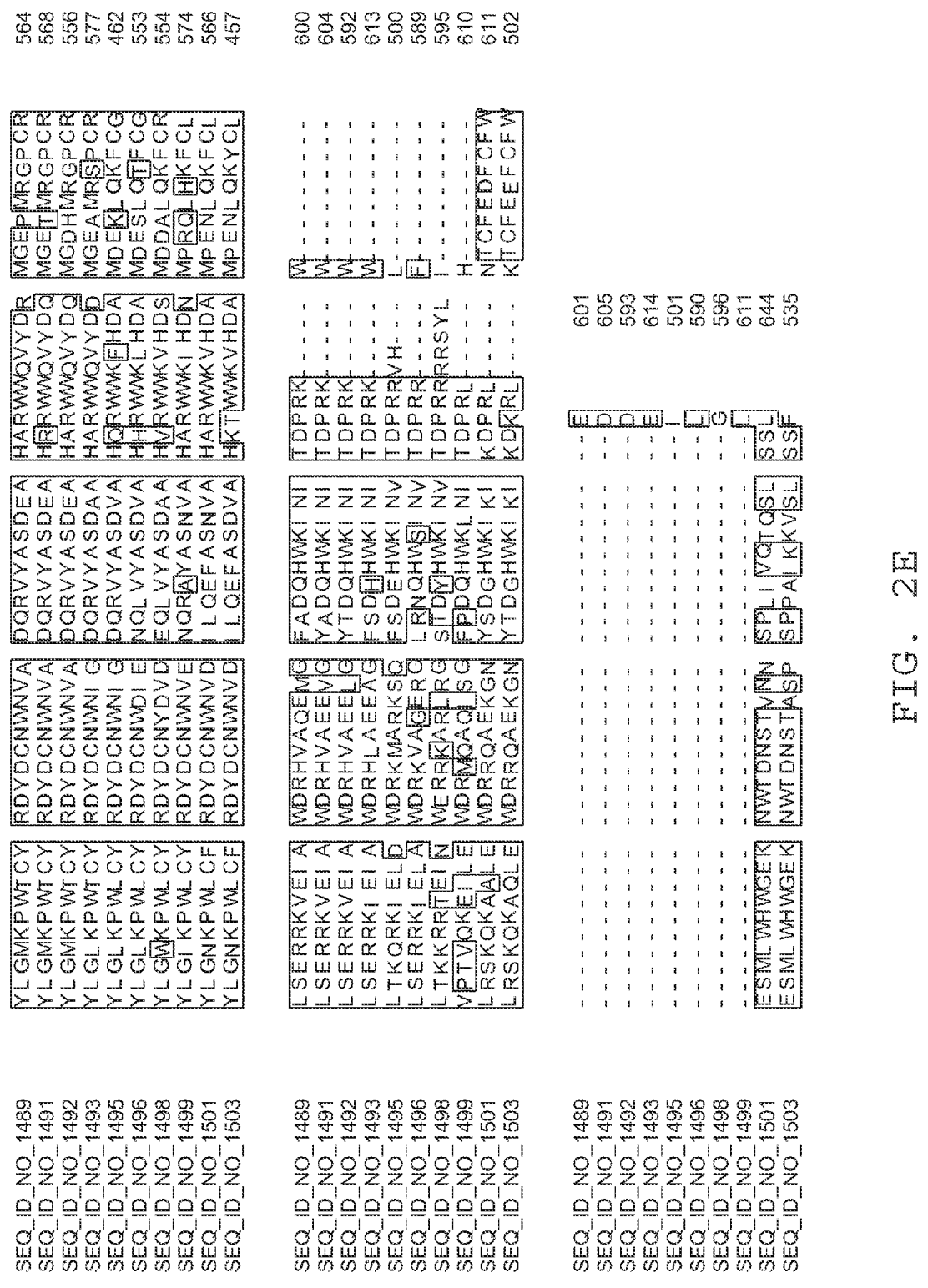

FIGS. 2A-2E are an alignment of the amino acid sequence of CeresClone:1909354 (SEQ ID NO: 1489) with homologous and/or orthologous amino acid sequences.

Figure 3A:
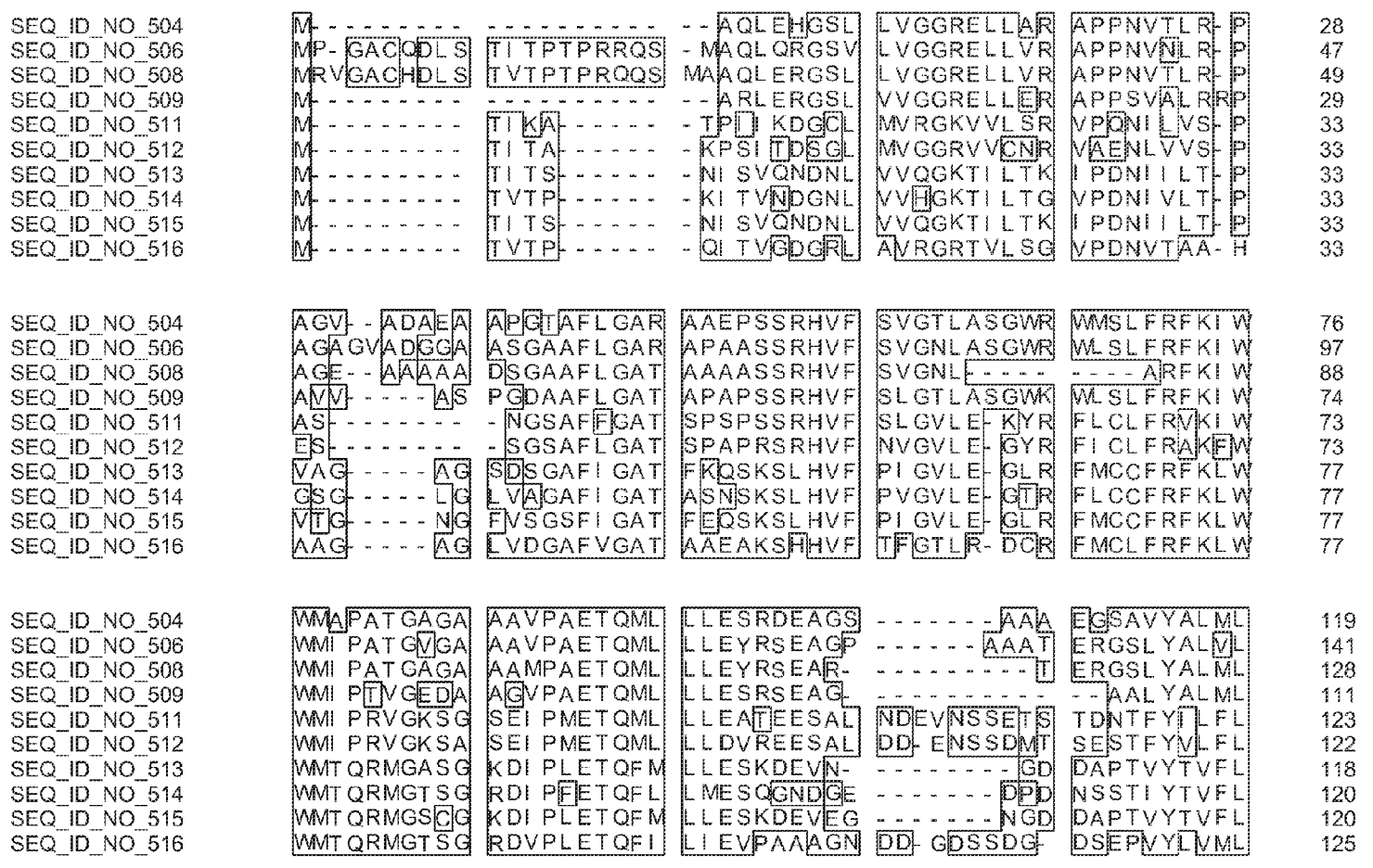
Figure 3B:
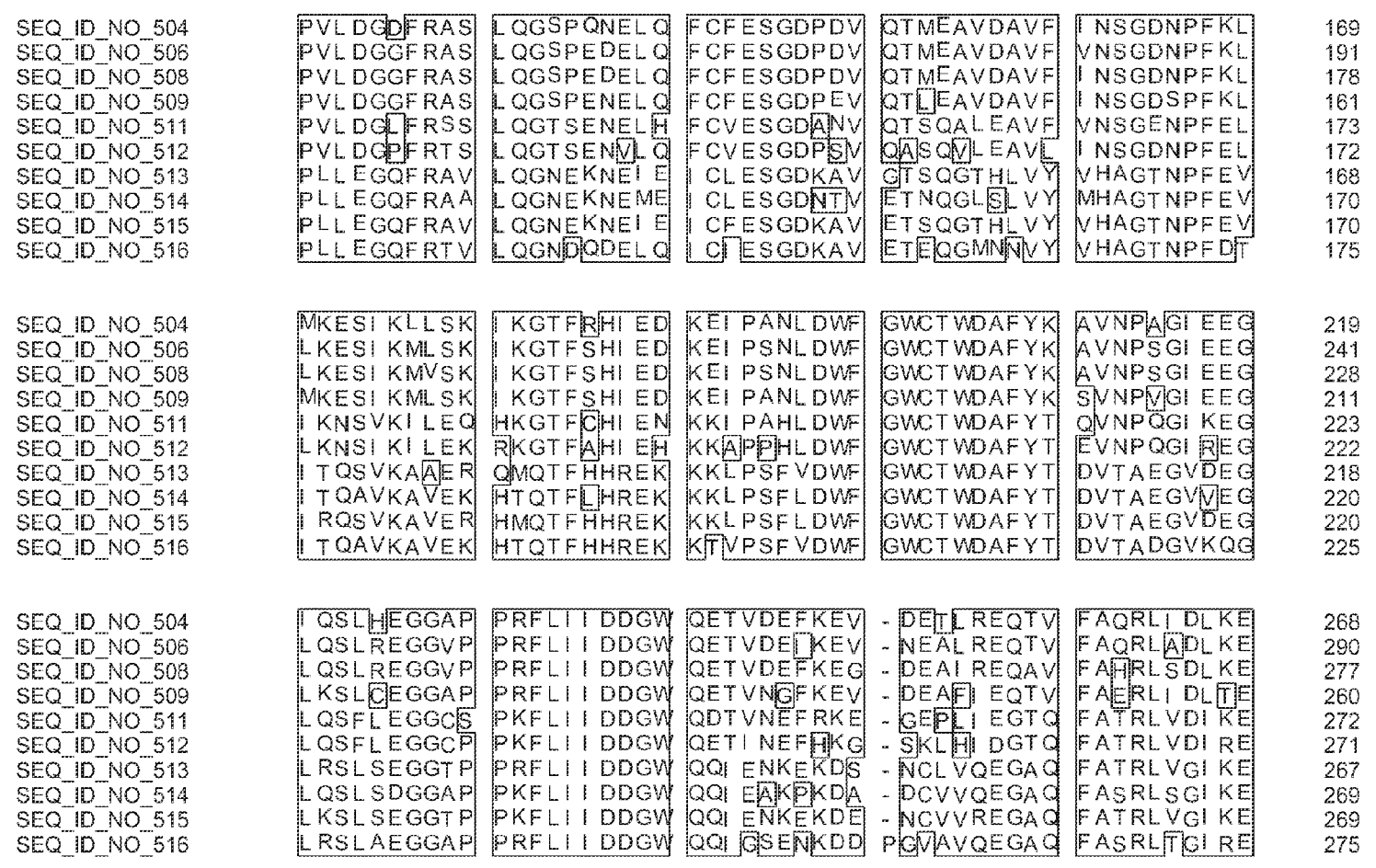
Figure 3D:
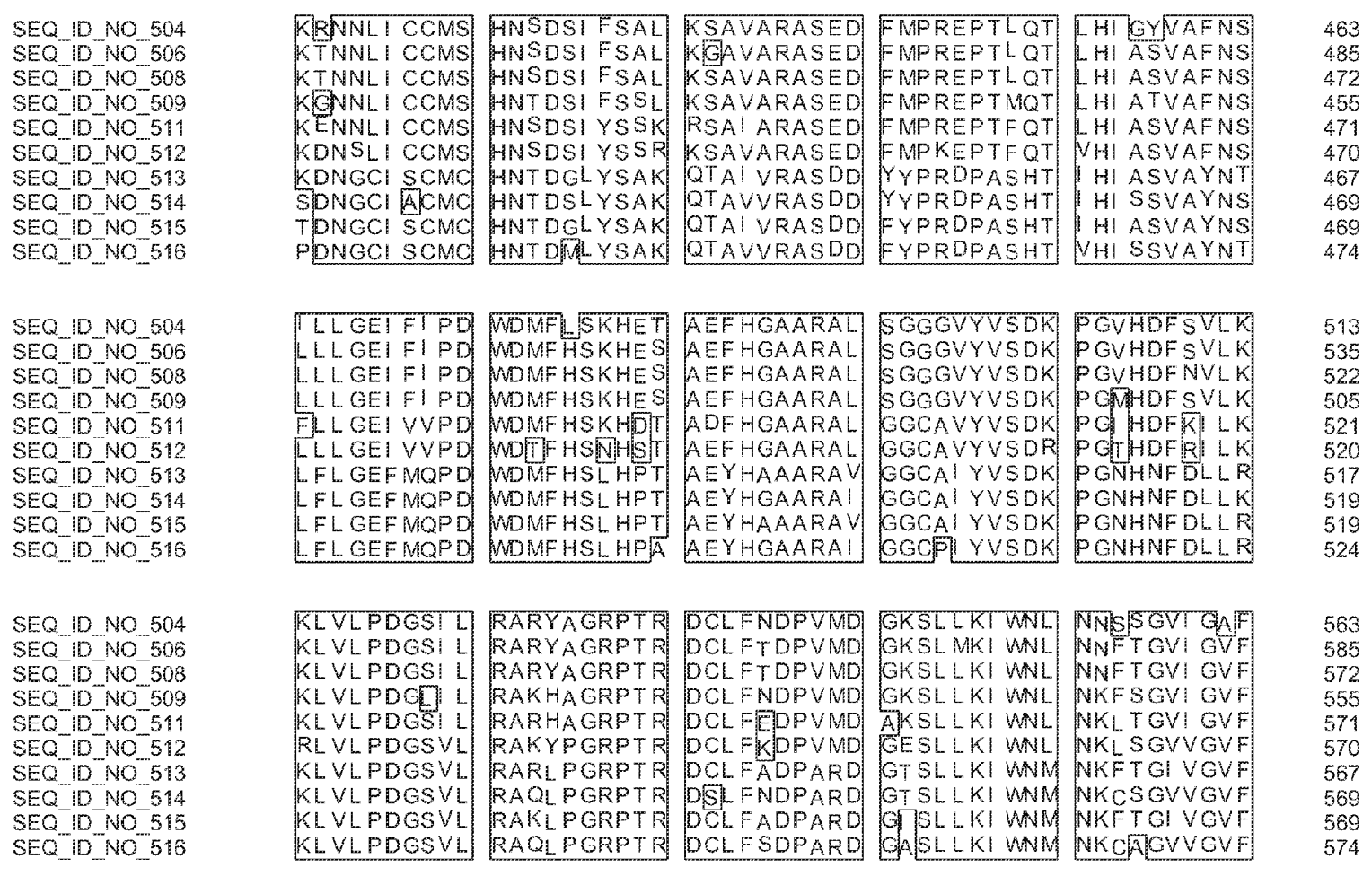
Figure 3E:
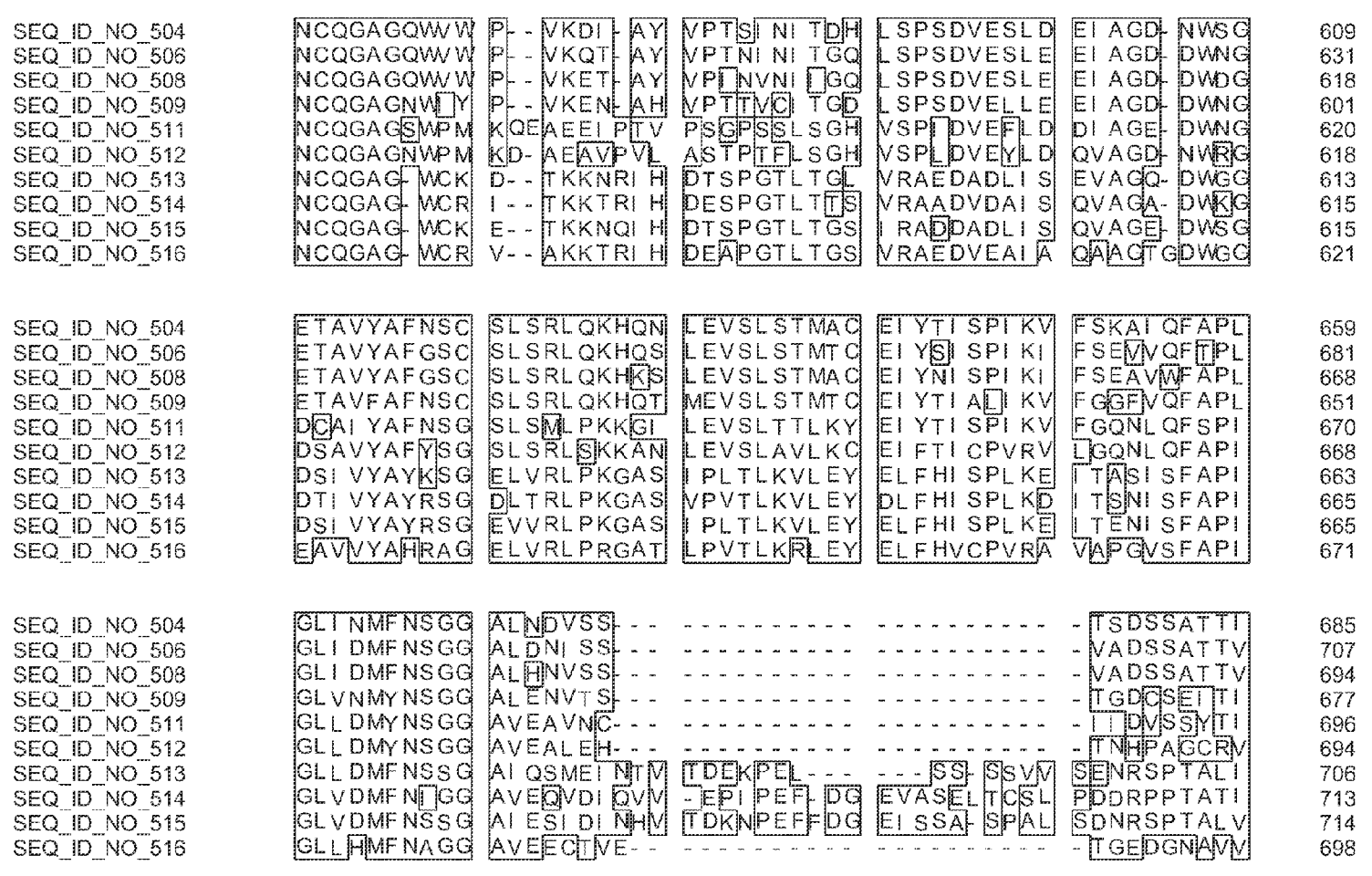
Figure 3F:
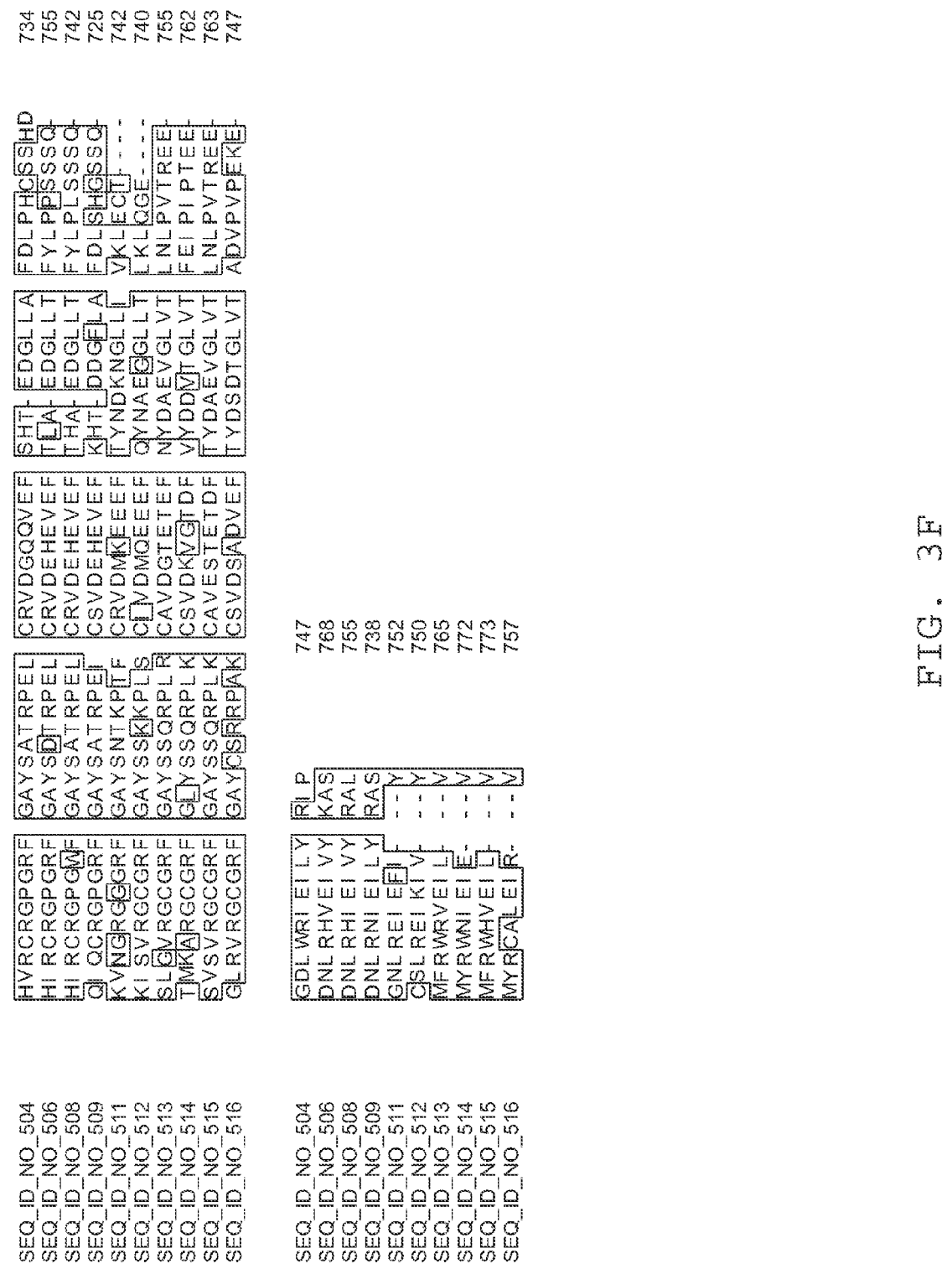

FIGS. 3A-3F are an alignment of the amino acid sequence of CeresClone:1882035 (SEQ ID NO: 504) with homologous and/or orthologous amino acid sequences.

FIGS. 4A-4C are an alignment of the amino acid sequence of CeresClone:1819917 (SEQ ID NO:198) with homologous and/or orthologous amino acid sequences.

Figure 5A:
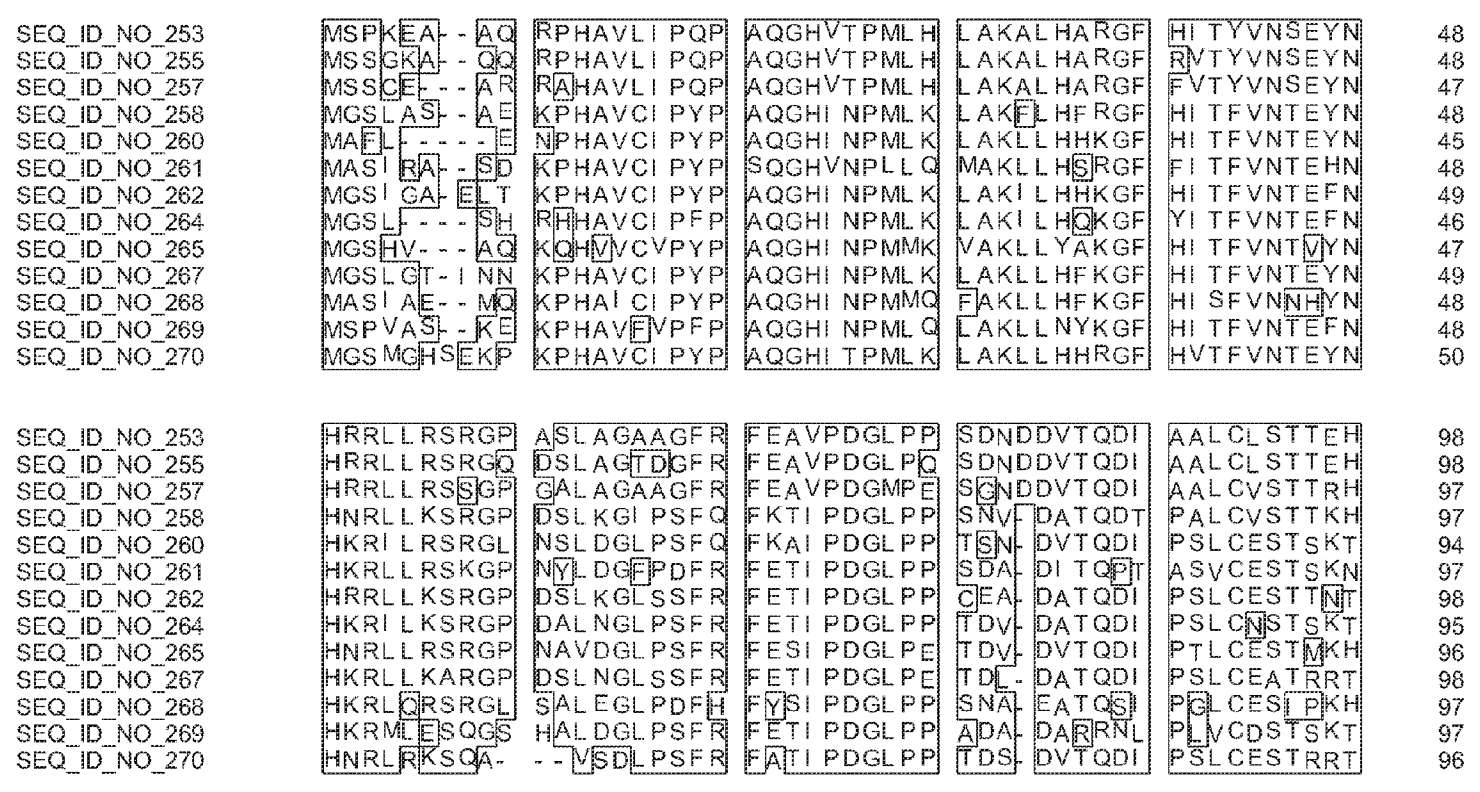
Figure 5C:
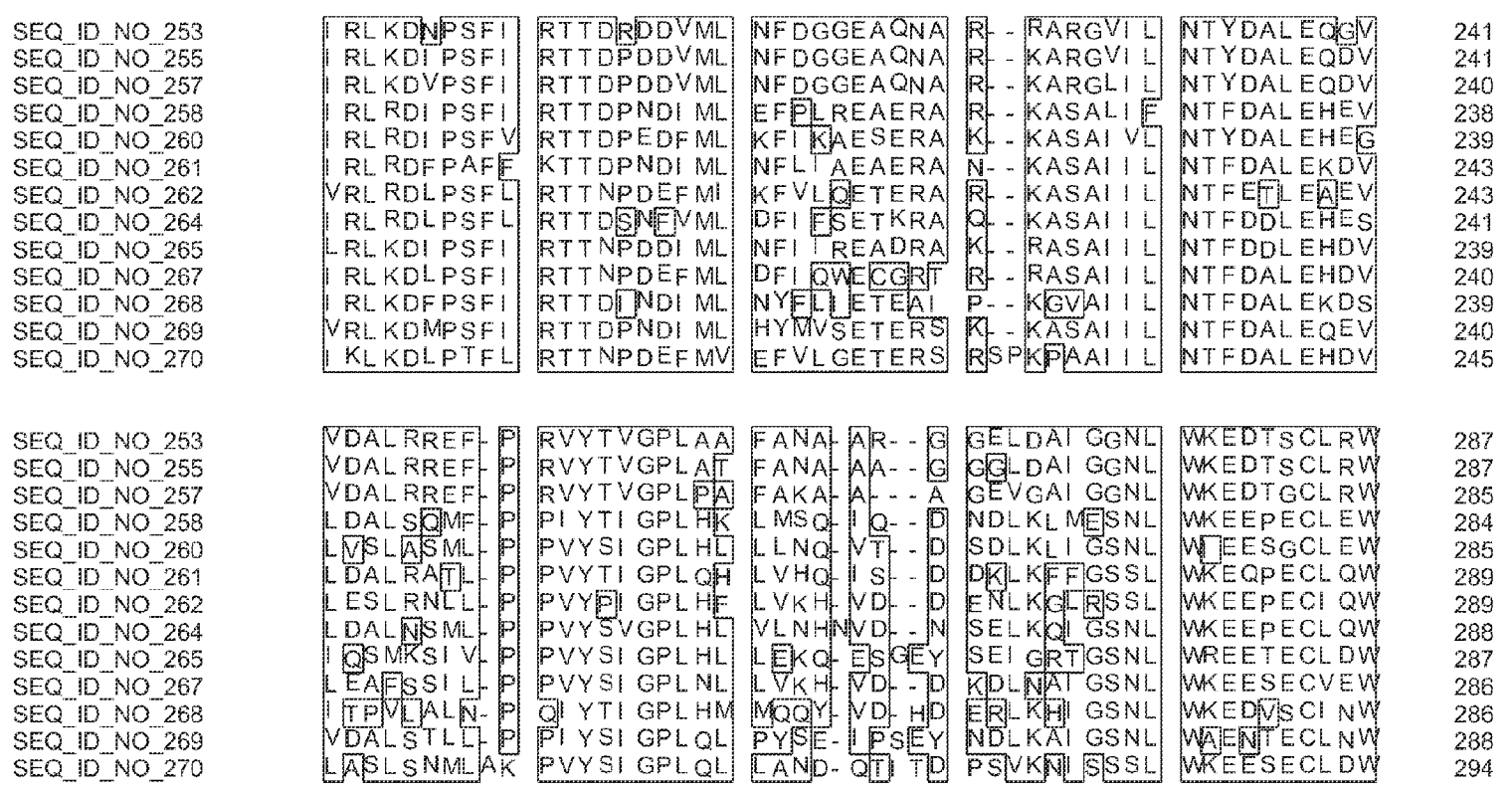

FIGS. 5A-5F are an alignment of the amino acid sequence of CeresClone:1815762 (SEQ ID NO: 253) with homologous and/or orthologous amino acid sequences.

FIGS. 6A-6C are an alignment of the amino acid sequence of CeresClone:1792015 (SEQ ID NO: 1541) with homologous and/or orthologous amino acid sequences.

FIGS. 7A-7D are an alignment of the amino acid sequence of CeresClone:1791384 (SEQ ID NO: 663) with homologous and/or orthologous amino acid sequences.

FIGS. 8A-8D are an alignment of the amino acid sequence of CeresClone:1786268 (SEQ ID NO: 1366) with homologous and/or orthologous amino acid sequences.

Figure 9A:
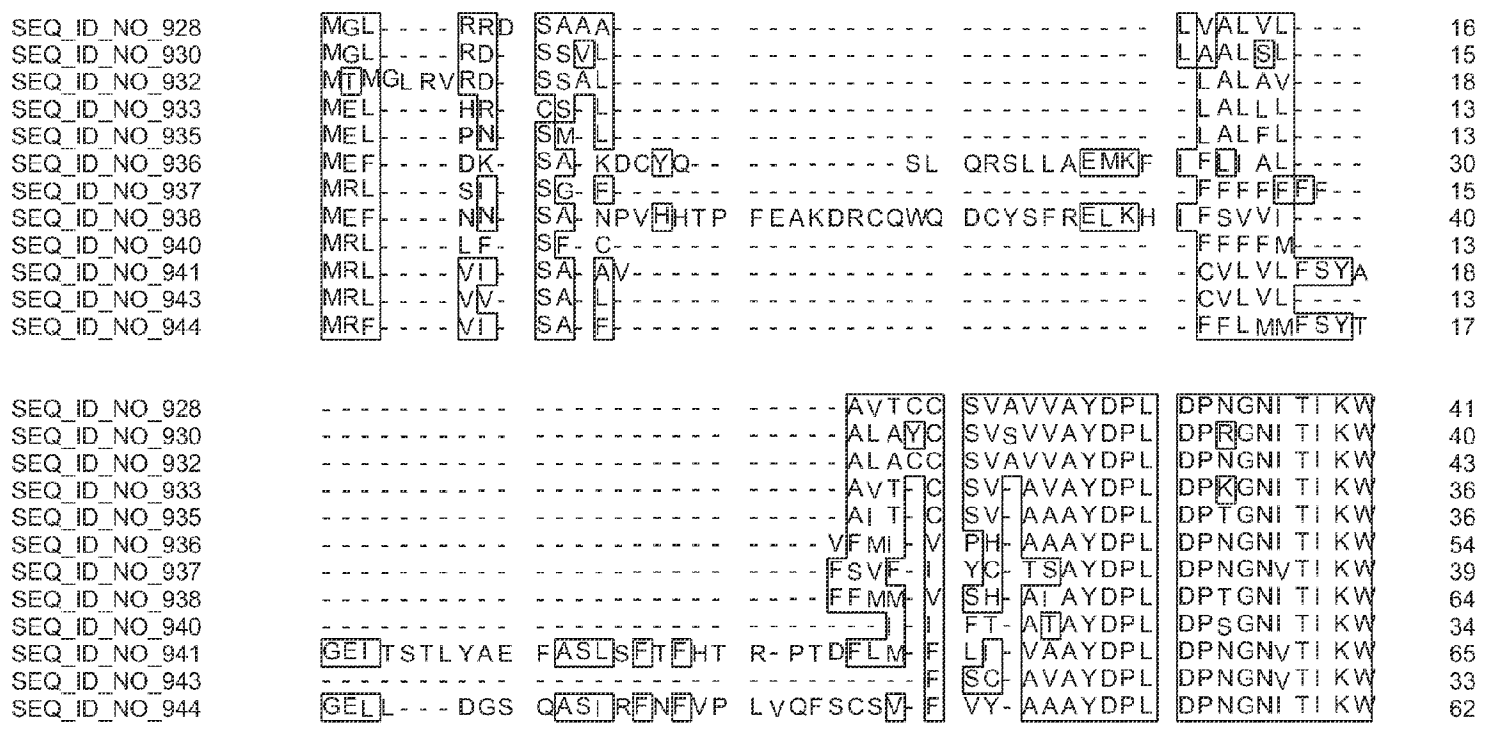
Figure 9B:
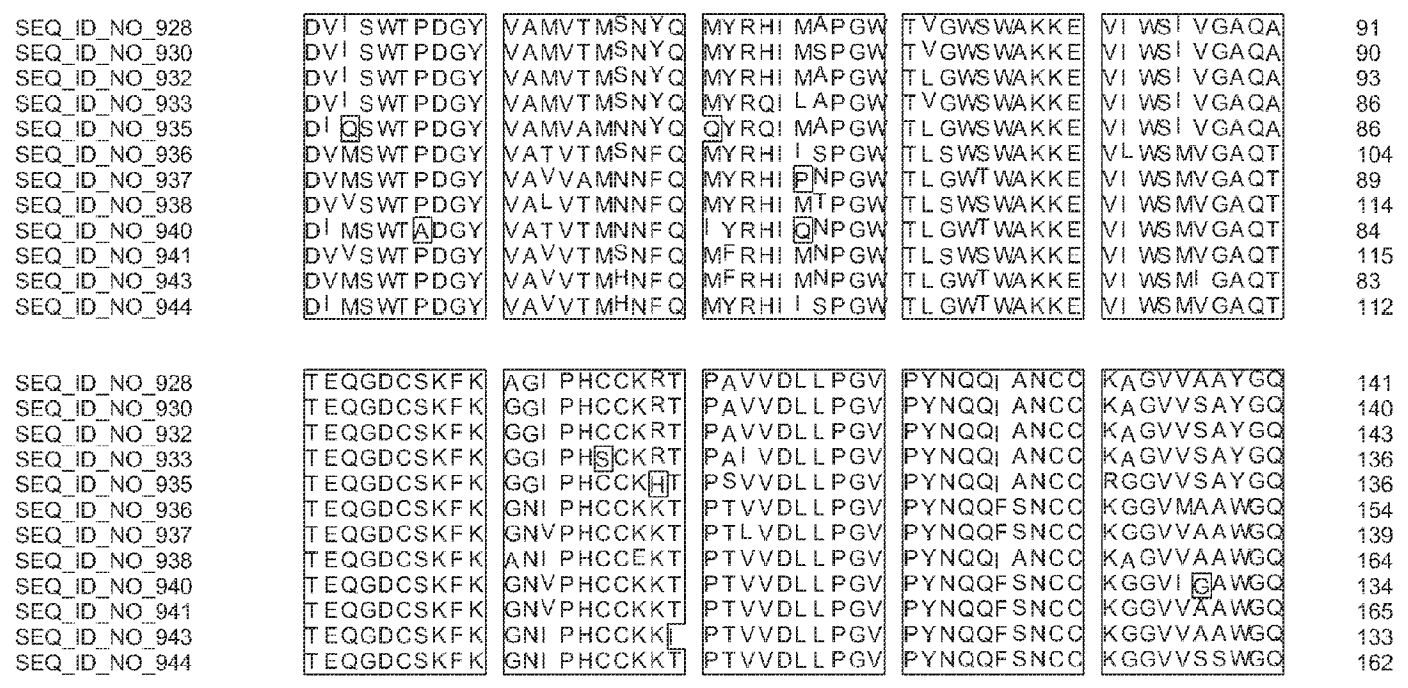
Figure 9D:
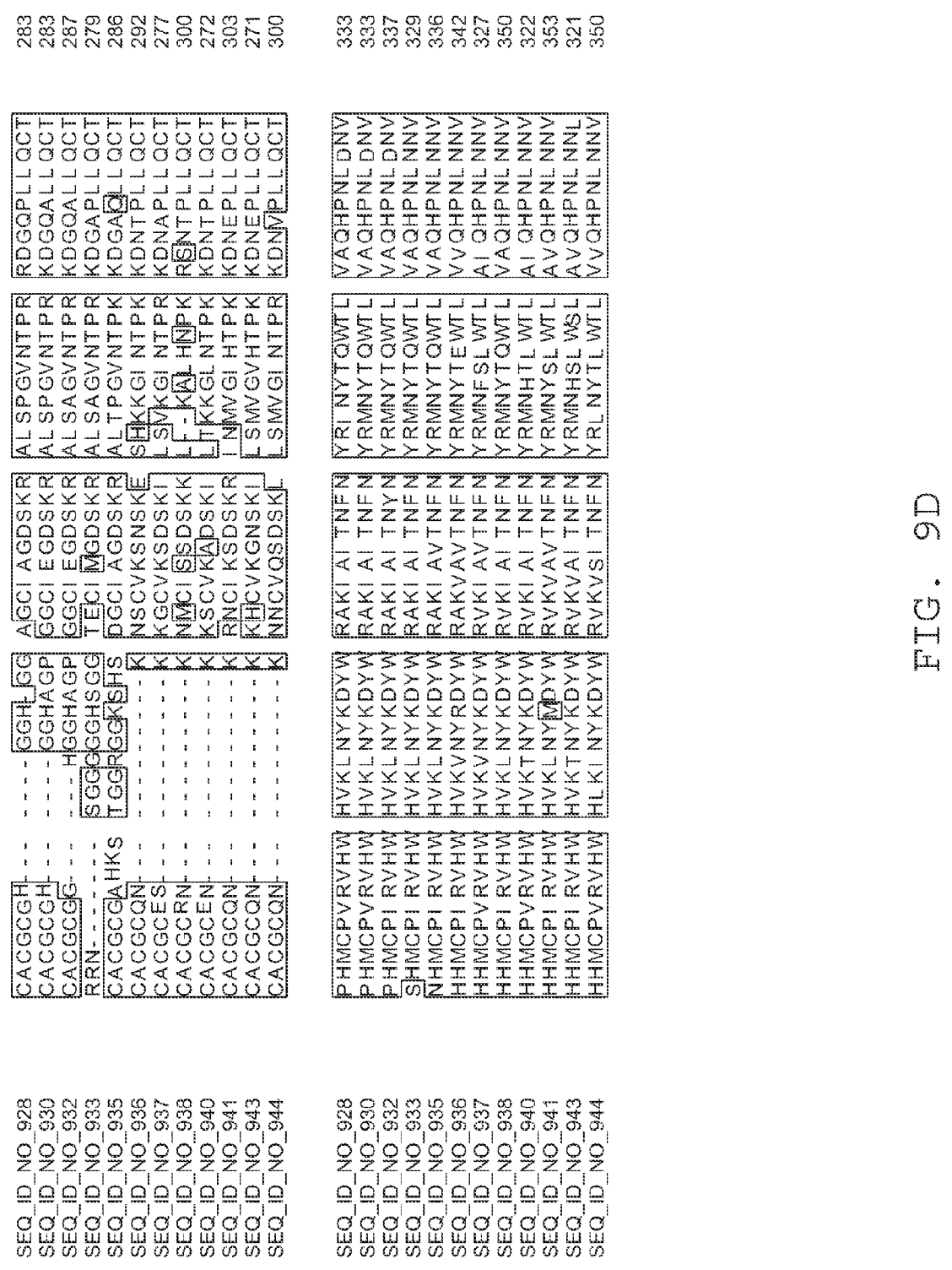
Figure 9E:
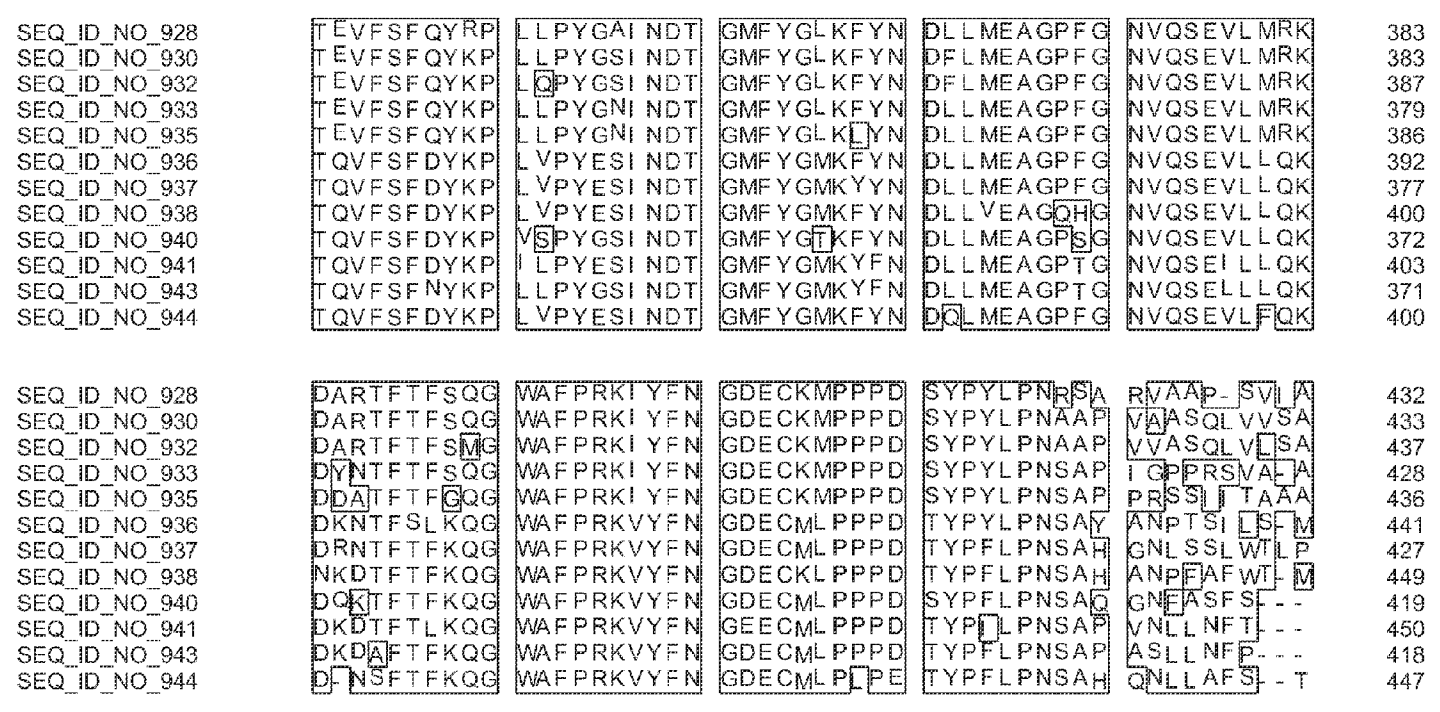

FIGS. 9A-9F are an alignment of the amino acid sequence of CeresClone:1781794 (SEQ ID NO: 928) with homologous and/or orthologous amino acid sequences.

Figure 10A:
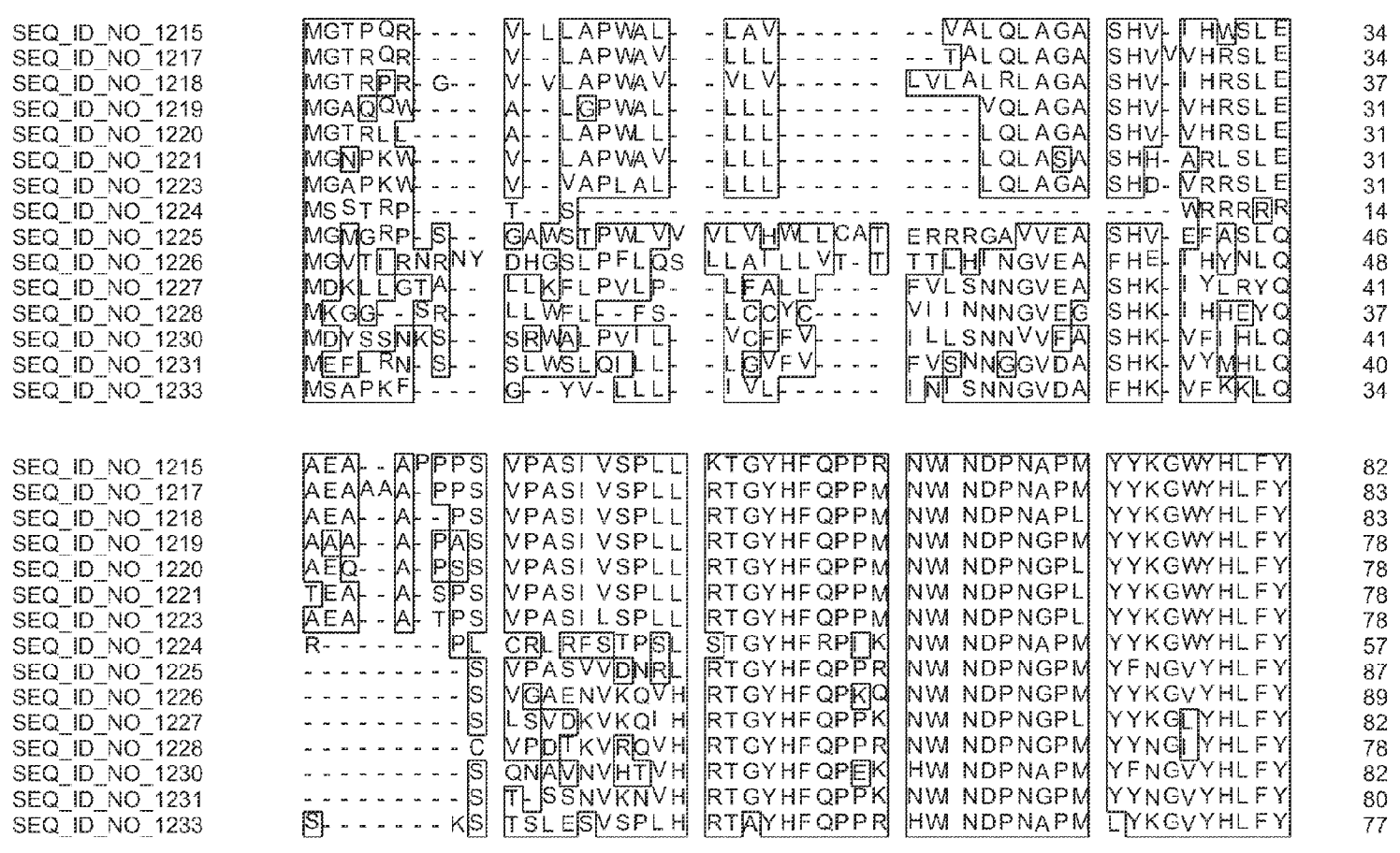
Figure 10D:
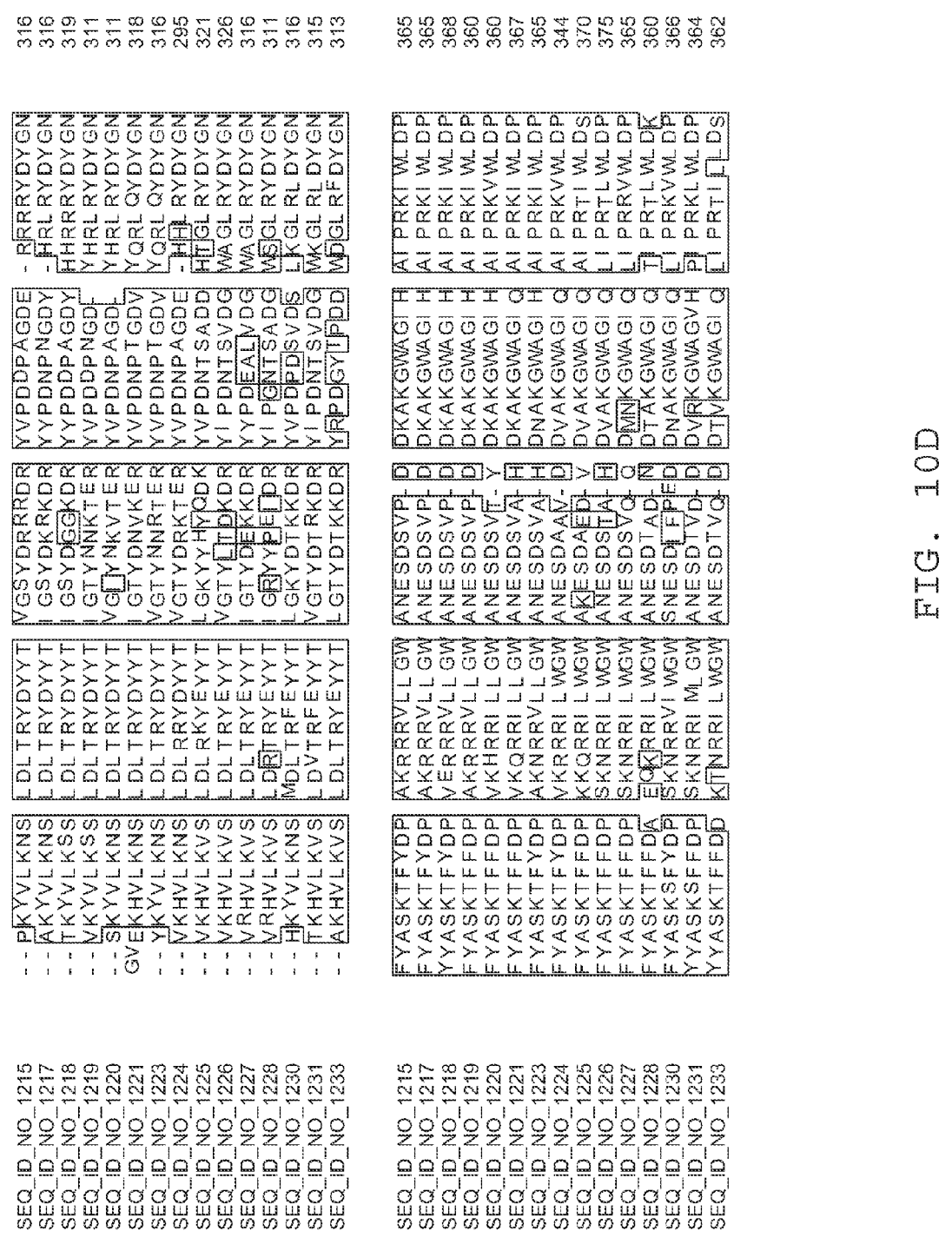

FIGS. 10A-10G are an alignment of the amino acid sequence of CeresClone:1769374 (SEQ ID NO:1215) with homologous and/or orthologous amino acid sequences.

Figure 11B:
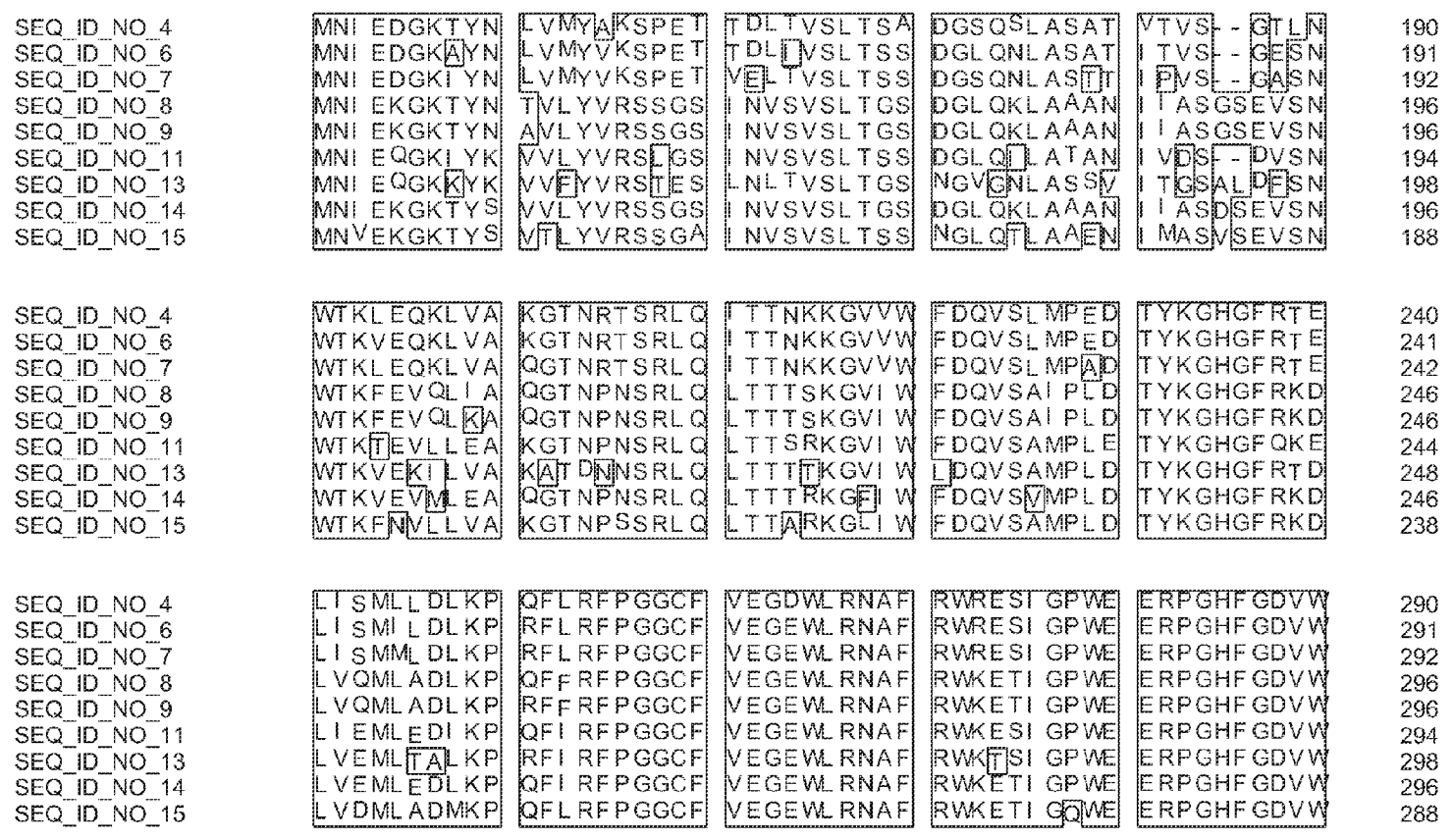
Figure 11E:
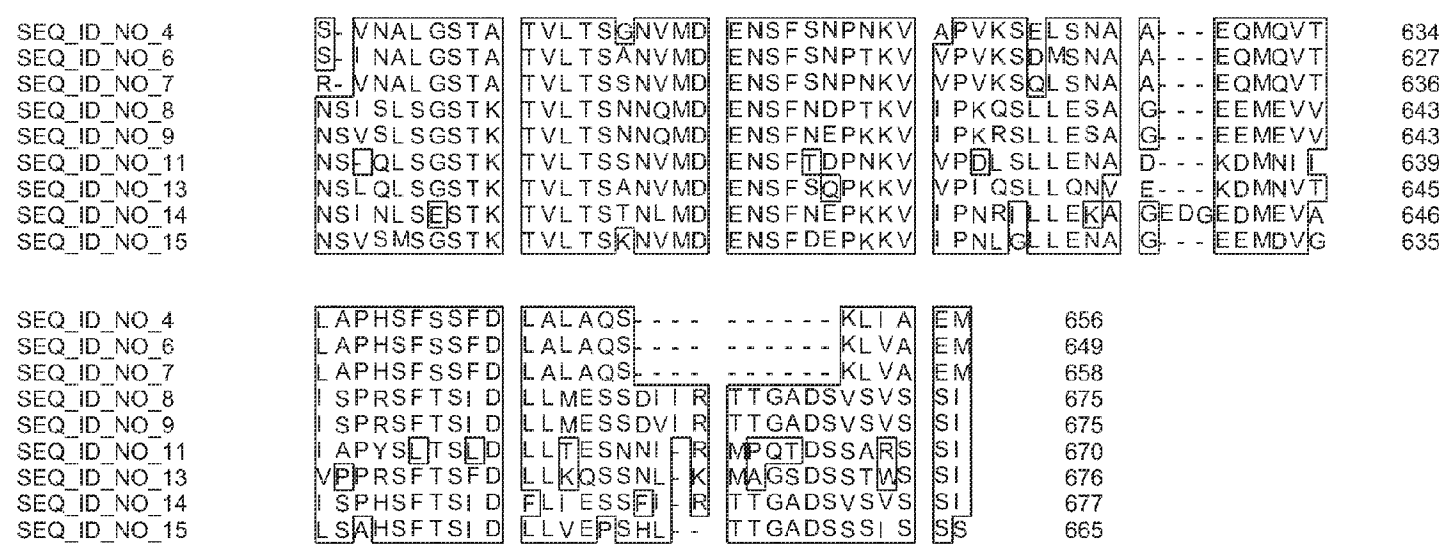

FIGS. 11A-11E are an alignment of the amino acid sequence of CeresClone:1753603 (SEQ ID NO: 4) with homologous and/or orthologous amino acid sequences.

FIGS. 12A-12B are an alignment of the amino acid sequence of CeresClone:1724480 (SEQ ID NO: 580) with homologous and/or orthologous amino acid sequences.

FIGS. 13A-13B are an alignment of the amino acid sequence of CeresAnnot:1514289 (SEQ ID NO: 53) with homologous and/or orthologous amino acid sequences.

FIGS. 14A-14B are an alignment of the amino acid sequence of CeresClone:466497 (SEQ ID NO: 1112) with homologous and/or orthologous amino acid sequences.

FIG. 15 is an alignment of the amino acid sequence of CeresClone:1841236_CW00741 (SEQ ID NO: 634) with homologous and/or orthologous amino acid sequences.

FIGS. 16A-16C are an alignment of the amino acid sequence of CeresClone:1790897_CW00776 (SEQ ID NO: 368) with homologous and/or orthologous amino acid sequences.

Figure 17A:
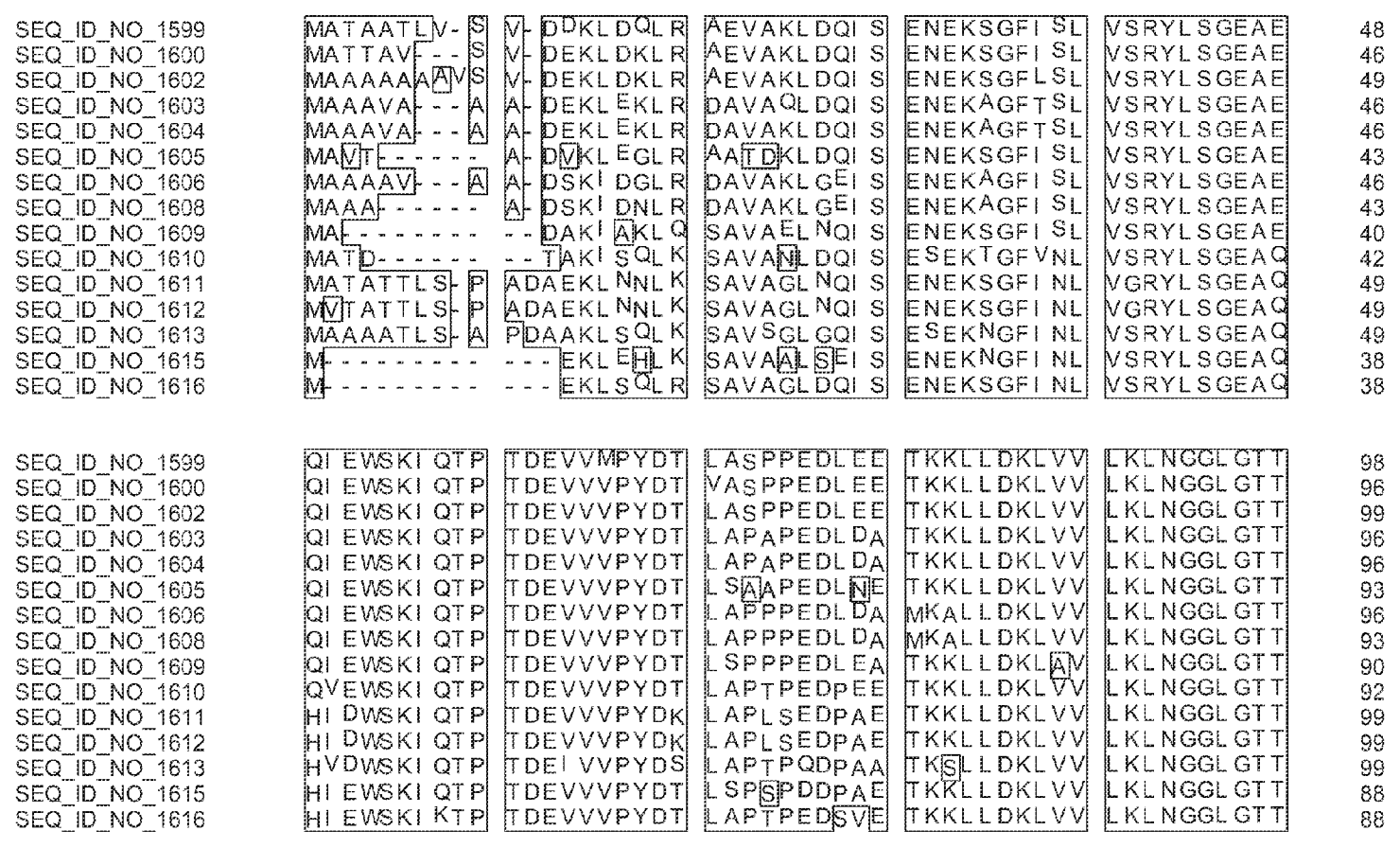
Figure 17C:
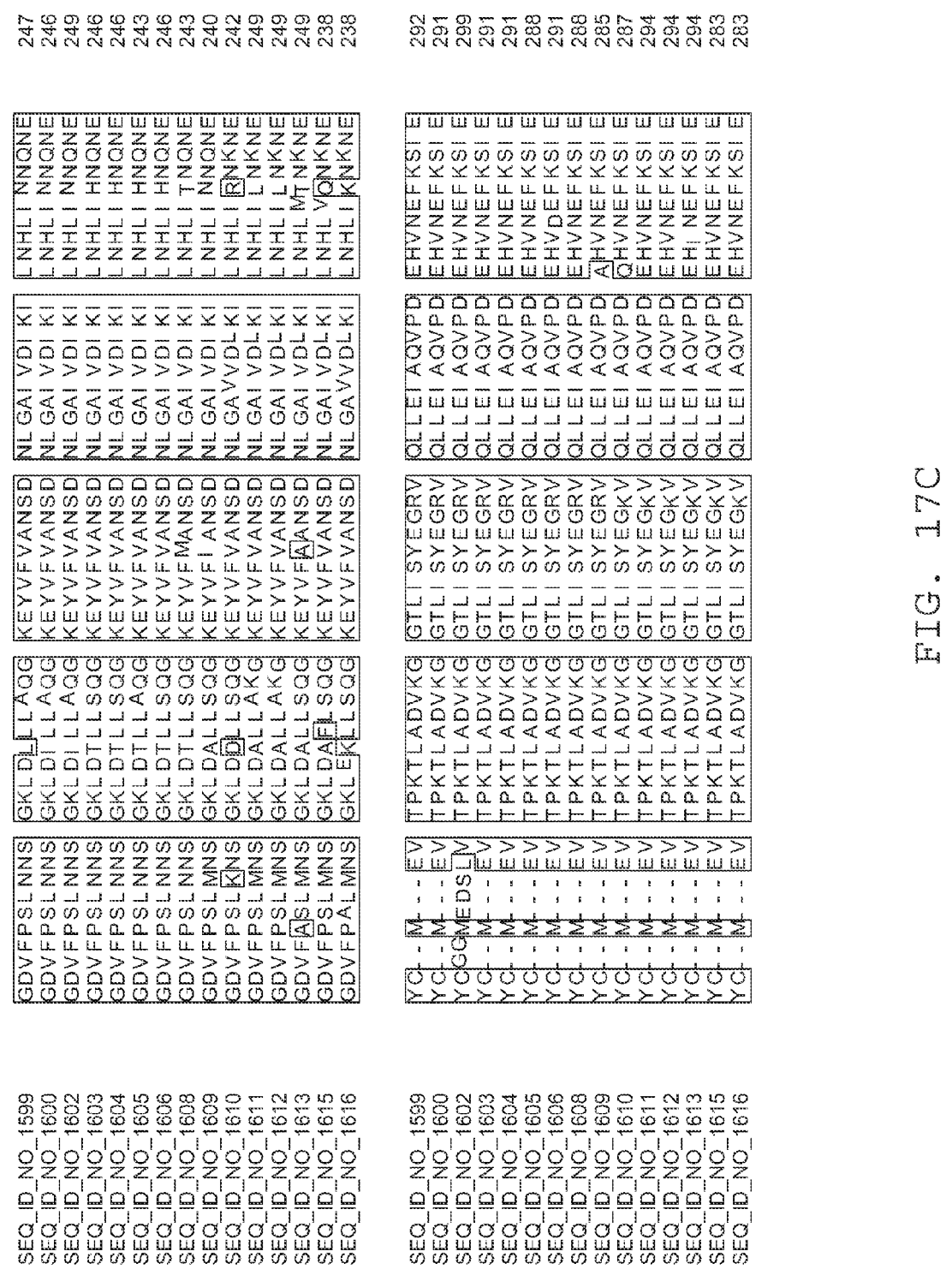
Figure 17D:
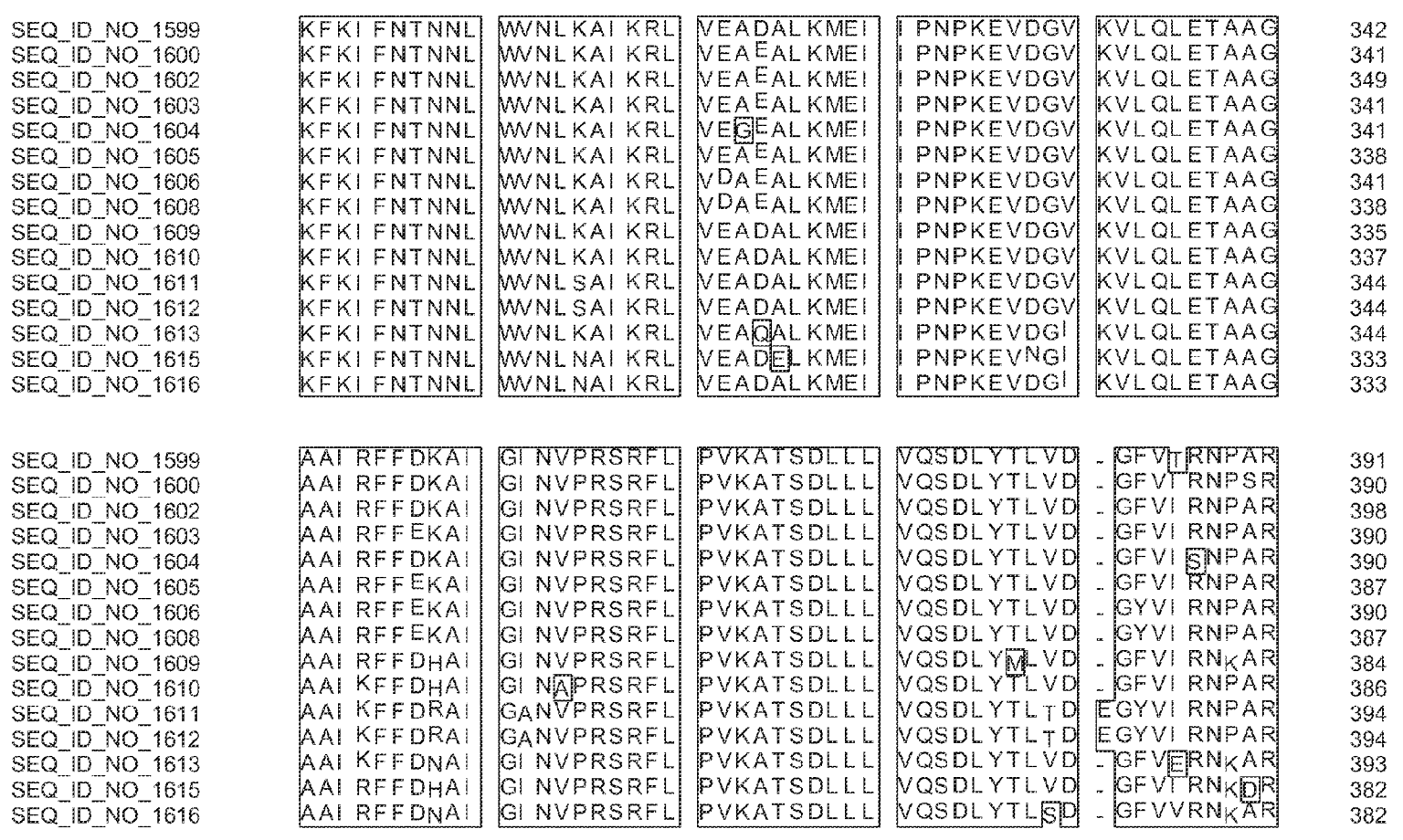
Figure 17E:
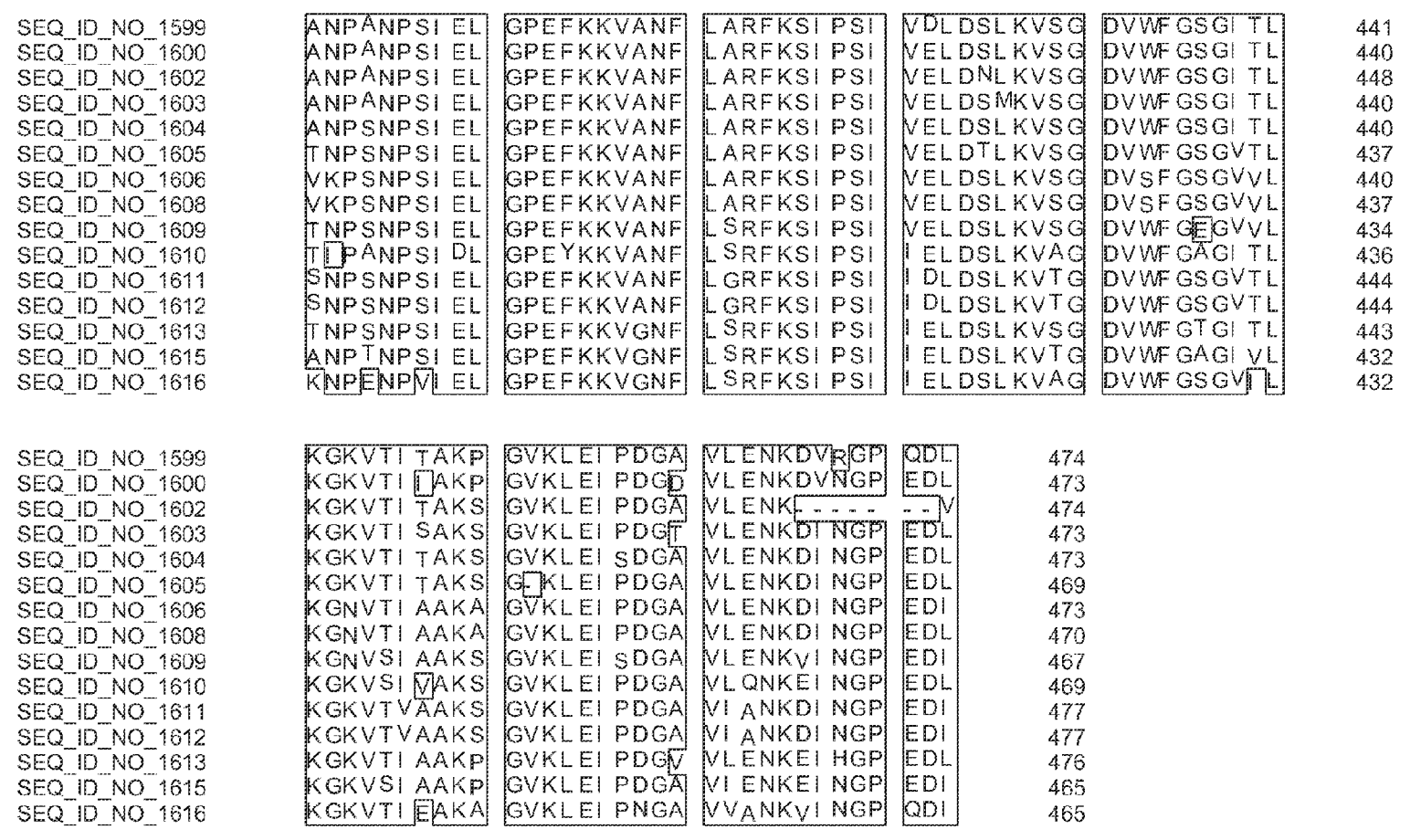

FIGS. 17A-17E are an alignment of the amino acid sequence of CeresClone:1780416_CW00778 (SEQ ID NO: 1599) with homologous and/or orthologous amino acid sequences.

FIG. 18 is an alignment of the amino acid sequence of CeresClone:1773290_CW00761 (SEQ ID NO: 154) with homologous and/or orthologous amino acid sequences.

FIG. 19 is an alignment of the amino acid sequence of CeresClone:1744499_CW00813 (SEQ ID NO: 1035) with homologous and/or orthologous amino acid sequences.

FIG. 20 is an alignment of the amino acid sequence of CeresClone:896483_CW00787 (SEQ ID NO: 741) with homologous and/or orthologous amino acid sequences.

FIGS. 21A-21B are an alignment of the amino acid sequence of CeresClone:225681_CW00792 (SEQ ID NO:187) with homologous and/or orthologous amino acid sequences.

Figure 22D:
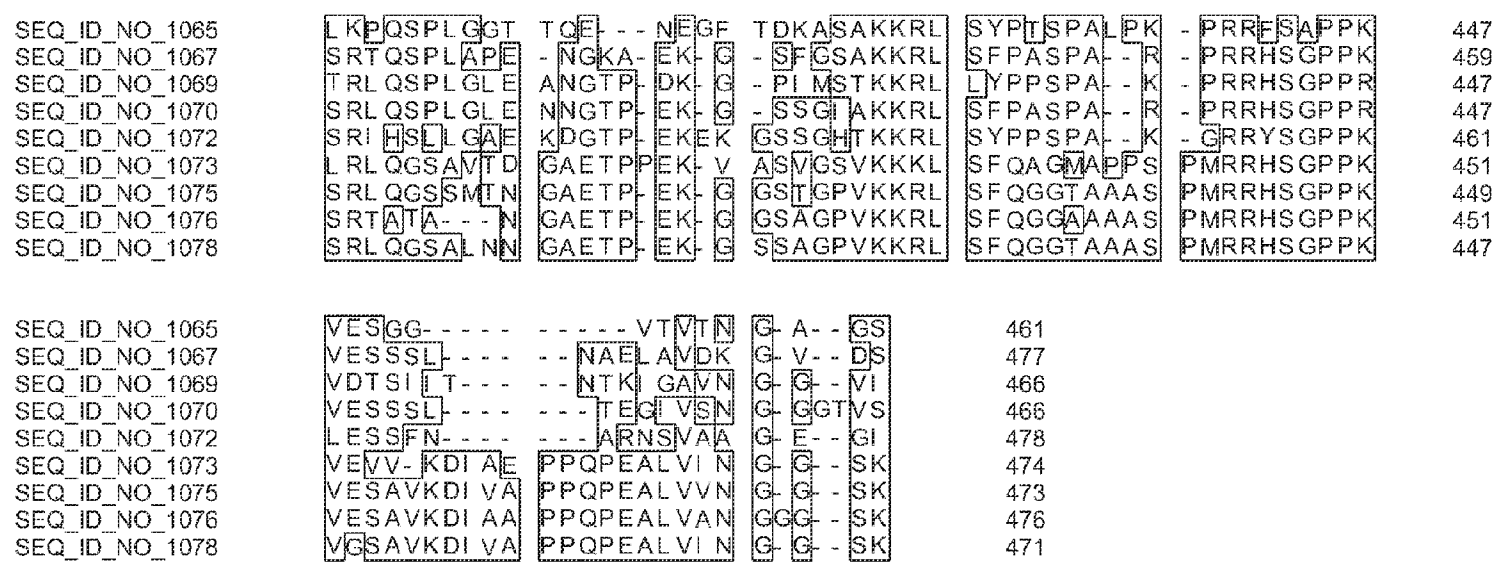

FIGS. 22A-22D are an alignment of the amino acid sequence of CeresClone:106263_CW00780 (SEQ ID NO: 1065) with homologous and/or orthologous amino acid sequences.

FIGS. 23A-23B are an alignment of the amino acid sequence of CeresAnnot:1310682 (SEQ ID NO: 1592) with homologous and/or orthologous amino acid sequences.

FIGS. 24A-24C are an alignment of the amino acid sequence of CeresAnnot:838049_CW00759 (SEQ ID NO: 851) with homologous and/or orthologous amino acid sequences.

FIGS. 25A-25B are an alignment of the amino acid sequence of CeresAnnot:553111_CW00758 (SEQ ID NO: 1016) with homologous and/or orthologous amino acid sequences.

FIG. 26 is an alignment of the amino acid sequence of CeresClone:1238706 (SEQ ID NO: 2186) with homologous and/or orthologous amino acid sequences.

Figure 27A:
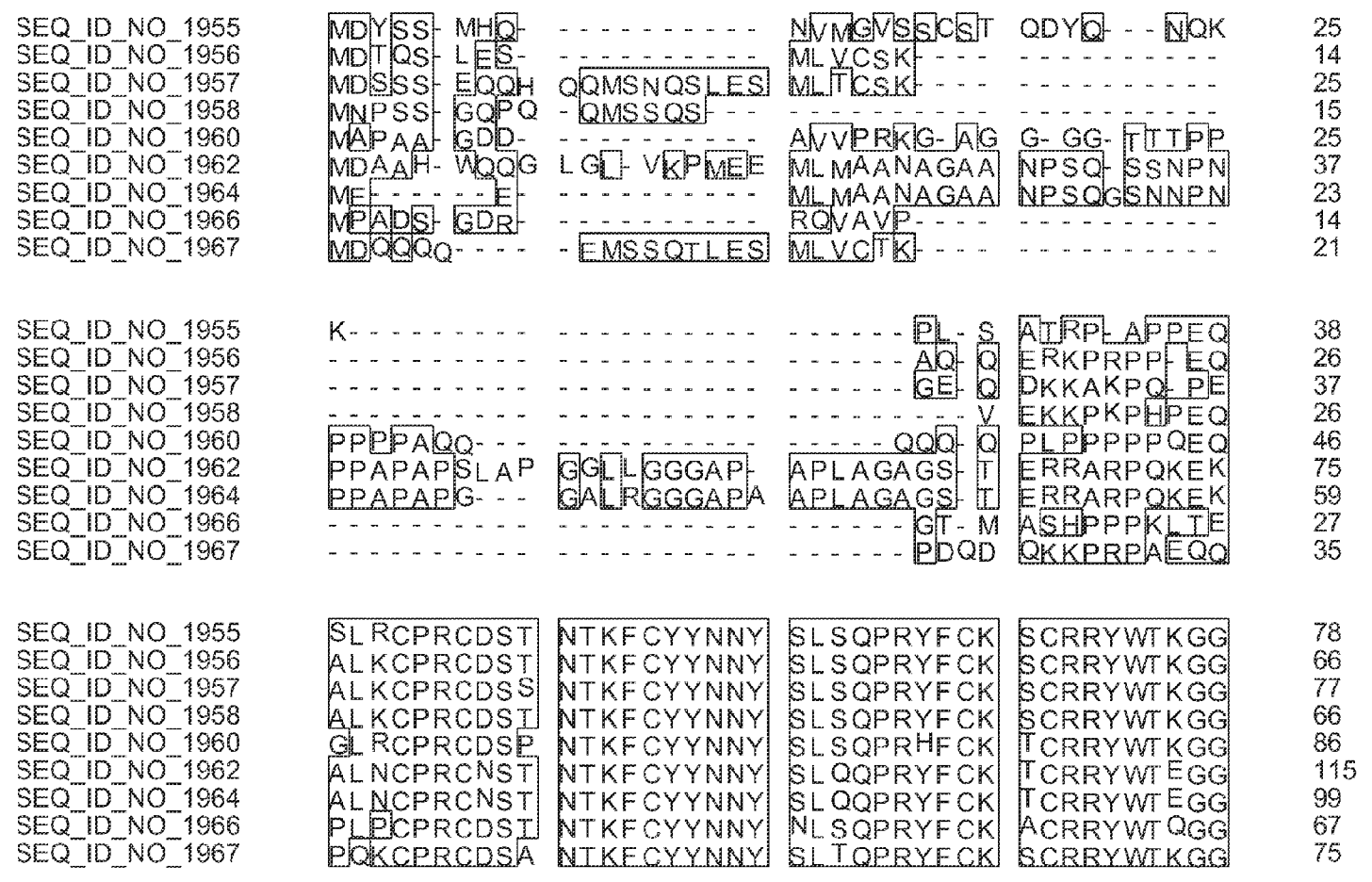
Figure 27B:
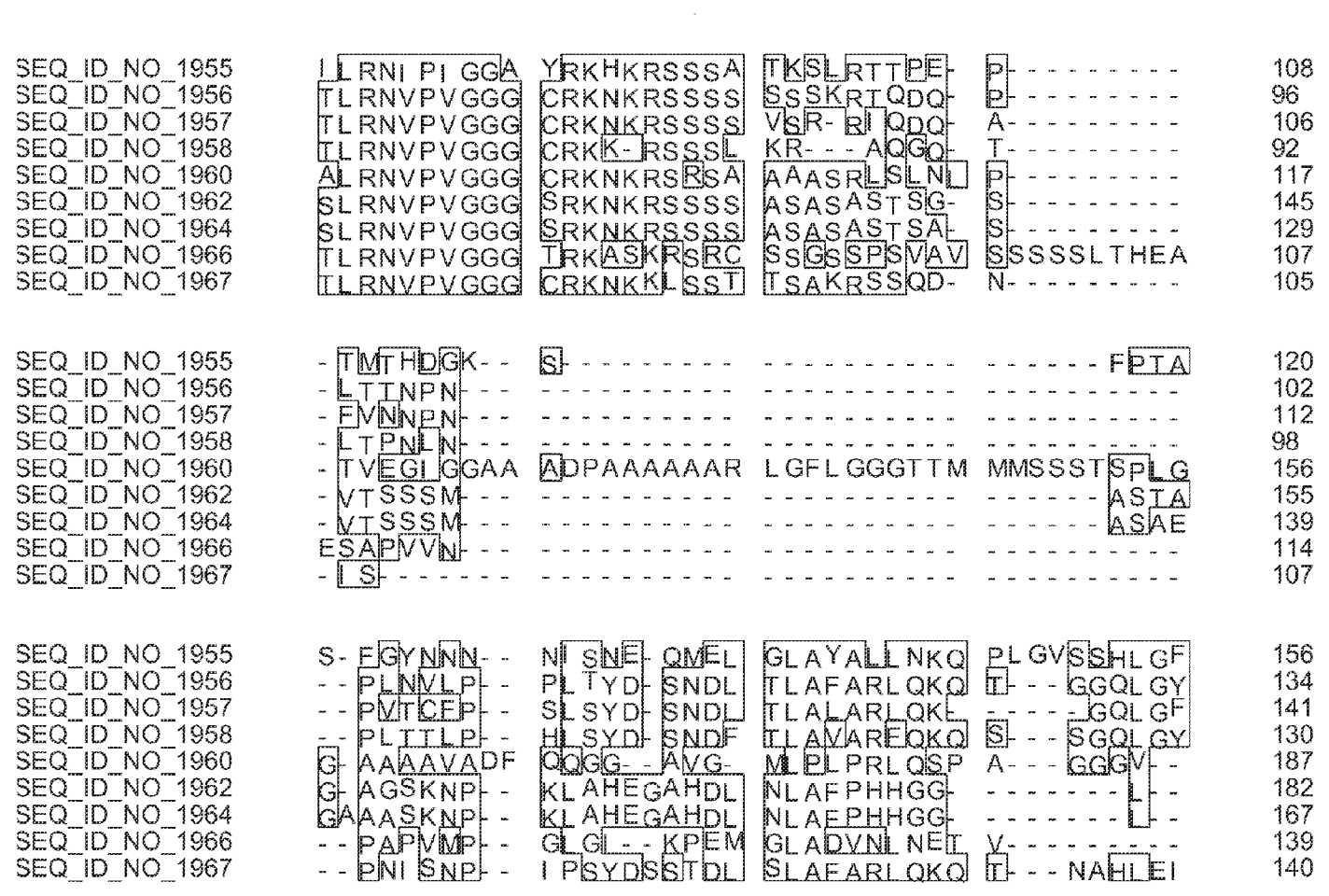
Figure 27C:
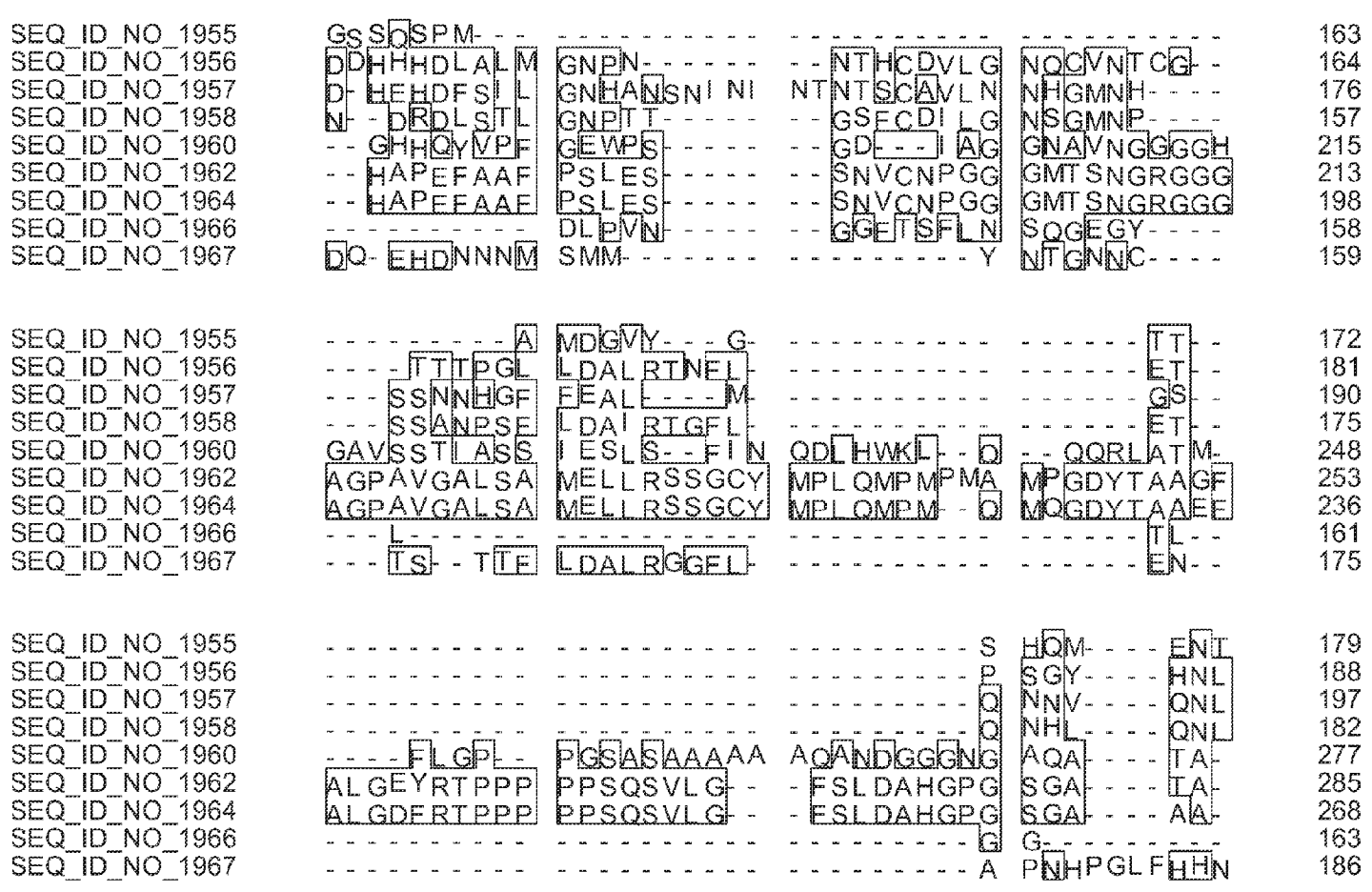
Figure 27D:
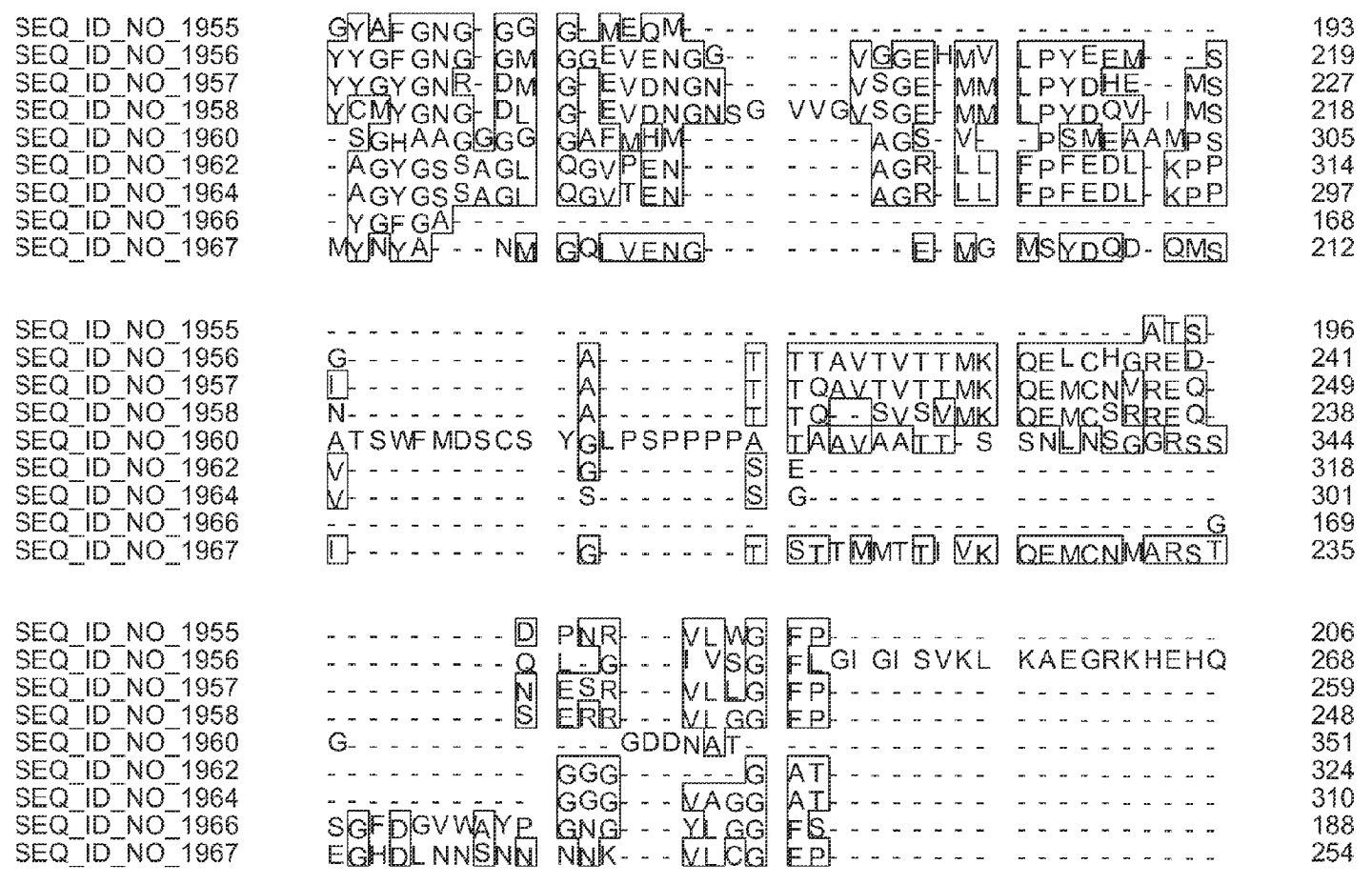
Figure 27E:
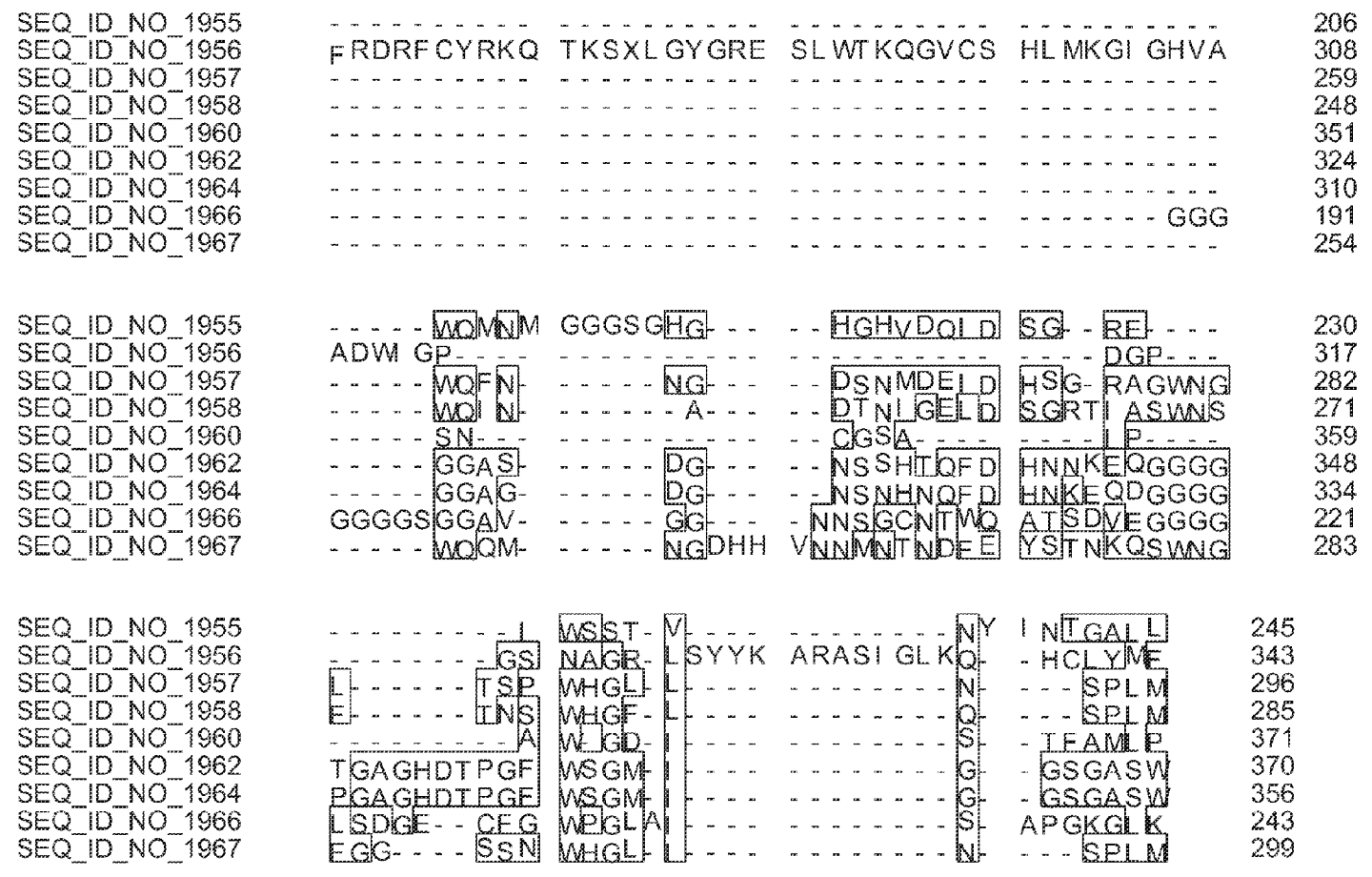

FIGS. 27A-27E are an alignment of the amino acid sequence of CeresAnnot:529860 (SEQ ID NO: 1955) with homologous and/or orthologous amino acid sequences.

FIG. 28 is an alignment of the amino acid sequence of CeresAnnot:851842 (SEQ ID NO: 2566) with homologous and/or orthologous amino acid sequences.

Figure 29A:
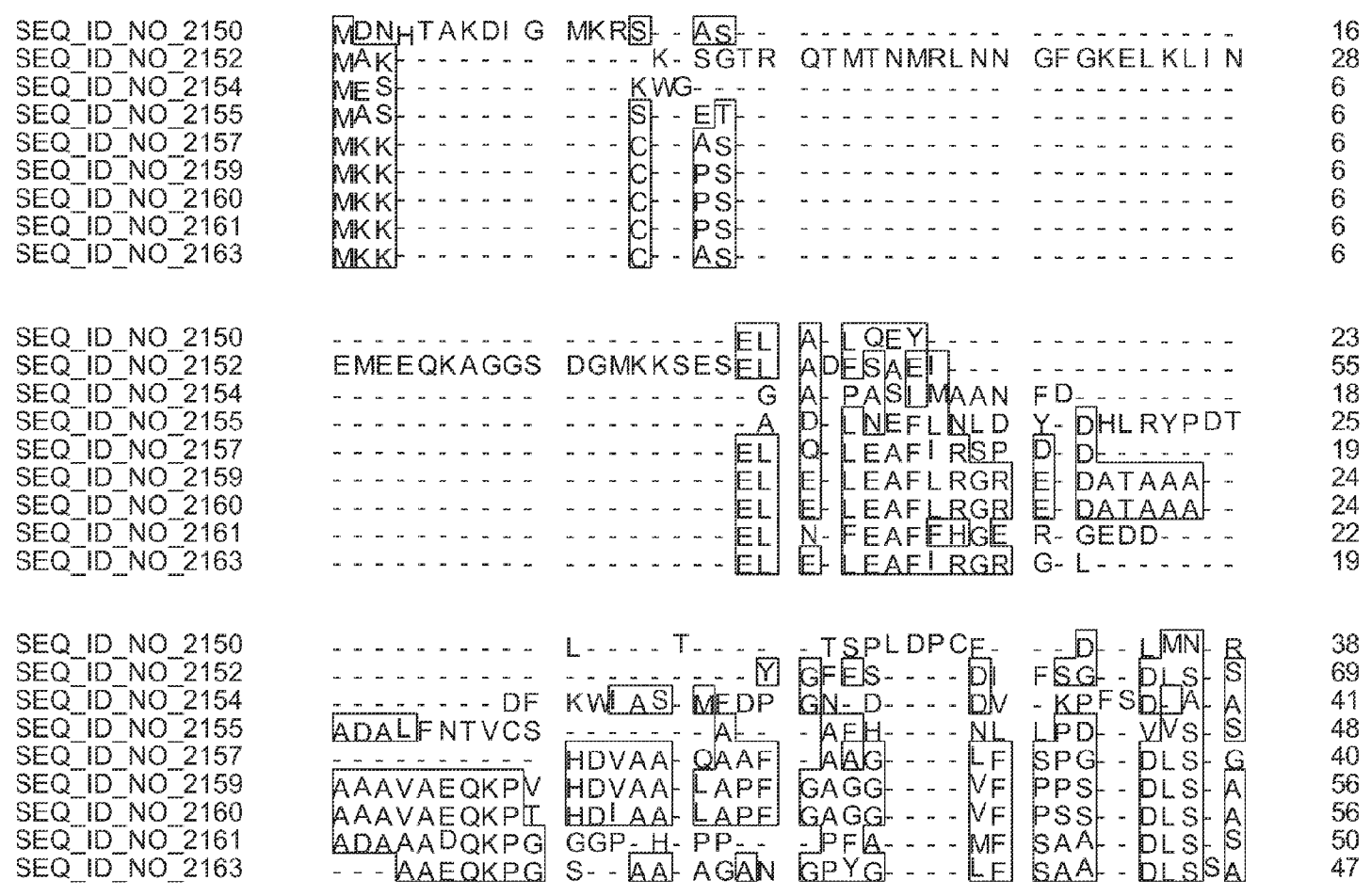
Figure 29C:
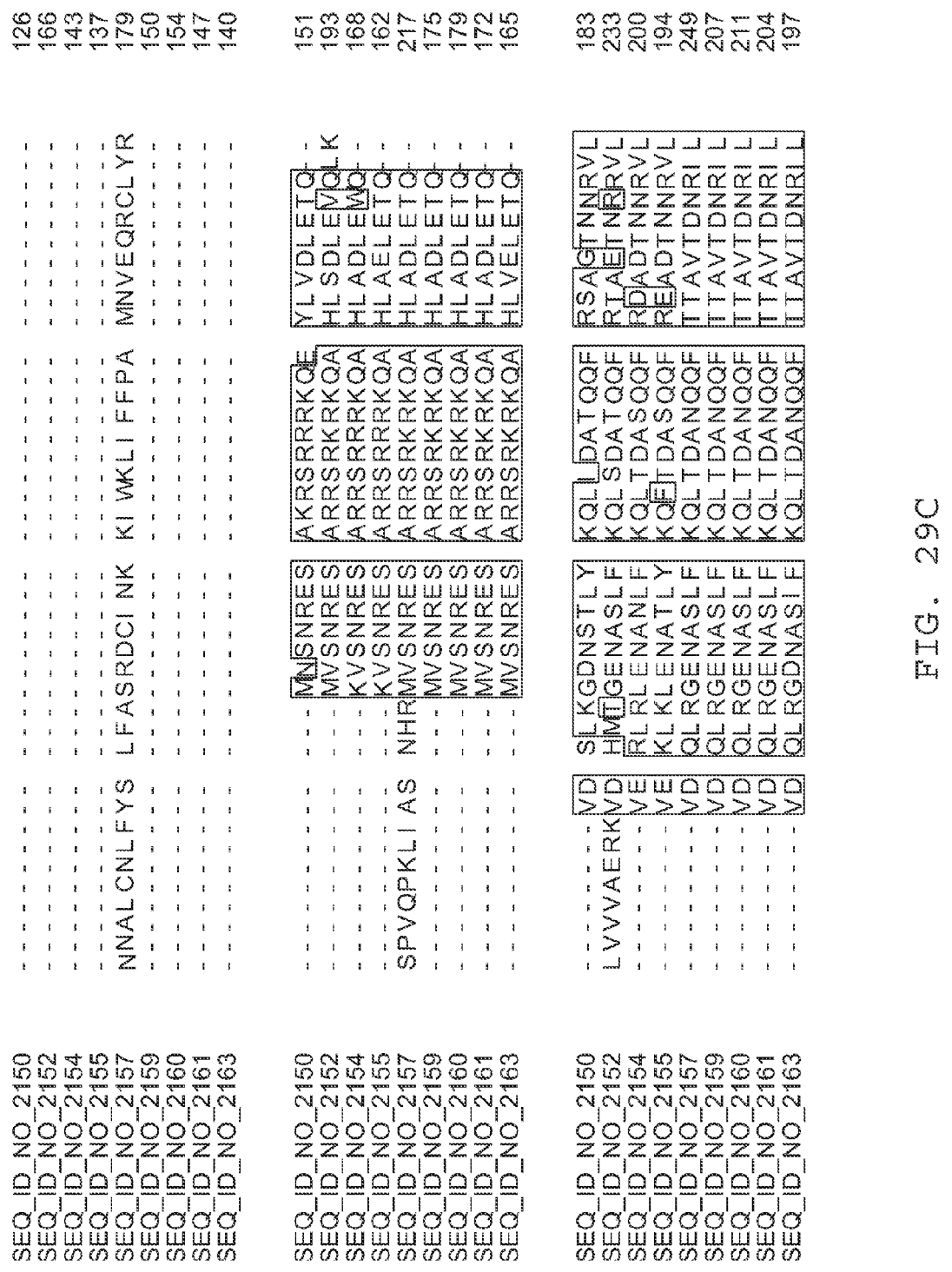
Figure 29D:
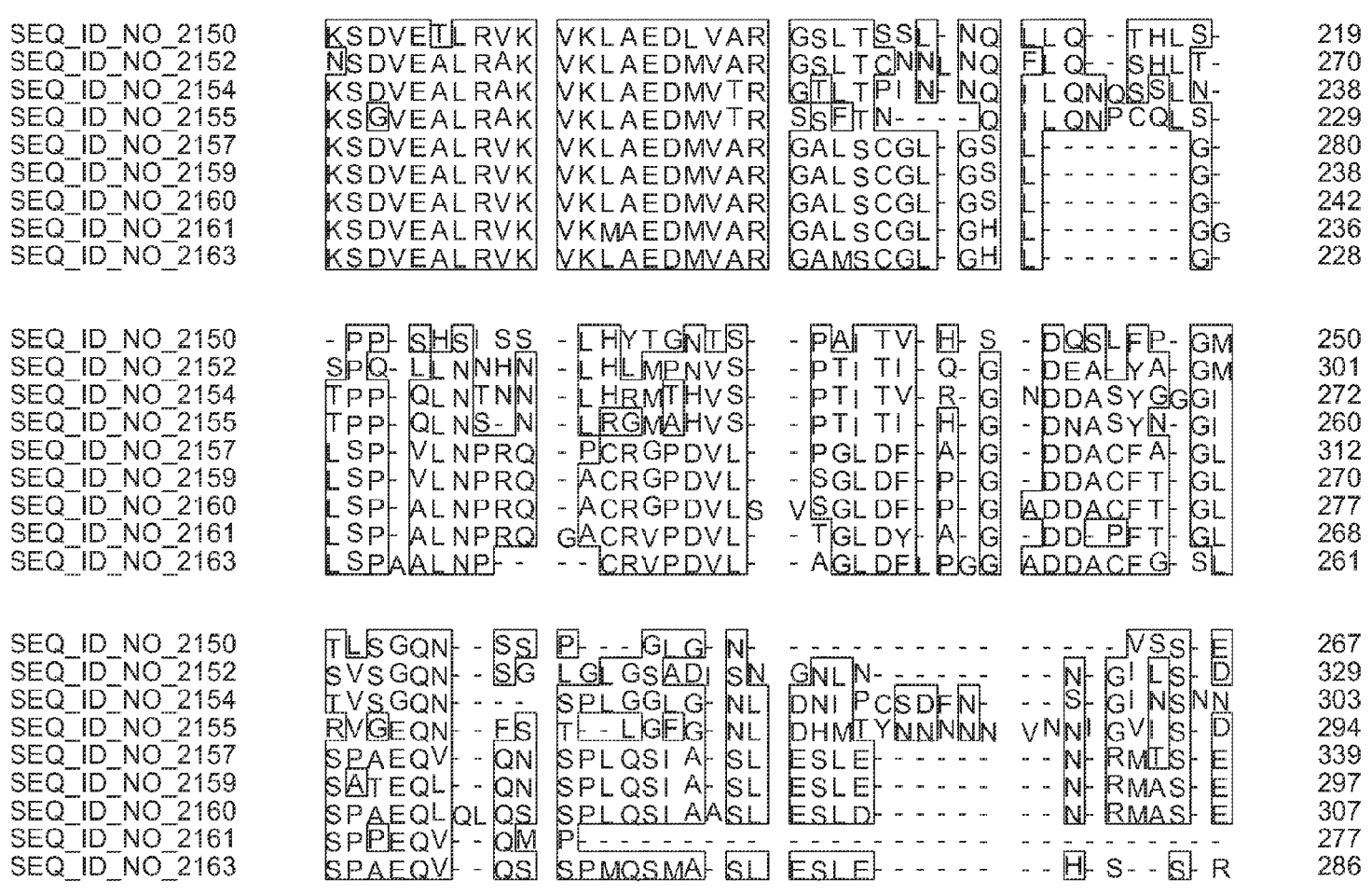

FIGS. 29A-29E are an alignment of the amino acid sequence of CeresAnnot:853198 (SEQ ID NO: 2150) with homologous and/or orthologous amino acid sequences.

Figure 30D:
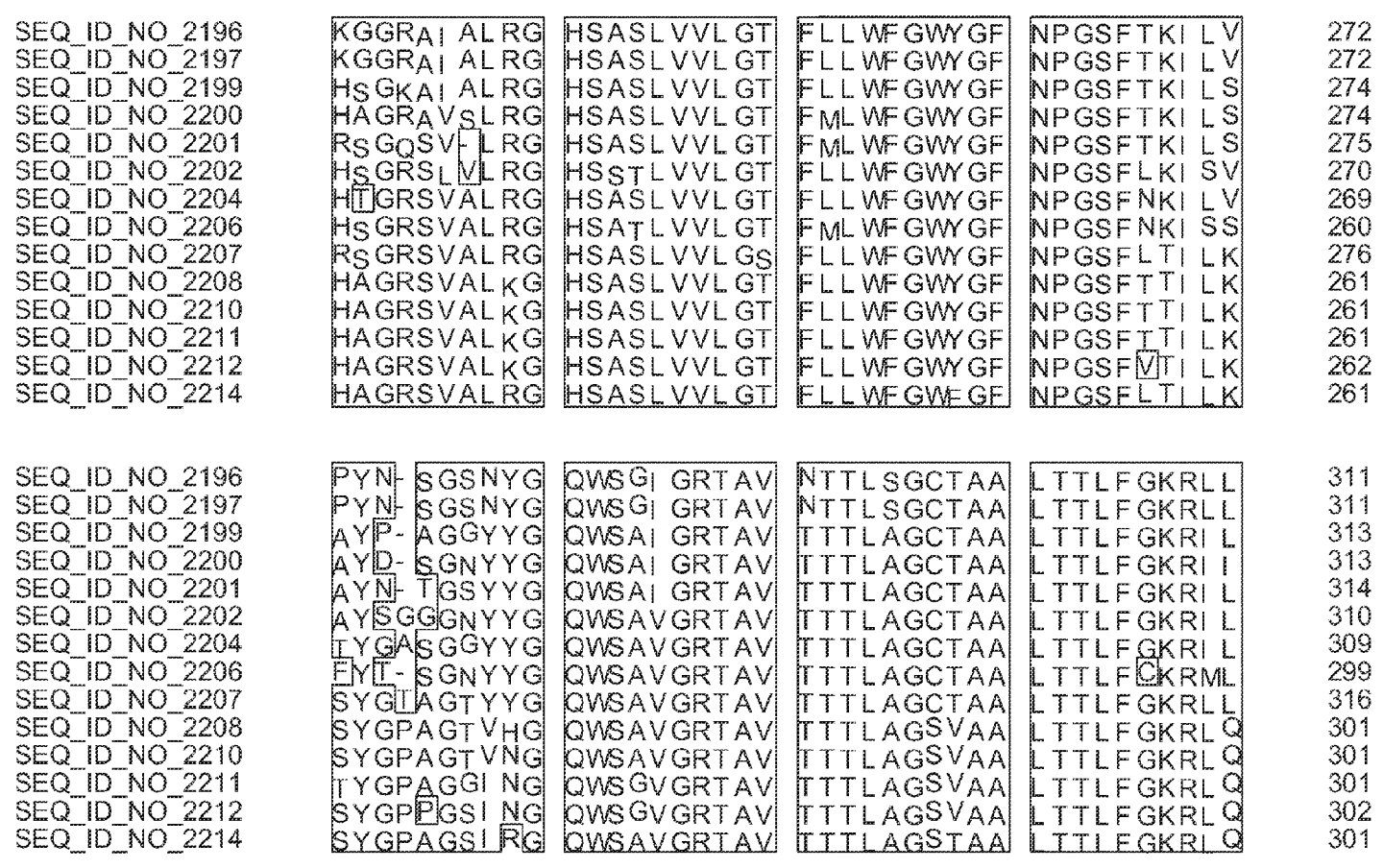
Figure 30E:
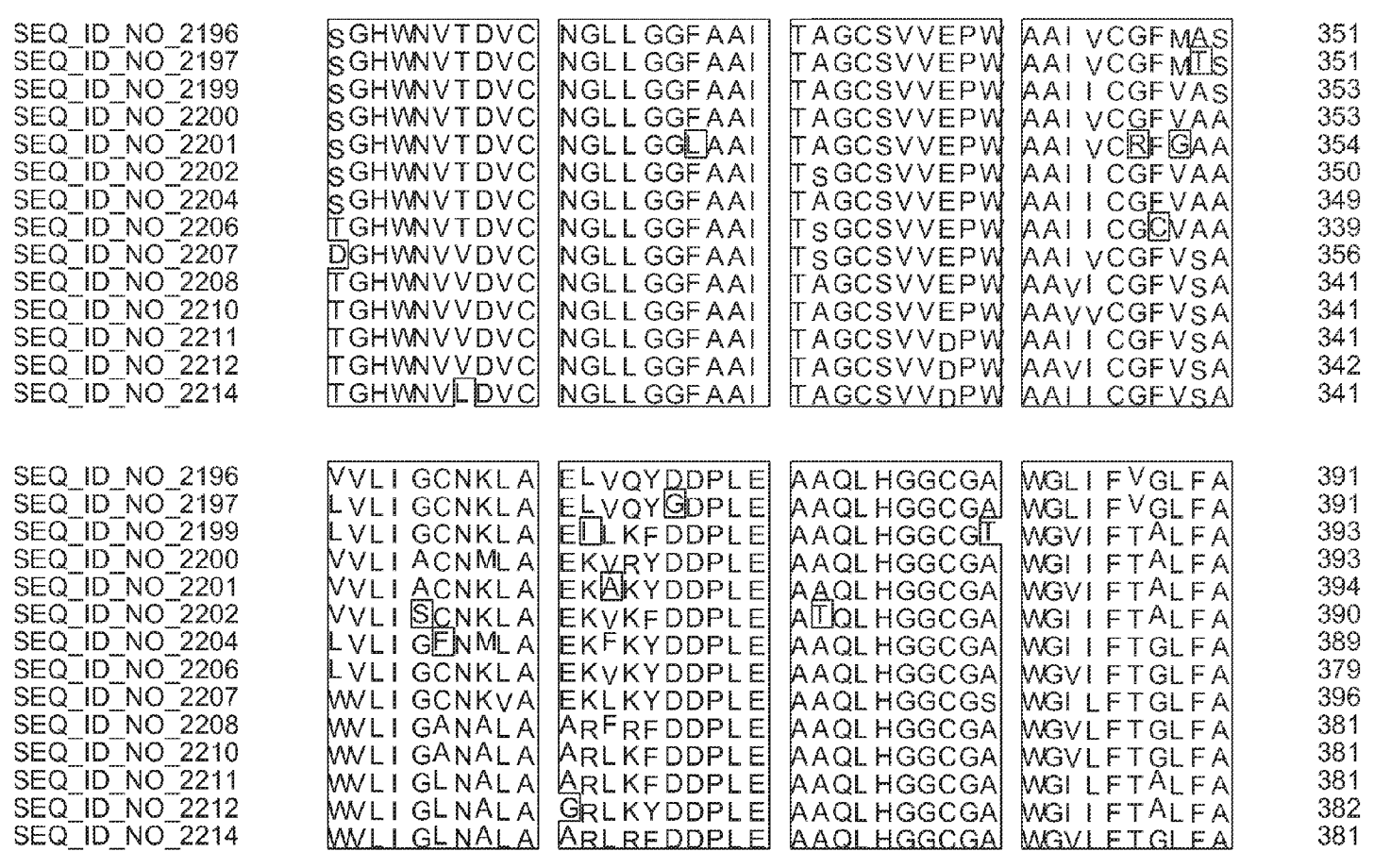
Figure 30F:
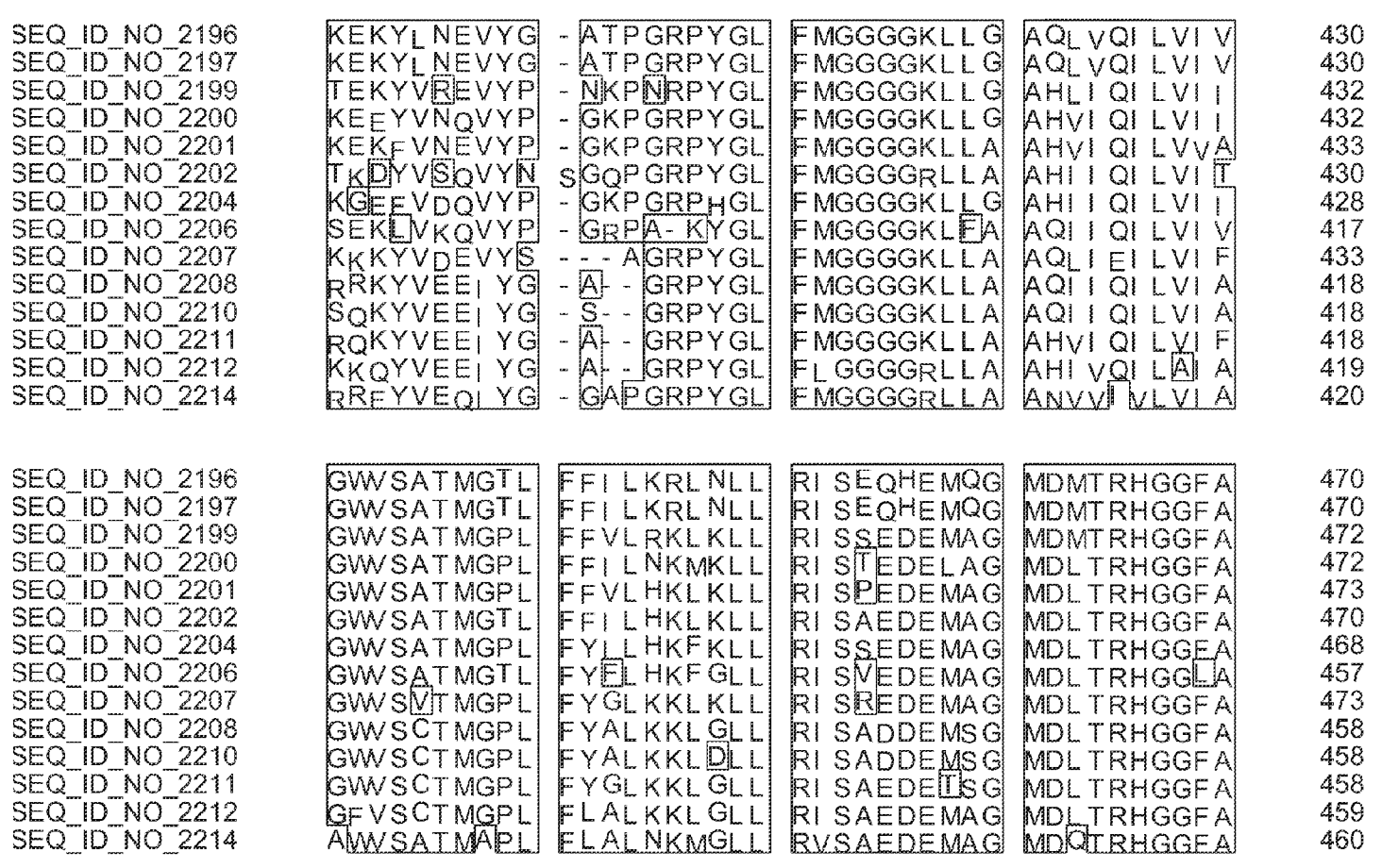
Figure 30G:
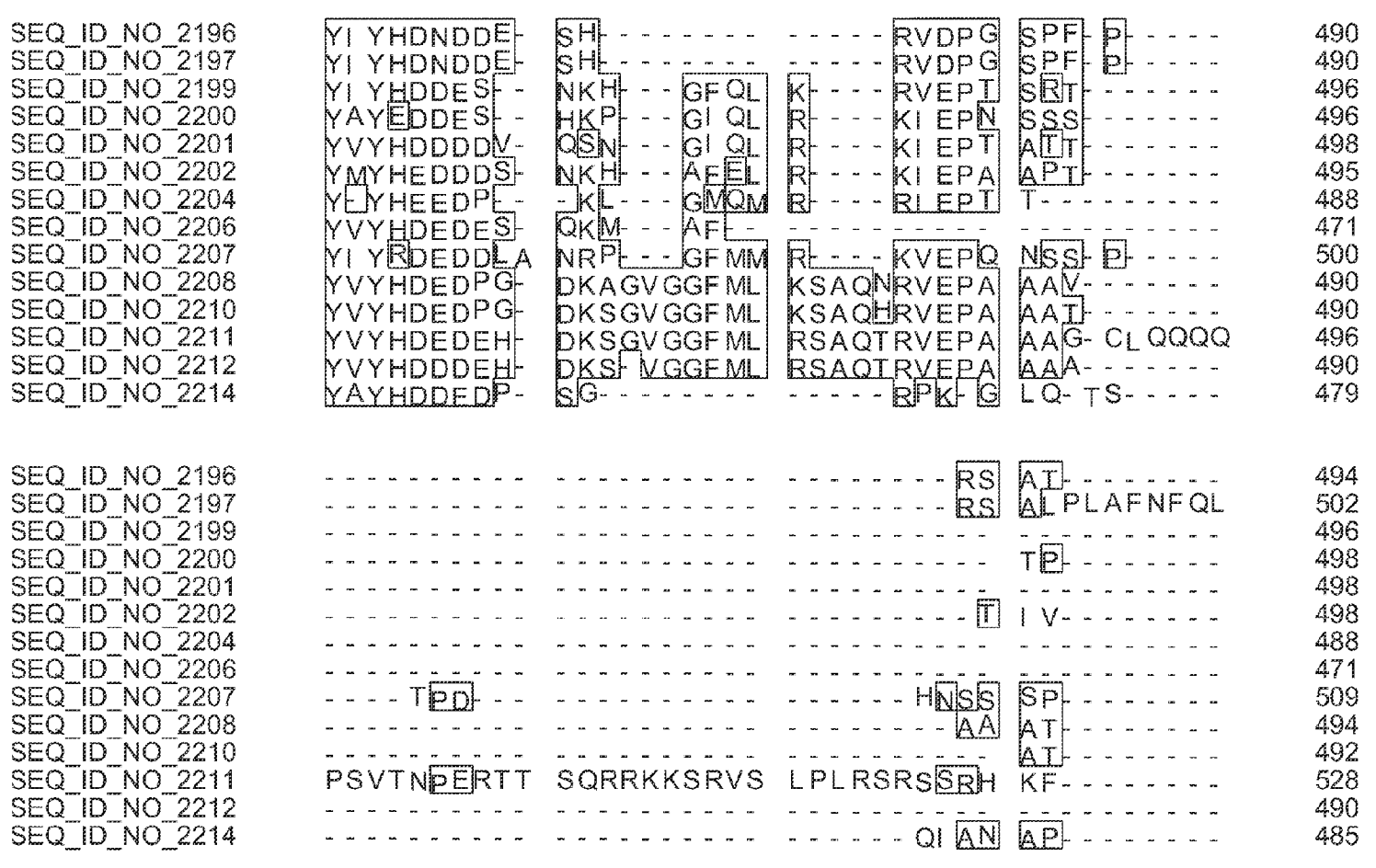
Figure 30H:
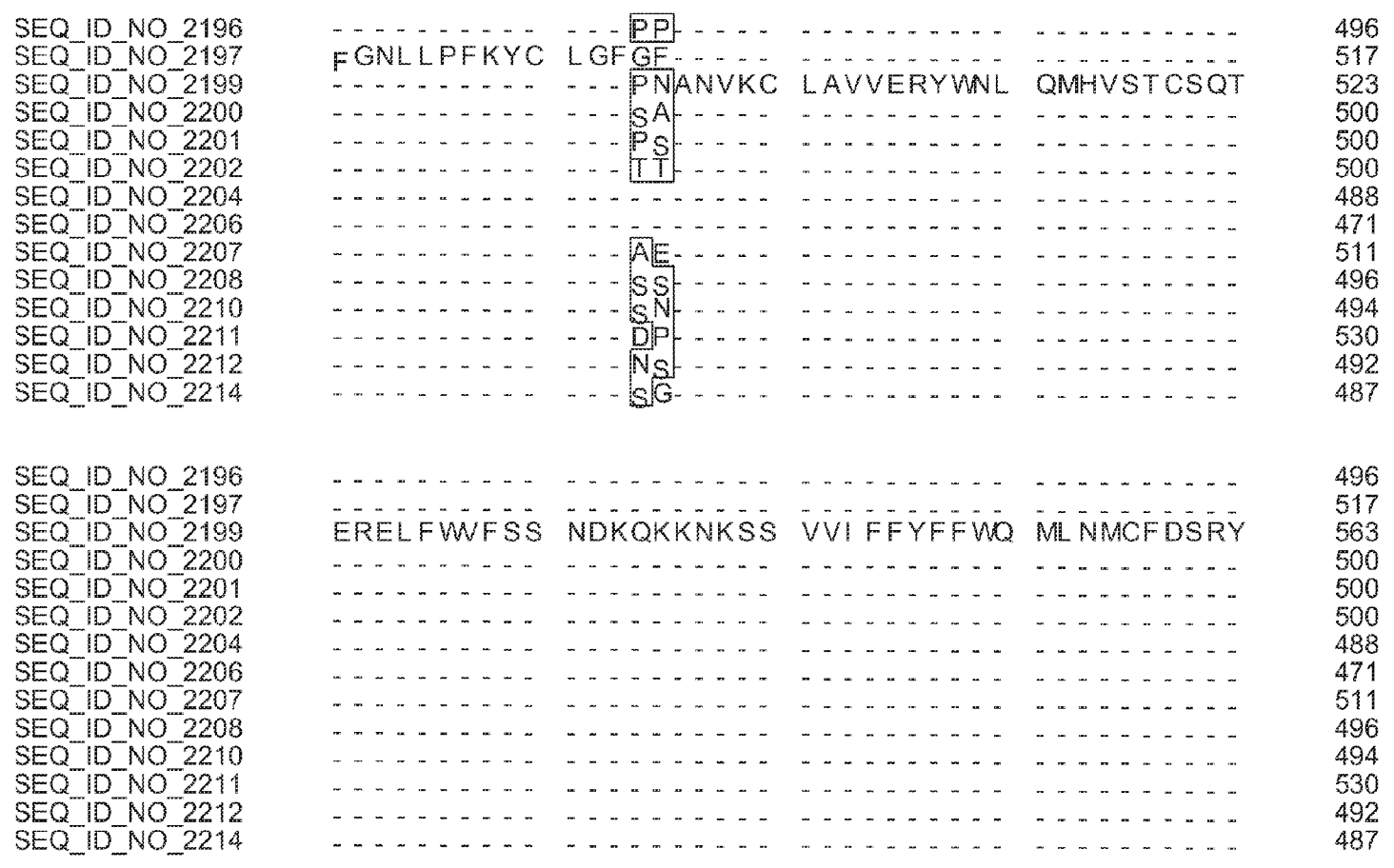
Figure 30L:
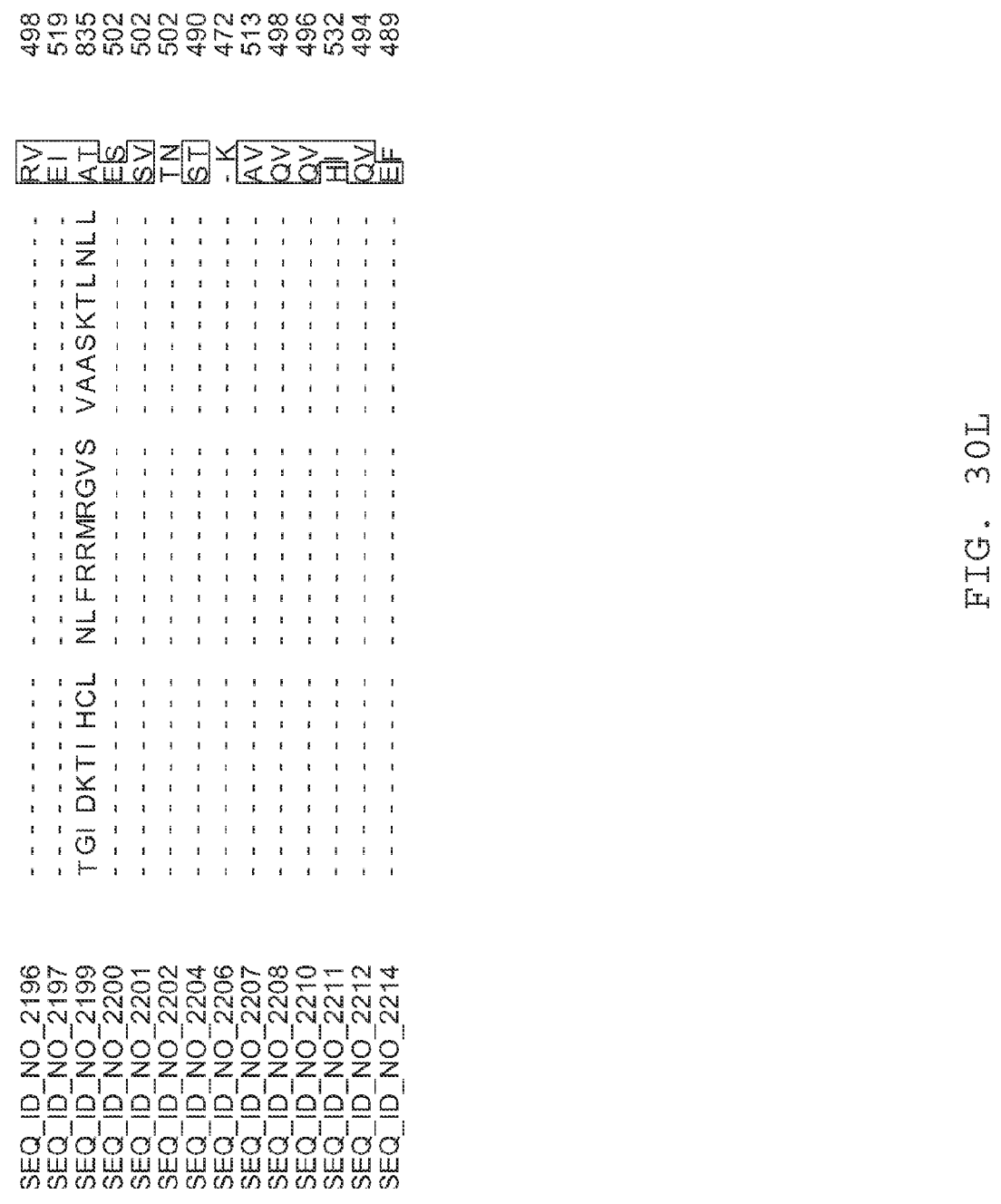

FIGS. 30A-30L are an alignment of the amino acid sequence of CeresAnnot:873343 (SEQ ID NO: 2196) with homologous and/or orthologous amino acid sequences.

FIGS. 31A-31K are an alignment of the amino acid sequence of CeresAnnot:878887 (SEQ ID NO: 2493) with homologous and/or orthologous amino acid sequences.

FIGS. 32A-32C are an alignment of the amino acid sequence of CeresAnnot:1440417 (SEQ ID NO: 2271) with homologous and/or orthologous amino acid sequences.

Figure 33A:
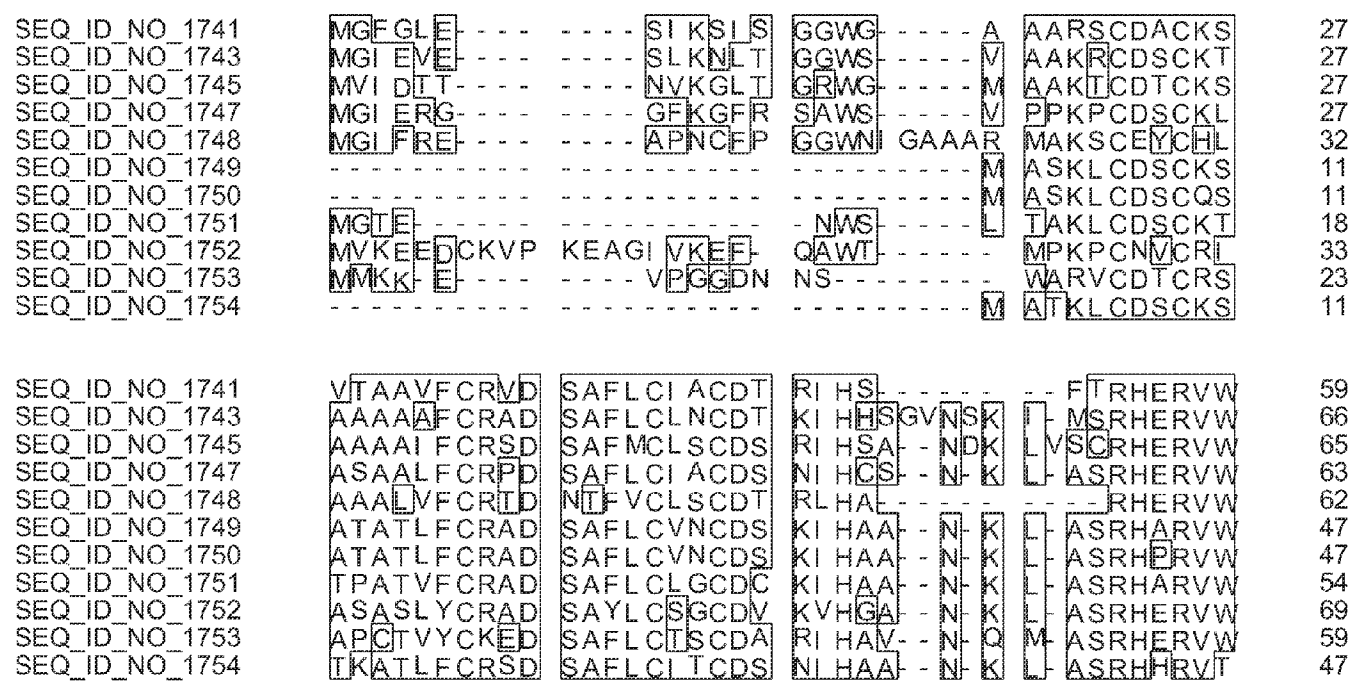
Figure 33B:
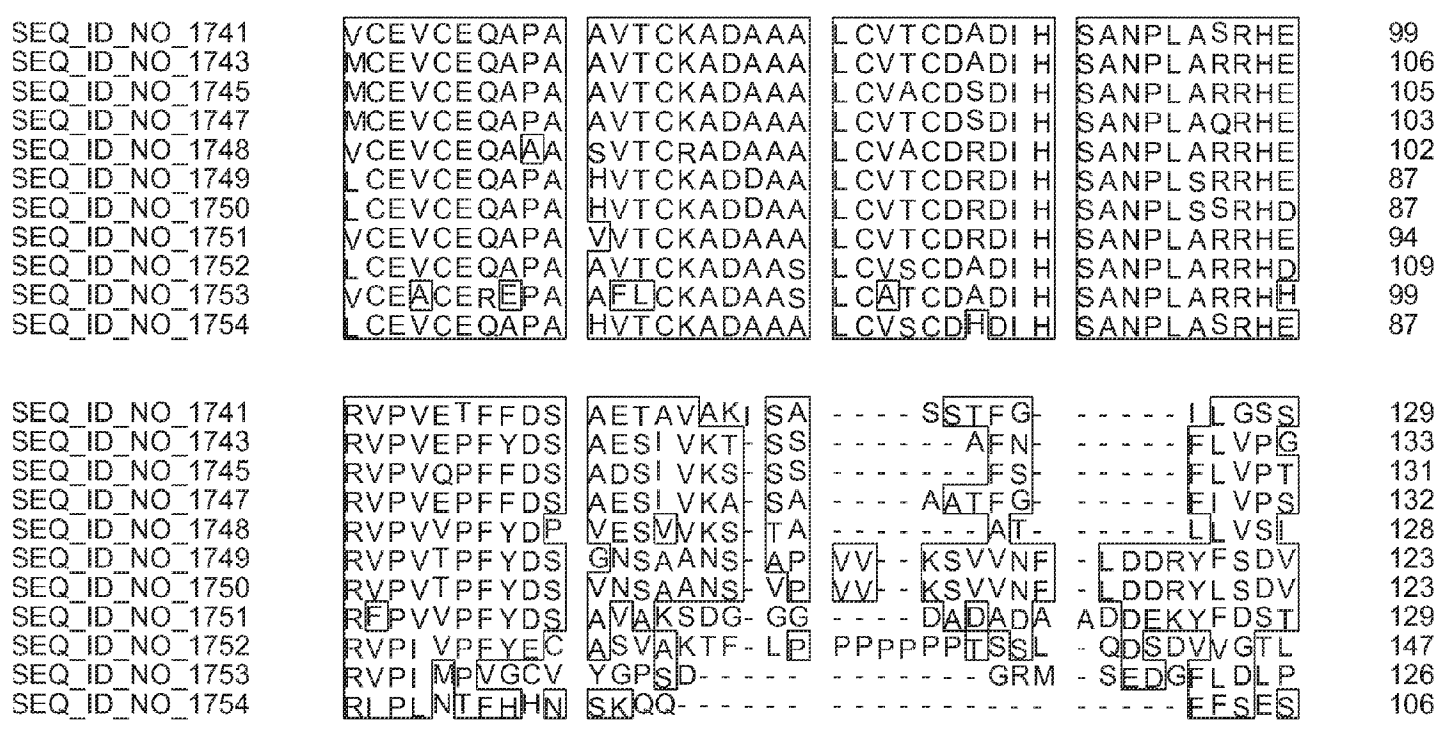
Figure 33C:
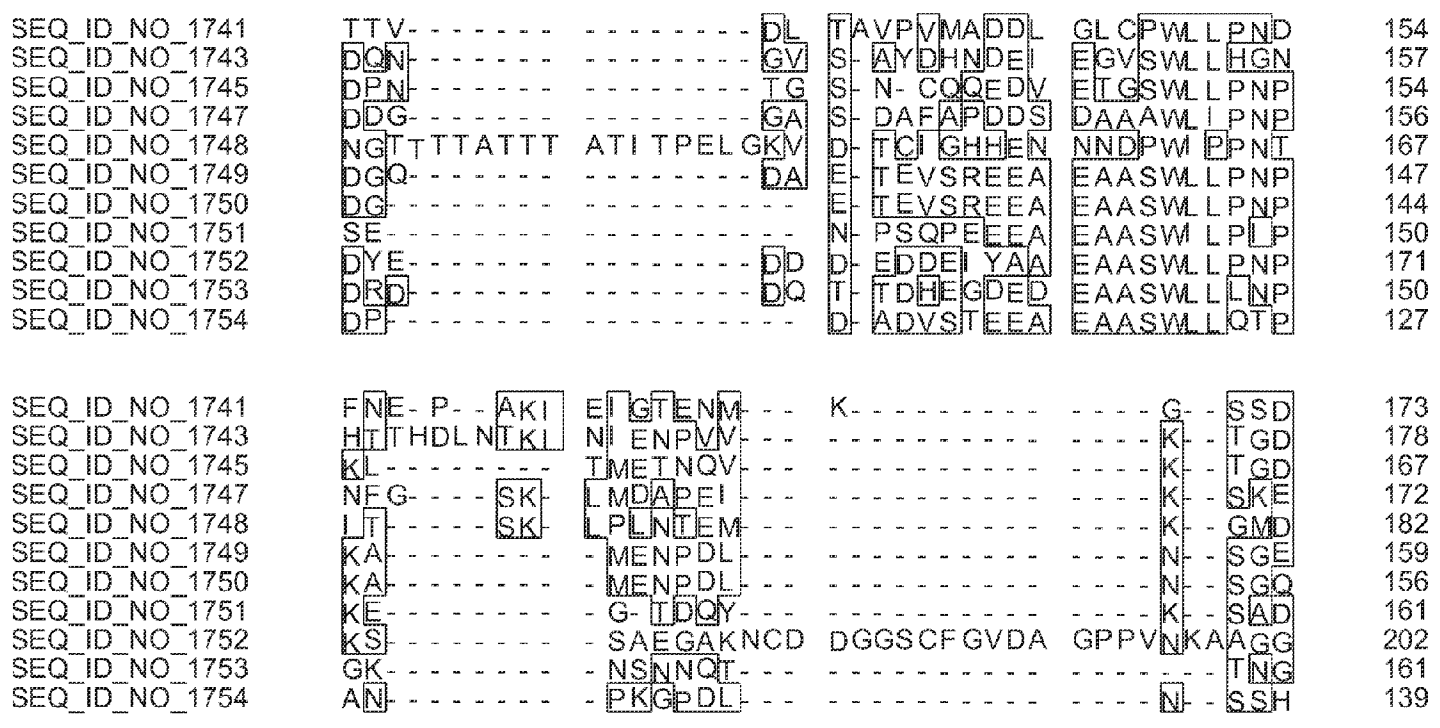
Figure 33D:
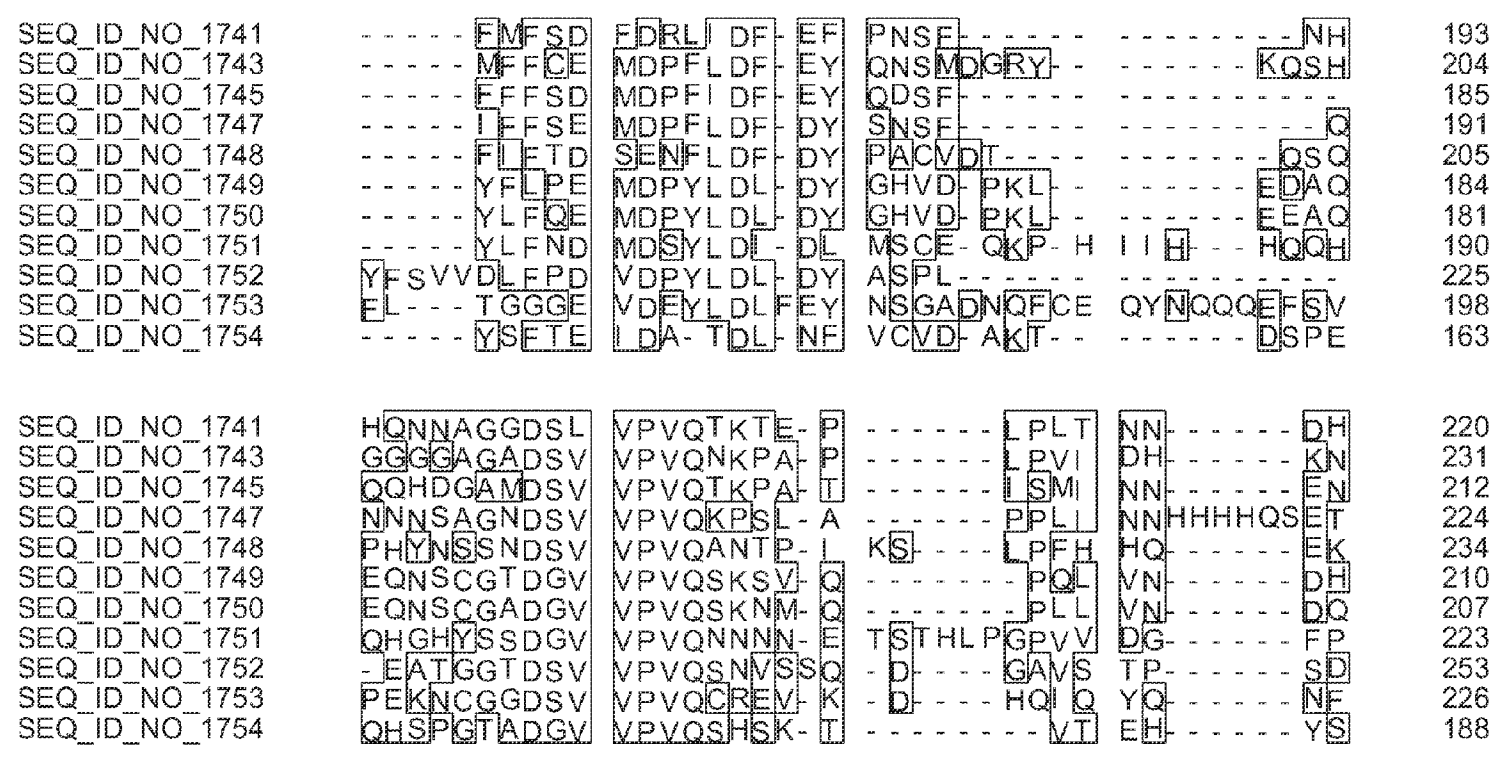
Figure 33F:
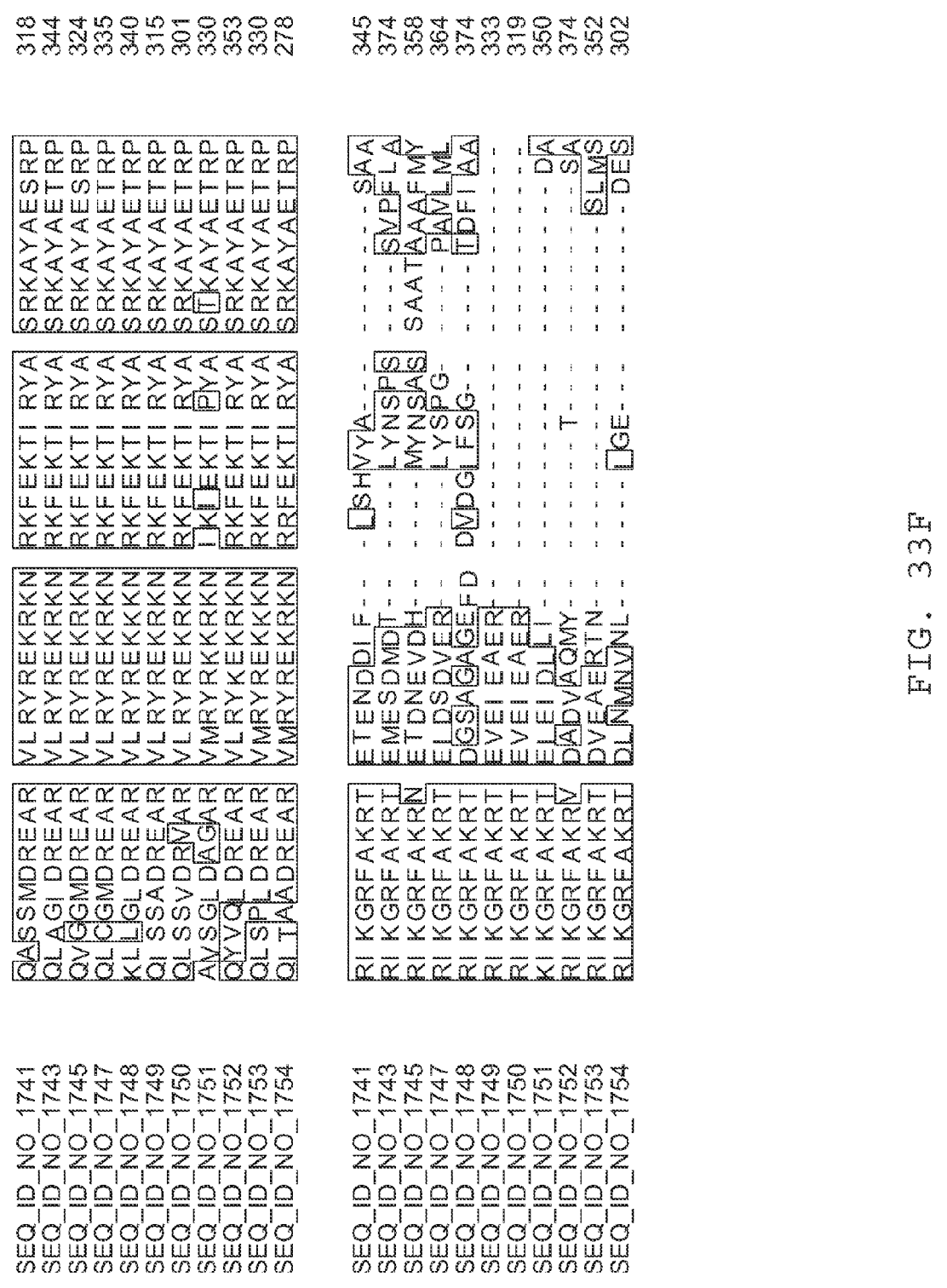

FIGS. 33A-33G are an alignment of the amino acid sequence of CeresClone:6639 (SEQ ID NO: 1741) with homologous and/or orthologous amino acid sequences.

FIG. 34 is an alignment of the amino acid sequence of CeresClone:11830 (SEQ ID NO: 1980) with homologous and/or orthologous amino acid sequences.

FIGS. 35A-35D are an alignment of the amino acid sequence of CeresClone:32753 (SEQ ID NO: 1812) with homologous and/or orthologous amino acid sequences.

FIGS. 36A-36C are an alignment of the amino acid sequence of CeresClone:39378 (SEQ ID NO: 2124) with homologous and/or orthologous amino acid sequences.

FIGS. 37A-37D are an alignment of the amino acid sequence of CeresClone:93867 (SEQ ID NO: 2035) with homologous and/or orthologous amino acid sequences.

Figure 38A:
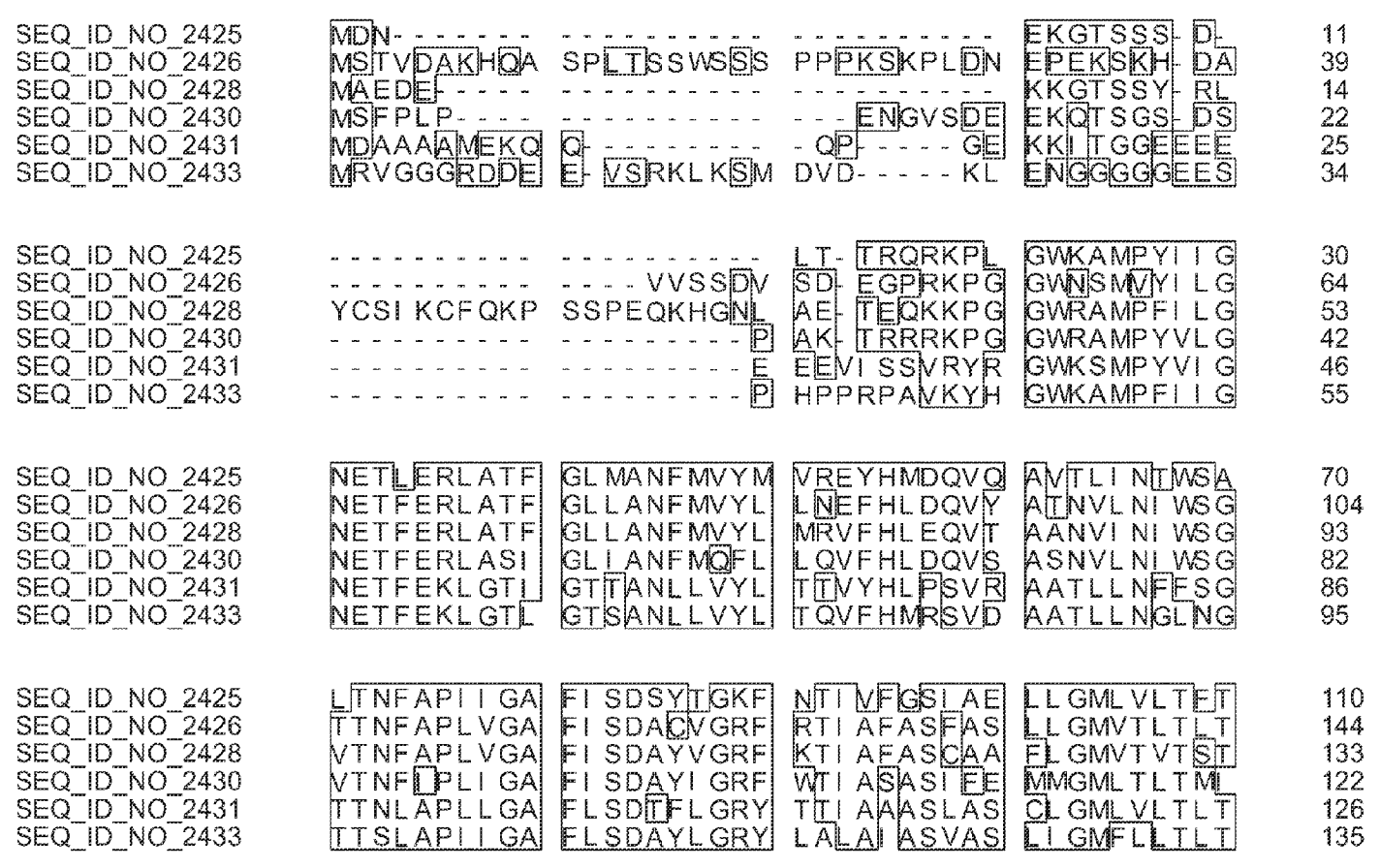
Figure 38C:
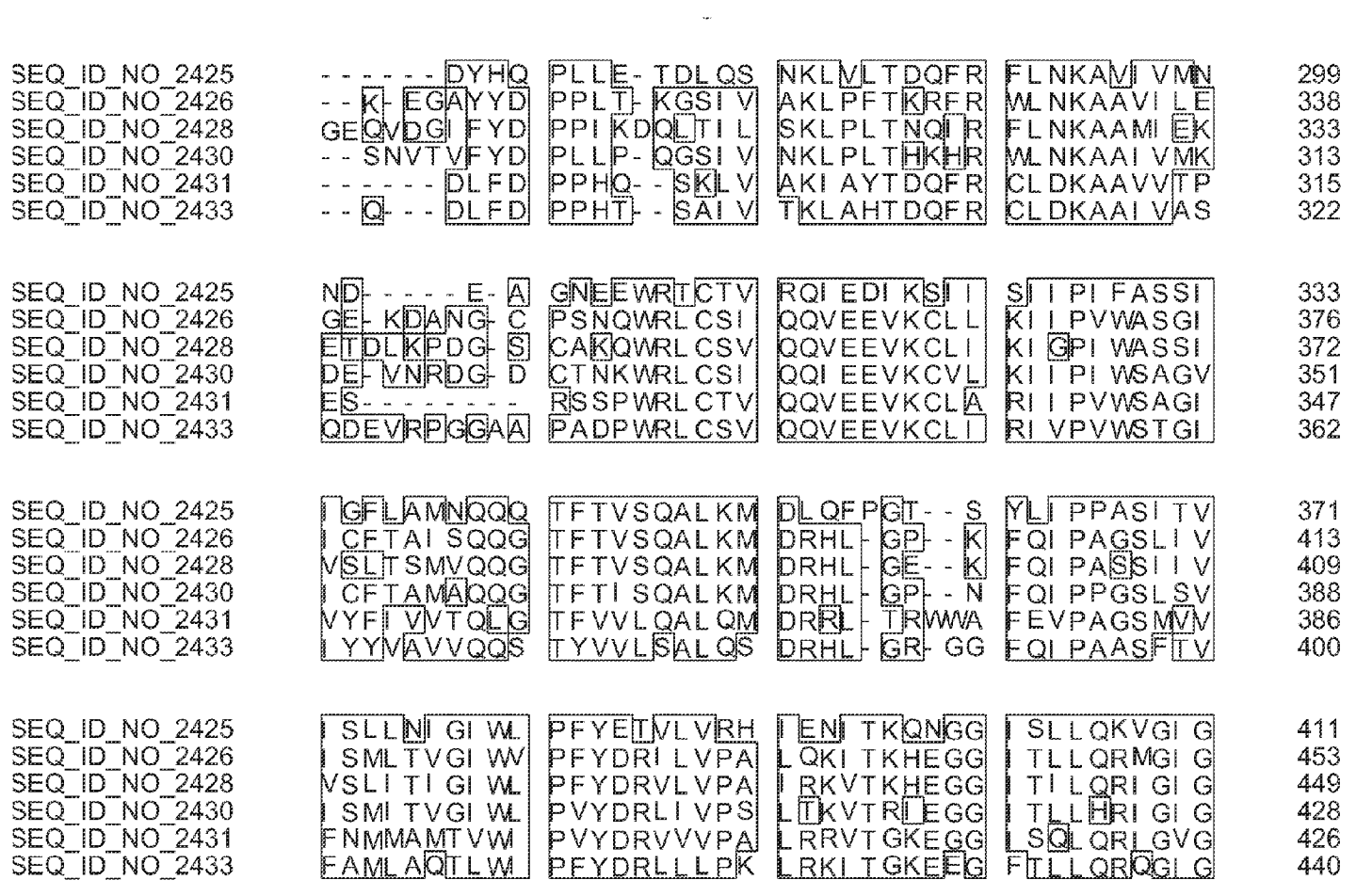
Figure 38D:
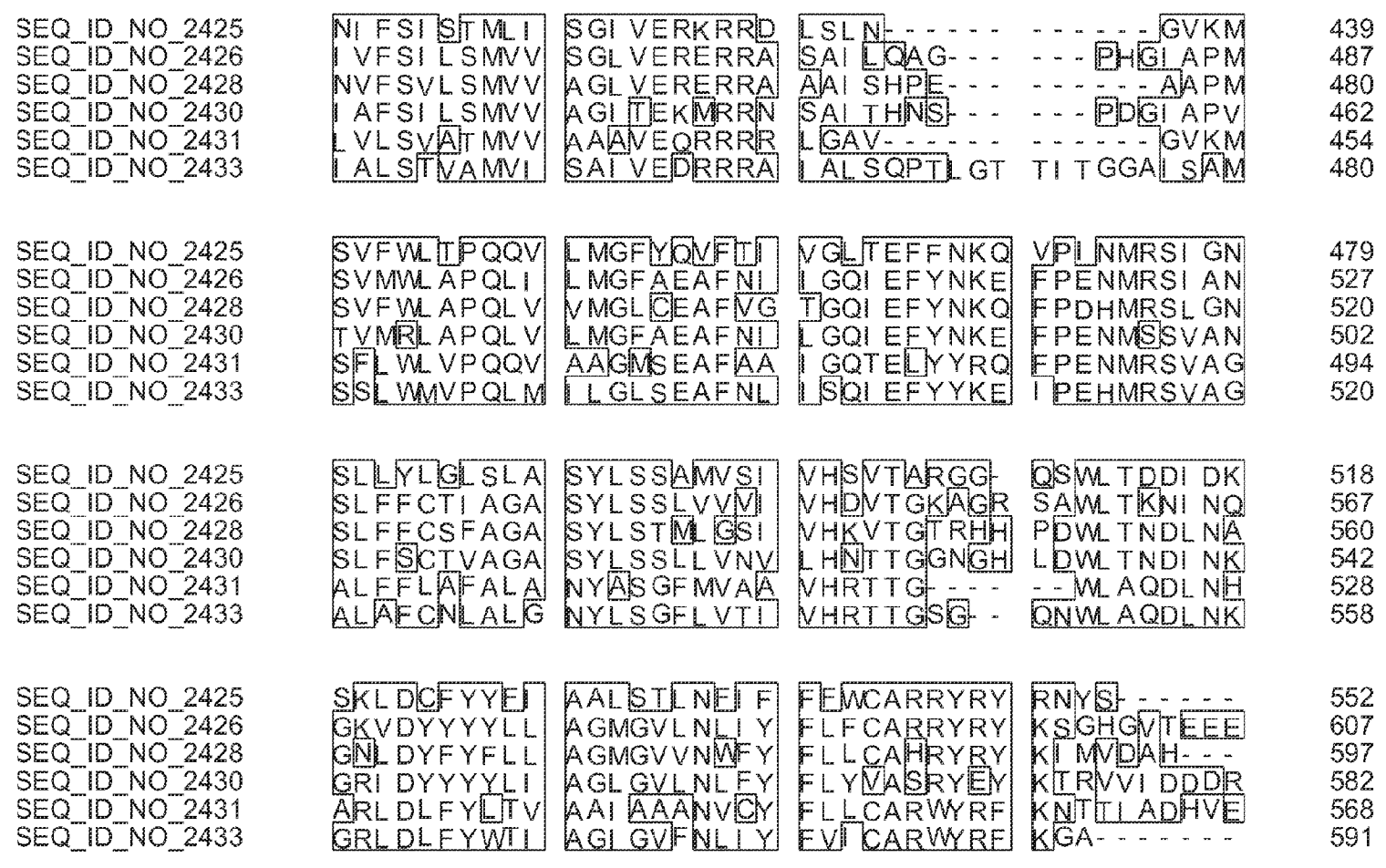

FIGS. 38A-38E are an alignment of the amino acid sequence of CeresAnnot:837788 (SEQ ID NO: 2425) with homologous and/or orthologous amino acid sequences.

DETAILED DESCRIPTION

The invention features methods and materials related to modulating biomass levels in plants. In some embodiments, the plants may also have modulated levels of, for example, lignin, modified root architecture, modified herbicide resistance, modified carotenoid biosynthesis, or modulated cell wall content. The methods can include transforming a plant cell with a nucleic acid encoding a biomass-modulating polypeptide, wherein expression of the polypeptide results in a modulated level of biomass. Plant cells produced using such methods can be grown to produce plants having an increased or decreased biomass. Such plants, and the seeds of such plants, may be used to produce, for example, biomass having an increased value as a biofuel feedstock.

I. Definitions

"Amino acid" refers to one of the twenty biologically occurring amino acids and to synthetic amino acids, including D/L optical isomers.

"Cell type-preferential promoter" or "tissue-preferential promoter" refers to a promoter that drives expression preferentially in a target cell type or tissue, respectively, but may also lead to some transcription in other cell types or tissues as well.

"Control plant" refers to a plant that does not contain the exogenous nucleic acid present in a transgenic plant of interest, but otherwise has the same or similar genetic background as such a transgenic plant. A suitable control plant can be a non-transgenic wild type plant, a non-transgenic segregant from a transformation experiment, or a transgenic plant that contains an exogenous nucleic acid other than the exogenous nucleic acid of interest.

"Domains" are groups of substantially contiguous amino acids in a polypeptide that can be used to characterize protein families and/or parts of proteins. Such domains have a "fingerprint" or "signature" that can comprise conserved primary sequence, secondary structure, and/or three-dimensional conformation. Generally, domains are correlated with specific in vitro and/or in vivo activities. A domain can have a length of from 10 amino acids to 400 amino acids, e.g., 10 to 50 amino acids, or 25 to 100 amino acids, or 35 to 65 amino acids, or 35 to 55 amino acids, or 45 to 60 amino acids, or 200 to 300 amino acids, or 300 to 400 amino acids.

"Down-regulation" refers to regulation that decreases production of expression products (mRNA, polypeptide, or both) relative to basal or native states.

"Exogenous" with respect to a nucleic acid indicates that the nucleic acid is part of a recombinant nucleic acid construct, or is not in its natural environment. For example, an exogenous nucleic acid can be a sequence from one species introduced into another species, i.e., a heterologous nucleic acid. Typically, such an exogenous nucleic acid is introduced into the other species via a recombinant nucleic acid construct. An exogenous nucleic acid can also be a sequence that is native to an organism and that has been reintroduced into cells of that organism. An exogenous nucleic acid that includes a native sequence can often be distinguished from the naturally occurring sequence by the presence of non-natural sequences linked to the exogenous nucleic acid, e.g., non-native regulatory sequences flanking a native sequence in a recombinant nucleic acid construct. In addition, stably transformed exogenous nucleic acids typically are integrated at positions other than the position where the native sequence is found. It will be appreciated that an exogenous nucleic acid may have been introduced into a progenitor and not into the cell under consideration. For example, a transgenic plant containing an exogenous nucleic acid can be the progeny of a cross between a stably transformed plant and a non-transgenic plant. Such progeny are considered to contain the exogenous nucleic acid.

"Expression" refers to the process of converting genetic information of a polynucleotide into RNA through transcription, which is catalyzed by an enzyme, RNA polymerase, and into protein, through translation of mRNA on ribosomes.

"Heterologous polypeptide" as used herein refers to a polypeptide that is not a naturally occurring polypeptide in a plant cell, e.g., a transgenic Panicum virgatum plant transformed with and expressing the coding sequence for a nitrogen transporter polypeptide from a Zea mays plant.

"Isolated nucleic acid" as used herein includes a naturally-occurring nucleic acid, provided one or both of the sequences immediately flanking that nucleic acid in its naturally-occurring genome is removed or absent. Thus, an isolated nucleic acid includes, without limitation, a nucleic acid that exists as a purified molecule or a nucleic acid molecule that is incorporated into a vector or a virus. A nucleic acid existing among hundreds to millions of other nucleic acids within, for example, cDNA libraries, genomic libraries, or gel slices containing a genomic DNA restriction digest, is not to be considered an isolated nucleic acid.

"Modulation" of the level of biomass refers to the change in the level of the biomass that is observed as a result of expression of, or transcription from, an exogenous nucleic acid in a plant cell and/or plant. The change in level is measured relative to the corresponding level in control plants.

"Nucleic acid" and "polynucleotide" are used interchangeably herein, and refer to both RNA and DNA, including cDNA, genomic DNA, synthetic DNA, and DNA or RNA containing nucleic acid analogs. A nucleic acid can be double-stranded or single-stranded (i.e., a sense strand or an antisense strand). Non-limiting examples of polynucleotides include genes, gene fragments, exons, introns, messenger RNA (mRNA), transfer RNA, ribosomal RNA, siRNA, micro-RNA, ribozymes, cDNA, recombinant polynucleotides, branched polynucleotides, nucleic acid probes and nucleic acid primers. A polynucleotide may contain unconventional or modified nucleotides.

"Operably linked" refers to the positioning of a regulatory region and a sequence to be transcribed in a nucleic acid so that the regulatory region is effective for regulating transcription or translation of the sequence. For example, to operably link a coding sequence and a regulatory region, the translation initiation site of the translational reading frame of the coding sequence is typically positioned between one and about fifty nucleotides downstream of the regulatory region. A regulatory region can, however, be positioned as much as about 5,000 nucleotides upstream of the translation initiation site, or about 2,000 nucleotides upstream of the transcription start site.

"Polypeptide" as used herein refers to a compound of two or more subunit amino acids, amino acid analogs, or other peptidomimetics, regardless of post-translational modification, e.g., phosphorylation or glycosylation. The subunits may be linked by peptide bonds or other bonds such as, for example, ester or ether bonds. Full-length polypeptides, truncated polypeptides, point mutants, insertion mutants, splice variants, chimeric proteins, and fragments thereof are encompassed by this definition.

"Progeny" includes descendants of a particular plant or plant line. Progeny of an instant plant include seeds formed on $F_1$, $F_2$, $F_3$, $F_4$, $F_5$, $F_6$ and subsequent generation plants, or seeds formed on $BC_1$, $BC_2$, $BC_3$, and subsequent generation plants, or seeds formed on $F_1BC_1$, $F_1BC_2$, $F_1BC_3$, and subsequent generation plants. The designation $F_1$ refers to the progeny of a cross between two parents that are genetically distinct. The designations $F_2$, $F_3$, $F_4$, $F_5$ and $F_6$ refer to subsequent generations of self- or sib-pollinated progeny of an $F_1$ plant.

"Regulatory region" refers to a nucleic acid having nucleotide sequences that influence transcription or translation initiation and rate, and stability and/or mobility of a transcription or translation product. Regulatory regions include, without limitation, promoter sequences, enhancer sequences, response elements, protein recognition sites, inducible elements, protein binding sequences, 5' and 3' untranslated regions (UTRs), transcriptional start sites, termination sequences, polyadenylation sequences, introns, and combinations thereof. A regulatory region typically comprises at least a core (basal) promoter. A regulatory region also may include at least one control element, such as an enhancer sequence, an upstream element or an upstream activation region (UAR). For example, a suitable enhancer is a cis-regulatory element (−212 to −154) from the upstream region of the octopine synthase (ocs) gene. Fromm et al., The Plant Cell, 1:977-984 (1989).

"Up-regulation" refers to regulation that increases the level of an expression product (mRNA, polypeptide, or both) relative to basal or native states.

"Vector" refers to a replicon, such as a plasmid, phage, or cosmid, into which another DNA segment may be inserted so as to bring about the replication of the inserted segment. Generally, a vector is capable of replication when associated with the proper control elements. The term "vector" includes cloning and expression vectors, as well as viral vectors and integrating vectors. An "expression vector" is a vector that includes a regulatory region.

II. Polypeptides

Polypeptides described herein include biomass-modulating polypeptides. Biomass-modulating polypeptides can be effective to modulate biomass levels when expressed in a plant or plant cell. Such polypeptides typically contain at least one domain indicative of biomass-modulating polypeptides, as described in more detail herein. Biomass-modulating polypeptides typically have an HMM bit score that is greater than 65 as described in more detail herein. In some embodiments, biomass-modulating polypeptides have greater than 80% identity to SEQ ID NOs: 2, 4, 6-9, 11, 13-15, 17, 18, 20-27, 29, 31-33, 35, 36, 38-51, 53, 54, 56-61, 63-67, 69, 70, 72-76, 78, 80-83, 85, 86, 88-91, 93-97, 99-103, 105, 107, 109, 110, 112, 113, 115, 117, 119-152, 154, 156, 158, 159, 161, 163, 165, 167, 168, 170, 172, 174, 176, 178, 180-185, 187, 188, 190, 192-194, 196, 198, 200, 202, 203, 205, 207-211, 213-251, 253, 255, 257, 258, 260-262, 264, 265, 267-272, 274-279, 281-283, 285, 287-292, 294, 295-297, 299, 301, 303-305, 307, 309, 310, 312, 314, 316-318, 320, 321, 323, 325, 327-329, 331, 332, 334, 335, 337-339, 341, 342, 344, 345, 347, 349, 351, 353, 355, 357, 359, 361-366, 368, 370, 372, 373, 375-378, 380, 382-387, 389, 391, 393, 395, 396, 398-404, 406-414, 416, 418, 420, 421, 423, 425, 427, 429, 431, 433, 435, 437, 439, 441, 443, 445, 447, 449, 451, 453, 455, 457, 459, 461, 463, 465, 467, 469, 471, 473, 475, 477, 479, 481, 483, 485, 487, 489, 491, 493, 495, 497-502, 504, 506, 508, 509, 511-517, 519, 521, 522, 524-527, 529, 530, 532, 533, 535, 536, 537, 539, 541, 543, 545, 546, 548, 550, 552-555, 557, 558, 560, 562, 564, 566, 568, 570-578, 580, 582, 584, 585, 587, 589, 591, 592, 594-596, 598, 600, 601, 603, 604, 606-608, 610, 611, 613, 615, 617, 619, 621, 623, 625, 626, 628-632, 634, 636, 638, 640, 642, 643, 645, 647, 649, 651, 653, 655, 657, 659, 661, 663, 665, 667-670, 672, 674, 675, 677, 679-682, 684, 685, 687, 689-692, 694-698, 700-704, 706, 707, 709-718, 720, 722, 724, 726-728, 730, 731, 733-739, 741, 743, 745, 746, 748, 750, 752, 754, 756, 758, 760-764, 766, 768, 770, 772, 774, 776, 778, 780, 782, 784, 785, 787, 789, 791, 793-795, 797, 799, 801, 803, 805, 806, 808, 810, 812, 814, 816, 818-820, 822-824, 826, 828, 830, 832, 834, 836, 838-840, 842, 843, 845-847, 849, 851, 853, 854, 856-858, 860, 862, 863, 865, 866, 868, 870-873, 875-878, 880-882, 884-886, 888, 890, 892, 893, 895, 897, 899, 900, 902, 903, 905, 907, 909, 911, 912, 913, 915, 917, 919, 921, 923, 925, 926, 928, 930, 932, 933, 935, 936-938, 940, 941, 943-945, 947, 949, 950, 952-955, 957-961, 963, 965-969, 971, 972, 974, 975, 977, 978, 980, 982, 984, 986, 988, 990, 992, 994, 996, 998, 1000-1014, 1016, 1018, 1020, 1021, 1023, 1024, 1026, 1027, 1029, 1030, 1032, 1033, 1035, 1037, 1038, 1040, 1042, 1043, 1045, 1047, 1049, 1051, 1053, 1055, 1057, 1059, 1061-1063, 1065, 1067, 1069, 1070, 1072, 1073, 1075, 1076, 1078-1080, 1082, 1083, 1085, 1087, 1089, 1091, 1093, 1095, 1096, 1098, 1100, 1101, 1103, 1105, 1106, 1108, 1110, 1112, 1114-1116, 1118, 1120-1123, 1125, 1127-1131, 1133, 1134, 1136, 1137, 1139-1145, 1147-1156, 1158-1161, 1163, 1165-1178, 1180-1188, 1190, 1191, 1193-1202, 1204, 1205-1207, 1209-1213, 1215, 1217-1221, 1223-1228, 1230, 1231, 1233-1241, 1243, 1245, 1247, 1249-1252, 1254, 1255, 1257-1259, 1261, 1263, 1264, 1266-1272, 1274-1276, 1278, 1280, 1282-1286, 1288, 1289, 1291-1331, 1333-1337, 1339, 1341, 1343, 1345, 1347-1350, 1352, 1354, 1356, 1358, 1360, 1362, 1364, 1366, 1368, 1370-1372, 1374, 1375, 1377-1379, 1381, 1383, 1384, 1386, 1388-1390, 1392-1397, 1399, 1400, 1402, 1403, 1405, 1407-1410, 1412-1418, 1420, 1422, 1424, 1426, 1428, 1430, 1432-1436, 1438, 1440, 1442-1444, 1446, 1447, 1449, 1450, 1452-1454, 1456, 1457, 1459, 1460, 1462, 1463, 1465-1468, 1470, 1471, 1473, 1475, 1477-1483, 1485, 1487, 1489, 1491-1493, 1495, 1496, 1498, 1499, 1501, 1503, 1504, 1506, 1508, 1510, 1511, 1513, 1514, 1516-1521, 1523, 1524, 1526, 1528-1532, 1534, 1536-1539, 1541, 1542, 1544, 1545, 1547, 1548, 1550, 1552, 1553, 1555-1559, 1561, 1563-1565, 1567, 1568, 1570, 1571, 1573, 1575, 1576, 1578, 1580, 1582, 1583, 1585, 1587, 1589, 1590, 1592, 1593, 1595, 1597, 1599, 1600, 1602-1606, 1608-1613, 1615, 1616, 1618-1626, 1628, 1629, 1631, 1633, 1634, 1636, 1637, 1639-1643, 1645, 1646-1739, 1741, 1743, 1745, 1747-1756, 1758, 1760, 1762-1764, 1766, 1767, 1769, 1770, 1772-1774, 1776, 1778-1783, 1785-1792, 1794, 1796, 1798, 1799, 1801, 1802, 1804, 1806, 1808-1810, 1812, 1814, 1815, 1817, 1819, 1821, 1822, 1824, 1826-1830, 1832, 1834, 1835, 1837, 1839-1841, 1843, 1844, 1846, 1847, 1849, 1851, 1852, 1854, 1856, 1858, 1860-1863, 1865-1953, 1955-1958, 1960, 1962, 1964, 1966-1968, 1970, 1972-1976, 1978, 1980, 1982, 1984-1986, 1988, 1990, 1991, 1993, 1995, 1997, 1999, 2001, 2003, 2005, 2007, 2009, 2011, 2013, 2015, 2017, 2019, 2021, 2023-2027, 2029, 2031, 2033, 2035, 2037, 2039, 2041, 2043, 2045, 2047-2049, 2051-2057, 2059, 2061, 2063, 2065, 2067, 2069, 2071, 2073, 2075, 2077, 2079, 2080, 2082, 2084, 2086, 2088, 2090, 2092, 2093, 2095, 2097, 2098, 2100-2122, 2124, 2126, 2128, 2129, 2131, 2133, 2135-2137, 2139, 2141, 2142, 2144-2148, 2150, 2152, 2154, 2155, 2157, 2159-2161, 2163, 2165, 2166, 2168, 2170, 2172-2175, 2177, 2179, 2181, 2183, 2184, 2186, 2188, 2189, 2191-2194, 2196, 2197, 2199-2202, 2204, 2206-2208, 2210-2212, 2214, 2215, 2217-2220, 2222, 2224-2226, 2228, 2230-2232, 2234-2242, 2244-2254, 2256-2269, 2271, 2273, 2274, 2276, 2278, 2280, 2281, 2283, 2285, 2286, 2288, 2290, 2292, 2294, 2296, 2297, 2299, 2301, 2303, 2305, 2307, 2309, 2311, 2313, 2314, 2316-2318, 2320, 2322, 2324, 2326, 2327, 2329, 2331, 2333, 2335, 2337, 2339, 2341, 2342, 2344, 2345, 2347-2349, 2351, 2353, 2355, 2357, 2359, 2361, 2363, 2365, 2367-2369, 2371, 2373, 2375, 2377, 2379, 2381, 2383, 2385, 2386, 2388, 2390, 2391, 2393, 2395, 2397, 2399, 2400, 2402, 2404, 2405, 2407, 2409, 2411, 2413, 2415, 2417, 2419, 2421, 2423, 2425, 2426, 2428, 2430, 2431, 2433, 2435, 2437, 2438-2440, 2442, 2444, 2445, 2447, 2449, 2451, 2453, 2455, 2457, 2459, 2461, 2463-2468, 2470, 2472, 2474, 2476, 2478, 2479, 2481, 2482, 2484, 2485, 2487-2491, 2493-2498, 2500-2510, 2512-2515, 2517-2531, 2533-2536, 2538-2542, 2544-2548, 2550, 2551, 2553, 2555-2558, 2560, 2562, 2564, 2566-2573, 2575-2579, 2581, 2583-2585, 2587-2602, 2604-2611, 2613, 2615, 2617, or 2619-2623 as described in more detail herein.

A. Domains Indicative of Biomass-Modulating Polypeptides

A biomass-modulating polypeptide can contain a methyltransferase_2 domain and a dimerization domain, which are predicted to be characteristic of a biomass-modulating polypeptide. SEQ ID NO: 1333 sets forth the amino acid sequence of a *Panicum virgatum* clone, identified herein as CeresClone:1871521 (SEQ ID NO:1332), that is predicted to encode a polypeptide containing methyltransferase_2 and dimerization domains. For example, a biomass-modulating polypeptide can comprise a methyltransferase_2 domain having 60 percent or greater (e.g., 65, 70, 75, 80, 85, 90, 95, 97, 98, 99, or 100%) sequence identity to residues 94 to 340 of SEQ ID NO: 1333 or can comprise a dimerization domain having 60 percent or greater (e.g., 65, 70, 75, 80, 85, 90, 95, 97, 98, 99, or 100%) sequence identity to residues 33 to 85 of SEQ ID NO:1333. In some embodiments, a biomass-modulating polypeptide can comprise a methyltransferase_2 domain and a dimerization domain having 60 percent or greater (e.g., 65, 70, 75, 80, 85, 90, 95, 97, 98, 99, or 100%)

sequence identity to the methyltransferase_2 and dimerization domains of one or more of the polypeptides set forth in SEQ ID NOs: 1334, 1335, 1336, 1337, 1339, 1341, 1343, 1345, 1347, 1348, 1349, 1350, 1352, 1354, 1356, 1358, 1360, 1362, or 1364. The methyltransferase_2 and dimerization domains of such sequences are set forth in the Sequence Listing. The methyltransferase_2 domain and dimerization domain are characteristic of O-methyltransferases, which catalyze the transfer of a methyl group from S-adenosyl-L-methionine (AdoMet) to either nitrogen, oxygen or carbon atoms of DNA, RNA, proteins, or small molecules. The dimerization domain typically is found at the N-terminus and mediates dimerization of the O-methyltransferases.

A biomass-modulating polypeptide can contain a glycosyl transferase family 8 domain, which is predicted to be characteristic of a biomass-modulating polypeptide. SEQ ID NO: 1489 sets forth the amino acid sequence of a *Panicum virgatum* clone, identified herein as CeresClone:1909354 (SEQ ID NO: 1488) that is predicted to encode a polypeptide containing a glycosyl transferase family 8 domain. For example, a biomass-modulating polypeptide can comprise a glycosyl transferase family 8 domain having 60 percent or greater (e.g., 65, 70, 75, 80, 85, 90, 95, 97, 98, 99, or 100%) sequence identity to residues 314 to 525 of SEQ ID NO: 1489. In some embodiments, a biomass-modulating polypeptide can comprise a glycosyl transferase family 8 domain having 60 percent or greater (e.g., 65, 70, 75, 80, 85, 90, 95, 97, 98, 99, or 100%) sequence identity to the glycosyl transferase family 8 domain of one or more of the polypeptides set forth in SEQ ID NOs: 1491, 1492, 1493, 1495, 1496, 1498, 1499, 1501, 1503, 1504, 1506, 1508, 1510, 1511, 1513, 1514, 1516, 1517, 1518, 1519, 1520, 1521, 1523, 1524, 1526, 1528, 1529, 1530, 1531, 1532, 1534, 1536, 1537, 1538, or 1539. The glycosyl transferase family 8 domain of such sequences are set forth in the Sequence Listing. The glycosyl transferase family 8 domain is found in a family of enzymes that transfer sugar residues to donor molecules. Members of the glycosyl transferase 8 family are involved in lipopolysaccharide biosynthesis and glycogen synthesis, and include lipopolysaccharide galactosyltransferase, lipopolysaccharide glucosyltransferase, and glycogenin glucosyltransferase.

A biomass-modulating polypeptide can contain a raffinose synthase domain, which is predicted to be characteristic of a biomass-modulating polypeptide. SEQ ID NO: 504 sets forth the amino acid sequence of a *Panicum virgatum* clone, identified herein as CeresClone:1882035 (SEQ ID NO:503) that is predicted to encode a polypeptide containing a raffinose synthase domain. For example, a biomass-modulating polypeptide can comprise a raffinose synthase domain having 60 percent or greater (e.g., 65, 70, 75, 80, 85, 90, 95, 97, 98, 99, or 100%) sequence identity to residues 2-727 of SEQ ID NO: 504. In some embodiments, a biomass-modulating polypeptide can comprise a raffinose synthase domain having 60 percent or greater (e.g., 65, 70, 75, 80, 85, 90, 95, 97, 98, 99, or 100%) sequence identity to the raffinose synthase domain of one or more of the polypeptides set forth in SEQ ID NOs: 506, 508, 509, 511, 512, 513, 514, 515, 516, 517, 519, 521, 522, 524, 525, 526, 527, 529, 530, 532, 533, 535, 536, 537, 539, 541, 543, 545, 546, 548, 550, 552, 553, 554, 555, 557, 558, 560, 562, 564, 566, 568, 570, 571, 572, 573, 574, 575, 576, 577, or 578. Raffinose family oligosaccharides (RFOs) are synthesized by a set of galactosyltransferases, which sequentially add galactose units from galactinol to sucrose. Raffinose synthase (EC 2.4.1.82) (also known as seed imbibition (Sip1) protein) produces raffinose by transferring a galactose unit from galactinol to sucrose. RFOs may act as protective agents during desiccation and storage of seeds in the dry state, and also may function as prebiotics, by specifically stimulating growth of remedial gut bacteria. See, Peterbauer et al., *Plant Physiol.* 127(4): 1764-1772 (2001).

A biomass-modulating polypeptide can contain an LpxC domain, which is predicted to be characteristic of a biomass-modulating polypeptide. SEQ ID NO: 198 sets forth the amino acid sequence of a *Panicum virgatum* clone, identified herein as CeresClone:1819917 (SEQ ID NO: 197), that is predicted to encode a polypeptide containing an LpxC domain. For example, a biomass-modulating polypeptide can comprise an LpxC domain having 60 percent or greater (e.g., 65, 70, 75, 80, 85, 90, 95, 97, 98, 99, or 100%) sequence identity to residues 24 to 315 of SEQ ID NO: 198. In some embodiments, a biomass-modulating polypeptide can comprise an LpxC domain having 60 percent or greater (e.g., 65, 70, 75, 80, 85, 90, 95, 97, 98, 99, or 100%) sequence identity to the LpxC domain of one or more of the polypeptides set forth in SEQ ID NOs: 200, 202, 203, 205, 207, 208, 209, 210, 211, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, or 251. The LpxC domains of such sequences are set forth in the Sequence Listing. Enzymes within the LpxC family are UDP-3-O— N-acetylglucosamine deacetylases, zinc-dependent metalloamidases that catalyse the second and committed step in the biosynthesis of Lipid A, which anchors lipopolysaccharide into the membrane in Gram negative bacteria. Orthologs of the *E. coli* LpxC genes are found in higher plants, which may synthesize Lipid A like substances. Such Lipid A like substances may be structural components of chloroplast outer membranes or may function as a signaling molecule in plants. See, Raetz and Whitfield, *Annu Rev Biochem.* 71: 635-700 (2002).

A biomass-modulating polypeptide can contain a UDP-glucoronosyl and UDP-glucosyl transfer (UDPGT) domain, which is predicted to be characteristic of a biomass-modulating polypeptide. SEQ ID NO: 253 sets forth the amino acid sequence of a *Panicum virgatum* clone, identified herein as CeresClone:1815762 (SEQ ID NO: 252), that is predicted to encode a polypeptide containing a UDPGT domain. For example, a biomass-modulating polypeptide can comprise a UDPGT domain having 60 percent or greater (e.g., 65, 70, 75, 80, 85, 90, 95, 97, 98, 99, or 100%) sequence identity to residues 11 to 480 of SEQ ID NO: 253. In some embodiments, a biomass-modulating polypeptide can comprise a UDPGT domain having 60 percent or greater (e.g., 65, 70, 75, 80, 85, 90, 95, 97, 98, 99, or 100%) sequence identity to the UDPGT domain of one or more of the polypeptides set forth in SEQ ID NOs: 255, 257, 258, 260, 261, 262, 264, 265, 267, 268, 269, 270, 271, 272, 274, 275, 276, 277, 278, 279, 281, 282, 283, 285, 287, 288, 289, 290, 291, 292, 294, 295, 296, 297, 299, 301, 303, 304, 305, 307, 309, 310, 312, 314, 316, 317, 318, 320, 321, 323, 325, 327, 328, 329, 331, 332, 334, 335, 337, 338, 339, 341, 342, 344, 345, 347, 349, 351, 353, 355, 357, 359, 361, 362, 363, 364, 365, or 366. The UDPGT domains of such sequences are set forth in the Sequence Listing. UDP-glucuronosyl transferases (EC:2.4.1.17) are part of a large family of membrane-bound microsomal enzymes that catalyze the transfer of glucuronic acid to exogenous and endogenous lipophilic substrates. Another enzyme in the UDPGT family is flavonol O(3)-glucosyltransferase (EC:2.4.1.91), which catalyzes the transfer of glucose from UDP-glucose to a flavanol.

A biomass-modulating polypeptide can contain a Glyco_hydro_18 domain, which is predicted to be characteristic of a biomass-modulating polypeptide. SEQ ID NO: 1541 sets forth the amino acid sequence of a *Panicum virgatum* clone, identified herein as CeresClone:1792015 (SEQ ID NO: 1540), that is predicted to encode a polypeptide containing a Glyco_hydro_18 domain. For example, a biomass-modulating polypeptide can comprise a Glyco_hydro_18 domain having 60 percent or greater (e.g., 65, 70, 75, 80, 85, 90, 95, 97, 98, 99, or 100%) sequence identity to residues 36 to 287 of SEQ ID NO: 1541. In some embodiments, a biomass-modulating polypeptide can comprise a Glyco_hydro_18 domain having 60 percent or greater (e.g., 65, 70, 75, 80, 85, 90, 95, 97, 98, 99, or 100%) sequence identity to the Glyco_hydro_18 domain of one or more of the polypeptides set forth in SEQ ID NOs: 1542, 1544, 1545, 1547, 1548, 1550, 1552, 1553, 1555, 1556, 1557, 1558, 1559, 1561, 1563, 1564, 1565, 1567, 1568, 1570, 1571, 1573, 1575, 1576, or 1578. The alpha/beta hydrolase fold domains of such sequences are set forth in the Sequence Listing. The Glyco_hydro_18 domain is found in O-glycosyl hydrolases, a group of enzymes that hydrolyse the glycosidic bond between two or more carbohydrates.

A biomass-modulating polypeptide can contain a Glyco_transf_34 domain, which is predicted to be characteristic of a biomass-modulating polypeptide. SEQ ID NO: 663 sets forth the amino acid sequence of a *Panicum virgatum* clone, identified herein as CeresClone:1791384 (SEQ ID NO: 662), that is predicted to encode a polypeptide containing a Glyco_transf_34 domain. For example, a biomass-modulating polypeptide can comprise a Glyco_transf_34 domain having 60 percent or greater (e.g., 65, 70, 75, 80, 85, 90, 95, 97, 98, 99, or 100%) sequence identity to residues 136 to 380 of SEQ ID NO: 663. In some embodiments, a biomass-modulating polypeptide can comprise a Glyco_transf_34 domain having 60 percent or greater (e.g., 65, 70, 75, 80, 85, 90, 95, 97, 98, 99, or 100%) sequence identity to the Glyco_transf_34 domain of one or more of the polypeptides set forth in SEQ ID NOs: 665, 667, 668, 669, 670, 672, 674, 675, 677, 679, 680, 681, 682, 684, 685, 687, 689, 690, 691, 692, 694, 695, 696, 697, 698, 700, 701, 702, 703, 704, 706, 707, 709, 710, 711, 712, 713, 714, 715, 716, 717, 718, 720, 722, 724, 726, 727, 728, 730, 731, 733, 734, 735, 736, 737, 738, or 739. The Glyco_transf_34 domains of such sequences are set forth in the Sequence Listing. Glyco_transf_34 domains are found within enzymes of the galactosyl transferase GMA12/MNN10 family. Many of the galactosyl transferases within this family contain a DXD motif.

A biomass-modulating polypeptide can contain a branch domain, which is predicted to be characteristic of a biomass-modulating polypeptide. SEQ ID NO: 1366 sets forth the amino acid sequence of a *Panicum virgatum* clone, identified herein as CeresClone:1786268 (SEQ ID NO: 1365), that is predicted to encode a polypeptide containing a branch domain. For example, a biomass-modulating polypeptide can comprise a branch domain having 60 percent or greater (e.g., 65, 70, 75, 80, 85, 90, 95, 97, 98, 99, or 100%) sequence identity to residues 75 to 300 of SEQ ID NO: 1366. In some embodiments, a biomass-modulating polypeptide can comprise a branch domain having 60 percent or greater (e.g., 65, 70, 75, 80, 85, 90, 95, 97, 98, 99, or 100%) sequence identity to the branch domain of one or more of the polypeptides set forth in SEQ ID NOs: 1368, 1370, 1371, 1372, 1374, 1375, 1377, 1378, 1379, 1381, 1383, 1384, 1386, 1388-1390, 1392, 1393, 1394, 1395, 1396, 1397, 1399, 1400, 1402, 1403, 1405, 1407, 1408, 1409, 1410, 1412, 1413, 1414, 1415, 1416, 1417, 1418, 1420, 1422, 1424, 1426, 1428, 1430, 1432, 1433, 1434, 1435, 1436, 1438, 1440, 1442, 1443, 1444, 1446, 1447, 1449, 1450, 1452, 1453, 1454, 1456, 1457, 1459, 1460, 1462, 1463, 1465, 1466, 1467, 1468, 1470, 1471, 1473, 1475, 1477, 1478, 1479, 1480, 1481, 1482, 1483, 1485, or 1487. The branch domains of such sequences are set forth in the Sequence Listing. The branch domain is found in a family of two different beta-1,6-N-acetylglucosaminyltransferase enzymes, 1-branching enzyme and core-2 branching enzyme, which are both integral membrane proteins. The I-branching enzyme converts linear into branched poly-N-acetyllactosaminoglycans in the glycosylation pathway while core-2 branching enzyme forms side-chain branches in O-glycans in the glycosylation pathway.

A biomass-modulating polypeptide can contain a COBRA domain, which is predicted to be characteristic of a biomass-modulating polypeptide. SEQ ID NO: 928 sets forth the amino acid sequence of a *Panicum virgatum* clone, identified herein as CeresClone:1781794 (SEQ ID NO: 927), that is predicted to encode a polypeptide containing a COBRA domain. For example, a biomass-modulating polypeptide can comprise a COBRA domain having 60 percent or greater (e.g., 65, 70, 75, 80, 85, 90, 95, 97, 98, 99, or 100%) sequence identity to residues 51 to 215 of SEQ ID NO: 928. In some embodiments, a biomass-modulating polypeptide can comprise a COBRA domain having 60 percent or greater (e.g., 65, 70, 75, 80, 85, 90, 95, 97, 98, 99, or 100%) sequence identity to the COBRA domain of one or more of the polypeptides set forth in SEQ ID NOs: 930, 932, 933, 935, 936. 937, 938, 940, 941, 943, 944, 945, 947, 949, 950, 952, 953, 954, 955, 957, 958, 959, 960, 961, 963, 965, 966, 967, 968, 969, 971, 972, 974, 975, 977, 978, 980, 982, 984, 986, 988, 990, 992, 994, 996, 998, 1000, 1001, 1002, 1003, 1004, 1005, 1006, 1007, 1008, 1009, 1010, 1011, 1012, 1013, or 1014. The COBRA domains of such sequences are set forth in the Sequence Listing. COBRA domains are found within a family of plant proteins designated COBRA-like (COBL) proteins. Members of the family are extracellular glycosyl-phosphatidyl inositol-anchored proteins (GPI-linked). COBRA is involved in determining the orientation of cell expansion, probably by playing an important role in cellulose deposition. It may act by recruiting cellulose synthesizing complexes to discrete positions on the cell surface. See Roudier et al., *Plant Cell.* 17(6):1749-63 (2005), Epub 2005 Apr. 22.

A biomass-modulating polypeptide can contain glycosyl hydrolase family 32 N and C-terminal domains, which are predicted to be characteristic of a biomass-modulating polypeptide. SEQ ID NO: 1215 sets forth the amino acid sequence of a *Panicum virgatum* clone, identified herein as CeresClone:1769374 (SEQ ID NO: 1214), that is predicted to encode a polypeptide containing glycosyl hydrolase family 32 N and C-terminal domains. For example, a biomass-modulating polypeptide can comprise a glycosyl hydrolase family 32 N-terminal domain having 60 percent or greater (e.g., 65, 70, 75, 80, 85, 90, 95, 97, 98, 99, or 100%) sequence identity to residues 57 to 374 of SEQ ID NO: 1215 and a glycosyl hydrolase family 32 C-terminal domain having 60 percent or greater (e.g., 65, 70, 75, 80, 85, 90, 95, 97, 98, 99, or 100%) sequence identity to residues 415 to 533 of SEQ ID NO: 1215. In some embodiments, a biomass-modulating polypeptide can comprise glycosyl hydrolase family 32 N and C-terminal domains having 60 percent or greater (e.g., 65, 70, 75, 80, 85, 90, 95, 97, 98, 99, or 100%) sequence identity to the glycosyl hydrolase family 32 N and C-terminal domains of one or more of the polypeptides set forth in SEQ ID NOs: 1217, 1218, 1219, 1220, 1221, 1223, 1224, 1225, 1226, 1227, 1228, 1230, 1231, 1233, 1234, 1235, 1236, 1237, 1238, 1239, 1240, 1241, 1243, 1245, 1247, 1249, 1250, 1251, 1252, 1254, 1255, 1257, 1258, 1259, 1261, 1263, 1264, 1266, 1267, 1268, 1269, 1270, 1271, 1272, 1274, 1275, 1276, 1278, 1280, 1282, 1283, 1284, 1285, 1286, 1288, 1289, 1291, 1292, 1293, 1294, 1295, 1296, 1297, 1298, 1299, 1300, 1301, 1302, 1303, 1304, 1305, 1306, 1307, 1308, 1309, 1310, 1311, 1312, 1313, 1314, 1315, 1316, 1317, 1318, 1319, 1320, 1321, 1322, 1323, 1324, 1325, 1326, 1327, 1328, 1329, 1330, or 1331. The glycosyl hydrolase family 32 N and C-terminal domains of such sequences are set forth in the Sequence Listing. The N-terminal domain of glycosyl hydrolase family 32 forms a five bladed beta propeller structure. The C-terminal domain of glycosyl hydrolase family 32 forms a five beta sandwich module. See Alberto et al., *J Biol. Chem.* 79(18):18903-10 (2004); Epub 2004 Feb. 18.

A biomass-modulating polypeptide can contain an Alpha-L-AF_C domain and a CBM_4_9 domain, which are predicted to be characteristic of a biomass-modulating polypeptide. SEQ ID NO: 4 sets forth the amino acid sequence of a *Panicum virgatum* clone, identified herein as CeresClone:1753603 (SEQ ID NO: 3), that is predicted to encode a polypeptide containing Alpha-L-AF_C and CBM_4_9 domains. For example, a biomass-modulating polypeptide can comprise an Alpha-L-AF_C domain having 60 percent or greater (e.g., 65, 70, 75, 80, 85, 90, 95, 97, 98, 99, or 100%) sequence identity to residues 454 to 639 of SEQ ID NO: 4 and a CBM_4_9 domain having 60 percent or greater (e.g., 65, 70, 75, 80, 85, 90, 95, 97, 98, 99, or 100%) sequence identity to residues 71 to 229 of SEQ ID NO: 4. In some embodiments, a biomass-modulating polypeptide can comprise Alpha-L-AF_C and CBM_4_9 domains having 60 percent or greater (e.g., 65, 70, 75, 80, 85, 90, 95, 97, 98, 99, or 100%) sequence identity to the Alpha-L-AF_C and CBM_4_9 domains of one or more of the polypeptides set forth in SEQ ID NOs: 6, 7, 8, 9, 11, 13, 14, 15, 17, 18, 20, 21, 22, 23, 24, 25, 26, 27, 29, 31, 32, 33, 35, 36, 38, 39, 40, 41, 42, 43, 44, 45, 46, 47, 48, 49, 50, or 51. The Alpha-L-AF_C and CBM_4_9 domains of such sequences are set forth in the Sequence Listing. The Alpha-L-AF_C domain represents the approximately 200 C-terminal residues of bacterial and eukaryotic alpha-L-arabinofuranosidase (EC: 3.2.1.55), which catalyzes the hydrolysis of nonreducing terminal alpha-L-arabinofuranosidic linkages in L-arabinose-containing polysaccharides. The CBM_4_9 domain is a carbohydrate binding domain.

A biomass-modulating polypeptide can contain an EMP24_GP25L domain, which is predicted to be characteristic of a biomass-modulating polypeptide. SEQ ID NO: 580 sets forth the amino acid sequence of a *Panicum virgatum* clone, identified herein as CeresClone:1724480 (SEQ ID NO: 579), that is predicted to encode a polypeptide containing an EMP24_GP25L domain. For example, a biomass-modulating polypeptide can comprise an EMP24_GP25L domain having 60 percent or greater (e.g., 65, 70, 75, 80, 85, 90, 95, 97, 98, 99, or 100%) sequence identity to residues 36 to 224 of SEQ ID NO: 580. In some embodiments, a biomass-modulating polypeptide can comprise an EMP24_GP25L domain having 60 percent or greater (e.g., 65, 70, 75, 80, 85, 90, 95, 97, 98, 99, or 100%) sequence identity to the EMP24_GP25L domain of one or more of the polypeptides set forth in SEQ ID NOs: 582, 584, 585, 587, 589, 591, 592, 594, 595, 596, 598, 600, 601, 603, 604, 606, 607, 608, 610, 611, 613, 615, 617, 619, 621, 623, 625, 626, 628, 629, 630, 631, or 632. The EMP24 GP25L domains of such sequences are set forth in the Sequence Listing. Members of the EMP24_GP25L family are implicated in bringing cargo forward from the ER and binding to coat proteins by their cytoplasmic domains. This domain corresponds closely to the beta-strand rich GOLD domain described in Anantharaman and Aravind, *Genome Biol.* 2002; 3(5):1-7; Epub 2002 Apr. 24. The GOLD domain is found combined with lipid- or membrane-association domains. Members of the p24 family are type I membrane proteins with a signal peptide at the amino terminus, a lumenal coiled-coil (extracytosolic) domain, a single transmembrane domain with conserved amino acids, and a short cytoplasmic tail.

A biomass-modulating polypeptide can contain a Methyltransf_3 domain, which is predicted to be characteristic of a biomass-modulating polypeptide. SEQ ID NO: 53 sets forth the amino acid sequence of a *Populus balsamifera* subsp. *trichocarpa* clone, identified herein as CeresAnnot: 1514289 (SEQ ID NO: 52), that is predicted to encode a polypeptide containing a Methyltransf_3 domain. For example, a biomass-modulating polypeptide can comprise a Methyltransf_3 domain having 60 percent or greater (e.g., 65, 70, 75, 80, 85, 90, 95, 97, 98, 99, or 100%) sequence identity to residues 34 to 246 of SEQ ID NO: 53. In some embodiments, a biomass-modulating polypeptide can comprise a Methyltransf_3 domain having 60 percent or greater (e.g., 65, 70, 75, 80, 85, 90, 95, 97, 98, 99, or 100%) sequence identity to the Methyltransf_3 domain of one or more of the polypeptides set forth in SEQ ID NOs: 54, 56-61, 63-67, 69, 70, 72-76, 78, 80-83, 85, 86, 88-91, 93-97, 99-103, 105, 107, 109, 110, 112, 113, 115, 117, or 119-152. The methyltransf 3 domain is characteristic of O-methyltransferases, which catalyze the transfer of a methyl group from S-adenosyl-L-methionine to either nitrogen, oxygen or carbon atoms of DNA, RNA, proteins, or small molecules.

A biomass-modulating polypeptide can contain a SRF-TF domain and a K-box domain, which are predicted to be characteristic of a biomass-modulating polypeptide. SEQ ID NO: 1112 sets forth the amino acid sequence of a *Zea mays* clone, identified herein as CeresClone:466497 (SEQ ID NO: 1111), that is predicted to encode a polypeptide containing a SRF-TF domain and a K-box domain. For example, a biomass-modulating polypeptide can comprise a SRF-TF domain having 60 percent or greater (e.g., 65, 70, 75, 80, 85, 90, 95, 97, 98, 99, or 100%) sequence identity to residues 11 to 61 of SEQ ID NO: 1112 and a K-box domain having 60 percent or greater (e.g., 65, 70, 75, 80, 85, 90, 95, 97, 98, 99, or 100%) sequence identity to residues 79 to 179 of SEQ ID NO:1112. In some embodiments, a biomass-modulating polypeptide can comprise a SRF-TF domain and a K-box domain having 60 percent or greater (e.g., 65, 70, 75, 80, 85, 90, 95, 97, 98, 99, or 100%) sequence identity to the SRF-TF domain and a K-box domain of one or more of the polypeptides set forth in SEQ ID NOs: 1112, 1114-1116, 1118, 1120-1123, 1125, 1127-1131, 1133, 1134, 1136, 1137, 1139-1145, 1147-1156, 1158-1161, 1163, 1165-1178, 1180-1188, 1190, 1191, 1193-1202, 1204, 1205-1207, or 1209-1213. A SRF-TF domain and a K-box domain are characteristic of serum response factor (SRF)-type transcription factors. A core domain of about 90 amino acids is sufficient for the activities of DNA-binding, dimerization, and interaction with accessory factors. The core DNA-binding region is designated the MADS box (Pellegrini et al., *Nature*, 376: 490-8 (1995)) and is highly similar to many eukaryotic regulatory proteins. MADS genes in plants encode developmental regulators of vegetative and reproductive development. The MADS-box domain is commonly found associated with a keratin-like (K-box) domain, which promotes protein dimerization.

A biomass-modulating polypeptide can contain a zinc finger (zf)-C3HC4 domain, which is predicted to be characteristic of a biomass-modulating polypeptide. SEQ ID NO: 634 sets forth the amino acid sequence of a *Gossypium hirsutum* clone, identified herein as CeresClone: 1841236_CW00741 (SEQ ID NO: 633), that is predicted to encode a polypeptide containing a zf-C3HC4 domain. For example, a biomass-modulating polypeptide can comprise a zf-C3HC4 domain having 60 percent or greater (e.g., 65, 70, 75, 80, 85, 90, 95, 97, 98, 99, or 100%) sequence identity to residues 95 to 136 of SEQ ID NO: 633. In some embodiments, a biomass-modulating polypeptide can comprise a zf-C3HC4 domain having 60 percent or greater (e.g., 65, 70, 75, 80, 85, 90, 95, 97, 98, 99, or 100%) sequence identity to the zf-C3HC4 domain of one or more of the polypeptides set forth in SEQ ID NOs: 636, 638, 640, 642, 643, 645, 647, 649, 651, 653, 655, 657, 659, or 661. The C3HC4 type zinc-finger (RING finger) is a cysteine-rich domain of 40 to 60 residues that coordinates two zinc ions, and has the consensus sequence: C-X2-C-X(9-39)-C-X(1-3)-H-X(2-3)-C-X2-C-X(4-48)-C-X2-C where X is any amino acid. See Borden and Freemont, *Curr Opin Struct Biol* 6:395-401 (1996). Many proteins containing a RING finger play a role in the ubiquitination pathway.

A biomass-modulating polypeptide can contain an epimerase domain, which is predicted to be characteristic of a biomass-modulating polypeptide. SEQ ID NO: 368 sets forth the amino acid sequence of a *Panicum virgatum* clone, identified herein as CeresClone:1790897_CW00776 (SEQ ID NO: 367), that is predicted to encode a polypeptide containing an epimerase domain. For example, a biomass-modulating polypeptide can comprise an epimerase domain having 60 percent or greater (e.g., 65, 70, 75, 80, 85, 90, 95, 97, 98, 99, or 100%) sequence identity to residues 5 to 244 of SEQ ID NO: 368. In some embodiments, a biomass-modulating polypeptide can comprise an epimerase domain having 60 percent or greater (e.g., 65, 70, 75, 80, 85, 90, 95, 97, 98, 99, or 100%) sequence identity to the epimerase domain of one or more of the polypeptides set forth in SEQ ID NOs: 370, 372, 373, 375-378, 380, 382-387, 389, 391, 393, 395, 396, 398-404, 406-414, 416, 418, 420, 421, 423, 425, 427, 429, 431, 433, 435, 437, 439, 441, 443, 445, 447, 449, 451, 453, 455, 457, 459, 461, 463, 465, 467, 469, 471, 473, 475, 477, 479, 481, 483, 485, 487, 489, 491, 493, 495, or 497-502. The epimerase domain is found in the NAD dependent epimerase/dehydratase family. Proteins in the family use NAD as a cofactor and nucleotide-sugar substrates for a variety of chemical reactions.

A biomass-modulating polypeptide can contain an UDPGP domain, which is predicted to be characteristic of a biomass-modulating polypeptide. SEQ ID NO: 1599 sets forth the amino acid sequence of a *Panicum virgatum* clone, identified herein as CeresClone:1780416_CW00778 (SEQ ID NO: 1598), that is predicted to encode a polypeptide containing an UDPGP domain. For example, a biomass-modulating polypeptide can comprise an UDPGP domain having 60 percent or greater (e.g., 65, 70, 75, 80, 85, 90, 95, 97, 98, 99, or 100%) sequence identity to residues 31 to 442 of SEQ ID NO: 1599. In some embodiments, a biomass-modulating polypeptide can comprise an UDPGP domain having 60 percent or greater (e.g., 65, 70, 75, 80, 85, 90, 95, 97, 98, 99, or 100%) sequence identity to the UDPGP domain of one or more of the polypeptides set forth in SEQ ID NOs: 1600, 1602-1606, 1608-1613, 1615, 1616, 1618- 1626, 1628, 1629, 1631, 1633, 1634, 1636, 1637, 1639-1643, 1645, or 1646-1739. UDPGP refers to the family of UTP-glucose-1-phosphate uridylyltransferases (EC:2.7.7.9) (also known as UDP-glucose pyrophosphorylase or Glucose-1-phosphate uridylyltransferase). UTP-glucose-1-phosphate uridylyltransferase catalyses the interconversion of MgUTP+glucose-1-phosphate and UDP-glucose+MgPPi.

A biomass-modulating polypeptide can contain a Myb_DNA-binding domain, which is predicted to be characteristic of a biomass-modulating polypeptide. SEQ ID NO: 741 sets forth the amino acid sequence of a *Zea mays* clone, identified herein as CeresClone:896483_CW00787 (SEQ ID NO: 740), that is predicted to encode a polypeptide containing a Myb_DNA-binding domain. For example, a biomass-modulating polypeptide can comprise a Myb_DNA-binding domain having 60 percent or greater (e.g., 65, 70, 75, 80, 85, 90, 95, 97, 98, 99, or 100%) sequence identity to residues 14 to 59 of SEQ ID NO: 741. In some embodiments, a biomass-modulating polypeptide can comprise a Myb_DNA-binding domain having 60 percent or greater (e.g., 65, 70, 75, 80, 85, 90, 95, 97, 98, 99, or 100%) sequence identity to the Myb_DNA-binding domain of one or more of the polypeptides set forth in SEQ ID NOs: 743, 745, 746, 748, 750, 752, 754, 756, 758, 760-764, 766, 768, 770, 772, 774, 776, 778, 780, 782, 784, 785, 787, 789, 791, 793-795, 797, 799, 801, 803, 805, 806, 808, 810, 812, 814, 816, 818-820, 822-824, 826, 828, 830, 832, 834, 836, 838-840, 842, 843, 845-847, or 849. The Myb_DNA-binding domain is found in the family of Myb proteins, as well as the SANT domain family. See, Aasland et al., *Trends Biochem Sci* 121:87-88 (1996). The SANT domain family specifically recognizes the sequence YAAC (G/T)G.

A biomass-modulating polypeptide can contain a zf-C3HC4 domain, which is predicted to be characteristic of a biomass-modulating polypeptide. SEQ ID NO: 187 sets forth the amino acid sequence of a *Zea mays* clone, identified herein as CeresClone:225681_CW00792 (SEQ ID NO: 186), that is predicted to encode a polypeptide containing a zf-C3HC4 domain. For example, a biomass-modulating polypeptide can comprise a zf-C3HC4 domain having 60 percent or greater (e.g., 65, 70, 75, 80, 85, 90, 95, 97, 98, 99, or 100%) sequence identity to residues 132 to 173 of SEQ ID NO: 186. In some embodiments, a biomass-modulating polypeptide can comprise a zf-C3HC4 domain having 60 percent or greater (e.g., 65, 70, 75, 80, 85, 90, 95, 97, 98, 99, or 100%) sequence identity to the zf-C3HC4 domain of one or more of the polypeptides set forth in SEQ ID NOs: 188, 190, 192, 193, 194, or 196.

A biomass-modulating polypeptide can contain an IQ domain, which is predicted to be characteristic of a biomass-modulating polypeptide. SEQ ID NO: 1065 sets forth the amino acid sequence of an *Arabidopsis thaliana* clone, identified herein as CeresClone:106263_CW00780 (SEQ ID NO: 1064), that is predicted to encode a polypeptide containing an IQ domain. For example, a biomass-modulating polypeptide can comprise an IQ domain having 60 percent or greater (e.g., 65, 70, 75, 80, 85, 90, 95, 97, 98, 99, or 100%) sequence identity to residues 115 to 135 of SEQ ID NO: 1065. In some embodiments, a biomass-modulating polypeptide can comprise an IQ domain having 60 percent or greater (e.g., 65, 70, 75, 80, 85, 90, 95, 97, 98, 99, or 100%) sequence identity to the IQ domain of one or more of the polypeptides set forth in SEQ ID NOs: 1067, 1069, 1070, 1072, 1073, 1075, 1076, 1078-1080, 1082, 1083, 1085, 1087, 1089, 1091, 1093, 1095, 1096, 1098, 1100, 1101, 1103, 1105, 1106, 1108, or 1110. The IQ domain is a consensus for calcium-independent binding of calmodulin, which is a calcium sensor and helps regulate events through its interaction with a diverse group of cellular proteins. See Rhoads and Friedberg, *FASEB J.,* 11(5):331-40 (1997).

A biomass-modulating polypeptide can contain an AUX_IAA domain, which is predicted to be characteristic of a biomass-modulating polypeptide. SEQ ID NO: 1592 sets forth the amino acid sequence of an *Arabidopsis thaliana* clone, identified herein as CeresAnnot:1310682 (SEQ ID NO: 1591), that is predicted to encode a polypeptide containing an AUX_IAA domain. For example, a biomass-modulating polypeptide can comprise an AUX_IAA domain having 60 percent or greater (e.g., 65, 70, 75, 80, 85, 90, 95, 97, 98, 99, or 100%) sequence identity to residues 32 to 190 of SEQ ID NO: 1592. In some embodiments, a biomass-modulating polypeptide can comprise an AUX_IAA domain having 60 percent or greater (e.g., 65, 70, 75, 80, 85, 90, 95, 97, 98, 99, or 100%) sequence identity to the AUX_IAA domain of one or more of the polypeptides set forth in SEQ ID NOs: 1580, 1582, 1583, 1585, 1587, 1589, 1590, 1593, 1595, 1597, 2604, 2605, 2606, 2607, 2608, 2609, 2610, 2611, 2613, 2615, 2617, 2619, 2620, 2621, 2622, or 2623. Transcription of genes in the Aux/IAA family is induced by auxin (indole-3-acetic acid, IAA), which regulates diverse cellular and developmental responses in plants, including cell division, expansion, differentiation and patterning of embryo responses. See, Kulaeva and Prokoptseva, *Biochemistry (Mosc).* 69(3):233-47 (2004). Aux/IAA proteins act as repressors of auxin-induced gene expression, possibly through modulating the activity of DNA-binding auxin response factors (ARFs).

A biomass-modulating polypeptide can contain a CRAL/TRIO and a CRAL/TRIO, N-terminus domain, which are predicted to be characteristic of a biomass-modulating polypeptide. SEQ ID NO: 851 sets forth the amino acid sequence of an *Arabidopsis thaliana* clone, identified herein as CeresAnnot:838049_CW00759 (SEQ ID NO: 850), that is predicted to encode a polypeptide containing CRAL/TRIO and CRAL/TRIO, N-terminus domains. For example, a biomass-modulating polypeptide can comprise a CRAL/TRIO domain having 60 percent or greater (e.g., 65, 70, 75, 80, 85, 90, 95, 97, 98, 99, or 100%) sequence identity to residues 212 to 391 of SEQ ID NO: 851 and a CRAL/TRIO, N-terminus domain having 60 percent or greater (e.g., 65, 70, 75, 80, 85, 90, 95, 97, 98, 99, or 100%) sequence identity to residues 114 to 200 of SEQ ID NO: 851. In some embodiments, a biomass-modulating polypeptide can comprise a CRAL/TRIO domain and a CRAL/TRIO, N-terminus domain having 60 percent or greater sequence identity to the CRAL/TRIO and CRAL/TRIO, N-terminus domains of one or more of the polypeptides set forth in SEQ ID NOs: 853, 854, 856-858, 860, 862, 863, 865, 866, 868, 870-873, 875-878, 880-882, 884-886, 888, 890, 892, 893, 895, 897, 899, 900, 902, 903, 905, 907, 909, 911, 912, 913, 915, 917, 919, 921, 923, 925, or 926. The CRAL/TRIO N-terminal domain is found in the N-terminal, and the CRAL/TRIO domain is found in the C-terminal of various retinaldehyde/retinal-binding proteins. Trio is a multidomain protein that binds to a transmembrane tyrosine phosphatase, contains a protein kinase domain, and has separate rac-specific and rho-specific guanine nucleotide exchange factor domains. See, DeBant et al., *Proc Natl Acad Sci USA.,* 93(11):5466-71 (1996). Trio is a multifunctional protein that integrates and amplifies signals involved in coordinating actin remodeling, which is necessary for cell migration and growth. Other members of the family are transfer proteins that include, guanine nucleotide exchange factor, phosphatidylinositol/phosphatidylcholine transfer protein that is required for the transport of secretory proteins from the golgi complex, and alpha-tocopherol transfer protein that enhances the transfer of the ligand between separate membranes.

A biomass-modulating polypeptide can contain a zinc-finger (zf) Dof domain, which is predicted to be characteristic of a biomass-modulating polypeptide. SEQ ID NO: 1955 sets forth the amino acid sequence of an *Arabidopsis thaliana* clone, identified herein as CeresAnnot:529860 (SEQ ID NO: 1954), that is predicted to encode a polypeptide containing a zf-D of domain. For example, a biomass-modulating polypeptide can comprise a zf-D of domain having 60 percent or greater (e.g., 65, 70, 75, 80, 85, 90, 95, 97, 98, 99, or 100%) sequence identity to residues 35 to 97 of SEQ ID NO: 1955. In some embodiments, a biomass-modulating polypeptide can comprise a zf-Dof domain having 60 percent or greater (e.g., 65, 70, 75, 80, 85, 90, 95, 97, 98, 99, or 100%) sequence identity to the zf-D of domain of one or more of the polypeptides set forth in SEQ ID NOs: 1956, 1957, 1958, 1960, 1962, 1964, 1966, 1967, 1968, 1970, 1972, 1973, 1974, 1975, 1976, or 1978. The D of domain is a zinc finger DNA-binding domain that shows resemblance to the Cys2 zinc finger although it has a longer putative loop where an extra Cys residue is conserved. See, Shimofurutani et al., *FEBS Lett* 430:251-256 (1998).

A biomass-modulating polypeptide can contain a bZIP transcription factor domain, which is predicted to be characteristic of a biomass-modulating polypeptide. SEQ ID NO: 2150 sets forth the amino acid sequence of an *Arabidopsis thaliana* clone, identified herein as CeresAnnot: 853198 (SEQ ID NO: 2149), that is predicted to encode a polypeptide containing a bZIP transcription factor domain. For example, a biomass-modulating polypeptide can comprise a bZIP transcription factor domain having 60 percent or greater (e.g., 65, 70, 75, 80, 85, 90, 95, 97, 98, 99, or 100%) sequence identity to residues 118 to 181 of SEQ ID NO: 2150. In some embodiments, a biomass-modulating polypeptide can comprise a bZIP transcription factor domain having 60 percent or greater (e.g., 65, 70, 75, 80, 85, 90, 95, 97, 98, 99, or 100%) sequence identity to the bZIP transcription factor domain of one or more of the polypeptides set forth in SEQ ID NOs: 2152, 2154, 2155, 2157, 2159-2161, 2163, 2165, 2166, 2168, 2170, 2172-2175, 2177, 2179, 2181, 2183, and 2184. The bZIP transcription factor domain is a basic region mediating sequence-specific DNA-binding followed by a leucine zipper region required for dimerization. See, Hurst., *Protein Profile.* 2(2):101-68 (1995).

A biomass-modulating polypeptide can contain an Ammonium_transp domain, which is predicted to be characteristic of a biomass-modulating polypeptide. SEQ ID NO: 2196 sets forth the amino acid sequence of an *Arabidopsis thaliana* clone, identified herein as CeresAnnot: 873343 (SEQ ID NO: 2195), that is predicted to encode a polypeptide containing an Ammonium_transp domain. For example, a biomass-modulating polypeptide can comprise an Ammonium_transp domain having 60 percent or greater (e.g., 65, 70, 75, 80, 85, 90, 95, 97, 98, 99, or 100%) sequence identity to residues 47 to 471 of SEQ ID NO: 2196. In some embodiments, a biomass-modulating polypeptide can comprise an Ammonium_transp domain having 60 percent or greater (e.g., 65, 70, 75, 80, 85, 90, 95, 97, 98, 99, or 100%) sequence identity to the Ammonium_transp domain of one or more of the polypeptides set forth in SEQ ID NOs: 2197, 2199-2202, 2204, 2206-2208, 2210-2212, 2214, 2215, 2217-2220, 2222, 2224-2226, 2228, 2230-2232, 2234-2242, 2244-2254, and 2256-2269. Members of the ammonium transporter family are ammonia or ammonium uptake transporters. Some, but not others, also transport methylammonium. See, for example, Marini et al., *Mol Cell Biol* 17:4282-4293 (1997); and Marini et al., *Trends Biochem Sci* 22:460-461 (1997).

A biomass-modulating polypeptide can contain a 2OG-FeII_Oxy domain, which is predicted to be characteristic of a biomass-modulating polypeptide. SEQ ID NO: 2493 sets forth the amino acid sequence of an *Arabidopsis thaliana* clone, identified herein as CeresAnnot:878887 (SEQ ID NO: 2492), that is predicted to encode a polypeptide containing a 2OG-FeII_Oxy domain. For example, a biomass-modulating polypeptide can comprise a 2OG-FeII_Oxy domain having 60 percent or greater (e.g., 65, 70, 75, 80, 85, 90, 95, 97, 98, 99, or 100%) sequence identity to residues 47 to 471 of SEQ ID NO: 2196. In some embodiments, a biomass-modulating polypeptide can comprise a 2OG-Fell Oxy domain having 60 percent or greater (e.g., 65, 70, 75, 80, 85, 90, 95, 97, 98, 99, or 100%) sequence identity to the 2OG-FeII_Oxy domain of one or more of the polypeptides set forth in SEQ ID NOs: 2494-2498, 2500-2510, 2512-2515, 2517-2531, 2533-2536, 2538-2542, 2544-2548, 2550, 2551, 2553, 2555-2558, 2560, 2562, and 2564. The 2OG-FeII_Oxy domain is found in the 2OG-Fe(II) oxygenase superfamily, which contains members of the 2-oxoglutarate (2OG) and Fe(II)-dependent oxygenase superfamily. This family includes the C-terminal of the prolyl 4-hydroxylase alpha subunit. The holoenzyme has the activity EC:1.14.11.2 and catalyzes the reaction: Procollagen L-proline+2-oxoglutarate+$O_2$<=>procollagen trans-4-hydroxy-L-proline+succinate+$CO_2$. The full enzyme consists of an $alpha_2$ $beta_2$ complex with the alpha subunit contributing most of the parts of the active site. The family also includes lysyl hydrolases, isopenicillin synthases and AlkB See, Aravind and Koonin, *Genome Biol.*, 2:RESEARCH0007 (2001); Annunen et al., *J Biol Chem* 272:17342-17348 (1997); Helaakoski et al., *Proc Natl Acad Sci USA* 92:4427-4431 (1995); and Roach et al., *Nature* 375:700-704 (1995).

A biomass-modulating polypeptide can contain a DUF640 domain, which is predicted to be characteristic of a biomass-modulating polypeptide. SEQ ID NO: 2271 sets forth the amino acid sequence of a *Populus balsamifera* subsp. *trichocarpa* clone, identified herein as CeresAnnot: 1440417 (SEQ ID NO: 2270), that is predicted to encode a polypeptide containing a DUF640 domain. For example, a biomass-modulating polypeptide can comprise a DUF640 domain having 60 percent or greater (e.g., 65, 70, 75, 80, 85, 90, 95, 97, 98, 99, or 100%) sequence identity to residues 30 to 162 of SEQ ID NO: 2271. In some embodiments, a biomass-modulating polypeptide can comprise a DUF640 domain having 60 percent or greater (e.g., 65, 70, 75, 80, 85, 90, 95, 97, 98, 99, or 100%) sequence identity to the DUF640 domain of one or more of the polypeptides set forth in SEQ ID NOs: 2273, 2274, 2276, 2278, 2280, 2281, 2283, 2285, 2286, 2288, 2290, 2292, 2294, 2296, 2297, 2299, 2301, 2303, 2305, 2307, 2309, 2311, 2313, 2314, 2316-2318, 2320, 2322, 2324, 2326, 2327, 2329, 2331, 2333, 2335, 2337, 2339, 2341, 2342, 2344, 2345, 2347-2349, 2351, 2353, 2355, 2357, 2359, 2361, 2363, 2365, 2367-2369, 2371, 2373, 2375, 2377, 2379, 2381, 2383, 2385, 2386, 2388, 2390, 2391, 2393, 2395, 2397, 2399, 2400, 2402, 2404, 2405, 2407, 2409, 2411, 2413, 2415, 2417, 2419, 2421, and 2423. The DUF640 domain is a conserved region found in plant proteins including Resistance protein-like protein.

A biomass-modulating polypeptide can contain a CCT and a zf-B_box domain, which are predicted to be characteristic of a biomass-modulating polypeptide. SEQ ID NO: 1741 sets forth the amino acid sequence of an *Arabidopsis thaliana* clone, identified herein as CeresClone:6639 (SEQ ID NO: 1740), that is predicted to encode a polypeptide containing a CCT and a zf-B_box domain. For example, a biomass-modulating polypeptide can comprise a CCT domain having 60 percent or greater (e.g., 65, 70, 75, 80, 85, 90, 95, 97, 98, 99, or 100%) sequence identity to residues 285 to 329 of SEQ ID NO: 1741 and a zf-B_box domain having 60 percent or greater (e.g., 65, 70, 75, 80, 85, 90, 95, 97, 98, 99, or 100%) sequence identity to residues 17 to 60 or 61-103 of SEQ ID NO: 1741. In some embodiments, a biomass-modulating polypeptide can comprise a CCT and a zf-B_box domain having 60 percent or greater (e.g., 65, 70, 75, 80, 85, 90, 95, 97, 98, 99, or 100%) sequence identity to the CCT and a zf-B_box domain of one or more of the polypeptides set forth in SEQ ID NOs: 1743, 1745, 1747-1756, 1758, 1760, 1762-1764, 1766, 1767, 1769, 1770, 1772-1774, 1776, 1778-1783, 1785-1792, 1794, 1796, 1798, 1799, 1801, 1802, 1804, 1806, and 1808-1810. The CCT (CONSTANS, CO-like, and TOC1) domain is a highly conserved basic module of approximately 43 amino acids, which is found near the C-terminus of plant proteins (e.g., proteins involved in light signal transduction). The CCT domain is found in association with other domains, such as the B-box-type zinc finger, the GATA-type zinc finger, the ZIM motif or the response regulatory domain. The CCT domain contains a putative nuclear localization signal within the second half of the CCT motif. See Strayer et al., *Science*, 289:768-771 (2000). B-box-type zinc finger domains are approximately 40 residues in length, and can be divided into two groups, type 1 and type 2, which differ in their consensus sequence and in the spacing of the 7-8 zinc-binding residues.

A biomass-modulating polypeptide can contain an X8 domain, which is predicted to be characteristic of a biomass-modulating polypeptide. SEQ ID NO: 1980 sets forth the amino acid sequence of an *Arabidopsis thaliana* clone, identified herein as CeresClone:11830 (SEQ ID NO: 1981), that is predicted to encode a polypeptide containing an X8 domain. For example, a biomass-modulating polypeptide can comprise an X8 domain having 60 percent or greater (e.g., 65, 70, 75, 80, 85, 90, 95, 97, 98, 99, or 100%) sequence identity to residues 29 to 115 of SEQ ID NO: 1980. In some embodiments, a biomass-modulating polypeptide can comprise an X8 domain having 60 percent or greater (e.g., 65, 70, 75, 80, 85, 90, 95, 97, 98, 99, or 100%) sequence identity to the X8 domain of one or more of the polypeptides set forth in SEQ ID NOs:1982, 1984-1986, 1988, 1990, 1991, 1993, 1995, 1997, 1999, 2001, 2003, 2005, 2007, 2009, 2011, 2013, 2015, 2017, 2019, 2021, 2023-2027, 2029, 2031, and 2033. The X8 domain contains 6 conserved cysteine residues that can form three disulphide bridges. The domain may be involved in carbohydrate binding. See, Barral et al., *J Immunol* 172:3644-3651 (2004); Henrissat and Davies, *Plant Physiol* 124:1515-1519 (2000); and Henrissat et al., *Plant Mol Biol* 47:55-72 (2001).

A biomass-modulating polypeptide can contain a Ribosomal_L18p domain, which is predicted to be characteristic of a biomass-modulating polypeptide. SEQ ID NO: 1812 sets forth the amino acid sequence of an *Arabidopsis thaliana* clone, identified herein as CeresClone:32753 (SEQ ID NO: 1811), that is predicted to encode a polypeptide containing a Ribosomal_L18p domain. For example, a biomass-modulating polypeptide can comprise a Ribosomal_L18p domain having 60 percent or greater (e.g., 65, 70, 75, 80, 85, 90, 95, 97, 98, 99, or 100%) sequence identity to residues 26 to 172 of SEQ ID NO: 1812. In some embodiments, a biomass-modulating polypeptide can comprise a Ribosomal_L18p domain having 60 percent or greater (e.g., 65, 70, 75, 80, 85, 90, 95, 97, 98, 99, or 100%) sequence identity to the Ribosomal_L18p domain of one or more of the polypeptides set forth in SEQ ID NOs: 1814, 1815, 1817, 1819, 1821, 1822, 1824, 1826-1830, 1832, 1834, 1835, 1837, 1839-1841, 1843, 1844, 1846, 1847, 1849, 1851, 1852, 1854, 1856, 1858, 1860-1863, and 1865-1953. The Ribosomal_L18p domain is found in ribosomal proteins from the large subunit. This family includes L18 from bacteria and L5 from eukaryotes.

A biomass-modulating polypeptide can contain a Ribosomal_S5 and a Ribosomal_S5_C domain, which are predicted to be characteristic of a biomass-modulating polypeptide. SEQ ID NO: 2035 sets forth the amino acid sequence of an *Arabidopsis thaliana* clone, identified herein as CeresClone:93867 (SEQ ID NO: 2034), that is predicted to encode a polypeptide containing a Ribosomal_S5 and a Ribosomal_S5_C domain. For example, a biomass-modulating polypeptide can comprise a Ribosomal_S5 domain having 60 percent or greater (e.g., 65, 70, 75, 80, 85, 90, 95, 97, 98, 99, or 100%) sequence identity to residues 94 to 160 of SEQ ID NO: 2035 and a Ribosomal_S5_C domain having 60 percent or greater (e.g., 65, 70, 75, 80, 85, 90, 95, 97, 98, 99, or 100%) sequence identity to residues 177 to 250 of SEQ ID NO: 2035. In some embodiments, a biomass-modulating polypeptide can comprise a Ribosomal_S5 and a Ribosomal_S5_C domain having 60 percent or greater (e.g., 65, 70, 75, 80, 85, 90, 95, 97, 98, 99, or 100%) sequence identity to the Ribosomal_S5 and Ribosomal_S5_C domains of one or more of the polypeptides set forth in SEQ ID NOs: 2037, 2039, 2041, 2043, 2045, 2047-2049, 2051-2057, 2059, 2061, 2063, 2065, 2067, 2069, 2071, 2073, 2075, 2077, 2079, 2080, 2082, 2084, 2086, 2088, 2090, 2092, 2093, 2095, 2097, 2098, and 2100-2122. The Ribosomal_S5 and Ribosomal_S5_C(C-terminal) domains are characteristics of a family of proteins related to the 30S ribosomal protein S5P from *Sulfolobus acidocaldarius*.

A biomass-modulating polypeptide can contain a PTR2 domain, which is predicted to be characteristic of a biomass-modulating polypeptide. SEQ ID NO: 2425 sets forth the amino acid sequence of an *Arabidopsis thaliana* clone, identified herein as CeresAnnot:837788 (SEQ ID NO: 2424), that is predicted to encode a polypeptide containing a PTR2 domain. For example, a biomass-modulating polypeptide can comprise a PTR2 domain having 60 percent or greater (e.g., 65, 70, 75, 80, 85, 90, 95, 97, 98, 99, or 100%) sequence identity to residues 90 to 486 of SEQ ID NO: 2425. In some embodiments, a biomass-modulating polypeptide can comprise a PTR2 domain having 60 percent or greater (e.g., 65, 70, 75, 80, 85, 90, 95, 97, 98, 99, or 100%) sequence identity to the PTR2 domain of one or more of the polypeptides set forth in SEQ ID NOs: 2426, 2428, 2430, 2431, 2433, 2435, 2437, 2438-2440, 2442, 2444, 2445, 2447, 2449, 2451, 2453, 2455, 2457, 2459, 2461, 2463-2468, 2470, 2472, 2474, 2476, 2478, 2479, 2481, 2482, 2484, 2485, and 2487-2491. The PTR2 (peptide transporter 2) domain is characteristic of the proton-dependent oligopeptide transport (POT) family. See, Paulsen and Skurray, *Trends Biochem Sci*, 19:404-404, (1994).

In some embodiments, a biomass-modulating polypeptide is truncated at the amino- or carboxy-terminal end of a naturally occurring polypeptide. A truncated polypeptide may retain certain domains of the naturally occurring polypeptide while lacking others. Thus, length variants that are up to 5 amino acids shorter or longer typically exhibit the biomass-modulating activity of a truncated polypeptide. In some embodiments, a truncated polypeptide is a dominant negative polypeptide. Expression in a plant of such a truncated polypeptide confers a difference in the level of biomass of a plant as compared to the corresponding level of a control plant that does not comprise the truncation.

B. Functional Homologs Identified by Reciprocal Basic Local Alignment Search Tool (BLAST)®

In some embodiments, one or more functional homologs of a reference biomass-modulating polypeptide defined by one or more of the Pfam descriptions indicated above are suitable for use as biomass-modulating polypeptides. A functional homolog is a polypeptide that has sequence similarity to a reference polypeptide, and that carries out one or more of the biochemical or physiological function(s) of the reference polypeptide. A functional homolog and the reference polypeptide may be natural occurring polypeptides, and the sequence similarity may be due to convergent or divergent evolutionary events. As such, functional homologs are sometimes designated in the literature as homologs, or orthologs, or paralogs. Variants of a naturally occurring functional homolog, such as polypeptides encoded by mutants of a wild type coding sequence, may themselves be functional homologs. Functional homologs can also be created via site-directed mutagenesis of the coding sequence for a biomass-modulating polypeptide, or by combining domains from the coding sequences for different naturally-occurring biomass-modulating polypeptides ("domain swapping"). The term "functional homolog" is sometimes applied to the nucleic acid that encodes a functionally homologous polypeptide.

Functional homologs can be identified by analysis of nucleotide and polypeptide sequence alignments. For example, performing a query on a database of nucleotide or polypeptide sequences can identify homologs of biomass-modulating polypeptides. Sequence analysis can involve Basic Local Alignment Search Tool (BLAST)®, Reciprocal BLAST®, or PSI-BLAST® analysis of nonredundant databases using a biomass-modulating polypeptide amino acid sequence as the reference sequence. Amino acid sequence is, in some instances, deduced from the nucleotide sequence. Those polypeptides in the database that have greater than 40% sequence identity are candidates for further evaluation for suitability as a biomass-modulating polypeptide. Amino acid sequence similarity allows for conservative amino acid substitutions, such as substitution of one hydrophobic residue for another or substitution of one polar residue for another. If desired, manual inspection of such candidates can be carried out in order to narrow the number of candidates to be further evaluated. Manual inspection can be performed by selecting those candidates that appear to have domains present in biomass-modulating polypeptides, e.g., conserved functional domains.

Conserved regions can be identified by locating a region within the primary amino acid sequence of a biomass-modulating polypeptide that is a repeated sequence, forms some secondary structure (e.g., helices and beta sheets), establishes positively or negatively charged domains, or represents a protein motif or domain. See, e.g., the Pfam web site describing consensus sequences for a variety of protein motifs and domains on the World Wide Web at sanger.ac.uk/Software/Pfam/ and pfam.janelia.org/. A description of the information included at the Pfam database is described in Sonnhammer et al., *Nucl. Acids Res.*, 26:320-322 (1998); Sonnhammer et al., *Proteins*, 28:405-420 (1997); and Bateman et al., *Nucl. Acids Res.*, 27:260-262 (1999). Conserved regions also can be determined by aligning sequences of the same or related polypeptides from closely related species. Closely related species preferably are from the same family. In some embodiments, alignment of sequences from two different species is adequate.

Typically, polypeptides that exhibit at least about 40% amino acid sequence identity are useful to identify conserved regions. Conserved regions of related polypeptides exhibit at least 45% amino acid sequence identity (e.g., at least 50%, at least 60%, at least 70%, at least 80%, or at least 90% amino acid sequence identity). In some embodiments, a conserved region exhibits at least 92%, 94%, 96%, 98%, or 99% amino acid sequence identity.

Examples of amino acid sequences of functional homologs of the polypeptide set forth in SEQ ID NO: 2 (Ceres Clone. 1724838) are provided in the Sequence Listing. Such functional homologs include, for example, GI:297838817 (SEQ ID NO: 2589) and GI:297850868 (SEQ ID NO: 2590). In some cases, a functional homolog of SEQ ID NO: 2 has an amino acid sequence with at least 45% sequence identity, e.g., 50%, 52%, 56%, 59%, 61%, 65%, 70%, 75%, 80%, 85%, 90%, 95%, 97%, 98%, or 99% sequence identity, to the amino acid sequence set forth in SEQ ID NO: 2. In some cases, a functional homolog of SEQ ID NO: 2 has an amino acid sequence with at least 45% sequence identity, e.g., 50%, 52%, 56%, 59%, 61%, 65%, 70%, 75%, 80%, 85%, 90%, 95%, 97%, 98%, or 99% sequence identity, to one or more functional homologs of SEQ ID NO:2 described above or set forth in the Sequence Listing.

Figure 1B:
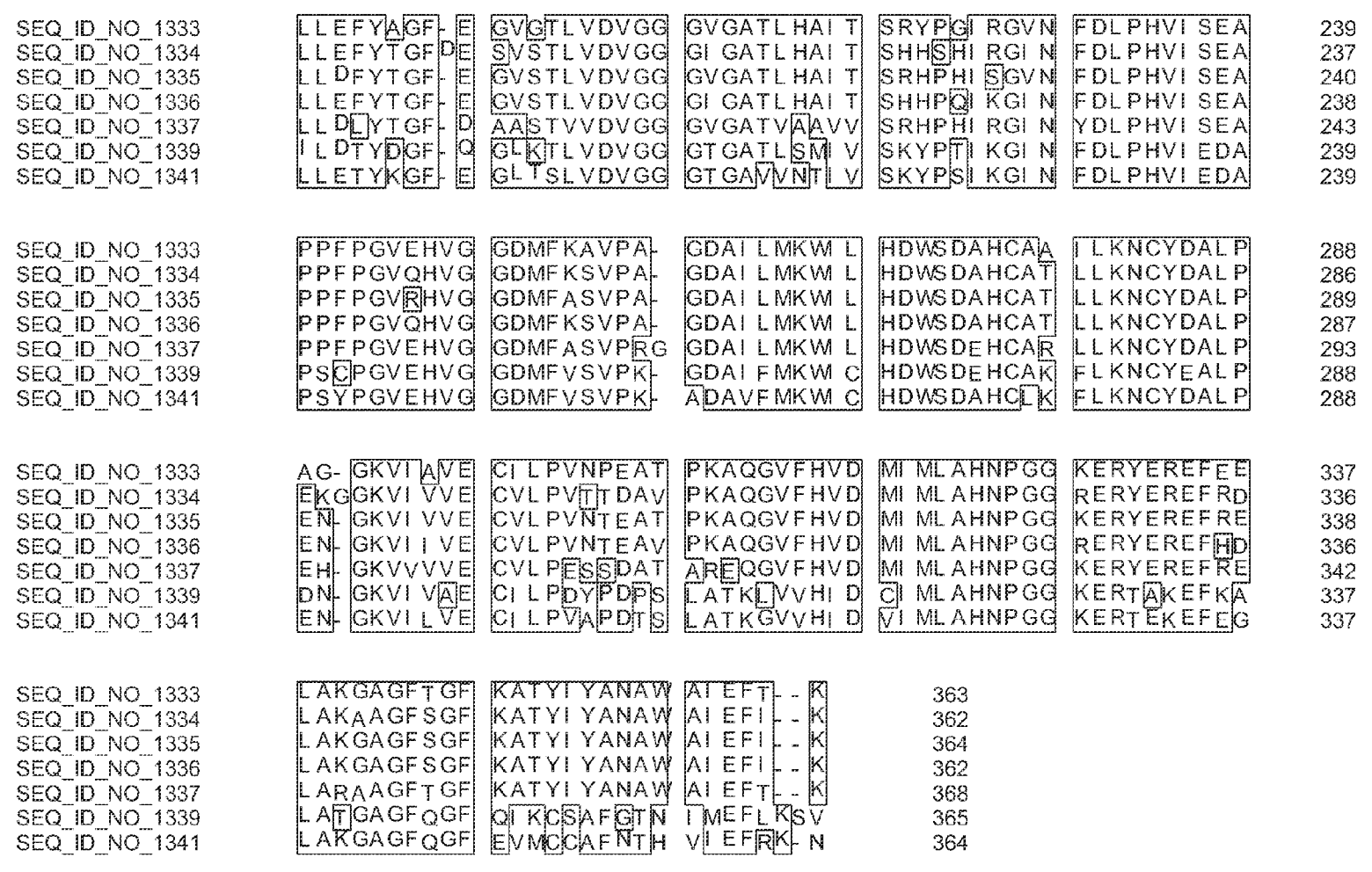

Examples of amino acid sequences of functional homologs of the polypeptide set forth in SEQ ID NO: 1333 are provided in FIG. 1 and in the Sequence Listing. Such functional homologs include, for example, GI:28569609 (SEQ ID NO: 1334), GI:729135 (SEQ ID NO: 1335), GI:29839259 (SEQ ID NO: 1336), GI:115474869 (SEQ ID NO: 1337), CeresClone:1838010 (SEQ ID NO: 1339), CeresAnnot:1521032 (SEQ ID NO: 1341), CeresClone:1769444 (SEQ ID NO: 1343), CeresClone:1869486 (SEQ ID NO: 1345), CeresAnnot:8704591 (SEQ ID NO: 1347), GI:18033964 (SEQ ID NO: 1348), GI:125602246 (SEQ ID NO: 1349), GI:125560205 (SEQ ID NO: 1350), CeresAnnot:1467665 (SEQ ID NO: 1352), CeresAnnot:1472909 (SEQ ID NO: 1354), CeresClone:253173 (SEQ ID NO: 1356), CeresClone:464420 (SEQ ID NO: 1358), CeresClone:1086143 (SEQ ID NO: 1360), CeresClone:1118817 (SEQ ID NO: 1362), or CeresClone:1128033 (SEQ ID NO: 1364). In some cases, a functional homolog of SEQ ID NO: 1333 has an amino acid sequence with at least 45% sequence identity, e.g., 50%, 52%, 56%, 59%, 61%, 65%, 70%, 75%, 80%, 85%, 90%, 95%, 97%, 98%, or 99% sequence identity, to the amino acid sequence set forth in SEQ ID NO: 1333. In some cases, a functional homolog of SEQ ID NO: 1333 has an amino acid sequence with at least 45% sequence identity, e.g., 50%, 52%, 56%, 59%, 61%, 65%, 70%, 75%, 80%, 85%, 90%, 95%, 97%, 98%, or 99% sequence identity, to one or more functional homologs of SEQ ID NO:1333 described above or set forth in the Sequence Listing.

Examples of amino acid sequences of functional homologs of the polypeptide set forth in SEQ ID NO: 1489 are provided in FIG. 2 and in the Sequence Listing. Such functional homologs include, for example, CeresAnnot:8642776 (SEQ ID NO:1491), GI:212276047 (SEQ ID NO:1492), GI:15217280 (SEQ ID NO:1493), CeresAnnot:1539881 (SEQ ID NO:1495), GI:225458601 (SEQ ID NO:1496), CeresAnnot:879992 (SEQ ID NO:1498), GI:116789722 (SEQ ID NO:1499), CeresClone:517025 (SEQ ID NO:1501), CeresClone:1948550 (SEQ ID NO:1503), GI:125542675 (SEQ ID NO:1504), CeresAnnot:1486466 (SEQ ID NO:1506), CeresClone:1794546 (SEQ ID NO:1508), CeresAnnot:8669878 (SEQ ID NO:1510), GI:115441423 (SEQ ID NO:1511), CeresAnnot:8679606 (SEQ ID NO:1513), GI:46391126 (SEQ ID NO:1514), CeresClone:1792549 (SEQ ID NO:1516), GI:186478283 (SEQ ID NO:1517), GI:157335049 (SEQ ID NO:1518), GI:46389857 (SEQ ID NO:1519), GI:15221943 (SEQ ID NO:1520), GI:60657590 (SEQ ID NO:1521), CeresAnnot:1505332 (SEQ ID NO:1523), GI:225450971 (SEQ ID NO:1524), CeresAnnot:1452239 (SEQ ID NO:1526), CeresAnnot:8462522 (SEQ ID NO:1528), GI:147866346 (SEQ ID NO:1529), GI:168006895 (SEQ ID NO:1530), GI:22330689 (SEQ ID NO:1531), GI:150036251 (SEQ ID NO:1532), CeresAnnot:542553 (SEQ ID NO:1534), CeresAnnot:1488968 (SEQ ID NO:1536), ACR36345 (SEQ ID NO:1537), Q10QT1_ORYSJ (SEQ ID NO:1538), or B9F5J9 ORYSJ (SEQ ID NO:1539). In some cases, a functional homolog of SEQ ID NO: 1489 has an amino acid sequence with at least 45% sequence identity, e.g., 50%, 52%, 56%, 59%, 61%, 65%, 70%, 75%, 80%, 85%, 90%, 95%, 97%, 98%, or 99% sequence identity, to the amino acid sequence set forth in SEQ ID NO: 1489. In some cases, a functional homolog of SEQ ID NO: 1489 has an amino acid sequence with at least 45% sequence identity, e.g., 50%, 52%, 56%, 59%, 61%, 65%, 70%, 75%, 80%, 85%, 90%, 95%, 97%, 98%, or 99% sequence identity, to one or more functional homologs of SEQ ID NO: 1489 described above or set forth in the Sequence Listing.

Examples of amino acid sequences of functional homologs of the polypeptide set forth in SEQ ID NO: 504 are provided in FIG. 3 and in the Sequence Listing. Such functional homologs include, for example, CeresClone:457093 (SEQ ID NO: 506), CeresAnnot:8701524 (SEQ ID NO: 508), GI:90265053 (SEQ ID NO: 509), CeresAnnot:1473716 (SEQ ID NO: 511), GI:225456842 (SEQ ID NO: 512), GI:488787 (SEQ ID NO: 513), GI:91075914 (SEQ ID NO: 514), GI:15292677 (SEQ ID NO: 515), GI:167100 (SEQ ID NO: 516), GI:38345247 (SEQ ID NO: 517), CeresAnnot:1480323 (SEQ ID NO: 519), CeresClone:1807161 (SEQ ID NO: 521), GI:29838631 (SEQ ID NO: 522), CeresAnnot:875520 (SEQ ID NO: 524), GI:225441787 (SEQ ID NO: 525), GI:115471135 (SEQ ID NO: 526), GI:125546144 (SEQ ID NO: 527), CeresClone:1533376 (SEQ ID NO: 529), GI:125557655 (SEQ ID NO: 530), CeresAnnot:8632040 (SEQ ID NO: 532), GI:50540754 (SEQ ID NO: 533), CeresAnnot:8645125 (SEQ ID NO: 535), GI:29838629 (SEQ ID NO: 536), GI:87128422 (SEQ ID NO: 537), CeresClone:826233 (SEQ ID NO: 539), CeresAnnot:1474940 (SEQ ID NO: 541), CeresClone:927786 (SEQ ID NO: 543), CeresAnnot:1453705 (SEQ ID NO: 545), GI:148925503 (SEQ ID NO: 546), CeresAnnot:8714640 (SEQ ID NO: 548), CeresAnnot:1528375 (SEQ ID NO: 550), CeresClone:1768954 (SEQ ID NO: 552), GI:23452226 (SEQ ID NO: 553), GI:7242785 (SEQ ID NO: 554), GI:30694660 (SEQ ID NO: 555), CeresAnnot:1532021 (SEQ ID NO: 557), GI:168002098 (SEQ ID NO: 558), CeresClone:1806608 (SEQ ID NO: 560), CeresAnnot:8457131 (SEQ ID NO: 562), CeresAnnot:8735307 (SEQ ID NO: 564), CeresAnnot:1453769 (SEQ ID NO: 566), CeresAnnot:1478531 (SEQ ID NO: 568), CeresClone:1575663 (SEQ ID NO: 570), GI:42572711 (SEQ ID NO: 571), XP_002448054 (SEQ ID NO: 572), SEQ ID NO: 573, SEQ ID NO: 574, B9FFR9_ORYSJ (SEQ ID NO: 575), SEQ ID NO: 576, Q0JCB5_ORYSJ (SEQ ID NO: 577), or SEQ ID NO: 578. In some cases, a functional homolog of SEQ ID NO: 504 has an amino acid sequence with at least 45% sequence identity, e.g., 50%, 52%, 56%, 59%, 61%, 65%, 70%, 75%, 80%, 85%, 90%, 95%, 97%, 98%, or 99% sequence identity, to the amino acid sequence set forth in SEQ ID NO: 504. In some cases, a functional homolog of SEQ ID NO: 504 has an amino acid sequence with at least 45% sequence identity, e.g., 50%, 52%, 56%, 59%, 61%, 65%, 70%, 75%, 80%, 85%, 90%, 95%, 97%, 98%, or 99% sequence identity, to one or more functional homologs of SEQ ID NO: 504 described above or set forth in the Sequence Listing.

Figure 4A:
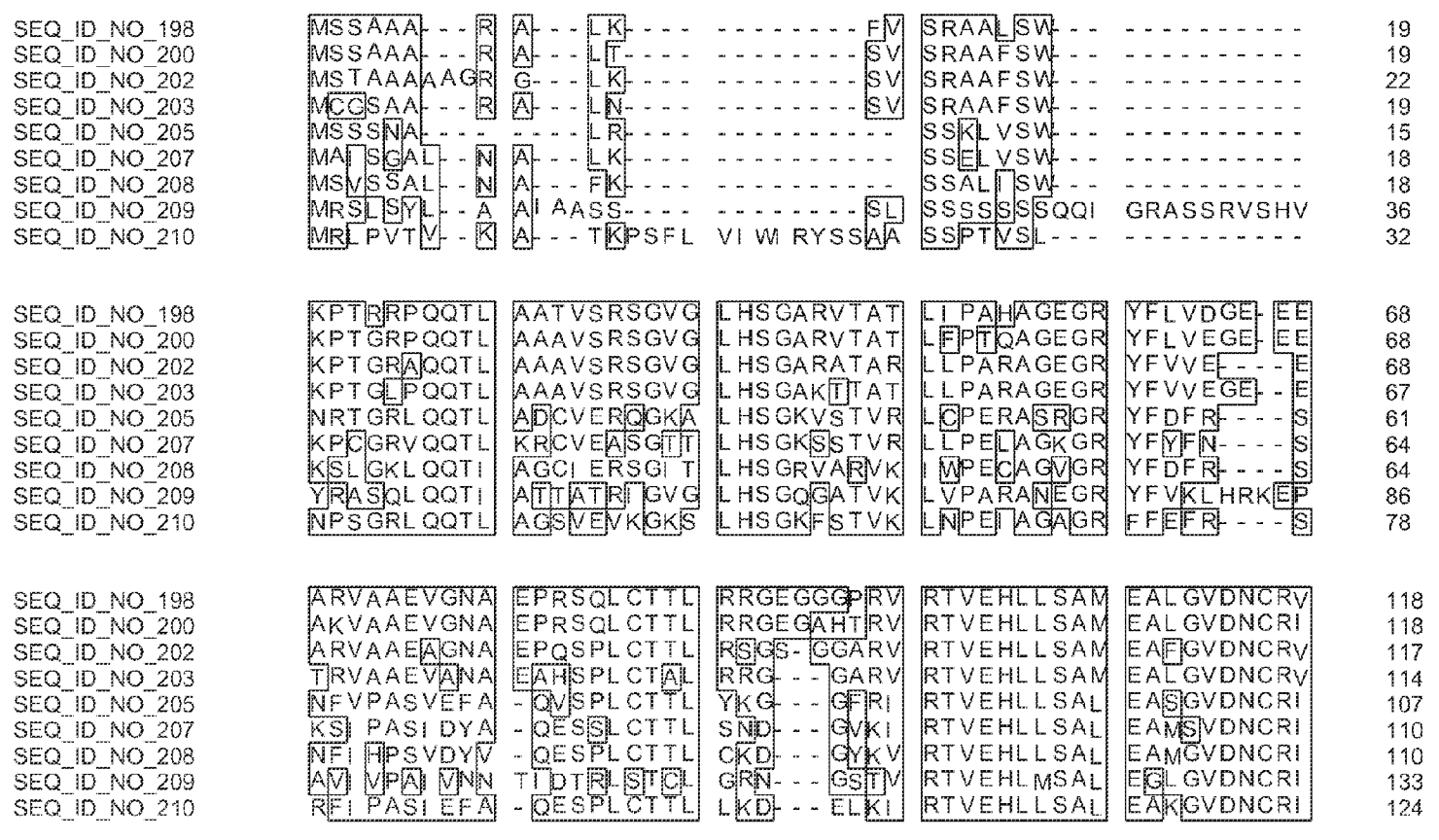
Figure 4B:
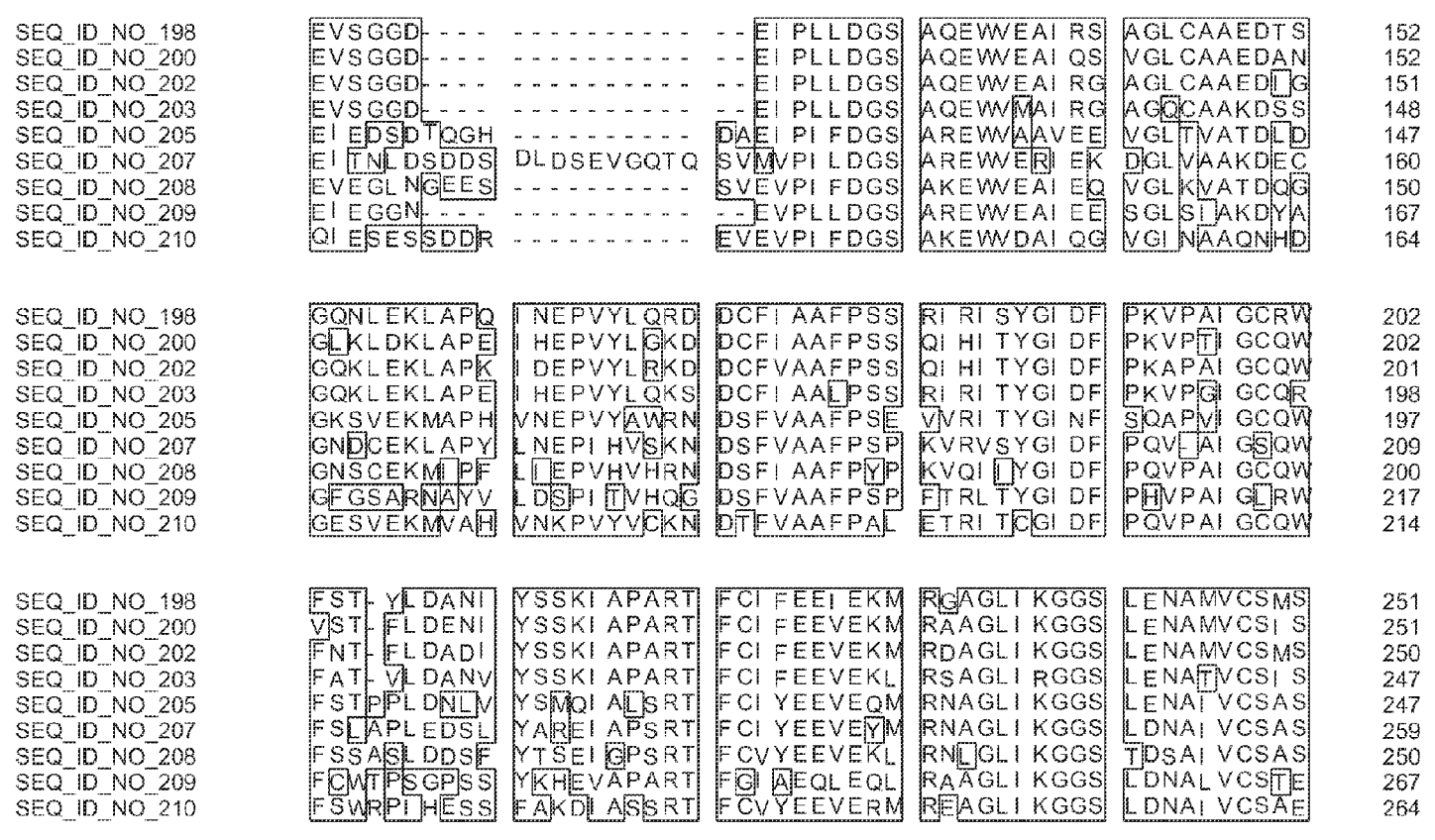
Figure 4C:
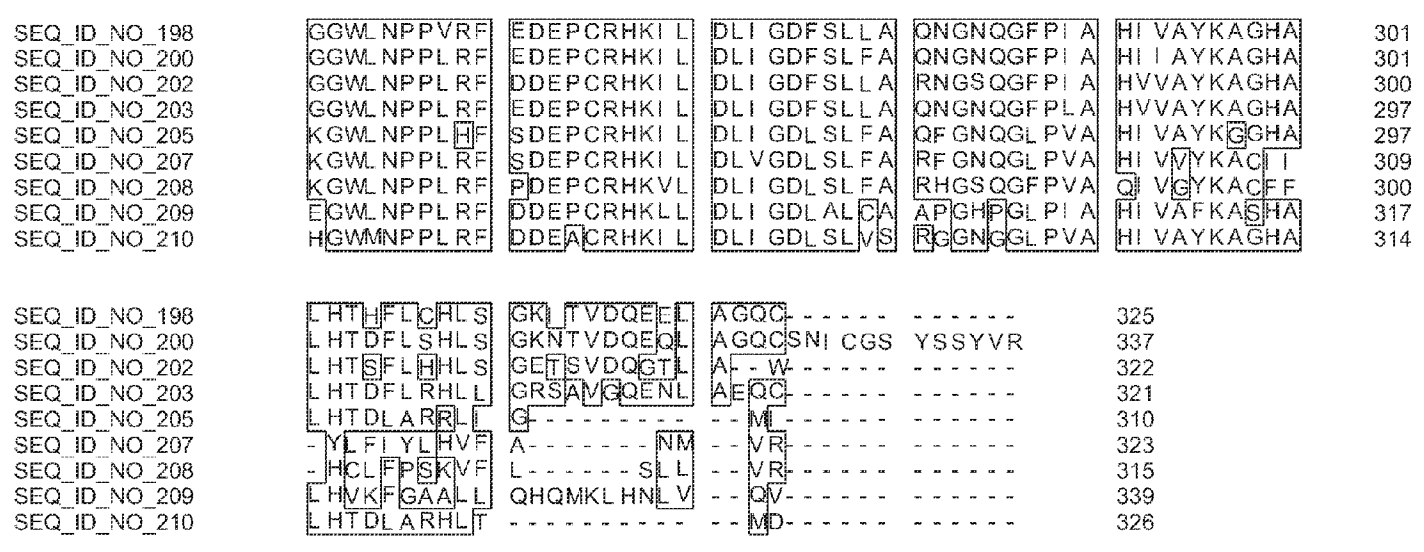

Examples of amino acid sequences of functional homologs of the polypeptide set forth in SEQ ID NO: 198 are provided in FIG. 4 and in the Sequence Listing. Such functional homologs include, for example, CeresAnnot: 8642356 (SEQ ID NO: 200), CeresClone:935672 (SEQ ID NO: 202), GI:115451651 (SEQ ID NO: 203), CeresClone: 553404 (SEQ ID NO: 205), CeresAnnot:1517043 (SEQ ID NO: 207), GI:157339009 (SEQ ID NO: 208), GI:167997651 (SEQ ID NO: 209), GI:186478838 (SEQ ID NO: 210), GI:24308613 (SEQ ID NO: 211), CeresAnnot:1463744 (SEQ ID NO: 213), GI:147769548 (SEQ ID NO: 214), GI:17229762 (SEQ ID NO: 215), GI:75906320 (SEQ ID NO: 216), GI:225148780 (SEQ ID NO: 217), GI:224402519 (SEQ ID NO: 218), GI:170076947 (SEQ ID NO: 219), GI:67924367 (SEQ ID NO: 220), GI:196258900 (SEQ ID NO: 221), GI:186683207 (SEQ ID NO: 222), GI:16329599 (SEQ ID NO: 223), GI:196244340 (SEQ ID NO: 224), GI:166366663 (SEQ ID NO: 225), GI:113476833 (SEQ ID NO: 226), GI:172037292 (SEQ ID NO: 227), GI:22299333 (SEQ ID NO: 228), GI:159027881 (SEQ ID NO: 229), GI:158333778 (SEQ ID NO: 230), GI:86610210 (SEQ ID NO: 231), GI:119491435 (SEQ ID NO: 232), GI:86606600 (SEQ ID NO: 233), GI:119511195 (SEQ ID NO: 234), GI:116073620 (SEQ ID NO: 235), GI:37521434 (SEQ ID NO: 236), GI:113954355 (SEQ ID NO: 237), GI:88807444 (SEQ ID NO: 238), GI:56750622 (SEQ ID NO: 239), GI:87123666 (SEQ ID NO: 240), GI:33865092 (SEQ ID NO: 241), GI:148240294 (SEQ ID NO: 242), GI:116071234 (SEQ ID NO: 243), GI:78213633 (SEQ ID NO: 244), GI:148242917 (SEQ ID NO: 245), GI:159903932 (SEQ ID NO: 246), GI:72382747 (SEQ ID NO: 247), GI:124026469 (SEQ ID NO: 248), GI:87301187 (SEQ ID NO: 249), GI:78184132 (SEQ ID NO: 250), or SEQ ID NO: 251. In some cases, a functional homolog of SEQ ID NO: 198 has an amino acid sequence with at least 45% sequence identity, e.g., 50%, 52%, 56%, 59%, 61%, 65%, 70%, 75%, 80%, 85%, 90%, 95%, 97%, 98%, or 99% sequence identity, to the amino acid sequence set forth in SEQ ID NO: 198. In some cases, a functional homolog of SEQ ID NO: 198 has an amino acid sequence with at least 45% sequence identity, e.g., 50%, 52%, 56%, 59%, 61%, 65%, 70%, 75%, 80%, 85%, 90%, 95%, 97%, 98%, or 99% sequence identity, to one or more functional homologs of SEQ ID NO: 198 described above or set forth in the Sequence Listing.

Examples of amino acid sequences of functional homologs of the polypeptide set forth in SEQ ID NO: 253 are provided in FIG. 5 and in the Sequence Listing. Such functional homologs include, for example, CeresAnnot: 8680534 (SEQ ID NO: 255), CeresAnnot:1694297 (SEQ ID NO:257), GI:225459251 (SEQ ID NO:258), CeresAnnot: 1443484 (SEQ ID NO:260), GI:225462851 (SEQ ID NO:261), GI:62241065 (SEQ ID NO:262), CeresClone: 1925472 (SEQ ID NO:264), GI:15219870 (SEQ ID NO:265), CeresClone:514069 (SEQ ID NO:267), GI:37993655 (SEQ ID NO:268), GI:157734205 (SEQ ID NO:269), GI:159171968 (SEQ ID NO:270), GI:125541183 (SEQ ID NO:271), GI:115448767 (SEQ ID NO:272), CeresAnnot:8680541 (SEQ ID NO:274), GI:225465718 (SEQ ID NO:275), GI:225459253 (SEQ ID NO:276), GI:225459257 (SEQ ID NO:277), GI:225459268 (SEQ ID NO:278), GI:225459266 (SEQ ID NO:279), CeresAnnot: 1441002 (SEQ ID NO:281), GI:225468662 (SEQ ID NO:282), GI:225459270 (SEQ ID NO:283), CeresAnnot: 1476414 (SEQ ID NO:285), CeresAnnot:1529873 (SEQ ID NO:287), GI:62241067 (SEQ ID NO:288), GI:225468664 (SEQ ID NO:289), GI:225467440 (SEQ ID NO:290), GI:225468668 (SEQ ID NO:291), GI:17065006 (SEQ ID NO:292), CeresAnnot:865380 (SEQ ID NO:294), GI:225468660 (SEQ ID NO:295), GI:19911203 (SEQ ID NO:296), GI:42571589 (SEQ ID NO:297), CeresAnnot: 1503910 (SEQ ID NO:299), CeresClone:1747545 (SEQ ID NO:301), CeresAnnot:1476416 (SEQ ID NO:303), GI:54292902 (SEQ ID NO:304), GI:225465732 (SEQ ID NO:305), CeresAnnot:1456348 (SEQ ID NO:307), CeresClone:1768985 (SEQ ID NO:309), GI:79349376 (SEQ ID NO:310), CeresAnnot:1476405 (SEQ ID NO:312), CeresClone:1597737 (SEQ ID NO:314), CeresClone:1862526 (SEQ ID NO:316), GI:79318336 (SEQ ID NO:317), GI:125541186 (SEQ ID NO:318), CeresClone:624581 (SEQ ID NO:320), GI:15219867 (SEQ ID NO:321), CeresClone:1797125 (SEQ ID NO:323), CeresAnnot:8701197 (SEQ ID NO:325), CeresAnnot:1453378 (SEQ ID NO:327), GI:115457712 (SEQ ID NO:328), GI:125547765 (SEQ ID NO:329), CeresAnnot:1453373 (SEQ ID NO:331), GI:115446887 (SEQ ID NO:332), CeresClone:1492154 (SEQ ID NO:334), GI:125525771 (SEQ ID NO:335), CeresClone:1571410 (SEQ ID NO:337), GI:115334817 (SEQ ID NO:338), GI:133874192 (SEQ ID NO:339), CeresAnnot: 1453383 (SEQ ID NO:341), GI:152149367 (SEQ ID NO:342), CeresClone:791790 (SEQ ID NO:344), GI:125561485 (SEQ ID NO:345), CeresClone:474849 (SEQ ID NO:347), CeresAnnot:1474602 (SEQ ID NO:349), CeresAnnot:8713073 (SEQ ID NO:351), CeresClone: 795726 (SEQ ID NO:353), CeresAnnot:8656770 (SEQ ID NO:355), CeresAnnot:8679871 (SEQ ID NO:357), CeresAnnot:833488 (SEQ ID NO:359), CeresClone:1769061 (SEQ ID NO:361), SEQ ID NO:362, SEQ ID NO:363, SEQ ID NO:364, B8AIT5_ORYSI (SEQ ID NO:365), or SEQ ID NO:366. In some cases, a functional homolog of SEQ ID NO: 253 has an amino acid sequence with at least 45% sequence identity, e.g., 50%, 52%, 56%, 59%, 61%, 65%, 70%, 75%, 80%, 85%, 90%, 95%, 97%, 98%, or 99% sequence identity, to the amino acid sequence set forth in SEQ ID NO: 253. In some cases, a functional homolog of SEQ ID NO: 253 has an amino acid sequence with at least 45% sequence identity, e.g., 50%, 52%, 56%, 59%, 61%, 65%, 70%, 75%, 80%, 85%, 90%, 95%, 97%, 98%, or 99% sequence identity, to one or more functional homologs of SEQ ID NO: 253 described above or set forth in the Sequence Listing.

Examples of amino acid sequences of functional homologs of the polypeptide set forth in SEQ ID NO: 1541 are provided in FIG. 6 and in the Sequence Listing. Such functional homologs include, for example, GI:194708348 (SEQ ID NO: 1542), CeresAnnot:8636073 (SEQ ID NO:1544), GI:115482024 (SEQ ID NO:1545), CeresClone: 703931 (SEQ ID NO:1547), GI:87240452 (SEQ ID NO:1548), CeresClone:529175 (SEQ ID NO:1550), CeresAnnot:1468685 (SEQ ID NO:1552), GI:116785783 (SEQ ID NO:1553), CeresClone:1832487 (SEQ ID NO:1555), GI:125531919 (SEQ ID NO:1556), GI:147820457 (SEQ ID NO:1557), GI:225435151 (SEQ ID NO:1558), GI:110556116 (SEQ ID NO:1559), CeresAnnot:8723603

(SEQ ID NO:1561), CeresClone:1674549 (SEQ ID NO:1563), GI:125531926 (SEQ ID NO:1564), GI:212721998 (SEQ ID NO:1565), CeresClone:1962414 (SEQ ID NO:1567), GI:115482030 (SEQ ID NO:1568), CeresAnnot:8684516 (SEQ ID NO:1570), GI:115482028 (SEQ ID NO:1571), CeresClone:633976 (SEQ ID NO:1573), CeresAnnot:1488712 (SEQ ID NO:1575), GI:147819531 (SEQ ID NO:1576), or CeresAnnot:8458360 (SEQ ID NO:1578). In some cases, a functional homolog of SEQ ID NO: 1541 has an amino acid sequence with at least 45% sequence identity, e.g., 50%, 52%, 56%, 59%, 61%, 65%, 70%, 75%, 80%, 85%, 90%, 95%, 97%, 98%, or 99% sequence identity, to the amino acid sequence set forth in SEQ ID NO: 1541. In some cases, a functional homolog of SEQ ID NO: 1541 has an amino acid sequence with at least 45% sequence identity, e.g., 50%, 52%, 56%, 59%, 61%, 65%, 70%, 75%, 80%, 85%, 90%, 95%, 97%, 98%, or 99% sequence identity, to one or more functional homologs of SEQ ID NO: 1541 described above or set forth in the Sequence Listing.

Figure 7A:
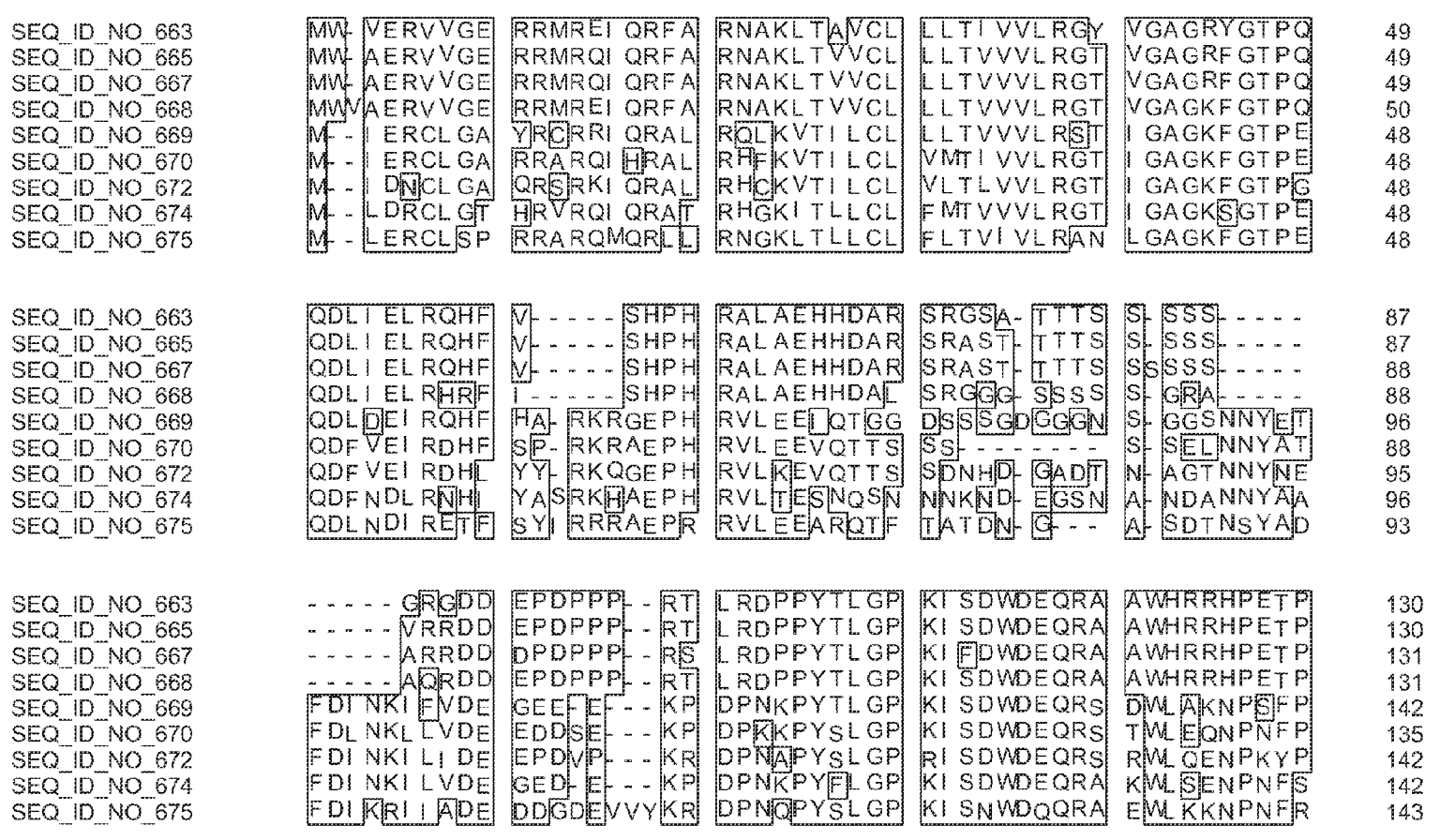

Examples of amino acid sequences of functional homologs of the polypeptide set forth in SEQ ID NO: 663 are provided in FIG. 7 and in the Sequence Listing. Such functional homologs include, for example, CeresAnnot: 8641619 (SEQ ID NO: 665), CeresClone:351171 (SEQ ID NO:667), GI:108707680 (SEQ ID NO:668), GI:18411962 (SEQ ID NO:669), GI:225437312 (SEQ ID NO:670), CeresClone:1928792 (SEQ ID NO:672), CeresAnnot:1481731 (SEQ ID NO:674), GI:190887122 (SEQ ID NO:675), CeresClone:1909588 (SEQ ID NO:677), CeresClone:287316 (SEQ ID NO:679), GI:125543514 (SEQ ID NO:680), GI:3892054 (SEQ ID NO:681), GI:147836354 (SEQ ID NO:682), CeresClone:1948406 (SEQ ID NO:684), GI:157350046 (SEQ ID NO:685), CeresClone:111543 (SEQ ID NO:687), CeresAnnot:1462791 (SEQ ID NO:689), GI:116786926 (SEQ ID NO:690), GI:55956972 (SEQ ID NO:691), GI:225457345 (SEQ ID NO:692), CeresClone: 1883805 (SEQ ID NO:694), GI:147855862 (SEQ ID NO:695), GI:55956986 (SEQ ID NO:696), GI:15221224 (SEQ ID NO:697), GI:55956984 (SEQ ID NO:698), CeresAnnot:881752 (SEQ ID NO:700), GI:55956988 (SEQ ID NO:701), GI:168048546 (SEQ ID NO:702), GI:84794310 (SEQ ID NO:703), GI:115446469 (SEQ ID NO:704), CeresAnnot:8679332 (SEQ ID NO:706), GI:162464392 (SEQ ID NO:707), CeresClone:1814558 (SEQ ID NO:709), GI:168049396 (SEQ ID NO:710), GI:186478616 (SEQ ID NO:711), GI:125535778 (SEQ ID NO:712), GI:168040071 (SEQ ID NO:713), GI:115487346 (SEQ ID NO:714), GI:168005537 (SEQ ID NO:715), GI:125543557 (SEQ ID NO:716), GI:115452571 (SEQ ID NO:717), GI:108707732 (SEQ ID NO:718), CeresAnnot:8715381 (SEQ ID NO:720), CeresAnnot:8658448 (SEQ ID NO:722), CeresAnnot: 8641531 (SEQ ID NO:724), CeresClone:793770 (SEQ ID NO:726), GI:168038797 (SEQ ID NO:727), GI:168034676 (SEQ ID NO:728), CeresAnnot:8641532 (SEQ ID NO:730), GI:168006484 (SEQ ID NO:731), CeresAnnot:8715380 (SEQ ID NO:733), SEQ ID NO:734, C0P7T0 MAIZE (SEQ ID NO:735), SEQ ID NO:736, A7NW49_VITVI (SEQ ID NO:737), Q5TIN5_VITVI (SEQ ID NO:738), or B9RT50_RICCO (SEQ ID NO:739). In some cases, a functional homolog of SEQ ID NO: 663 has an amino acid sequence with at least 45% sequence identity, e.g., 50%, 52%, 56%, 59%, 61%, 65%, 70%, 75%, 80%, 85%, 90%, 95%, 97%, 98%, or 99% sequence identity, to the amino acid sequence set forth in SEQ ID NO: 663. In some cases, a functional homolog of SEQ ID NO: 663 has an amino acid sequence with at least 45% sequence identity, e.g., 50%, 52%, 56%, 59%, 61%, 65%, 70%, 75%, 80%, 85%, 90%, 95%, 97%, 98%, or 99% sequence identity, to one or more functional homologs of SEQ ID NO: 663 described above or set forth in the Sequence Listing.

Figure 8A:
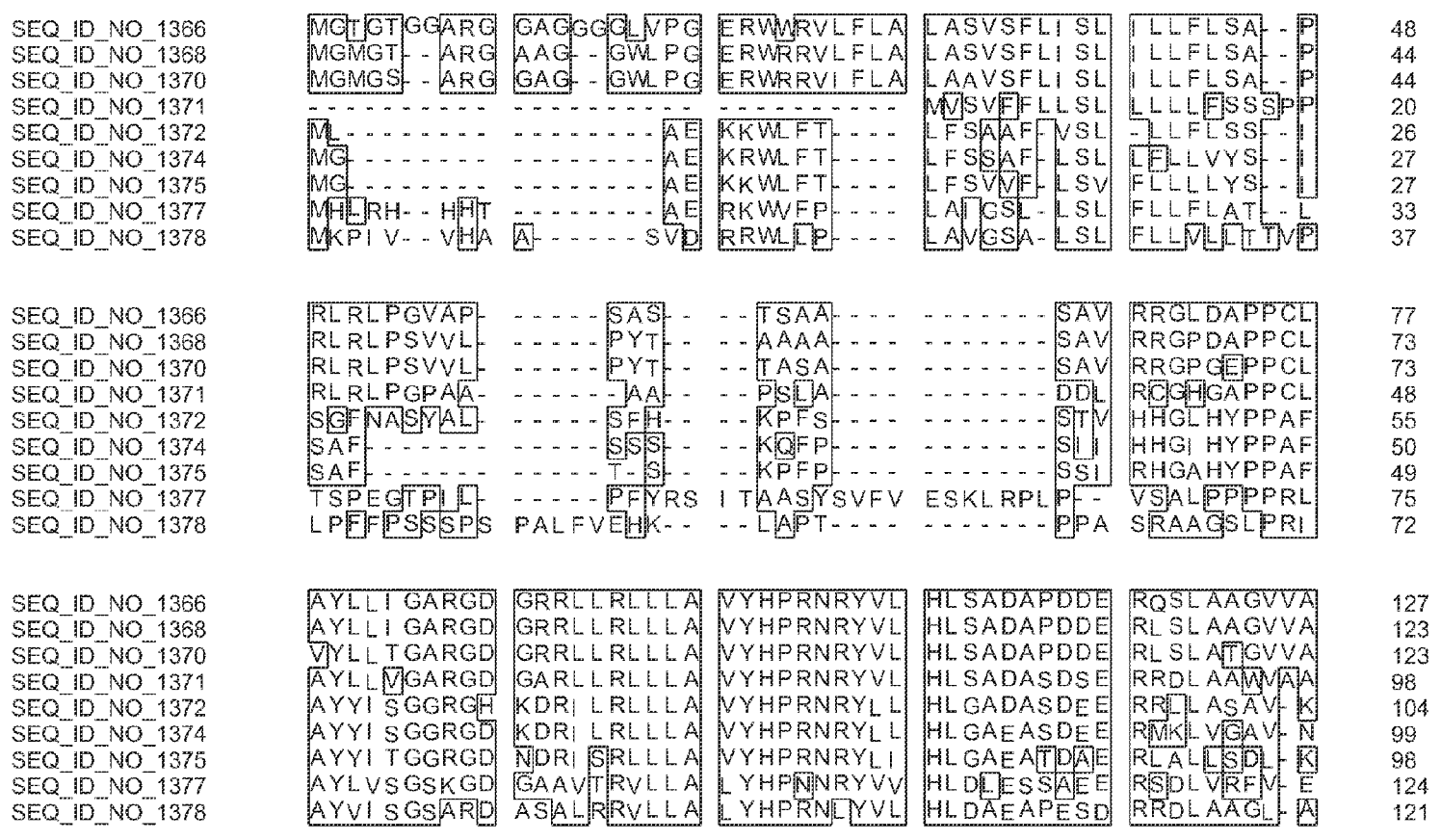
Figure 8B:
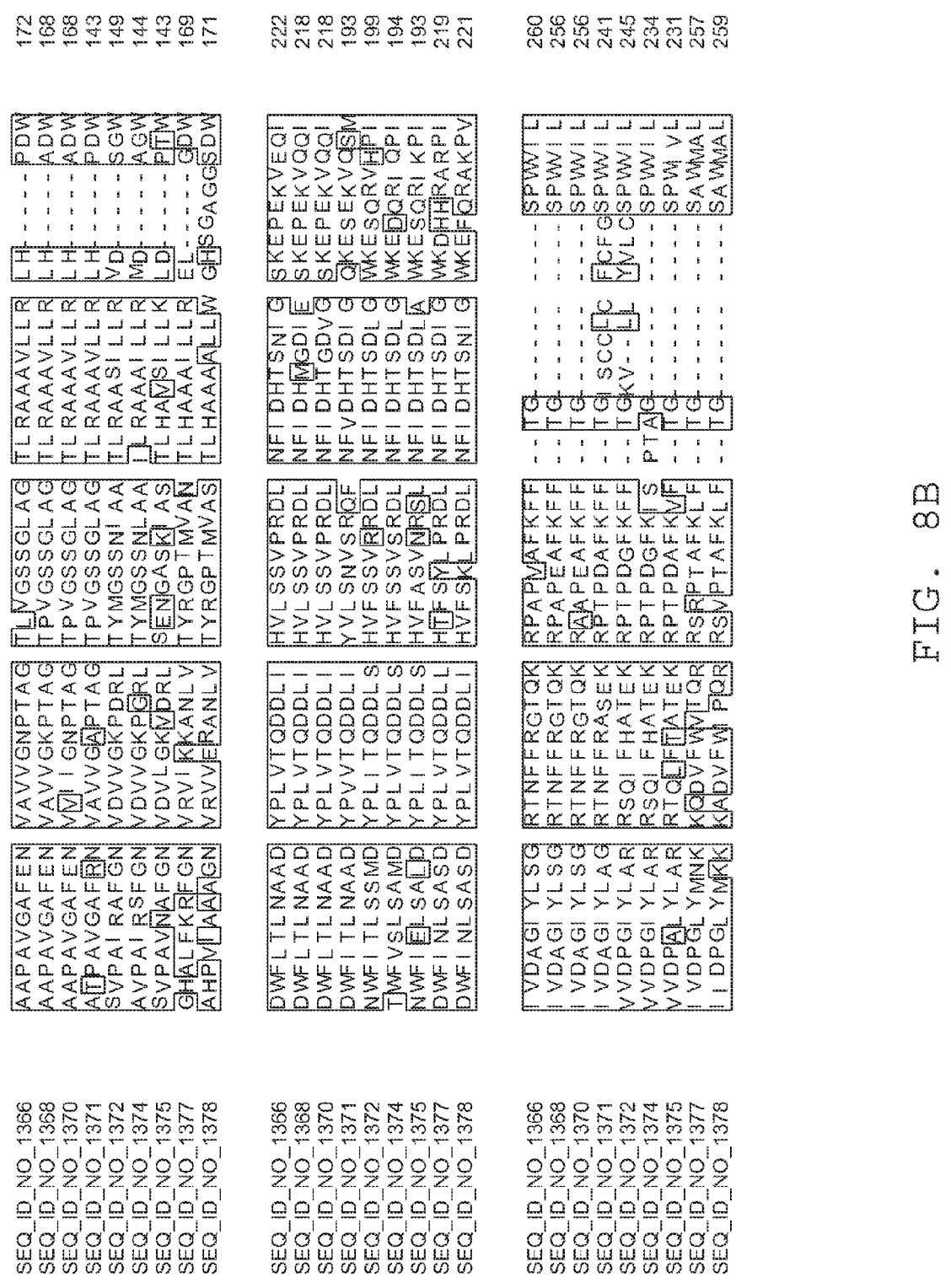

Examples of amino acid sequences of functional homologs of the polypeptide set forth in SEQ ID NO: 1366 are provided in FIG. 8 and in the Sequence Listing. Such functional homologs include, for example, CeresAnnot: 8724997 (SEQ ID NO: 1368), CeresClone:210401 (SEQ ID NO:1370), GI:52353585 (SEQ ID NO:1371), GI:157338893 (SEQ ID NO:1372), CeresAnnot:1517155 (SEQ ID NO:1374), GI:18409754 (SEQ ID NO:1375), CeresClone:479516 (SEQ ID NO:1377), GI:61656778 (SEQ ID NO:1378), GI:13486801 (SEQ ID NO:1379), CeresClone:494392 (SEQ ID NO:1381), CeresAnnot: 8659030 (SEQ ID NO:1383), GI:168060848 (SEQ ID NO:1384), CeresClone:794127 (SEQ ID NO:1386), CeresAnnot:8724191 (SEQ ID NO:1388), GI:15242532 (SEQ ID NO:1389), GI:225452656 (SEQ ID NO:1390), CeresClone:25053 (SEQ ID NO:1392), GI:115489808 (SEQ ID NO:1393), GI:46358506 (SEQ ID NO:1394), GI:55276719 (SEQ ID NO:1395), GI:61656789 (SEQ ID NO:1396), GI:61656799 (SEQ ID NO:1397), CeresClone:1857630 (SEQ ID NO:1399), GI:168052705 (SEQ ID NO:1400), CeresClone:105097 (SEQ ID NO:1402), GI:116786996 (SEQ ID NO:1403), CeresClone:532355 (SEQ ID NO:1405), CeresAnnot:1530144 (SEQ ID NO:1407), GI:225424849 (SEQ ID NO:1408), GI:147787134 (SEQ ID NO:1409), GI:116794047 (SEQ ID NO:1410), CeresClone: 1562166 (SEQ ID NO:1412), GI:168043094 (SEQ ID NO:1413), GI:116308950 (SEQ ID NO:1414), GI:116789207 (SEQ ID NO:1415), GI:115457614 (SEQ ID NO:1416), GI:60657606 (SEQ ID NO:1417), GI:125555973 (SEQ ID NO:1418), CeresClone:508189 (SEQ ID NO:1420), CeresAnnot:1502889 (SEQ ID NO:1422), CeresClone:1808311 (SEQ ID NO:1424), CeresClone:349234 (SEQ ID NO:1426), CeresAnnot:1457604 (SEQ ID NO:1428), CeresAnnot:8743317 (SEQ ID NO:1430), CeresAnnot:1523979 (SEQ ID NO:1432), GI:225433389 (SEQ ID NO:1433), GI:115454715 (SEQ ID NO:1434), GI:157344331 (SEQ ID NO:1435), GI:157342943 (SEQ ID NO:1436), CeresClone:1018703 (SEQ ID NO:1438), CeresAnnot:8643189 (SEQ ID NO:1440), CeresClone:1888533 (SEQ ID NO:1442), GI:118485429 (SEQ ID NO:1443), GI:102139993 (SEQ ID NO:1444), CeresAnnot:863010 (SEQ ID NO:1446), GI:115474761 (SEQ ID NO:1447), CeresAnnot:1438095 (SEQ ID NO:1449), GI:70663986 (SEQ ID NO:1450), CeresAnnot:8633314 (SEQ ID NO:1452), GI:15236287 (SEQ ID NO:1453), GI:108707468 (SEQ ID NO:1454), CeresClone:468692 (SEQ ID NO:1456), GI:225461471 (SEQ ID NO:1457), CeresAnnot:1462238 (SEQ ID NO:1459), GI:15229570 (SEQ ID NO:1460), CeresAnnot: 8641860 (SEQ ID NO:1462), GI:9454535 (SEQ ID NO:1463), CeresClone:1553206 (SEQ ID NO:1465), GI:42567183 (SEQ ID NO:1466), GI:60657604 (SEQ ID NO:1467), GI:157359338 (SEQ ID NO:1468), CeresAnnot: 1520081 (SEQ ID NO:1470), GI:18400725 (SEQ ID NO:1471), CeresAnnot:1523194 (SEQ ID NO:1473), CeresClone:1927095 (SEQ ID NO:1475), CeresClone: 1810164 (SEQ ID NO:1477), GI:115482162 (SEQ ID NO:1478), SEQ ID NO:1479, B8AY55_ORYSI (SEQ ID NO:1480), SEQ ID NO:1481, C7J2B6 ORYSJ (SEQ ID NO:1482), SEQ ID NO:1483, CeresAnnot:8704386 (SEQ ID NO:1485), or CeresAnnot:8657984 (SEQ ID NO:1487). In some cases, a functional homolog of SEQ ID NO: 1366 has an amino acid sequence with at least 45% sequence identity, e.g., 50%, 52%, 56%, 59%, 61%, 65%, 70%, 75%, 80%, 85%, 90%, 95%, 97%, 98%, or 99% sequence identity, to the amino acid sequence set forth in SEQ ID NO: 1366. In some cases, a functional homolog of SEQ ID NO: 1366 has an amino acid sequence with at least 45% sequence identity, e.g., 50%, 52%, 56%, 59%, 61%, 65%, 70%, 75%, 80%, 85%, 90%, 95%, 97%, 98%, or 99% sequence identity, to one or more functional homologs of SEQ ID NO: 1366 described above or set forth in the Sequence Listing.

Examples of amino acid sequences of functional homologs of the polypeptide set forth in SEQ ID NO: 928 are provided in FIG. 9 and in the Sequence Listing. Such functional homologs include, for example, CeresAnnot:8640603 (SEQ ID NO: 930), CeresClone:285169 (SEQ ID NO: 932), GI:125586664 (SEQ ID NO: 933), CeresClone:829440 (SEQ ID NO: 935), GI:118488472 (SEQ ID NO: 936), GI:90657534 (SEQ ID NO: 937), GI:225456557 (SEQ ID NO: 938), CeresAnnot:1355066 (SEQ ID NO: 940), GI:38194917 (SEQ ID NO: 941), CeresClone:1237946 (SEQ ID NO: 943), GI:157341292 (SEQ ID NO: 944), GI:115453531 (SEQ ID NO: 945), CeresClone:1804732 (SEQ ID NO: 947), CeresAnnot:8656625 (SEQ ID NO: 949), GI:162462515 (SEQ ID NO: 950), CeresClone:570485 (SEQ ID NO: 952), GI:75133694 (SEQ ID NO: 953), GI:115473243 (SEQ ID NO: 954), GI:125559102 (SEQ ID NO: 955), CeresAnnot:1450186 (SEQ ID NO: 957), GI:125552171 (SEQ ID NO: 958), GI:115463639 (SEQ ID NO: 959), GI:116790012 (SEQ ID NO: 960), GI:38194916 (SEQ ID NO: 961), CeresClone:1806851 (SEQ ID NO: 963), CeresClone:236876 (SEQ ID NO: 965), GI:162459408 (SEQ ID NO: 966), GI:125545759 (SEQ ID NO: 967), GI:225456559 (SEQ ID NO: 968), GI:225451792 (SEQ ID NO: 969), CeresClone:17250 (SEQ ID NO: 971), GI:147780878 (SEQ ID NO: 972), CeresAnnot:1363625 (SEQ ID NO: 974), GI:30090032 (SEQ ID NO: 975), CeresClone:1848658 (SEQ ID NO: 977), GI:224124236 (SEQ ID NO: 978), CeresClone:1546455 (SEQ ID NO: 980), CeresClone:1788775 (SEQ ID NO: 982), CeresAnnot:1450185 (SEQ ID NO: 984), CeresClone:1883580 (SEQ ID NO: 986), CeresAnnot:1809854 (SEQ ID NO: 988), CeresAnnot:8640602 (SEQ ID NO: 990), CeresAnnot:1326475 (SEQ ID NO: 992), CeresClone:98007 (SEQ ID NO: 994), CeresAnnot:1481980 (SEQ ID NO: 996), CeresAnnot:8702104 (SEQ ID NO: 998), CeresAnnot:1297618 (SEQ ID NO: 1000), ACA04978 (SEQ ID NO: 1001), SEQ ID NO: 1002, SEQ ID NO: 1003, XP_002514628 (SEQ ID NO: 1004), XP_002330107 (SEQ ID NO: 1005), SEQ ID NO: 1006, XP_002277911 (SEQ ID NO: 1007), B6E8Y8_9MYRT (SEQ ID NO: 1008), XP_002265282 (SEQ ID NO: 1009), C6T7C7 SOYBN (SEQ ID NO: 1010), SEQ ID NO: 1011, C6T8T2 SOYBN (SEQ ID NO: 1012), XP_002330106 (SEQ ID NO: 1013), or SEQ ID NO: 1014. In some cases, a functional homolog of SEQ ID NO: 928 has an amino acid sequence with at least 45% sequence identity, e.g., 50%, 52%, 56%, 59%, 61%, 65%, 70%, 75%, 80%, 85%, 90%, 95%, 97%, 98%, or 99% sequence identity, to the amino acid sequence set forth in SEQ ID NO: 928. In some cases, a functional homolog of SEQ ID NO: 928 has an amino acid sequence with at least 45% sequence identity, e.g., 50%, 52%, 56%, 59%, 61%, 65%, 70%, 75%, 80%, 85%, 90%, 95%, 97%, 98%, or 99% sequence identity, to one or more functional homologs of SEQ ID NO: 928 described above or set forth in the Sequence Listing.

Examples of amino acid sequences of functional homologs of the polypeptide set forth in SEQ ID NO: 1215 are provided in FIG. 10 and in the Sequence Listing. Such functional homologs include, for example, CeresAnnot:8679388 (SEQ ID NO: 1217), GI:162460472 (SEQ ID NO:1218), GI:82470028 (SEQ ID NO:1219), GI:158513202 (SEQ ID NO:1220), GI:71153895 (SEQ ID NO:1221), CeresClone:696222 (SEQ ID NO:1223), GI:26986190 (SEQ ID NO:1224), GI:27802647 (SEQ ID NO:1225), GI:18324 (SEQ ID NO:1226), GI:166079160 (SEQ ID NO:1227), GI:157346189 (SEQ ID NO:1228), CeresAnnot:1100195 (SEQ ID NO:1230), GI:551259 (SEQ ID NO:1231), CeresClone:1148635 (SEQ ID NO:1233), GI:115446509 (SEQ ID NO:1234), GI:20196210 (SEQ ID NO:1235), GI:125539762 (SEQ ID NO:1236), GI:82470026 (SEQ ID NO:1237), GI:158563895 (SEQ ID NO:1238), GI:115458296 (SEQ ID NO:1239), GI:33694260 (SEQ ID NO:1240), GI:38346326 (SEQ ID NO:1241), CeresAnnot:8752603 (SEQ ID NO:1243), CeresClone:483472 (SEQ ID NO:1245), CeresAnnot:8752602 (SEQ ID NO:1247), CeresAnnot:8752608 (SEQ ID NO:1249), GI:115458294 (SEQ ID NO:1250), GI:33694264 (SEQ ID NO:1251), GI:38346325 (SEQ ID NO:1252), CeresAnnot:8632838 (SEQ ID NO:1254), GI:162461901 (SEQ ID NO:1255), CeresAnnot:8752594 (SEQ ID NO:1257), GI:3342240 (SEQ ID NO:1258), GI:166079162 (SEQ ID NO:1259), CeresAnnot:1475229 (SEQ ID NO:1261), CeresAnnot:1528678 (SEQ ID NO:1263), GI:2500928 (SEQ ID NO:1264), CeresAnnot:1139380 (SEQ ID NO:1266), GI:2500929 (SEQ ID NO:1267), GI:719270 (SEQ ID NO:1268), GI:16225878 (SEQ ID NO:1269), GI:7162116 (SEQ ID NO:1270), GI:861155 (SEQ ID NO:1271), GI:87240831 (SEQ ID NO:1272), CeresAnnot:1475230 (SEQ ID NO:1274), GI:4886267 (SEQ ID NO:1275), GI:7414364 (SEQ ID NO:1276), CeresAnnot:861091 (SEQ ID NO:1278), CeresClone:118038 (SEQ ID NO:1280), CeresAnnot:8462885 (SEQ ID NO:1282), GI:79314823 (SEQ ID NO:1283), GI:33636090 (SEQ ID NO:1284), GI:3152880 (SEQ ID NO:1285), GI:4205115 (SEQ ID NO:1286), CeresClone:1789943 (SEQ ID NO:1288), GI:21322514 (SEQ ID NO:1289), CeresAnnot:867594 (SEQ ID NO:1291), GI:2500930 (SEQ ID NO:1292), GI:2597853 (SEQ ID NO:1293), GI:53127612 (SEQ ID NO:1294), GI:70780260 (SEQ ID NO:1295), GI:112383512 (SEQ ID NO:1296), GI:38141533 (SEQ ID NO:1297), GI:18072861 (SEQ ID NO:1298), GI:160625677 (SEQ ID NO:1299), GI:13940209 (SEQ ID NO:1300), GI:160625675 (SEQ ID NO:1301), GI:4127662 (SEQ ID NO:1302), GI:13940211 (SEQ ID NO:1303), GI:162793818 (SEQ ID NO:1304), SEQ ID NO:1305, SEQ ID NO:1306, SEQ ID NO:1307, SEQ ID NO:1308, B7ZZM5_MAIZE (SEQ ID NO:1309), SEQ ID NO:1310, SEQ ID NO:1311, SEQ ID NO:1312, SEQ ID NO:1313, -SEQ ID NO:1314, SEQ ID NO:1315, SEQ ID NO:1316, SEQ ID NO:1317, SEQ ID NO:1318, SEQ ID NO:1319, AAF06991 (SEQ ID NO:1320), SEQ ID NO:1321, SEQ ID NO:1322, SEQ ID NO:1323, AAF06992 (SEQ ID NO:1324), AAD02510 (SEQ ID NO:1325), B6U1H5_MAIZE (SEQ ID NO:1326), CAH67363 (SEQ ID NO:1327), SEQ ID NO:1328, SEQ ID NO:1329, C6JS51_SORBI (SEQ ID NO:1330), or SEQ ID NO:1331. In some cases, a functional homolog of SEQ ID NO: 1215 has an amino acid sequence with at least 45% sequence identity, e.g., 50%, 52%, 56%, 59%, 61%, 65%, 70%, 75%, 80%, 85%, 90%, 95%, 97%, 98%, or 99% sequence identity, to the amino acid sequence set forth in SEQ ID NO: 1215. In some cases, a functional homolog of SEQ ID NO: 1215 has an amino acid sequence with at least 45% sequence identity, e.g., 50%, 52%, 56%, 59%, 61%, 65%, 70%, 75%, 80%, 85%, 90%, 95%, 97%, 98%, or 99% sequence identity, to one or more functional homologs of SEQ ID NO: 1215 described above or set forth in the Sequence Listing.

Examples of amino acid sequences of functional homologs of the polypeptide set forth in SEQ ID NO: 4 are provided in FIG. 11 and in the Sequence Listing. Such functional homologs include, for example, CeresAnnot: 8682811 (SEQ ID NO: 6), GI:115483997 (SEQ ID NO: 7), GI:119507455 (SEQ ID NO: 8), GI:33151175 (SEQ ID NO: 9), CeresAnnot:1506572 (SEQ ID NO: 11), CeresClone: 549408 (SEQ ID NO: 13), GI:157313302 (SEQ ID NO: 14), GI:157072586 (SEQ ID NO: 15), CeresClone:1786359 (SEQ ID NO: 17), GI:13398412 (SEQ ID NO: 18), Ceres-Clone:1789981 (SEQ ID NO: 20), GI:116310992 (SEQ ID NO: 21), GI:38347003 (SEQ ID NO: 22), GI:115484005 (SEQ ID NO: 23), GI:37777015 (SEQ ID NO: 24), GI:116739148 (SEQ ID NO: 25), GI:157072584 (SEQ ID NO: 26), GI:37777013 (SEQ ID NO: 27), CeresAnnot: 556941 (SEQ ID NO: 29), CeresAnnot:1453426 (SEQ ID NO: 31), GI:225440254 (SEQ ID NO: 32), GI:22327075 (SEQ ID NO: 33), CeresAnnot:1528070 (SEQ ID NO: 35), GI:22324432 (SEQ ID NO: 36), CeresAnnot:8657414 (SEQ ID NO: 38), GI:108707861 (SEQ ID NO: 39), GI:50507838 (SEQ ID NO: 40), GI:168060089 (SEQ ID NO: 41), ACN33779 (SEQ ID NO: 42), SEQ ID NO: 43, ACN34313 (SEQ ID NO: 44), SEQ ID NO: 45, NP_001066062 (SEQ ID NO: 46), SEQ ID NO: 47, SEQ ID NO: 48, B9SCF3_RICCO (SEQ ID NO: 49), C9EA44_CARPA (SEQ ID NO: 50), or B9IHH9_POPTR (SEQ ID NO: 51). In some cases, a functional homolog of SEQ ID NO: 4 has an amino acid sequence with at least 45% sequence identity, e.g., 50%, 52%, 56%, 59%, 61%, 65%, 70%, 75%, 80%, 85%, 90%, 95%, 97%, 98%, or 99% sequence identity, to the amino acid sequence set forth in SEQ ID NO: 4. In some cases, a functional homolog of SEQ ID NO: 4 has an amino acid sequence with at least 45% sequence identity, e.g., 50%, 52%, 56%, 59%, 61%, 65%, 70%, 75%, 80%, 85%, 90%, 95%, 97%, 98%, or 99% sequence identity, to one or more functional homologs of SEQ ID NO: 4 described above or set forth in the Sequence Listing.

Examples of amino acid sequences of functional homologs of the polypeptide set forth in SEQ ID NO: 580 are provided in FIG. 12 and in the Sequence Listing. Such functional homologs include, for example, CeresClone: 100919106 (SEQ ID NO: 582), CeresAnnot:8656883 (SEQ ID NO:584), GI:115473539 (SEQ ID NO:585), CeresClone: 632946 (SEQ ID NO:587), CeresAnnot:1511794 (SEQ ID NO:589), CeresClone:661231 (SEQ ID NO:591), GI:225452883 (SEQ ID NO:592), CeresAnnot:865775 (SEQ ID NO:594), GI:116781949 (SEQ ID NO:595), GI:124360246 (SEQ ID NO:596), CeresClone:241236 (SEQ ID NO:598), CeresClone:100923096 (SEQ ID NO:600), GI:125601197 (SEQ ID NO:601), CeresAnnot: 8640957 (SEQ ID NO:603), GI:115453237 (SEQ ID NO:604), CeresClone:373329 (SEQ ID NO:606), GI:118489897 (SEQ ID NO:607), GI:224112183 (SEQ ID NO:608), CeresClone:117183 (SEQ ID NO:610), GI:147853846 (SEQ ID NO:611), CeresClone:646035 (SEQ ID NO:613), CeresAnnot:1476847 (SEQ ID NO:615), CeresAnnot:864422 (SEQ ID NO:617), CeresAnnot: 1517733 (SEQ ID NO:619), CeresClone:125621 (SEQ ID NO:621), CeresAnnot:868892 (SEQ ID NO:623), Ceres-Clone:1363654 (SEQ ID NO:625), GI:168026300 (SEQ ID NO:626), CeresAnnot:873900 (SEQ ID NO:628), GI:168059834 (SEQ ID NO:629), SEQ ID NO:630, SEQ ID NO:631, or SEQ ID NO:632. In some cases, a functional homolog of SEQ ID NO: 580 has an amino acid sequence with at least 45% sequence identity, e.g., 50%, 52%, 56%, 59%, 61%, 65%, 70%, 75%, 80%, 85%, 90%, 95%, 97%, 98%, or 99% sequence identity, to the amino acid sequence set forth in SEQ ID NO: 580. In some cases, a functional homolog of SEQ ID NO: 580 has an amino acid sequence with at least 45% sequence identity, e.g., 50%, 52%, 56%, 59%, 61%, 65%, 70%, 75%, 80%, 85%, 90%, 95%, 97%, 98%, or 99% sequence identity, to one or more functional homologs of SEQ ID NO: 580 described above or set forth in the Sequence Listing.

Figure 13B:
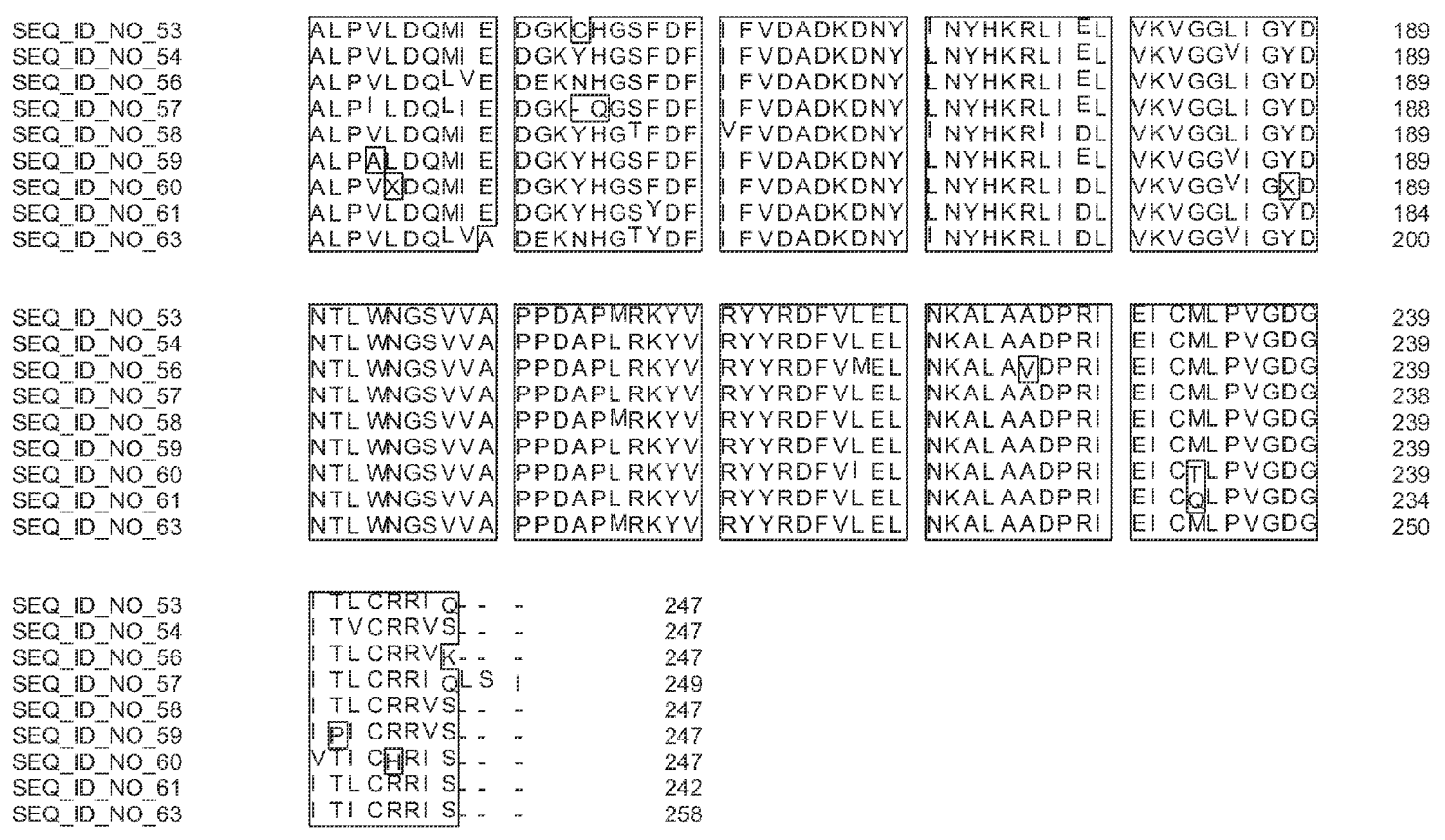

Examples of amino acid sequences of functional homologs of the polypeptide set forth in SEQ ID NO: 53 are provided in FIG. 13 and in the Sequence Listing. Such functional homologs include, for example, GI:47680455 (SEQ ID NO:54), CeresClone:1843515 (SEQ ID NO: 56), GI:3023419 (SEQ ID NO: 57), GI:82941443 (SEQ ID NO: 58), GI:55724835 (SEQ ID NO: 59), GI:167613943 (SEQ ID NO: 60), GI:30580349 (SEQ ID NO: 61), CeresClone: 1365873 (SEQ ID NO: 63), GI:3023436 (SEQ ID NO: 64), GI:190710715 (SEQ ID NO: 65), GI:13249171 (SEQ ID NO: 66), GI:119655556 (SEQ ID NO: 67), CeresAnnot: 1441117 (SEQ ID NO: 69), GI:3023437 (SEQ ID NO: 70), CeresClone:100036370 (SEQ ID NO: 72), GI:225428851 (SEQ ID NO: 73), GI:91771911 (SEQ ID NO: 74), GI:74053616 (SEQ ID NO: 75), GI:105671415 (SEQ ID NO: 76), CeresClone:8049 (SEQ ID NO: 78), CeresClone: 541352 (SEQ ID NO: 80), GI:40795556 (SEQ ID NO: 81), GI:30580341 (SEQ ID NO: 82), GI:193290676 (SEQ ID NO: 83), CeresAnnot:8454550 (SEQ ID NO: 85), GI:21595512 (SEQ ID NO: 86), CeresAnnot:8454548 (SEQ ID NO: 88), GI:30580343 (SEQ ID NO: 89), GI:30580381 (SEQ ID NO: 90), GI:30580324 (SEQ ID NO: 91), Ceres-Clone:1605906 (SEQ ID NO: 93), GI:30580325 (SEQ ID NO: 94), GI:115559 (SEQ ID NO: 95), GI:68271859 (SEQ ID NO: 96), GI:48093469 (SEQ ID NO: 97), CeresAnnot: 8454545 (SEQ ID NO: 99), GI:157863689 (SEQ ID NO: 100), GI:30580342 (SEQ ID NO: 101), GI:116780030 (SEQ ID NO: 102), GI:115466622 (SEQ ID NO: 103), CeresAnnot:8735228 (SEQ ID NO: 105), CeresClone:1281422 (SEQ ID NO: 107), CeresClone:239406 (SEQ ID NO: 109), GI:30580380 (SEQ ID NO: 110), CeresClone:100834883 (SEQ ID NO: 112), GI:32347427 (SEQ ID NO: 113), CeresClone:558470 (SEQ ID NO: 115), CeresClone:320643 (SEQ ID NO: 117), CeresClone:786185 (SEQ ID NO: 119), ABK94003 (SEQ ID NO: 120), SEQ ID NO: 121, SEQ ID NO: 122, SEQ ID NO: 123, SEQ ID NO: 124, ACJ38669 (SEQ ID NO: 125), SEQ ID NO: 126, CAN72492 (SEQ ID NO: 127), XP_002282867 (SEQ ID NO: 128), SEQ ID NO: 129, XP_002518739 (SEQ ID NO: 130), ACJ84500 (SEQ ID NO: 131), BAG71894 (SEQ ID NO: 132), SEQ ID NO: 133, ACY66929 (SEQ ID NO: 134), B5LZY1_LINUS (SEQ ID NO: 135), ACX37696 (SEQ ID NO: 136), BAG71889 (SEQ ID NO: 137), A9QWL5_9FABA (SEQ ID NO: 138), B6F0U5 CARTI (SEQ ID NO: 139), ABB89956 (SEQ ID NO: 140), BAG71891 (SEQ ID NO: 141), BAG71893 (SEQ ID NO: 142), A0S6W2_9CONI (SEQ ID NO: 143), BAG71892 (SEQ ID NO: 144), ABO26812 (SEQ ID NO: 145), ACY66930 (SEQ ID NO: 146), ACX37697 (SEQ ID NO: 147), SEQ ID NO: 148, A2Y9Q8_ORYSI (SEQ ID NO: 149), SEQ ID NO: 150, SEQ ID NO: 151, or SEQ ID NO: 152. In some cases, a functional homolog of SEQ ID NO: 53 has an amino acid sequence with at least 45% sequence identity, e.g., 50%, 52%, 56%, 59%, 61%, 65%, 70%, 75%, 80%, 85%, 90%, 95%, 97%, 98%, or 99% sequence identity, to the amino acid sequence set forth in SEQ ID NO: 53. In some cases, a functional homolog of SEQ ID NO: 53 has an amino acid sequence with at least 45% sequence identity, e.g., 50%, 52%, 56%, 59%, 61%, 65%, 70%, 75%, 80%, 85%, 90%, 95%, 97%, 98%, or 99% sequence identity, to one or more functional homologs of SEQ ID NO: 53 described above or set forth in the Sequence Listing.

Examples of amino acid sequences of functional homologs of the polypeptide set forth in SEQ ID NO: 1112 are provided in FIG. 14 and in the Sequence Listing. Such functional homologs include, for example, CeresAnnot: 8721881 (SEQ ID NO: 1114), GI:115488672 (SEQ ID NO:1115), GI:62132631 (SEQ ID NO:1116), CeresClone: 1820645 (SEQ ID NO:1118), CeresClone:522963 (SEQ ID NO:1120), GI:11120557 (SEQ ID NO:1121), GI:33309870 (SEQ ID NO:1122), GI:154551049 (SEQ ID NO:1123), CeresAnnot:8656632 (SEQ ID NO:1125), CeresClone: 246416 (SEQ ID NO:1127), GI:115473253 (SEQ ID NO:1128), GI:115455399 (SEQ ID NO:1129), GI:6175371 (SEQ ID NO:1130), GI:158517760 (SEQ ID NO:1131), CeresClone:1815457 (SEQ ID NO:1133), GI:7592642 (SEQ ID NO:1134), CeresClone:100955082 (SEQ ID NO:1136), GI:6606070 (SEQ ID NO:1137), CeresClone: 1908817 (SEQ ID NO:1139), GI:33309864 (SEQ ID NO:1140), GI:158954871 (SEQ ID NO:1141), GI:30090030 (SEQ ID NO:1142), GI:58422998 (SEQ ID NO:1143), GI:224118942 (SEQ ID NO:1144), GI:58422996 (SEQ ID NO:1145), CeresClone:1757409 (SEQ ID NO:1147), GI:30721847 (SEQ ID NO:1148), GI:39843110 (SEQ ID NO:1149), GI:58866601 (SEQ ID NO:1150), GI:95981882 (SEQ ID NO:1151), GI:31712055 (SEQ ID NO:1152), GI:110164923 (SEQ ID NO:1153), GI:3688589 (SEQ ID NO:1154), GI:4204232 (SEQ ID NO:1155), GI:194500619 (SEQ ID NO:1156), CeresClone:1793949 (SEQ ID NO:1158), GI:28630953 (SEQ ID NO:1159), GI:162458731 (SEQ ID NO:1160), GI:39843112 (SEQ ID NO:1161), CeresClone:257029 (SEQ ID NO:1163), CeresClone: 100883955 (SEQ ID NO:1165), GI:9367313 (SEQ ID NO:1166), GI:95981890 (SEQ ID NO:1167), GI:148540534 (SEQ ID NO:1168), GI:78127315 (SEQ ID NO:1169), GI:3947985 (SEQ ID NO:1170), GI:28630955 (SEQ ID NO:1171), GI:4204234 (SEQ ID NO:1172), GI:157674589 (SEQ ID NO:1173), GI:63094571 (SEQ ID NO:1174), GI:33342030 (SEQ ID NO:1175), GI:225423412 (SEQ ID NO:1176), GI:110164939 (SEQ ID NO:1177), GI:78127313 (SEQ ID NO:1178), CeresAnnot:8643934 (SEQ ID NO:1180), GI:196166890 (SEQ ID NO:1181), GI:9367309 (SEQ ID NO:1182), GI:6467974 (SEQ ID NO:1183), GI:89152252 (SEQ ID NO:1184), GI:22091473 (SEQ ID NO:1185), GI:6634708 (SEQ ID NO:1186), GI:1483232 (SEQ ID NO:1187), GI:33391153 (SEQ ID NO:1188), CeresClone:467075 (SEQ ID NO:1190), GI:5070142 (SEQ ID NO:1191), CeresClone:480529 (SEQ ID NO:1193), GI:27373049 (SEQ ID NO:1194), GI:197244651 (SEQ ID NO:1195), GI:60100338 (SEQ ID NO:1196), GI:14518447 (SEQ ID NO:1197), GI:16052 (SEQ ID NO:1198), GI:4102111 (SEQ ID NO:1199), GI:3913001 (SEQ ID NO:1200), GI:82734203 (SEQ ID NO:1201), GI:106636058 (SEQ ID NO:1202), CeresAnnot:857111 (SEQ ID NO:1204), GI:16549085 (SEQ ID NO:1205), GI:602908 (SEQ ID NO:1206), GI:6606306 (SEQ ID NO:1207), CeresClone:25591 (SEQ ID NO:1209), GI:73537279 (SEQ ID NO:1210), SEQ ID NO:1211, SEQ ID NO:1212, or ACN33552 (SEQ ID NO:1213). In some cases, a functional homolog of SEQ ID NO: 1112 has an amino acid sequence with at least 45% sequence identity, e.g., 50%, 52%, 56%, 59%, 61%, 65%, 70%, 75%, 80%, 85%, 90%, 95%, 97%, 98%, or 99% sequence identity, to the amino acid sequence set forth in SEQ ID NO: 1112. In some cases, a functional homolog of SEQ ID NO: 1112 has an amino acid sequence with at least 45% sequence identity, e.g., 50%, 52%, 56%, 59%, 61%, 65%, 70%, 75%, 80%, 85%, 90%, 95%, 97%, 98%, or 99% sequence identity, to one or more functional homologs of SEQ ID NO: 1112 described above or set forth in the Sequence Listing.

Figure 15:
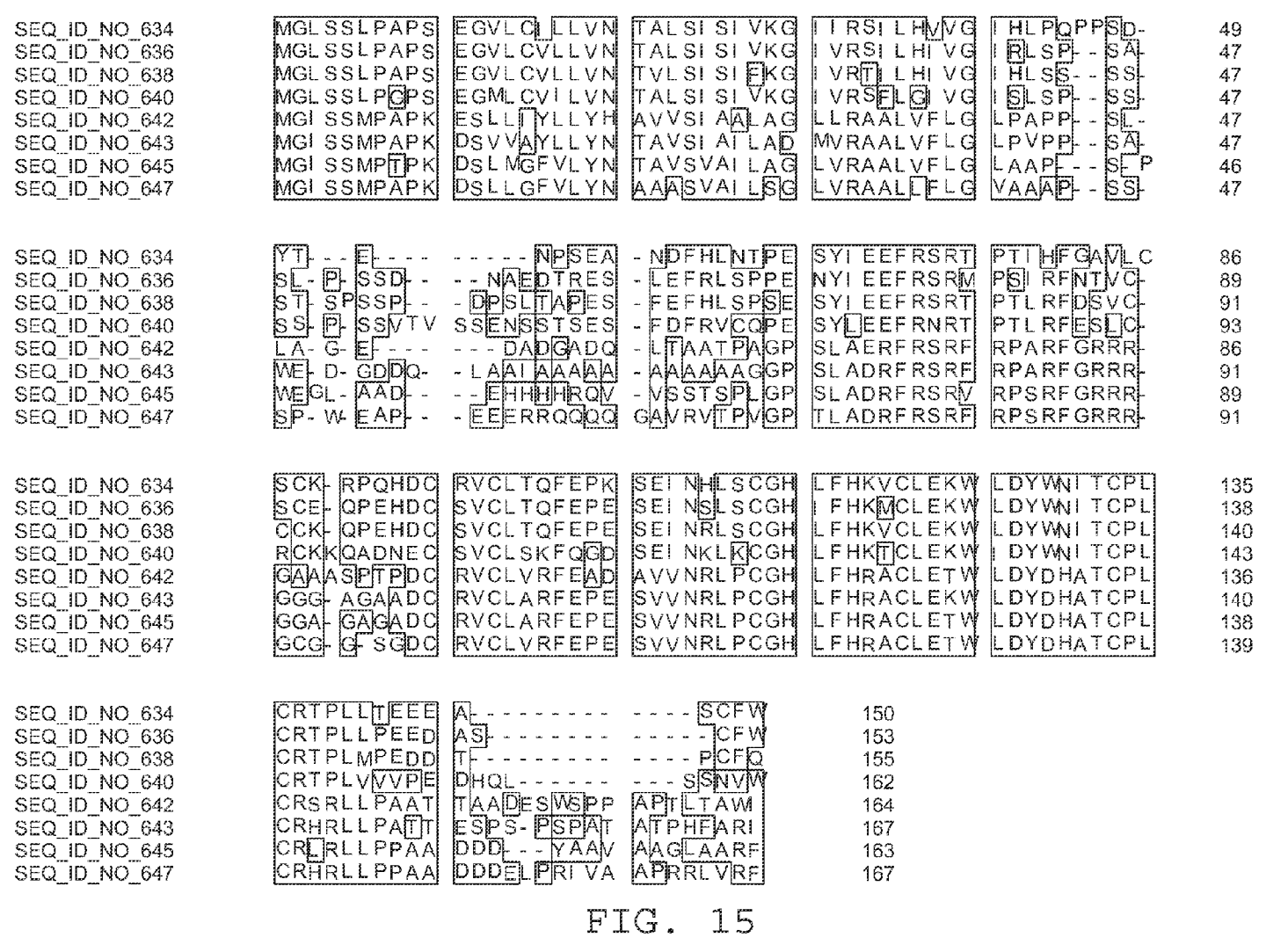

Examples of amino acid sequences of functional homologs of the polypeptide set forth in SEQ ID NO: 634 are provided in FIG. 15 and in the Sequence Listing. Such functional homologs include, for example, CeresAnnot: 1525600 (SEQ ID NO: 636), CeresClone:473509 (SEQ ID NO: 638), CeresAnnot:550729 (SEQ ID NO: 640), CeresClone:633470 (SEQ ID NO: 642), GI:115477050 (SEQ ID NO: 643), CeresClone:1790901 (SEQ ID NO: 645), CeresAnnot:8714668 (SEQ ID NO: 647), CeresClone:1808334 (SEQ ID NO: 649), CeresAnnot:1472192 (SEQ ID NO: 651), CeresClone:1662527 (SEQ ID NO: 653), CeresClone: 952050 (SEQ ID NO: 655), CeresClone:1460088 (SEQ ID NO: 657), CeresClone:1816723 (SEQ ID NO: 659), or CeresClone:374439 (SEQ ID NO: 661). In some cases, a functional homolog of SEQ ID NO: 634 has an amino acid sequence with at least 45% sequence identity, e.g., 50%, 52%, 56%, 59%, 61%, 65%, 70%, 75%, 80%, 85%, 90%, 95%, 97%, 98%, or 99% sequence identity, to the amino acid sequence set forth in SEQ ID NO: 634. In some cases, a functional homolog of SEQ ID NO: 634 has an amino acid sequence with at least 45% sequence identity, e.g., 50%, 52%, 56%, 59%, 61%, 65%, 70%, 75%, 80%, 85%, 90%, 95%, 97%, 98%, or 99% sequence identity, to one or more functional homologs of SEQ ID NO: 634 described above or set forth in the Sequence Listing.

Figure 16C:
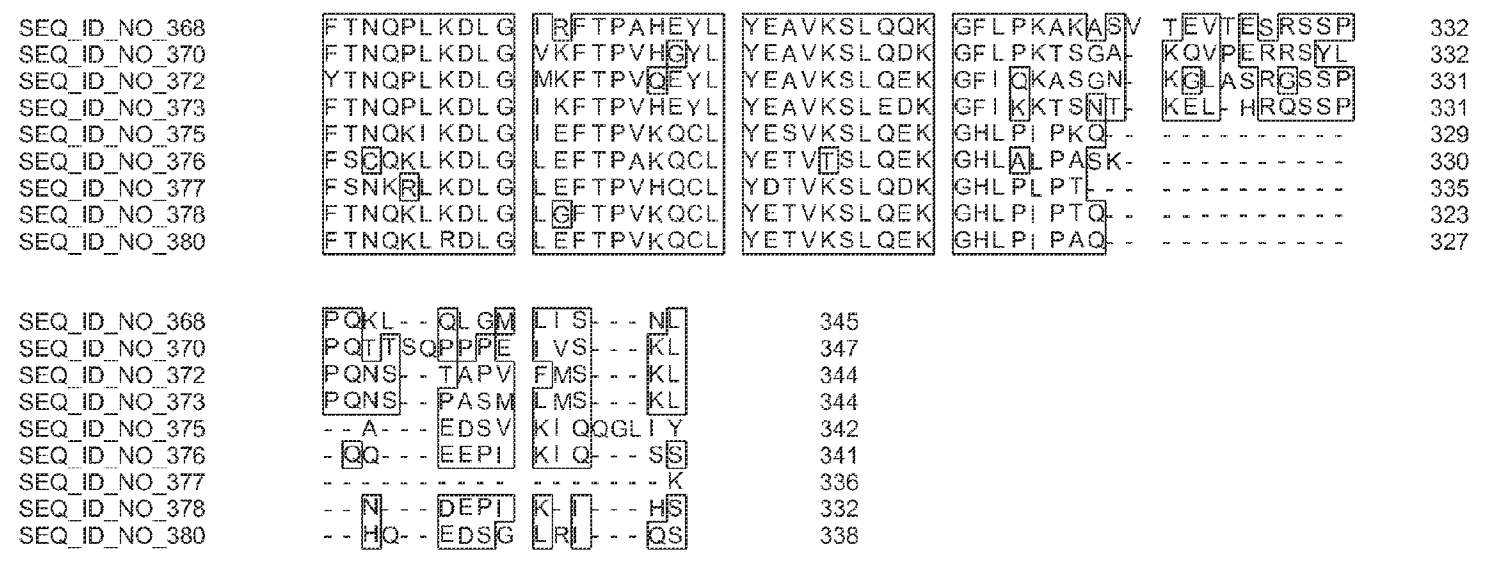

Examples of amino acid sequences of functional homologs of the polypeptide set forth in SEQ ID NO: 368 are provided in FIG. 16 and in the Sequence Listing. Such functional homologs include, for example, CeresClone: 1583304 (SEQ ID NO: 370), CeresClone:703342 (SEQ ID NO: 372), GI:115444625 (SEQ ID NO: 373), CeresAnnot: 1490808 (SEQ ID NO: 375), GI:57282092 (SEQ ID NO: 376), GI:115501961 (SEQ ID NO: 377), GI:25140434 (SEQ ID NO: 378), CeresClone:1895447 (SEQ ID NO: 380), CeresClone:2023103 (SEQ ID NO: 382), GI:28544965 (SEQ ID NO: 383), GI:59805044 (SEQ ID NO: 384), GI:28544959 (SEQ ID NO: 385), GI:125562805 (SEQ ID NO: 386), GI:115478030 (SEQ ID NO: 387), CeresClone: 1821848 (SEQ ID NO: 389), CeresAnnot:1483675 (SEQ ID NO: 391), CeresAnnot:1483663 (SEQ ID NO: 393), CeresAnnot:1448084 (SEQ ID NO: 395), GI:190710713 (SEQ ID NO: 396), CeresClone:1602920 (SEQ ID NO: 398), GI:40233135 (SEQ ID NO: 399), GI:2960364 (SEQ ID NO: 400), GI:25140432 (SEQ ID NO: 401), GI:65306614 (SEQ ID NO: 402), GI:9964087 (SEQ ID NO: 403), GI:2058311 (SEQ ID NO: 404), CeresClone:1243741 (SEQ ID NO: 406), GI:50345916 (SEQ ID NO: 407), GI:170285663 (SEQ ID NO: 408), GI:7239228 (SEQ ID NO: 409), GI:225465530 (SEQ ID NO: 410), GI:25989515 (SEQ ID NO: 411), GI:90902167 (SEQ ID NO: 412), GI:3341511 (SEQ ID NO: 413), GI:50345922 (SEQ ID NO: 414), CeresClone:475958 (SEQ ID NO: 416), CeresAnnot: 1437997 (SEQ ID NO: 418), CeresClone:1724312 (SEQ ID NO: 420), GI:10304406 (SEQ ID NO: 421), CeresClone: 1993306 (SEQ ID NO: 423), CeresAnnot:1255335 (SEQ ID NO: 425), CeresClone:1819180 (SEQ ID NO: 427), CeresClone:238838 (SEQ ID NO: 429), CeresClone:1039956 (SEQ ID NO: 431), CeresClone:705402 (SEQ ID NO: 433), CeresClone:1115220 (SEQ ID NO: 435), CeresAnnot: 8713261 (SEQ ID NO: 437), CeresClone:100960981 (SEQ ID NO: 439), CeresClone:1823576 (SEQ ID NO: 441), CeresClone:34141 (SEQ ID NO: 443), CeresClone:32255

(SEQ ID NO: 445), CeresClone:785059 (SEQ ID NO: 447), CeresClone:763048 (SEQ ID NO: 449), CeresAnnot: 8735461 (SEQ ID NO: 451), CeresAnnot:1483659 (SEQ ID NO: 453), CeresAnnot:8682158 (SEQ ID NO: 455), CeresClone:1996254 (SEQ ID NO: 457), CeresAnnot:8682157 (SEQ ID NO: 459), CeresAnnot:1224770 (SEQ ID NO: 461), CeresClone:100877847 (SEQ ID NO: 463), CeresClone:2023344 CeresAnnot:8659462 (SEQ ID NO: 465), CeresAnnot:8659462 (SEQ ID NO: 467), CeresClone: 1804701 (SEQ ID NO: 469), CeresClone:100056656 (SEQ ID NO: 471), CeresClone:1823484 (SEQ ID NO: 473), CeresAnnot:8659864 (SEQ ID NO: 475), CeresClone: 1780698 (SEQ ID NO: 477), CeresClone:218097 (SEQ ID NO: 479), CeresClone:6748 (SEQ ID NO: 481), CeresClone:703077 (SEQ ID NO: 483), CeresAnnot:1514866 (SEQ ID NO: 485), CeresClone:297597 (SEQ ID NO: 487), CeresAnnot:8673965 (SEQ ID NO: 489), CeresClone: 626124 (SEQ ID NO: 491), CeresClone:1724968 (SEQ ID NO: 493), CeresAnnot:8743556 (SEQ ID NO: 495), CeresClone:1850477 (SEQ ID NO: 497), ACZ74586 (SEQ ID NO: 498), ACZ74585 (SEQ ID NO: 499), ACZ74587 (SEQ ID NO: 500), C5XWV7 SORBI (SEQ ID NO: 501), or ACG45043 (SEQ ID NO: 502). In some cases, a functional homolog of SEQ ID NO: 368 has an amino acid sequence with at least 45% sequence identity, e.g., 50%, 52%, 56%, 59%, 61%, 65%, 70%, 75%, 80%, 85%, 90%, 95%, 97%, 98%, or 99% sequence identity, to the amino acid sequence set forth in SEQ ID NO: 368. In some cases, a functional homolog of SEQ ID NO: 368 has an amino acid sequence with at least 45% sequence identity, e.g., 50%, 52%, 56%, 59%, 61%, 65%, 70%, 75%, 80%, 85%, 90%, 95%, 97%, 98%, or 99% sequence identity, to one or more functional homologs of SEQ ID NO: 368 described above or set forth in the Sequence Listing.

Examples of amino acid sequences of functional homologs of the polypeptide set forth in SEQ ID NO: 1599 are provided in FIG. 17 and in the Sequence Listing. Such functional homologs include, for example, GI:212275438 (SEQ ID NO: 1600), CeresAnnot:8655553 (SEQ ID NO: 1602), GI:37729658 (SEQ ID NO: 1603), GI:158705664 (SEQ ID NO: 1604), GI:115480571 (SEQ ID NO: 1605), GI:6136111 (SEQ ID NO: 1606), CeresClone:604729 (SEQ ID NO: 1608), GI:12585489 (SEQ ID NO: 1609), GI:82659609 (SEQ ID NO: 1610), GI:136739 (SEQ ID NO: 1611), GI:1388021 (SEQ ID NO: 1612), GI:192338746 (SEQ ID NO: 1613), CeresClone:1924295 (SEQ ID NO: 1615), GI:225431563 (SEQ ID NO: 1616), CeresClone: 220954 (SEQ ID NO: 1618), GI:88866516 (SEQ ID NO: 1619), GI:115443819 (SEQ ID NO: 1620), GI:7417426 (SEQ ID NO: 1621), GI:21599 (SEQ ID NO: 1622), GI:32527831 (SEQ ID NO: 1623), GI:28863909 (SEQ ID NO: 1624), GI:17026394 (SEQ ID NO: 1625), GI:90820120 (SEQ ID NO: 1626), CeresClone:577563 (SEQ ID NO: 1628), GI:6136112 (SEQ ID NO: 1629), CeresClone: 713920 (SEQ ID NO: 1631), CeresClone:1926174 (SEQ ID NO: 1633), GI:12585472 (SEQ ID NO: 1634), CeresAnnot: 1487348 (SEQ ID NO: 1636), GI:15228498 (SEQ ID NO: 1637), CeresClone:256780 (SEQ ID NO: 1639), GI:13605559 (SEQ ID NO: 1640), GI:76160958 (SEQ ID NO: 1641), GI:148887793 (SEQ ID NO: 1642), GI:116787113 (SEQ ID NO: 1643), CeresAnnot:8671040 (SEQ ID NO: 1645), GI:168057301 (SEQ ID NO: 1646), GI:19911799 (SEQ ID NO: 1647), GI:168014649 (SEQ ID NO: 1648), GI:19911797 (SEQ ID NO: 1649), GI:220682974 (SEQ ID NO: 1650), GI:224814363 (SEQ ID NO: 1651), GI:4140688 (SEQ ID NO: 1652), GI:71023003 (SEQ ID NO: 1653), GI:47086583 (SEQ ID NO: 1654), GI:58264886 (SEQ ID NO: 1655), GI:213513005 (SEQ ID NO: 1656), GI:148235435 (SEQ ID NO: 1657), GI:126304392 (SEQ ID NO: 1658), GI:19343890 (SEQ ID NO: 1659), GI:73969769 (SEQ ID NO: 1660), GI:53130600 (SEQ ID NO: 1661), GI:6136108 (SEQ ID NO: 1662), GI:109103119 (SEQ ID NO: 1663), GI:169846774 (SEQ ID NO: 1664), GI:67078526 (SEQ ID NO: 1665), GI:449441 (SEQ ID NO: 1666), GI:50292841 (SEQ ID NO: 1667), GI:149727538 (SEQ ID NO: 1668), GI:148234947 (SEQ ID NO: 1669), GI:41386780 (SEQ ID NO: 1670), GI:194374183 (SEQ ID NO: 1671), GI:6322815 (SEQ ID NO: 1672), GI:45383884 (SEQ ID NO: 1673), GI:7415873 (SEQ ID NO: 1674), GI:48255968 (SEQ ID NO: 1675), GI:156543768 (SEQ ID NO: 1676), GI:149238918 (SEQ ID NO: 1677), GI:197098334 (SEQ ID NO: 1678), GI:72006253 (SEQ ID NO: 1679), GI:47522786 (SEQ ID NO: 1680), GI:157775599 (SEQ ID NO: 1681), GI:68491920 (SEQ ID NO: 1682), GI:156848676 (SEQ ID NO: 1683), GI:73969767 (SEQ ID NO: 1684), GI:17554108 (SEQ ID NO: 1685), GI:189208247 (SEQ ID NO: 1686), GI:116181760 (SEQ ID NO: 1687), GI:196014839 (SEQ ID NO: 1688), GI:50312377 (SEQ ID NO: 1689), GI:46107282 (SEQ ID NO: 1690), GI:50427861 (SEQ ID NO: 1691), GI:19075632 (SEQ ID NO: 1692), GI:171696094 (SEQ ID NO: 1693), GI:150863853 (SEQ ID NO: 1694), GI:156405246 (SEQ ID NO: 1695), GI:157110519 (SEQ ID NO: 1696), GI:145613451 (SEQ ID NO: 1697), GI:170097792 (SEQ ID NO: 1698), GI:169613428 (SEQ ID NO: 1699), GI:154301169 (SEQ ID NO: 1700), GI:164427705 (SEQ ID NO: 1701), GI:66816096 (SEQ ID NO: 1702), GI:156057023 (SEQ ID NO: 1703), GI:66536233 (SEQ ID NO: 1704), GI:195442796 (SEQ ID NO: 1705), GI:119188835 (SEQ ID NO: 1706), GI:195377136 (SEQ ID NO: 1707), GI:118795048 (SEQ ID NO: 1708), GI:154279628 (SEQ ID NO: 1709), GI:194751331 (SEQ ID NO: 1710), GI:195126913 (SEQ ID NO: 1711), GI:62484278 (SEQ ID NO: 1712), GI:195490906 (SEQ ID NO: 1713), GI:50543038 (SEQ ID NO: 1714), GI:195015057 (SEQ ID NO: 1715), GI:195173943 (SEQ ID NO: 1716), GI:194867745 (SEQ ID NO: 1717), GI:170039309 (SEQ ID NO: 1718), GI:167536224 (SEQ ID NO: 1719), GI:111144847 (SEQ ID NO: 1720), GI:111144907 (SEQ ID NO: 1721), GI:111144899 (SEQ ID NO: 1722), GI:170589920 (SEQ ID NO: 1723), GI:109103123 (SEQ ID NO: 1724), GI:119489040 (SEQ ID NO: 1725), GI:169781996 (SEQ ID NO: 1726), GI:121709268 (SEQ ID NO: 1727), GI:70982442 (SEQ ID NO: 1728), GI:145245828 (SEQ ID NO: 1729), GI:193713936 (SEQ ID NO: 1730), GI:170098292 (SEQ ID NO: 1731), SEQ ID NO: 1732, SEQ ID NO: 1733, SEQ ID NO: 1734, SEQ ID NO: 1735, SEQ ID NO: 1736, SEQ ID NO: 1737, SEQ ID NO: 1738, or SEQ ID NO: 1739. In some cases, a functional homolog of SEQ ID NO: 1599 has an amino acid sequence with at least 45% sequence identity, e.g., 50%, 52%, 56%, 59%, 61%, 65%, 70%, 75%, 80%, 85%, 90%, 95%, 97%, 98%, or 99% sequence identity, to the amino acid sequence set forth in SEQ ID NO: 1599. In some cases, a functional homolog of SEQ ID NO: 1599 has an amino acid sequence with at least 45% sequence identity, e.g., 50%, 52%, 56%, 59%, 61%, 65%, 70%, 75%, 80%, 85%, 90%, 95%, 97%, 98%, or 99% sequence identity, to one or more functional homologs of SEQ ID NO: 1599 described above or set forth in the Sequence Listing.

Examples of amino acid sequences of functional homologs of the polypeptide set forth in SEQ ID NO: 154 are provided in FIG. 18 and in the Sequence Listing. Such functional homologs include, for example, CeresAnnot: 8701724 (SEQ ID NO: 156), CeresClone:1531656 (SEQ ID NO: 158), GI:115456900 (SEQ ID NO: 159), CeresClone: 869980 (SEQ ID NO: 161), CeresClone:1739862 (SEQ ID NO: 163), CeresAnnot:1452831 (SEQ ID NO: 165), CeresClone:1123182 (SEQ ID NO: 167), GI:225427800 (SEQ ID NO: 168), CeresClone:1649408 (SEQ ID NO: 170), CeresAnnot:1442596 (SEQ ID NO: 172), CeresClone: 100011527 (SEQ ID NO: 174), CeresClone:1347664 (SEQ ID NO: 176), CeresClone:679875 (SEQ ID NO: 178), CeresClone:1606594 (SEQ ID NO: 180), SEQ ID NO: 181, ACG30817 (SEQ ID NO: 182), ACG26737 (SEQ ID NO: 183), ABK92849 (SEQ ID NO: 184), or XP_002305470 (SEQ ID NO: 185). In some cases, a functional homolog of SEQ ID NO: 154 has an amino acid sequence with at least 45% sequence identity, e.g., 50%, 52%, 56%, 59%, 61%, 65%, 70%, 75%, 80%, 85%, 90%, 95%, 97%, 98%, or 99% sequence identity, to the amino acid sequence set forth in SEQ ID NO: 154. In some cases, a functional homolog of SEQ ID NO: 154 has an amino acid sequence with at least 45% sequence identity, e.g., 50%, 52%, 56%, 59%, 61%, 65%, 70%, 75%, 80%, 85%, 90%, 95%, 97%, 98%, or 99% sequence identity, to one or more functional homologs of SEQ ID NO: 154 described above or set forth in the Sequence Listing.

Figure 19:
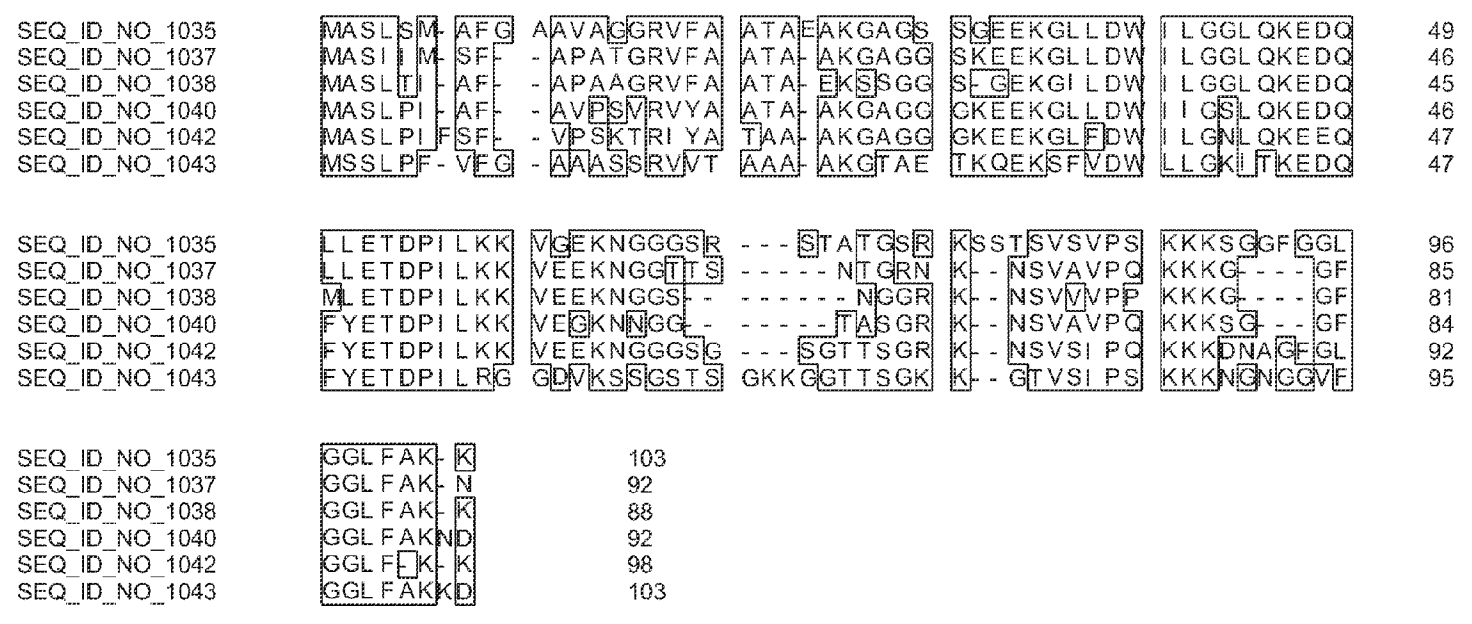

Examples of amino acid sequences of functional homologs of the polypeptide set forth in SEQ ID NO: 1035 are provided in FIG. 19 and in the Sequence Listing. Such functional homologs include, for example, CeresClone: 1660759 (SEQ ID NO: 1037), GI:225434658 (SEQ ID NO: 1038), CeresAnnot:1439822 (SEQ ID NO: 1040), CeresClone:1808650 (SEQ ID NO: 1042), GI:27529048 (SEQ ID NO: 1043), CeresClone:1743842 (SEQ ID NO: 1045), CeresClone:560309 (SEQ ID NO: 1047), CeresAnnot: 1461680 (SEQ ID NO: 1049), CeresClone:1853867 (SEQ ID NO: 1051), CeresClone:1087882 (SEQ ID NO: 1053), CeresClone:1108470 (SEQ ID NO: 1055), CeresClone: 1605553 (SEQ ID NO: 1057), CeresClone:25829 (SEQ ID NO: 1059), CeresClone:958635 (SEQ ID NO: 1061), SEQ ID NO: 1062, or B9SHY8_RICCO (SEQ ID NO: 1063). In some cases, a functional homolog of SEQ ID NO: 1035 has an amino acid sequence with at least 45% sequence identity, e.g., 50%, 52%, 56%, 59%, 61%, 65%, 70%, 75%, 80%, 85%, 90%, 95%, 97%, 98%, or 99% sequence identity, to the amino acid sequence set forth in SEQ ID NO: 1035. In some cases, a functional homolog of SEQ ID NO: 1035 has an amino acid sequence with at least 45% sequence identity, e.g., 50%, 52%, 56%, 59%, 61%, 65%, 70%, 75%, 80%, 85%, 90%, 95%, 97%, 98%, or 99% sequence identity, to one or more functional homologs of SEQ ID NO: 1035 described above or set forth in the Sequence Listing.

Examples of amino acid sequences of functional homologs of the polypeptide set forth in SEQ ID NO: 741 are provided in FIG. 20 and in the Sequence Listing. Such functional homologs include, for example, CeresClone: 1515957 (SEQ ID NO: 743), CeresAnnot:8734086 (SEQ ID NO: 745), GI:125553354 (SEQ ID NO: 746), CeresClone: 1785379 (SEQ ID NO: 748), CeresAnnot:1460824 (SEQ ID NO: 750), CeresClone:638126 (SEQ ID NO: 752), CeresAnnot:850366 (SEQ ID NO: 754), CeresClone:2034321 (SEQ ID NO: 756), CeresAnnot:8667941 (SEQ ID NO: 758), CeresClone:100965215 (SEQ ID NO: 760), GI:125527154 (SEQ ID NO: 761), GI:115471859 (SEQ ID NO: 762), GI:125558161 (SEQ ID NO: 763), GI:55773837 (SEQ ID NO: 764), CeresClone:1722230 (SEQ ID NO: 766), CeresAnnot:1487827 (SEQ ID NO: 768), CeresClone: 1910072 (SEQ ID NO: 770), CeresClone:143475 (SEQ ID NO: 772), CeresAnnot:1514100 (SEQ ID NO: 774), CeresClone:1069222 (SEQ ID NO: 776), CeresAnnot:1510450 (SEQ ID NO: 778), CeresClone:100068619 (SEQ ID NO: 780), CeresAnnot:8734211 (SEQ ID NO: 782), CeresAnnot: 8456508 (SEQ ID NO: 784), GI:225428460 (SEQ ID NO: 785), CeresClone:100067803 (SEQ ID NO: 787), CeresAnnot:1450327 (SEQ ID NO: 789), CeresClone:1787372 (SEQ ID NO: 791), CeresAnnot:1457249 (SEQ ID NO: 793), GI:7981380 (SEQ ID NO: 794), GI:147767321 (SEQ ID NO: 795), CeresClone:1916884 (SEQ ID NO: 797), CeresClone:1775942 (SEQ ID NO: 799), CeresClone:1761808 (SEQ ID NO: 801), CeresClone:1914387 (SEQ ID NO: 803), CeresAnnot:8734209 (SEQ ID NO: 805), GI:225428458 (SEQ ID NO: 806), CeresClone:1847251 (SEQ ID NO: 808), CeresClone:477814 (SEQ ID NO: 810), CeresAnnot:543794 (SEQ ID NO: 812), CeresAnnot: 1679467 (SEQ ID NO: 814), CeresClone:1523182 (SEQ ID NO: 816), CeresAnnot:1495620 (SEQ ID NO: 818), GI:118137433 (SEQ ID NO: 819), GI:5091605 (SEQ ID NO: 820), CeresAnnot:838426 (SEQ ID NO: 822), GI:110931736 (SEQ ID NO: 823), GI:125553458 (SEQ ID NO: 824), CeresClone:1113584 (SEQ ID NO: 826), CeresClone:857342 (SEQ ID NO: 828), CeresAnnot:827713 (SEQ ID NO: 830), CeresClone:331755 (SEQ ID NO: 832), CeresClone:1723374 (SEQ ID NO: 834), CeresClone: 1785685 (SEQ ID NO: 836), CeresClone:1927753 (SEQ ID NO: 838), GI:112292438 (SEQ ID NO: 839), GI:116830269 (SEQ ID NO: 840), CeresClone:100002959 (SEQ ID NO: 842), GI:112292440 (SEQ ID NO: 843), CeresClone:41695 (SEQ ID NO: 845), GI:124264312 (SEQ ID NO: 846), GI:115438765 (SEQ ID NO: 847) or CeresAnnot:1445878 (SEQ ID NO: 849). In some cases, a functional homolog of SEQ ID NO: 741 has an amino acid sequence with at least 45% sequence identity, e.g., 50%, 52%, 56%, 59%, 61%, 65%, 70%, 75%, 80%, 85%, 90%, 95%, 97%, 98%, or 99% sequence identity, to the amino acid sequence set forth in SEQ ID NO: 741. In some cases, a functional homolog of SEQ ID NO: 741 has an amino acid sequence with at least 45% sequence identity, e.g., 50%, 52%, 56%, 59%, 61%, 65%, 70%, 75%, 80%, 85%, 90%, 95%, 97%, 98%, or 99% sequence identity, to one or more functional homologs of SEQ ID NO: 741 described above or set forth in the Sequence Listing.

Examples of amino acid sequences of functional homologs of the polypeptide set forth in SEQ ID NO: 187 are provided in FIG. 21 and in the Sequence Listing. Such functional homologs include, for example, GI:115480375 (SEQ ID NO: 188), CeresClone:632248 (SEQ ID NO: 190), CeresAnnot:8657298 (SEQ ID NO: 192), GI:194703722 (SEQ ID NO: 193), GI:125564503 (SEQ ID NO: 194), or CeresClone:313499 (SEQ ID NO: 196). In some cases, a functional homolog of SEQ ID NO: 187 has an amino acid sequence with at least 45% sequence identity, e.g., 50%, 52%, 56%, 59%, 61%, 65%, 70%, 75%, 80%, 85%, 90%, 95%, 97%, 98%, or 99% sequence identity, to the amino acid sequence set forth in SEQ ID NO: 187. In some cases, a functional homolog of SEQ ID NO: 187 has an amino acid sequence with at least 45% sequence identity, e.g., 50%, 52%, 56%, 59%, 61%, 65%, 70%, 75%, 80%, 85%, 90%, 95%, 97%, 98%, or 99% sequence identity, to one or more functional homologs of SEQ ID NO: 187 described above or set forth in the Sequence Listing.

Examples of amino acid sequences of functional homologs of the polypeptide set forth in SEQ ID NO: 1065 are provided in FIG. 22 and in the Sequence Listing. Such functional homologs include, for example, CeresClone: 467508 (SEQ ID NO: 1067), CeresClone:1942871 (SEQ ID NO: 1069), GI:157347478 (SEQ ID NO: 1070), CeresAnnot:1528800 (SEQ ID NO: 1072), GI:54306075 (SEQ ID NO: 1073), CeresAnnot:8724651 (SEQ ID NO: 1075), GI:194696788 (SEQ ID NO: 1076), CeresClone:1792902 (SEQ ID NO: 1078), GI:7413581 (SEQ ID NO: 1079), GI:15232741 (SEQ ID NO: 1080), CeresAnnot:1484880 (SEQ ID NO: 1082), GI:147809623 (SEQ ID NO: 1083), CeresAnnot:1475350 (SEQ ID NO: 1085), CeresClone:1886384 (SEQ ID NO: 1087), CeresAnnot:1465047 (SEQ ID NO: 1089), CeresClone:228069 (SEQ ID NO: 1091), CeresClone:1806867 (SEQ ID NO: 1093), CeresClone:1897134 (SEQ ID NO: 1095), GI:157344055 (SEQ ID NO: 1096), CeresClone:1727738 (SEQ ID NO: 1098), CeresClone:1919901 (SEQ ID NO: 1100), GI:15231175 (SEQ ID NO: 1101), CeresClone:1747444 (SEQ ID NO: 1103), CeresClone:2034697 (SEQ ID NO: 1105), GI:194702278 (SEQ ID NO: 1106), CeresAnnot:8669409 (SEQ ID NO: 1108), or CeresAnnot:1161946 (SEQ ID NO: 1110). In some cases, a functional homolog of SEQ ID NO: 1065 has an amino acid sequence with at least 45% sequence identity, e.g., 50%, 52%, 56%, 59%, 61%, 65%, 70%, 75%, 80%, 85%, 90%, 95%, 97%, 98%, or 99% sequence identity, to the amino acid sequence set forth in SEQ ID NO: 1065. In some cases, a functional homolog of SEQ ID NO: 1065 has an amino acid sequence with at least 45% sequence identity, e.g., 50%, 52%, 56%, 59%, 61%, 65%, 70%, 75%, 80%, 85%, 90%, 95%, 97%, 98%, or 99% sequence identity, to one or more functional homologs of SEQ ID NO: 1065 described above or set forth in the Sequence Listing.

Examples of amino acid sequences of functional homologs of the polypeptide set forth in SEQ ID NO: 1592 are provided in FIG. 23 and in the Sequence Listing. Such functional homologs include, for example, Ceres Annot 1298824 (SEQ ID NO:1580), CeresAnnot:1463921 (SEQ ID NO: 1582), GI:157338847 (SEQ ID NO: 1583), CeresAnnot:8458737 (SEQ ID NO: 1585), CeresAnnot:8682232 (SEQ ID NO: 1587), CeresClone:846036 (SEQ ID NO: 1589), GI:6899651 (SEQ ID NO: 1590), GI:147787084 (SEQ ID NO: 1593), CeresClone:13741 (SEQ ID NO: 1595), CeresClone:147816 (SEQ ID NO: 1597), CeresAnnot:1463921 (SEQ ID NO:2604), GI:297737772 (SEQ ID NO:2605), GI:255570659 (SEQ ID NO:2606), GI:225424081 (SEQ ID NO:2607), GI:147787084 (SEQ ID NO:2608), GI:297814362 (SEQ ID NO: 2609), GI:115449665 (SEQ ID NO:2610), GI:226509392 (SEQ ID NO:2611), CeresClone:846036 (SEQ ID NO:2613), CeresClone:1791455 (SEQ ID NO:2615), CeresAnnot:8682232 (SEQ ID NO:2617), CeresClone:846036 (SEQ ID NO:2619), GI:238014206 (SEQ ID NO:2620), SoyY23_accession (SEQ ID N:2621), GI:297849932 (SEQ ID NO:2622), and GI:224108407 (SEQ ID NO:2623). In some cases, a functional homolog of SEQ ID NO: 1592 has an amino acid sequence with at least 45% sequence identity, e.g., 50%, 52%, 56%, 59%, 61%, 65%, 70%, 75%, 80%, 85%, 90%, 95%, 97%, 98%, or 99% sequence identity, to the amino acid sequence set forth in SEQ ID NO: 1592. In some cases, a functional homolog of SEQ ID NO: 1592 has an amino acid sequence with at least 45% sequence identity, e.g., 50%, 52%, 56%, 59%, 61%, 65%, 70%, 75%, 80%, 85%, 90%, 95%, 97%, 98%, or 99% sequence identity, to one or more functional homologs of SEQ ID NO: 1592 described above or set forth in the Sequence Listing.

Figure 24A:
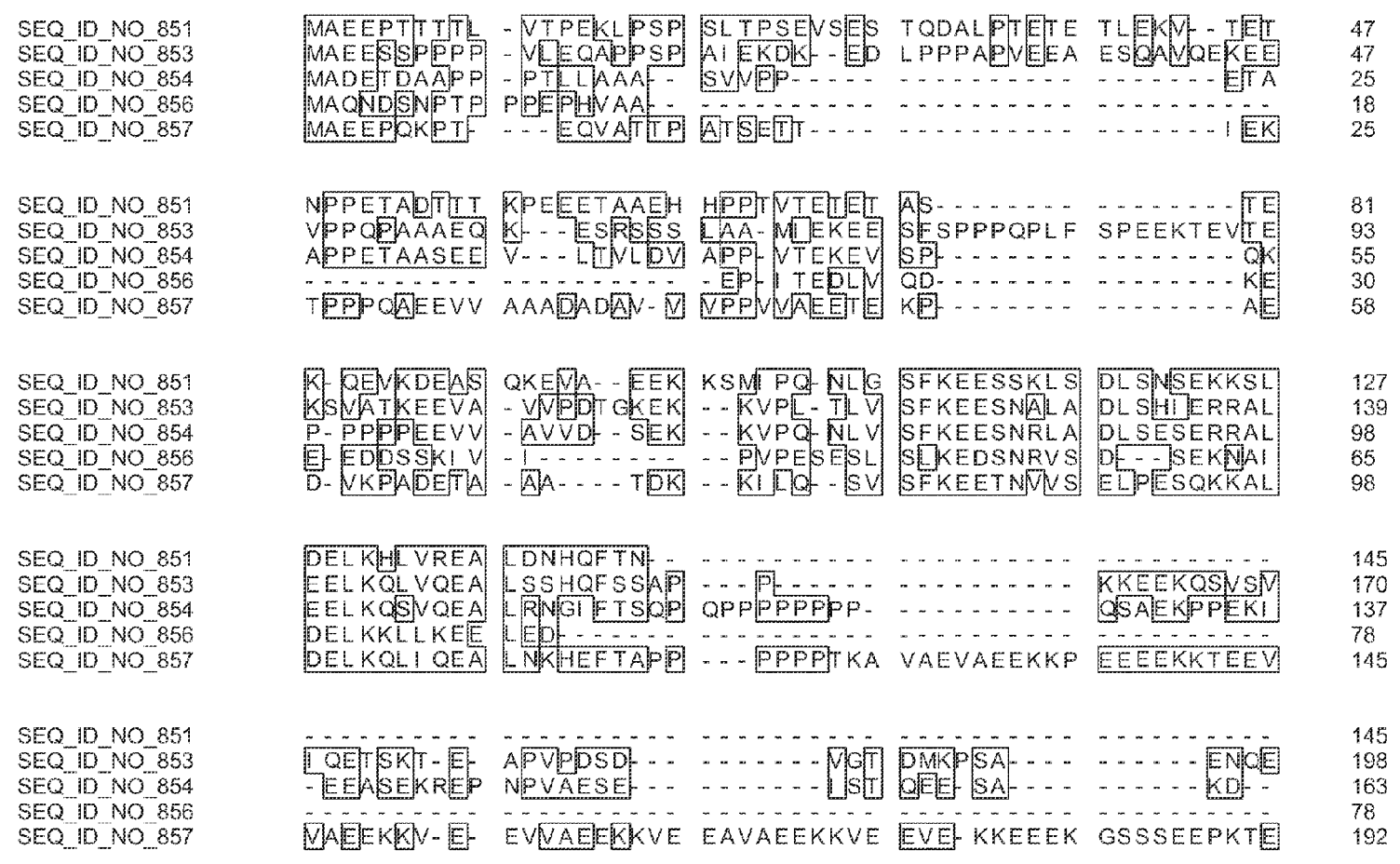

Examples of amino acid sequences of functional homologs of the polypeptide set forth in SEQ ID NO: 851 are provided in FIG. 24 and in the Sequence Listing. Such functional homologs include, for example, CeresAnnot: 1486825 (SEQ ID NO: 853), GI:147859031 (SEQ ID NO: 854), CeresClone:524404 (SEQ ID NO: 856), GI:84453208 (SEQ ID NO: 857), GI:30680992 (SEQ ID NO: 858), CeresClone:1152744 (SEQ ID NO: 860), CeresAnnot:1479687 (SEQ ID NO: 862), GI:7267559 (SEQ ID NO: 863), CeresAnnot:1532284 (SEQ ID NO: 865), GI:157357696 (SEQ ID NO: 866), CeresAnnot:1480239 (SEQ ID NO: 868), CeresAnnot:1486823 (SEQ ID NO: 870), GI:82469976 (SEQ ID NO: 871), GI:225460394 (SEQ ID NO: 872), GI:212275574 (SEQ ID NO: 873), CeresClone:846541 (SEQ ID NO: 875), GI:147859032 (SEQ ID NO: 876), GI:125528559 (SEQ ID NO: 877), GI:115441357 (SEQ ID NO: 878), CeresClone:325220 (SEQ ID NO: 880), GI:115464035 (SEQ ID NO: 881), GI:225444143 (SEQ ID NO: 882), CeresAnnot:544140 (SEQ ID NO: 884), GI:125572823 (SEQ ID NO: 885), GI:147864826 (SEQ ID NO: 886), CeresAnnot:8692801 (SEQ ID NO: 888), CeresAnnot:869188 (SEQ ID NO: 890), CeresAnnot:8456541 (SEQ ID NO: 892), GI:147801354 (SEQ ID NO: 893), CeresAnnot:1442146 (SEQ ID NO: 895), CeresClone:1838310 (SEQ ID NO: 897), CeresAnnot:866220 (SEQ ID NO: 899), GI:225439560 (SEQ ID NO: 900), CeresClone:1209913 (SEQ ID NO: 902), GI:115469468 (SEQ ID NO: 903), CeresClone:1727755 (SEQ ID NO: 905), CeresClone:240809 (SEQ ID NO: 907), CeresClone:1769321 (SEQ ID NO: 909), CeresClone:704211 (SEQ ID NO: 911), GI:115463311 (SEQ ID NO: 912), GI:125551906 (SEQ ID NO: 913), CeresClone:1868378 (SEQ ID NO: 915), CeresClone:1812513 (SEQ ID NO: 917), CeresClone:209421 (SEQ ID NO: 919), CeresAnnot:8730934 (SEQ ID NO: 921), CeresAnnot:1452687 (SEQ ID NO: 923), CeresClone:351936 (SEQ ID NO: 925), or SEQ ID NO: 926. In some cases, a functional homolog of SEQ ID NO: 851 has an amino acid sequence with at least 45% sequence identity, e.g., 50%, 52%, 56%, 59%, 61%, 65%, 70%, 75%, 80%, 85%, 90%, 95%, 97%, 98%, or 99% sequence identity, to the amino acid sequence set forth in SEQ ID NO: 851. In some cases, a functional homolog of SEQ ID NO: 851 has an amino acid sequence with at least 45% sequence identity, e.g., 50%, 52%, 56%, 59%, 61%, 65%, 70%, 75%, 80%, 85%, 90%, 95%, 97%, 98%, or 99% sequence identity, to one or more functional homologs of SEQ ID NO: 851 described above or set forth in the Sequence Listing.

Figure 25A:
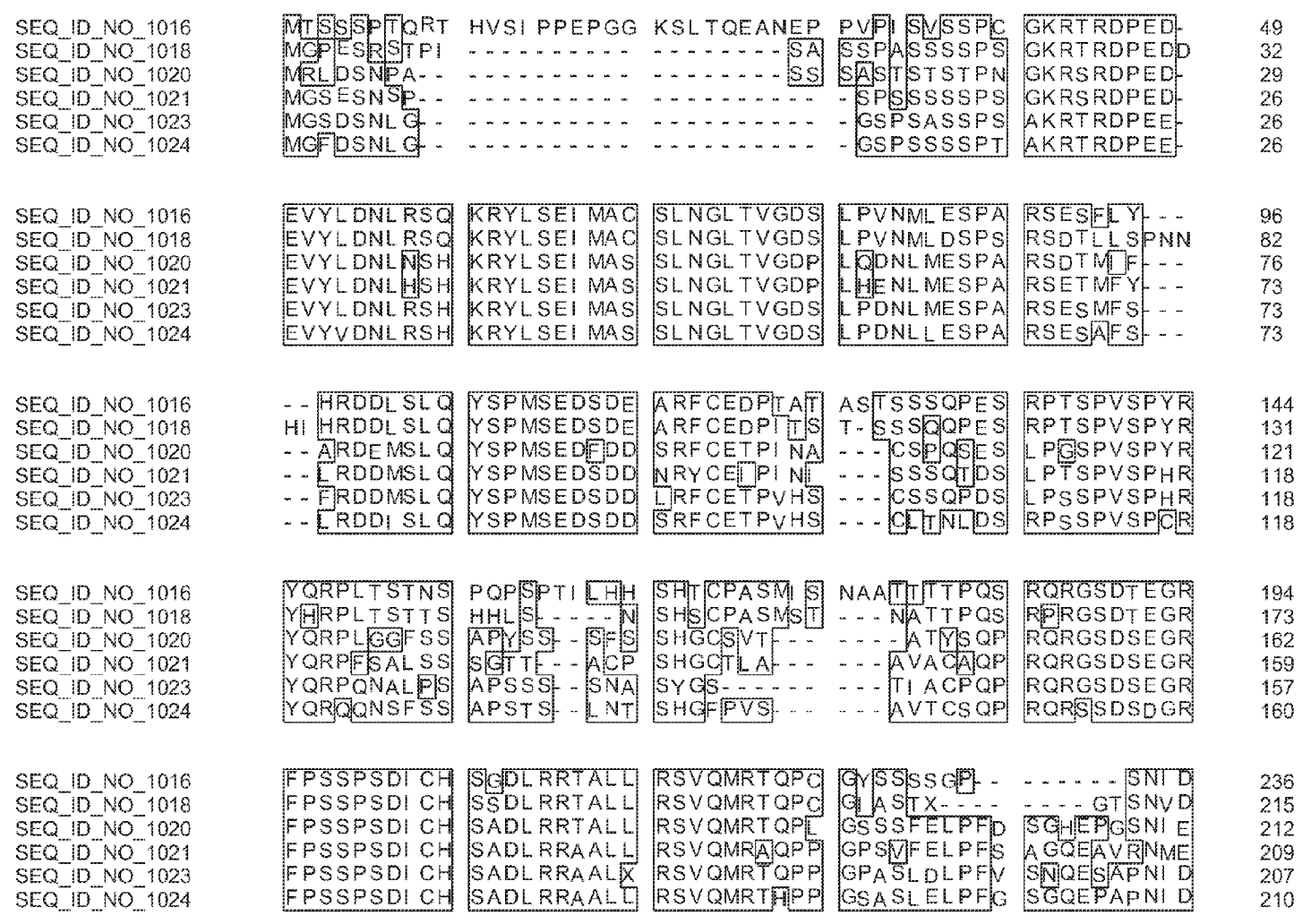

Examples of amino acid sequences of functional homologs of the polypeptide set forth in SEQ ID NO: 1016 are provided in FIG. 25 and in the Sequence Listing. Such functional homologs include, for example, CeresClone:949027 (SEQ ID NO: 1018), CeresAnnot:1471603 (SEQ ID NO: 1020), GI:225437511 (SEQ ID NO: 1021), CeresClone:527044 (SEQ ID NO: 1023), GI:61611694 (SEQ ID NO: 1024), CeresClone:1343264 (SEQ ID NO: 1026), GI:118482768 (SEQ ID NO: 1027), CeresAnnot:1497745 (SEQ ID NO: 1029), GI:147783944 (SEQ ID NO: 1030), CeresAnnot:1444766 (SEQ ID NO: 1032), GI:118485088 (SEQ ID NO: 1033), GI:29782568 (SEQ ID NO:2578), GI:255548507 (SEQ ID NO:2579), CeresClone:226231 (SEQ ID NO:2581), CeresAnnot:8725117 (SEQ ID NO:2583), GI:115462191 (SEQ ID NO:2584), GI:218196129 (SEQ ID NO:2585), CeresClone:779610 (SEQ ID NO:2587), and GI:294463836 (SEQ ID NO:2588). In some cases, a functional homolog of SEQ ID NO: 1016 has an amino acid sequence with at least 45% sequence identity, e.g., 50%, 52%, 56%, 59%, 61%, 65%, 70%, 75%, 80%, 85%, 90%, 95%, 97%, 98%, or 99% sequence identity, to the amino acid sequence set forth in SEQ ID NO: 1016. In some cases, a functional homolog of SEQ ID NO: 1016 has an amino acid sequence with at least 45% sequence identity, e.g., 50%, 52%, 56%, 59%, 61%, 65%, 70%, 75%, 80%, 85%, 90%, 95%, 97%, 98%, or 99% sequence identity, to one or more functional homologs of SEQ ID NO: 1016 described above or set forth in the Sequence Listing.

Figure 26:
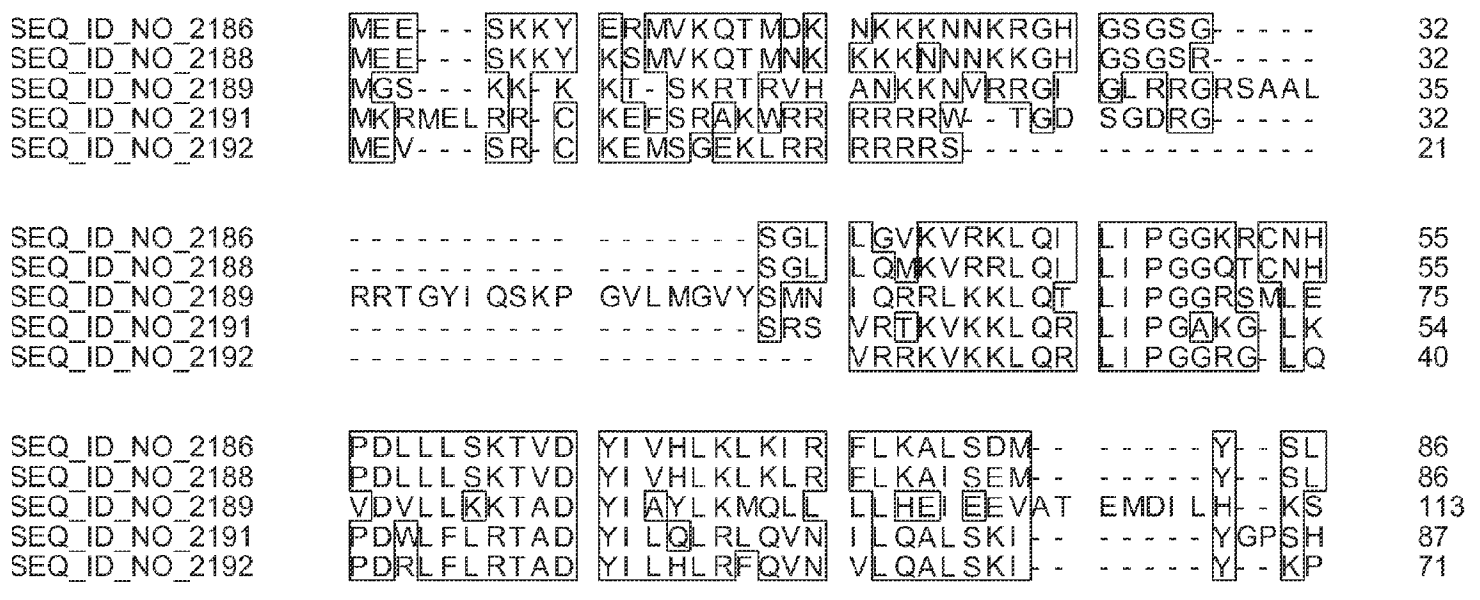

Examples of amino acid sequences of functional homologs of the polypeptide set forth in SEQ ID NO: 2186 are provided in FIG. 26 and in the Sequence Listing. Such functional homologs include, for example, CeresClone: 260808 (SEQ ID NO: 2188), CeresAnnot:1471 GI:116786056 (SEQ ID NO: 2189), CeresClone:1916112 (SEQ ID NO:2191), GI:225424709 (SEQ ID NO: 2192), GI:238478596 (SEQ ID NO: 2193), and GI:255560021 (SEQ ID NO: 2194). In some cases, a functional homolog of SEQ ID NO: 2186 has an amino acid sequence with at least 45% sequence identity, e.g., 50%, 52%, 56%, 59%, 61%, 65%, 70%, 75%, 80%, 85%, 90%, 95%, 97%, 98%, or 99% sequence identity, to the amino acid sequence set forth in SEQ ID NO: 2186. In some cases, a functional homolog of SEQ ID NO: 2186 has an amino acid sequence with at least 45% sequence identity, e.g., 50%, 52%, 56%, 59%, 61%, 65%, 70%, 75%, 80%, 85%, 90%, 95%, 97%, 98%, or 99% sequence identity, to one or more functional homologs of SEQ ID NO: 2186 described above or set forth in the Sequence Listing.

Examples of amino acid sequences of functional homologs of the polypeptide set forth in SEQ ID NO: 1955 are provided in FIG. 27 and in the Sequence Listing. Such functional homologs include, for example, GI:147810484 (SEQ ID NO: 1956), GI:37051125 (SEQ ID NO: 1957), GI:112363376 (SEQ ID NO: 1958), CeresAnnot:1702519 (SEQ ID NO: 1960), CeresClone:286416 (SEQ ID NO: 1962), CeresAnnot:8702387 (SEQ ID NO: 1964), CeresClone:1951902 (SEQ ID NO: 1966), GI:113205234 (SEQ ID NO: 1967), GI:5689615 (SEQ ID NO: 1968), CeresClone:1107598 (SEQ ID NO: 1970), CeresClone:543840 (SEQ ID NO: 1972), GI:6092016 (SEQ ID NO: 1973), GI:20372847 (SEQ ID NO: 1974), GI:20372895 (SEQ ID NO: 1975), GI:38344272 (SEQ ID NO: 1976), and CeresClone:738478 (SEQ ID NO: 1978). In some cases, a functional homolog of SEQ ID NO: 1955 has an amino acid sequence with at least 45% sequence identity, e.g., 50%, 52%, 56%, 59%, 61%, 65%, 70%, 75%, 80%, 85%, 90%, 95%, 97%, 98%, or 99% sequence identity, to the amino acid sequence set forth in SEQ ID NO: 1955. In some cases, a functional homolog of SEQ ID NO: 1955 has an amino acid sequence with at least 45% sequence identity, e.g., 50%, 52%, 56%, 59%, 61%, 65%, 70%, 75%, 80%, 85%, 90%, 95%, 97%, 98%, or 99% sequence identity, to one or more functional homologs of SEQ ID NO: 1955 described above or set forth in the Sequence Listing.

Figure 28:
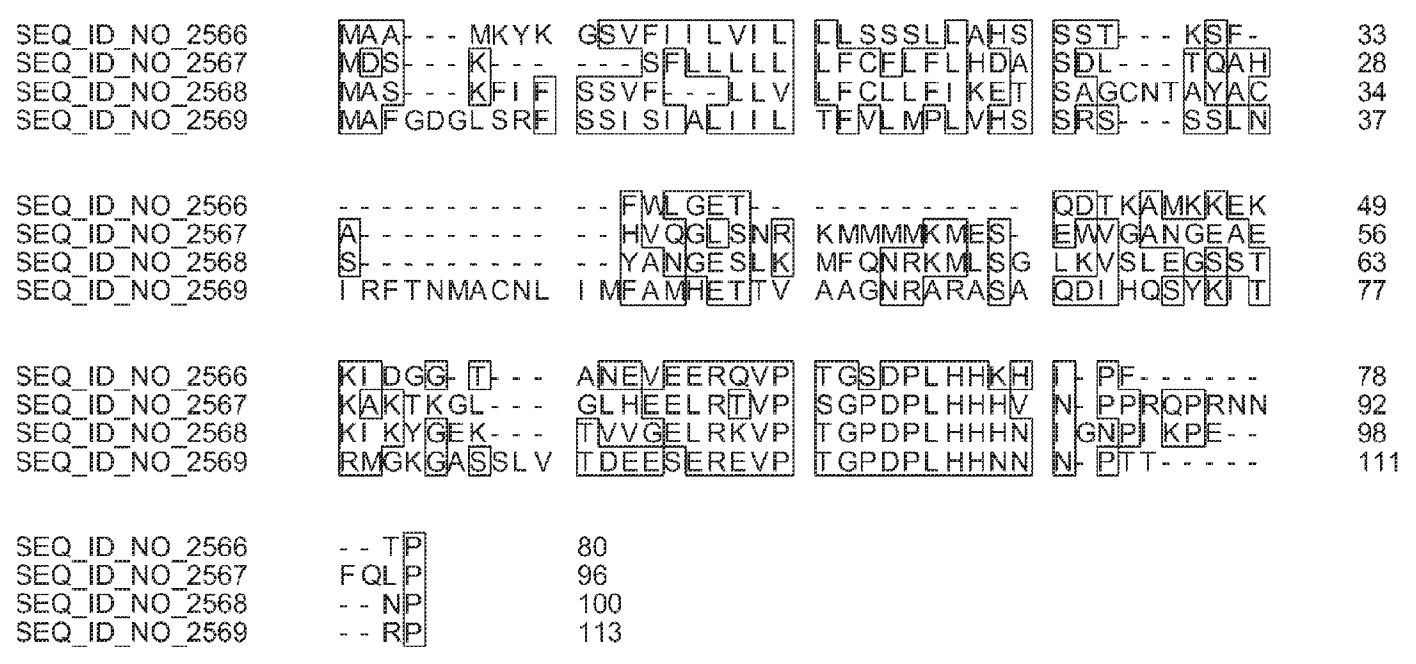

Examples of amino acid sequences of functional homologs of the polypeptide set forth in SEQ ID NO: 2566 are provided in FIG. 28 and in the Sequence Listing. Such functional homologs include, for example, GI:84028190 (SEQ ID NO:2567), GI:124359888 (SEQ ID NO:2568), GI:224057515 (SEQ ID NO:2569), GI:255544778 (SEQ ID NO:2570), GI:4680323 (SEQ ID NO:2571), GI:5306272 (SEQ ID NO:2572), GI:42570935 (SEQ ID NO:2573), CeresAnnot:860028 (SEQ ID NO:2575), EE521385_Brassica (SEQ ID NO:2576), DY002473_Brassica (SEQ ID NO:2577), and GI:297811417 (SEQ ID NO:2591). In some cases, a functional homolog of SEQ ID NO: 2566 has an amino acid sequence with at least 45% sequence identity, e.g., 50%, 52%, 56%, 59%, 61%, 65%, 70%, 75%, 80%, 85%, 90%, 95%, 97%, 98%, or 99% sequence identity, to the amino acid sequence set forth in SEQ ID NO: 2566. In some cases, a functional homolog of SEQ ID NO: 2566 has an amino acid sequence with at least 45% sequence identity, e.g., 50%, 52%, 56%, 59%, 61%, 65%, 70%, 75%, 80%, 85%, 90%, 95%, 97%, 98%, or 99% sequence identity, to one or more functional homologs of SEQ ID NO: 2566 described above or set forth in the Sequence Listing.

Examples of amino acid sequences of functional homologs of the polypeptide set forth in SEQ ID NO: 2150 are provided in FIG. 29 and in the Sequence Listing. Such functional homologs include, for example, CeresAnnot: 1534418 (SEQ ID NO:2152), CeresClone:1045493 (SEQ ID NO:2154), GI:193237559 (SEQ ID NO:2155), CeresClone: 1811618 (SEQ ID NO:2157), CeresAnnot:8671739 (SEQ ID NO:2159), GI:212723754 (SEQ ID NO:2160), GI:115445455 (SEQ ID NO:2161), CeresClone:616810 (SEQ ID NO:2163), CeresAnnot:1480933 (SEQ ID NO:2165), GI:113367184 (SEQ ID NO:2166), CeresClone: 657501 (SEQ ID NO:2168), CeresClone:1902421 (SEQ ID NO:2170), CeresClone:1812854 (SEQ ID NO:2172), GI:13365772 (SEQ ID NO:2173), GI:49388982 (SEQ ID NO:2174), GI:113367144 (SEQ ID NO:2175), CeresAnnot: 8743947 (SEQ ID NO:2177), CeresClone:1810791 (SEQ ID NO:2179), CeresClone:297691 (SEQ ID NO:2181), CeresClone:775677 (SEQ ID NO:2183), and GI:115469364 (SEQ ID NO:2184). In some cases, a functional homolog of SEQ ID NO: 2150 has an amino acid sequence with at least 45% sequence identity, e.g., 50%, 52%, 56%, 59%, 61%, 65%, 70%, 75%, 80%, 85%, 90%, 95%, 97%, 98%, or 99% sequence identity, to the amino acid sequence set forth in SEQ ID NO: 2150. In some cases, a functional homolog of SEQ ID NO: 2150 has an amino acid sequence with at least 45% sequence identity, e.g., 50%, 52%, 56%, 59%, 61%, 65%, 70%, 75%, 80%, 85%, 90%, 95%, 97%, 98%, or 99% sequence identity, to one or more functional homologs of SEQ ID NO: 2150 described above or set forth in the Sequence Listing.

Examples of amino acid sequences of functional homologs of the polypeptide set forth in SEQ ID NO: 2196 are provided in FIG. 30 and in the Sequence Listing. Such functional homologs include, for example, GI:11066960 (SEQ ID NO:2197), CeresAnnot:1462983 (SEQ ID NO:2199), GI:10637893 (SEQ ID NO:2200), GI:121485994 (SEQ ID NO:2201), GI:147805516 (SEQ ID NO:2202), CeresAnnot:8463421 (SEQ ID NO:2204), CeresClone:1854329 (SEQ ID NO:2206), GI:50428339 (SEQ ID NO:2207), GI:226508974 (SEQ ID NO:2208), CeresAnnot:8701853 (SEQ ID NO:2210), GI:15705368 (SEQ ID NO:2211), GI:38684027 (SEQ ID NO:2212), CeresClone:1789833 (SEQ ID NO:2214), GI:15230090 (SEQ ID NO:2215), CeresAnnot:877376 (SEQ ID NO:2217), GI:10952510 (SEQ ID NO:2218), GI:225433318 (SEQ ID NO:2219), GI:57283313 (SEQ ID NO:2220), CeresAnnot:1478997 (SEQ ID NO:2222), CeresAnnot:1445817 (SEQ ID NO:2224), GI:31322044 (SEQ ID NO:2225), GI:15235398 (SEQ ID NO:2226), CeresAnnot:8462622 (SEQ ID NO:2228), CeresAnnot:1445818 (SEQ ID NO:2230), GI:22001520 (SEQ ID NO:2231), GI:46409004 (SEQ ID NO:2232), CeresAnnot:868358 (SEQ ID NO:2234), GI:51371875 (SEQ ID NO:2235), GI:5880357 (SEQ ID NO:2236), GI:226508974 (SEQ ID NO:2237), GI:116311063 (SEQ ID NO:2238), GI:52550773 (SEQ ID NO:2239), GI:188506975 (SEQ ID NO:2240), GI:226500244 (SEQ ID NO:2241), GI:115447353 (SEQ ID NO:2242), CeresAnnot:8680294 (SEQ ID NO:2244), GI:212276282 (SEQ ID NO:2245), GI:168011841 (SEQ ID NO:2246), GI:115447351 (SEQ ID NO:2247), GI:168067175 (SEQ ID NO:2248), GI:168068394 (SEQ ID NO:2249), GI:15705372 (SEQ ID NO:2250), GI:168011817 (SEQ ID NO:2251), GI:168011819 (SEQ ID NO:2252), GI:15705370 (SEQ ID NO:2253), GI:225434604 (SEQ ID NO:2254), CeresAnnot:1514946 (SEQ ID NO:2256), GI:22001522 (SEQ ID NO:2257), GI:145356298 (SEQ ID NO:2258), GI:159478831 (SEQ ID NO:2259), GI:14028761 (SEQ ID NO:2260), GI:66816227 (SEQ ID NO:2261), GI:156361112 (SEQ ID NO:2262), GI:72171193 (SEQ ID NO:2263), GI:159900308 (SEQ ID NO:2264), GI:156741881 (SEQ ID NO:2265), GI:146297474 (SEQ ID NO:2266), GI:167038063 (SEQ ID NO:2267), GI:163846579 (SEQ ID NO:2268), and GI:148657093 (SEQ ID NO:2269). In some cases, a functional homolog of SEQ ID NO: 2196 has an amino acid sequence with at least 45% sequence identity, e.g., 50%, 52%, 56%, 59%, 61%, 65%, 70%, 75%, 80%, 85%, 90%, 95%, 97%, 98%, or 99% sequence identity, to the amino acid sequence set forth in SEQ ID NO: 2196. In some cases, a functional homolog of SEQ ID NO: 2196 has an amino acid sequence with at least 45% sequence identity, e.g., 50%, 52%, 56%, 59%, 61%, 65%, 70%, 75%, 80%, 85%, 90%, 95%, 97%, 98%, or 99% sequence identity, to one or more functional homologs of SEQ ID NO: 2196 described above or set forth in the Sequence Listing.

Figure 31A:
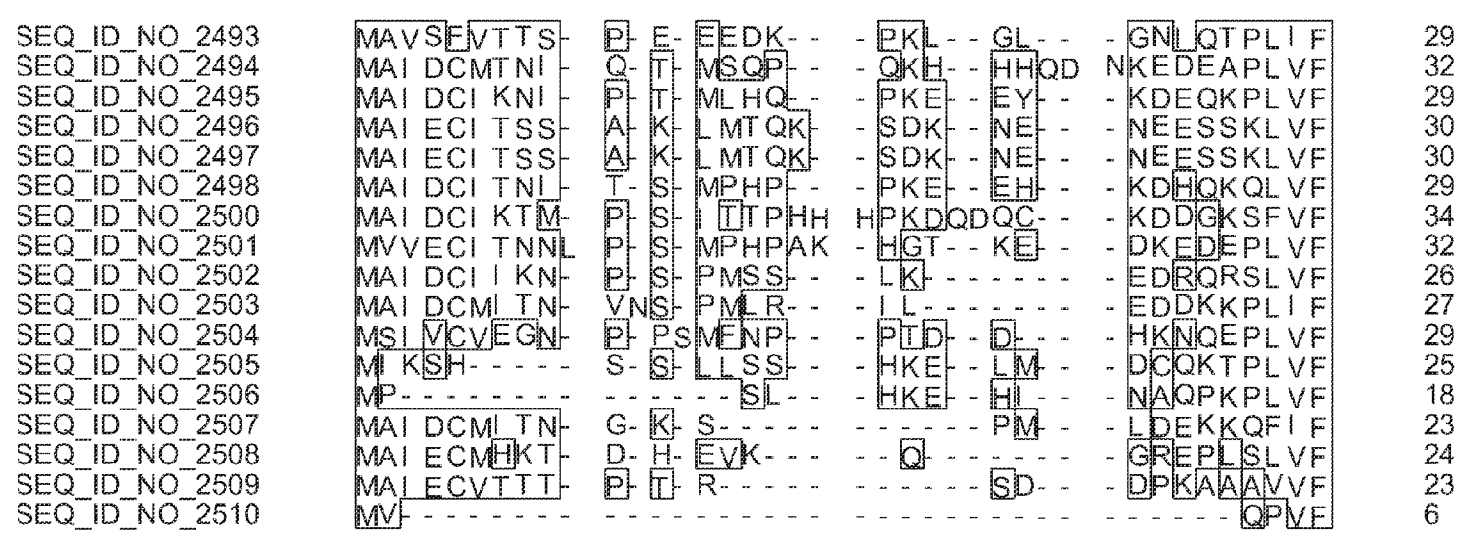
Figure 31K:
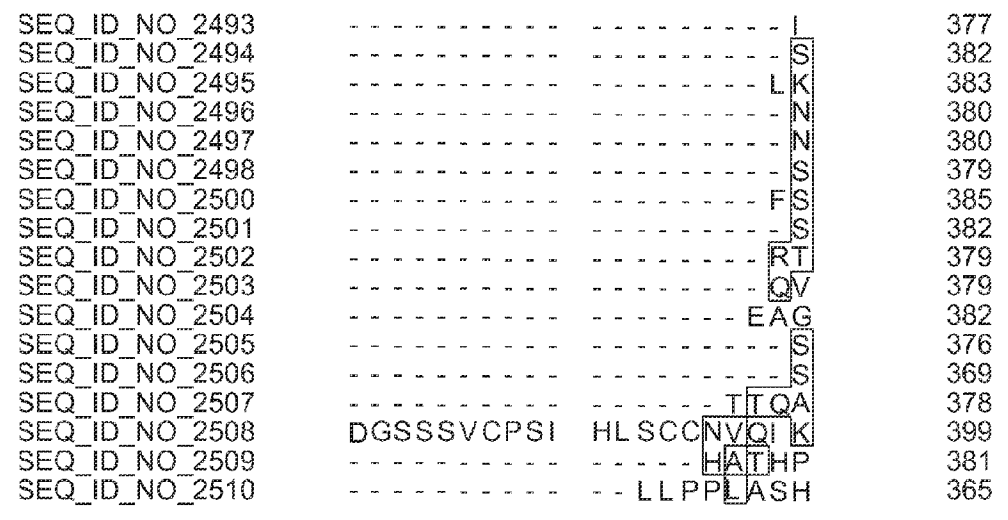

Examples of amino acid sequences of functional homologs of the polypeptide set forth in SEQ ID NO: 2493 are provided in FIG. 31 and in the Sequence Listing. Such functional homologs include, for example, GI:2262201 (SEQ ID NO:2494), GI:8919865 (SEQ ID NO:2495), GI:2108428 (SEQ ID NO:2496), GI:1848146 (SEQ ID NO:2497), GI:18496057 (SEQ ID NO:2498), CeresAnnot: 1474270 (SEQ ID NO:2500), GI:160623443 (SEQ ID NO:2501), GI:187455574 (SEQ ID NO:2502), GI:30519873 (SEQ ID NO:2503), GI:99032729 (SEQ ID NO:2504), GI:190192210 (SEQ ID NO:2505), GI:4164143 (SEQ ID NO:2506), GI:4321496 (SEQ ID NO:2507), GI:109729787 (SEQ ID NO:2508), GI:60498576 (SEQ ID NO:2509), GI:75276875 (SEQ ID NO:2510), CeresClone: 156575 (SEQ ID NO:2512), GI:9791186 (SEQ ID NO:2513), GI:9791187 (SEQ ID NO:2514), GI:15242189 (SEQ ID NO:2515), CeresClone:1101515 (SEQ ID NO:2517), GI:28316358 (SEQ ID NO:2518), GI:9650811 (SEQ ID NO:2519), GI:53139594 (SEQ ID NO:2520), GI:40233167 (SEQ ID NO:2521), GI:53139616 (SEQ ID NO:2522), GI:53139588 (SEQ ID NO:2523), GI:53139592 (SEQ ID NO:2524), GI:77632796 (SEQ ID NO:2525), GI:34013374 (SEQ ID NO:2526), GI:53139654 (SEQ ID NO:2527), GI:2108432 (SEQ ID NO:2528), GI:53139590 (SEQ ID NO:2529), GI:160623445 (SEQ ID NO:2530), GI:53139610 (SEQ ID NO:2531), CeresClone:1842451 (SEQ ID NO:2533), GI:53139612 (SEQ ID NO:2534), GI:4164141 (SEQ ID NO:2535), GI:3327245 (SEQ ID NO:2536), CeresClone:624633 (SEQ ID NO:2538), GI:158392463 (SEQ ID NO:2539), GI:3402332 (SEQ ID NO:2540), GI:169403818 (SEQ ID NO:2541), GI:27124556 (SEQ ID NO:2542), CeresAnnot:1497117 (SEQ ID NO:2544), GI:190192208 (SEQ ID NO:2545), GI:12231168 (SEQ ID NO:2546), GI:21322508 (SEQ ID NO:2547), GI:51011360 (SEQ ID NO:2548), CeresAnnot: 8461546 (SEQ ID NO:2550), GI:10800976 (SEQ ID NO:2551), CeresAnnot:1524411 (SEQ ID NO:2553), CeresAnnot:881675 (SEQ ID NO:2555), GI:1144390 (SEQ ID NO:2556), GI:9971219 (SEQ ID NO:2557), GI:3327247 (SEQ ID NO:2558), CeresClone:818172 (SEQ ID NO:2560), CeresClone:329121 (SEQ ID NO:2562), and CeresAnnot:8631464 (SEQ ID NO:2564). In some cases, a functional homolog of SEQ ID NO: 2493 has an amino acid sequence with at least 45% sequence identity, e.g., 50%, 52%, 56%, 59%, 61%, 65%, 70%, 75%, 80%, 85%, 90%, 95%, 97%, 98%, or 99% sequence identity, to the amino acid sequence set forth in SEQ ID NO: 2493. In some cases, a functional homolog of SEQ ID NO: 2493 has an amino acid sequence with at least 45% sequence identity, e.g., 50%, 52%, 56%, 59%, 61%, 65%, 70%, 75%, 80%, 85%, 90%, 95%, 97%, 98%, or 99% sequence identity, to one or more functional homologs of SEQ ID NO: 2493 described above or set forth in the Sequence Listing.

Figure 32C:
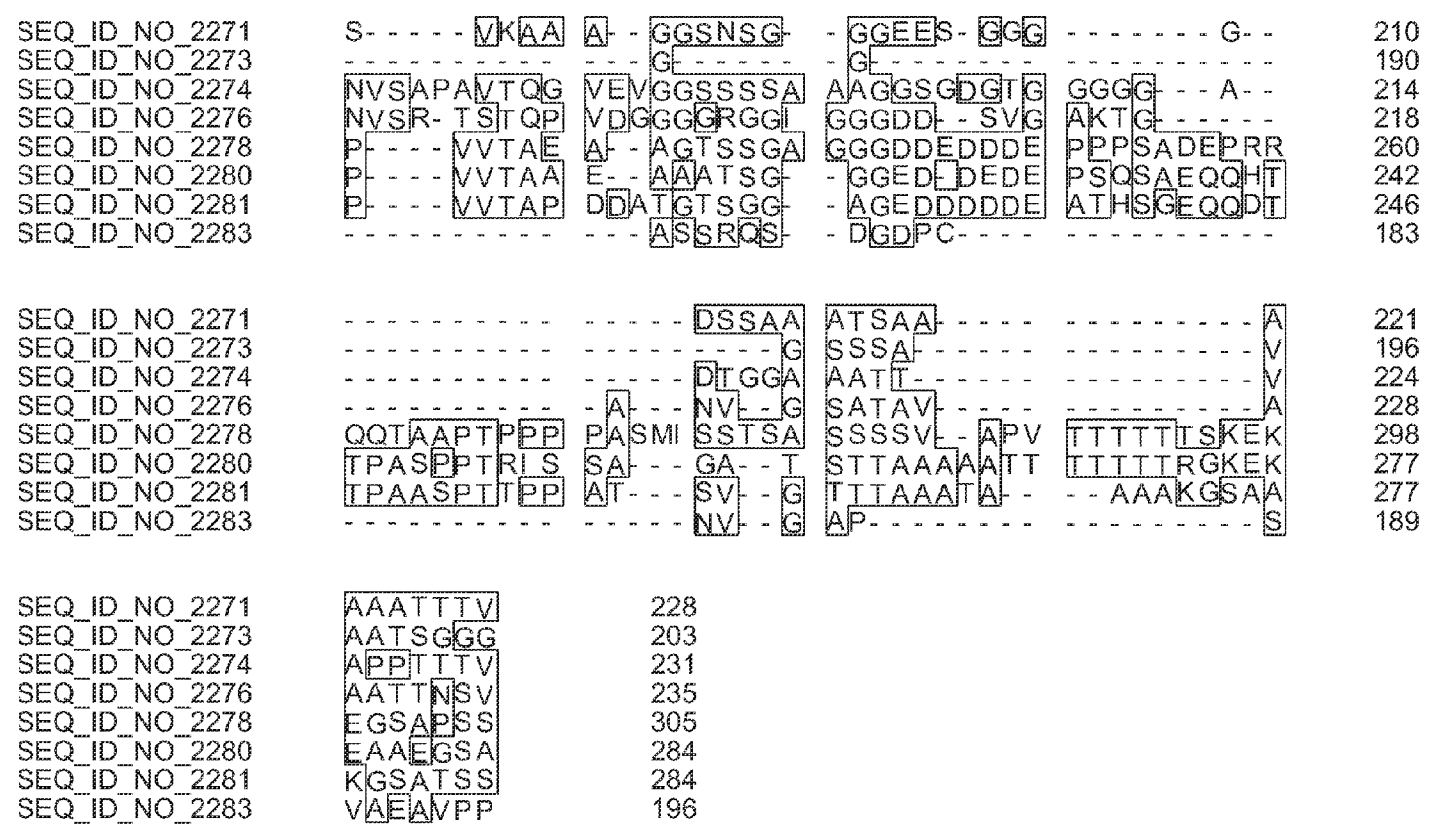

Examples of amino acid sequences of functional homologs of the polypeptide set forth in SEQ ID NO: 2271 are provided in FIG. 32 and in the Sequence Listing. Such functional homologs include, for example, CeresClone: 1245717 (SEQ ID NO:2273), GI:147768778 (SEQ ID NO:2274), CeresClone:1855399 (SEQ ID NO:2276), CeresClone:281322 (SEQ ID NO:2278), CeresClone:1048839 (SEQ ID NO:2280), GI:115463333 (SEQ ID NO:2281), CeresClone:28780 (SEQ ID NO:2283), CeresAnnot: 1461298 (SEQ ID NO:2285), GI:225434496 (SEQ ID NO:2286), CeresClone:1942084 (SEQ ID NO:2288), CeresClone:662149 (SEQ ID NO:2290), CeresClone:100901314 (SEQ ID NO:2292), CeresAnnot:1373087 (SEQ ID NO:2294), CeresClone:1118987 (SEQ ID NO:2296), GI:125543059 (SEQ ID NO:2297), CeresClone:1073674 (SEQ ID NO:2299), CeresClone:100846865 (SEQ ID NO:2301), CeresClone:240797 (SEQ ID NO:2303), CeresClone:1797203 (SEQ ID NO:2305), CeresAnnot:8733177 (SEQ ID NO:2307), CeresAnnot:8669372 (SEQ ID NO:2309), CeresClone:100867501 (SEQ ID NO:2311), CeresClone:2012696 (SEQ ID NO:2313), GI:51038155 (SEQ ID NO:2314), CeresClone:2004419 (SEQ ID NO:2316), GI:125552681 (SEQ ID NO:2317), GI:115449465 (SEQ ID NO:2318), CeresClone:773100 (SEQ ID NO:2320), CeresAnnot:8670506 (SEQ ID NO:2322), CeresClone:298827 (SEQ ID NO:2324), CeresAnnot:1442133 (SEQ ID NO:2326), GI:225444171 (SEQ ID NO:2327), CeresClone:1386592 (SEQ ID NO:2329), CeresAnnot:1467194 (SEQ ID NO:2331), CeresAnnot: 8680326 (SEQ ID NO:2333), CeresAnnot:1469591 (SEQ ID NO:2335), CeresClone:1790902 (SEQ ID NO:2337), CeresAnnot:1484626 (SEQ ID NO:2339), CeresAnnot: 8635017 (SEQ ID NO:2341), GI:115459426 (SEQ ID NO:2342), CeresClone:660540 (SEQ ID NO:2344), GI:125590992 (SEQ ID NO:2345), CeresClone:100873191 (SEQ ID NO:2347), GI:47847657 (SEQ ID NO:2348), GI:259490587 (SEQ ID NO:2349), CeresClone:1464359 (SEQ ID NO:2351), CeresClone:1988960 (SEQ ID NO:2353), CeresClone:100871850 (SEQ ID NO:2355), CeresClone:34761 (SEQ ID NO:2357), CeresClone:964932 (SEQ ID NO:2359), CeresClone:1288341 (SEQ ID NO:2361), CeresClone:916104 (SEQ ID NO:2363), CeresAnnot:8701919 (SEQ ID NO:2365), CeresAnnot:828846 (SEQ ID NO:2367), GI:116780542 (SEQ ID NO:2368), GI:212723306 (SEQ ID NO:2369), CeresAnnot:856813 (SEQ ID NO:2371), CeresClone:2010260 (SEQ ID NO:2373), CeresClone:662956 (SEQ ID NO:2375), CeresAnnot:1459517 (SEQ ID NO:2377), CeresClone:1994588 (SEQ ID NO:2379), CeresClone:571893 (SEQ ID NO:2381), CeresClone:572195 (SEQ ID NO:2383), CeresClone:1990206 (SEQ ID NO:2385), GI:115444445 (SEQ ID NO:2386), CeresClone:1461999 (SEQ ID NO:2388), CeresClone:1884986 (SEQ ID NO:2390), GI:125580940 (SEQ ID NO:2391), CeresClone:625781 (SEQ ID NO:2393), CeresAnnot:8454580 (SEQ ID NO:2395), CeresClone:1457623 (SEQ ID NO:2397), CeresAnnot: 853637 (SEQ ID NO:2399), GI:147795605 (SEQ ID NO:2400), CeresAnnot:1482911 (SEQ ID NO:2402), CeresAnnot:861920 (SEQ ID NO:2404), GI:147776506 (SEQ ID NO:2405), CeresAnnot:839537 (SEQ ID NO:2407), CeresAnnot:8453882 (SEQ ID NO:2409), CeresClone: 1987520 (SEQ ID NO:2411), CeresAnnot:1466494 (SEQ ID NO:2413), CeresAnnot:870022 (SEQ ID NO:2415), CeresAnnot:8744064 (SEQ ID NO:2417), CeresClone: 1848017 (SEQ ID NO:2419), CeresClone:1650005 (SEQ ID NO:2421), and CeresAnnot:1449022 (SEQ ID NO:2423). In some cases, a functional homolog of SEQ ID NO: 2271 has an amino acid sequence with at least 45% sequence identity, e.g., 50%, 52%, 56%, 59%, 61%, 65%, 70%, 75%, 80%, 85%, 90%, 95%, 97%, 98%, or 99% sequence identity, to the amino acid sequence set forth in SEQ ID NO: 2271. In some cases, a functional homolog of SEQ ID NO: 2271 has an amino acid sequence with at least 45% sequence identity, e.g., 50%, 52%, 56%, 59%, 61%, 65%, 70%, 75%, 80%, 85%, 90%, 95%, 97%, 98%, or 99% sequence identity, to one or more functional homologs of SEQ ID NO: 2271 described above or set forth in the Sequence Listing.

Examples of amino acid sequences of functional homologs of the polypeptide set forth in SEQ ID NO: 1741 are provided in FIG. 33 and in the Sequence Listing. Such functional homologs include, for example, CeresAnnot: 1482536 (SEQ ID NO:1743), CeresClone:1842825 (SEQ ID NO:1745), CeresClone:463157 (SEQ ID NO:1747), GI:186915025 (SEQ ID NO:1748), GI:197726026 (SEQ ID NO:1749), GI:4091806 (SEQ ID NO:1750), GI:111378451 (SEQ ID NO:1751), GI:150014754 (SEQ ID NO:1752), GI:170779036 (SEQ ID NO:1753), GI:61611682 (SEQ ID NO:1754), GI:18424009 (SEQ ID NO:1755), GI:9759262 (SEQ ID NO:1756), CeresClone:1834027 (SEQ ID NO:1758), CeresAnnot:8457547 (SEQ ID NO:1760), CeresAnnot:1455741 (SEQ ID NO:1762), GI:52840166 (SEQ ID NO:1763), GI:118489345 (SEQ ID NO:1764), CeresClone:1937613 (SEQ ID NO:1766), GI:189014382 (SEQ ID NO:1767), CeresAnnot:1477832 (SEQ ID NO:1769), GI:4091804 (SEQ ID NO:1770), CeresClone:530984 (SEQ ID NO:1772), GI:116787635 (SEQ ID NO:1773), GI:3341723 (SEQ ID NO:1774), CeresClone:949 (SEQ ID NO:1776), CeresClone:17434 (SEQ ID NO:1778), GI:186911828 (SEQ ID NO:1779), GI:170779038 (SEQ ID NO:1780), GI:60459257 (SEQ ID NO:1781), GI:110277457 (SEQ ID NO:1782), GI:41323976 (SEQ ID NO:1783), CeresClone:1755065 (SEQ ID NO:1785), GI:21667485 (SEQ ID NO:1786), GI:90657642 (SEQ ID NO:1787), GI:41323978 (SEQ ID NO:1788), GI:168063317 (SEQ ID NO:1789), GI:115447239 (SEQ ID NO:1790), GI:168030717 (SEQ ID NO:1791), GI:125540249 (SEQ ID NO:1792), CeresClone:7088 (SEQ ID NO:1794), CeresClone:1996408 (SEQ ID NO:1796), CeresAnnot:8701721 (SEQ ID NO:1798), GI:66841020 (SEQ ID NO:1799), CeresAnnot:882715 (SEQ ID NO:1801), GI:21655154 (SEQ ID NO:1802), CeresClone: 1770031 (SEQ ID NO:1804), CeresClone:1559496 (SEQ ID NO:1806), CeresAnnot:8680182 (SEQ ID NO:1808), GI:15242402 (SEQ ID NO:1809), and GI:108859363 (SEQ ID NO:1810). In some cases, a functional homolog of SEQ ID NO: 1741 has an amino acid sequence with at least 45% sequence identity, e.g., 50%, 52%, 56%, 59%, 61%, 65%, 70%, 75%, 80%, 85%, 90%, 95%, 97%, 98%, or 99% sequence identity, to the amino acid sequence set forth in SEQ ID NO: 1741. In some cases, a functional homolog of SEQ ID NO: 1741 has an amino acid sequence with at least 45% sequence identity, e.g., 50%, 52%, 56%, 59%, 61%, 65%, 70%, 75%, 80%, 85%, 90%, 95%, 97%, 98%, or 99% sequence identity, to one or more functional homologs of SEQ ID NO: 1741 described above or set forth in the Sequence Listing.

Examples of amino acid sequences of functional homologs of the polypeptide set forth in SEQ ID NO: 1980 are provided in FIG. 34 and in the Sequence Listing. Such functional homologs include, for example, CeresAnnot: 1472114 (SEQ ID NO:1982), CeresClone:1058242 (SEQ ID NO:1984), GI:147772269 (SEQ ID NO:1985), GI:116784922 (SEQ ID NO:1986), CeresAnnot:1525524 (SEQ ID NO:1988), CeresAnnot:1453309 (SEQ ID NO:1990), GI:118481810 (SEQ ID NO:1991), CeresAnnot: 826234 (SEQ ID NO:1993), CeresAnnot:1466045 (SEQ ID NO:1995), CeresClone:1248956 (SEQ ID NO:1997), CeresClone:1650911 (SEQ ID NO:1999), CeresAnnot:1495956 (SEQ ID NO:2001), CeresClone:2008765 (SEQ ID NO:2003), CeresClone:100817949 (SEQ ID NO:2005), CeresClone:100821842 (SEQ ID NO:2007), CeresClone: 2001181 (SEQ ID NO:2009), CeresClone:2030722 (SEQ ID NO:2011), CeresClone:343585 (SEQ ID NO:2013), CeresClone:1869093 (SEQ ID NO:2015), CeresClone:1790958 (SEQ ID NO:2017), CeresAnnot:1489440 (SEQ ID NO:2019), CeresClone:1657593 (SEQ ID NO:2021), CeresAnnot:887360 (SEQ ID NO:2023), GI:225446539 (SEQ ID NO:2024), GI:225446539 (SEQ ID NO:2025), GI:116793199 (SEQ ID NO:2026), GI:125557245 (SEQ ID NO:2027), CeresClone:603590 (SEQ ID NO:2029), CeresClone:981503 (SEQ ID NO:2031), and CeresClone: 1919739 (SEQ ID NO:2033). In some cases, a functional homolog of SEQ ID NO: 1980 has an amino acid sequence with at least 45% sequence identity, e.g., 50%, 52%, 56%, 59%, 61%, 65%, 70%, 75%, 80%, 85%, 90%, 95%, 97%, 98%, or 99% sequence identity, to the amino acid sequence set forth in SEQ ID NO: 1980. In some cases, a functional homolog of SEQ ID NO: 1980 has an amino acid sequence with at least 45% sequence identity, e.g., 50%, 52%, 56%, 59%, 61%, 65%, 70%, 75%, 80%, 85%, 90%, 95%, 97%, 98%, or 99% sequence identity, to one or more functional homologs of SEQ ID NO: 1980 described above or set forth in the Sequence Listing.

Examples of amino acid sequences of functional homologs of the polypeptide set forth in SEQ ID NO: 1812 are provided in FIG. 35 and in the Sequence Listing. Such functional homologs include, for example, CeresClone: 1073884 (SEQ ID NO:1814), GI:224127226 (SEQ ID NO:1815), CeresClone:544072 (SEQ ID NO:1817), CeresClone:1974604 (SEQ ID NO:1819), CeresClone:339870 (SEQ ID NO:1821), GI:55976189 (SEQ ID NO:1822), CeresClone:1724322 (SEQ ID NO:1824), CeresClone: 1072407 (SEQ ID NO:1826), GI:77999273 (SEQ ID NO:1827), GI:158513203 (SEQ ID NO:1828), GI:116778980 (SEQ ID NO:1829), GI:18404552 (SEQ ID NO:1830), CeresClone:21756 (SEQ ID NO:1832), CeresClone:1894842 (SEQ ID NO:1834), GI:118483391 (SEQ ID NO:1835), CeresAnnot:8460689 (SEQ ID NO:1837), CeresClone:278897 (SEQ ID NO:1839), GI:224121940 (SEQ ID NO:1840), GI:118484032 (SEQ ID NO:1841), CeresClone:1726573 (SEQ ID NO:1843), GI:115441607 (SEQ ID NO:1844), CeresClone:1833880 (SEQ ID NO:1846), GI:21952858 (SEQ ID NO:1847), CeresAnnot: 1480607 (SEQ ID NO:1849), CeresClone:1614435 (SEQ ID NO:1851), GI:168062894 (SEQ ID NO:1852), CeresClone: 1729334 (SEQ ID NO:1854), CeresClone:1921953 (SEQ ID NO:1856), CeresClone:1849983 (SEQ ID NO:1858), CeresAnnot:1534090 (SEQ ID NO:1860), GI:159463258 (SEQ ID NO:1861), GI:6094086 (SEQ ID NO:1862), GI:6094085 (SEQ ID NO:1863), CeresClone:2023733 (SEQ ID NO:1865), GI:145354281 (SEQ ID NO:1866), GI:116055139 (SEQ ID NO:1867), GI:2500286 (SEQ ID NO:1868), GI:122050162 (SEQ ID NO:1869), GI:155966157 (SEQ ID NO:1870), GI:156388083 (SEQ ID NO:1871), GI:198420685 (SEQ ID NO:1872), GI:15293871 (SEQ ID NO:1873), GI:195999960 (SEQ ID NO:1874), GI:116007382 (SEQ ID NO:1875), GI:74829222 (SEQ ID NO:1876), GI:50344868 (SEQ ID NO:1877), GI:194769639 (SEQ ID NO:1878), GI:195355748 (SEQ ID NO:1879), GI:195437688 (SEQ ID NO:1880), GI:148230833 (SEQ ID NO:1881), GI:195164533 (SEQ ID NO:1882), GI:40642990 (SEQ ID NO:1883), GI:268530064 (SEQ ID NO:1884), GI:47215976 (SEQ ID NO:1885), GI:112983276 (SEQ ID NO:1886), GI:164690935 (SEQ ID NO:1887), GI:17534333 (SEQ ID NO:1888), GI:45360909 (SEQ ID NO:1889), GI:197632317 (SEQ ID NO:1890), GI:115723047 (SEQ ID NO:1891), GI:14591909 (SEQ ID NO:1892), GI:112907480 (SEQ ID NO:1893), GI:170049217 (SEQ ID NO:1894), GI:157105498 (SEQ ID NO:1895), GI:166796061 (SEQ ID NO:1896), GI:108862056 (SEQ ID NO:1897), GI:114557920 (SEQ ID NO:1898), GI:75076080 (SEQ ID NO:1899), GI:45383023 (SEQ ID NO:1900), GI:187609312 (SEQ ID NO:1901), GI:149626807 (SEQ ID NO:1902), GI:22758888 (SEQ ID NO:1903), GI:126305867 (SEQ ID NO:1904), GI:13592051 (SEQ ID NO:1905), GI:74845700 (SEQ ID NO:1906), GI:90991371 (SEQ ID NO:1907), GI:193627230 (SEQ ID NO:1908), GI:23956082 (SEQ ID NO:1909), GI:121701409 (SEQ ID NO:1910), GI:197128747 (SEQ ID NO:1911), GI:159145700 (SEQ ID NO:1912), GI:167206806 (SEQ ID NO:1913), GI:119495376 (SEQ ID NO:1914), GI:45185790 (SEQ ID NO:1915), GI:156089549 (SEQ ID NO:1916), GI:74848092 (SEQ ID NO:1917), GI:71030018 (SEQ ID NO:1918), GI:152031669 (SEQ ID NO:1919), GI:170783723 (SEQ ID NO:1920), GI:19577350 (SEQ ID NO:1921), GI:5007074 (SEQ ID NO:1922), GI:145240087 (SEQ ID NO:1923), GI:50294105 (SEQ ID NO:1924), GI:84995804 (SEQ ID NO:1925), GI:50306789 (SEQ ID NO:1926), GI:169861151 (SEQ ID NO:1927), GI:169763400 (SEQ ID NO:1928), GI:46136989 (SEQ ID NO:1929), GI:67517624 (SEQ ID NO:1930), GI:154294907 (SEQ ID NO:1931), GI:156044424 (SEQ ID NO:1932), GI:85098188 (SEQ ID NO:1933), GI:170586178 (SEQ ID NO:1934), GI:171694355 (SEQ ID NO:1935), GI:71021101 (SEQ ID NO:1936), GI:188572500 (SEQ ID NO:1937), GI:133003 (SEQ ID NO:1938), GI:39971465 (SEQ ID NO:1939), GI:154271618 (SEQ ID NO:1940), GI:115491879 (SEQ ID NO:1941), GI:189207733 (SEQ ID NO:1942), GI:116197729 (SEQ ID NO:1943), GI:149235570 (SEQ ID NO:1944), GI:66816906 (SEQ ID NO:1945), GI:126133112 (SEQ ID NO:1946), GI:156843920 (SEQ ID NO:1947), GI:170091820 (SEQ ID NO:1948), GI:167519038 (SEQ ID NO:1949), GI:70995808 (SEQ ID NO:1950), GI:154344695 (SEQ ID NO:1951), GI:119181612 (SEQ ID NO:1952), and GI:72547732 (SEQ ID NO:1953). In some cases, a functional homolog of SEQ ID NO: 1812 has an amino acid sequence with at least 45% sequence identity, e.g., 50%, 52%, 56%, 59%, 61%, 65%, 70%, 75%, 80%, 85%, 90%, 95%, 97%, 98%, or 99% sequence identity, to the amino acid sequence set forth in SEQ ID NO: 1812. In some cases, a functional homolog of SEQ ID NO: 1812 has an amino acid sequence with at least 45% sequence identity, e.g., 50%, 52%, 56%, 59%, 61%, 65%, 70%, 75%, 80%, 85%, 90%, 95%, 97%, 98%, or 99% sequence identity, to one or more functional homologs of SEQ ID NO: 1812 described above or set forth in the Sequence Listing.

Figure 36A:
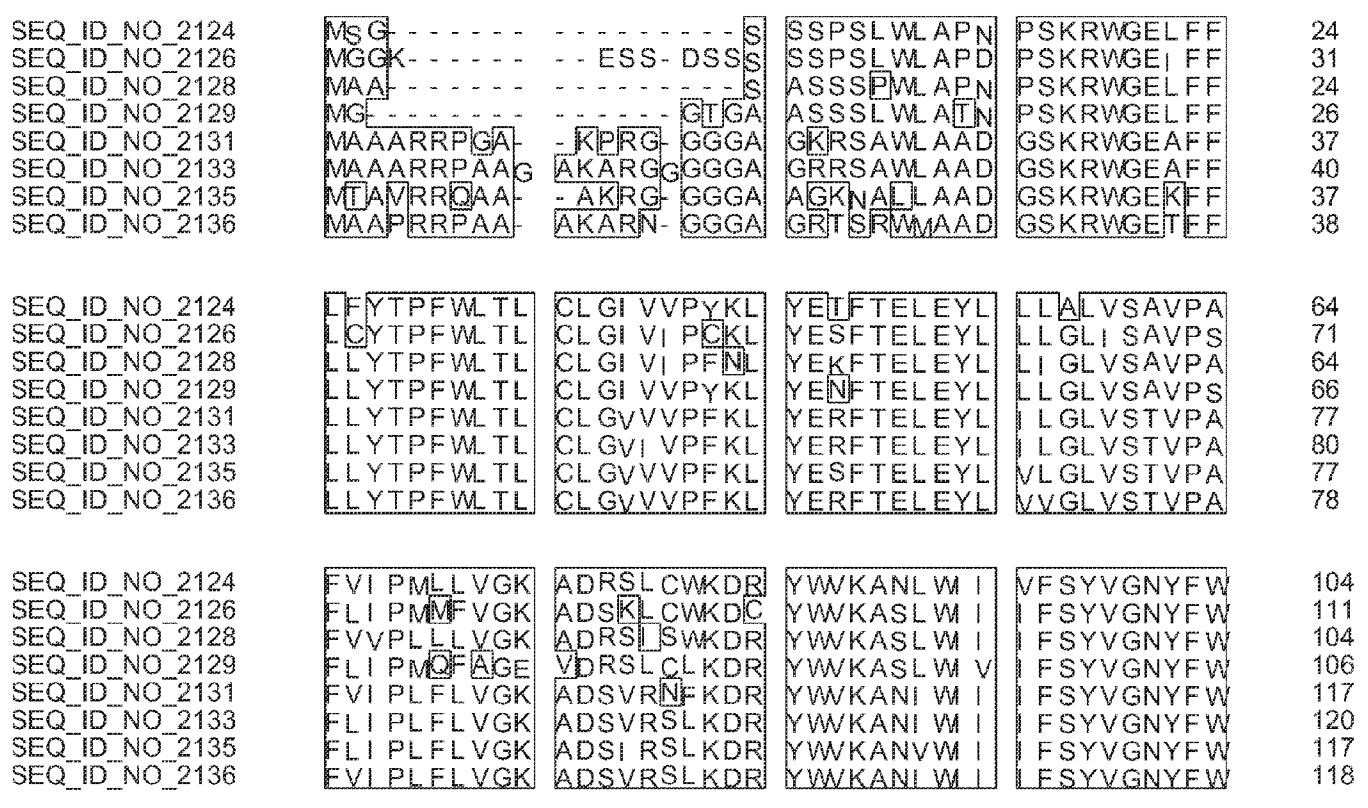
Figure 36B:
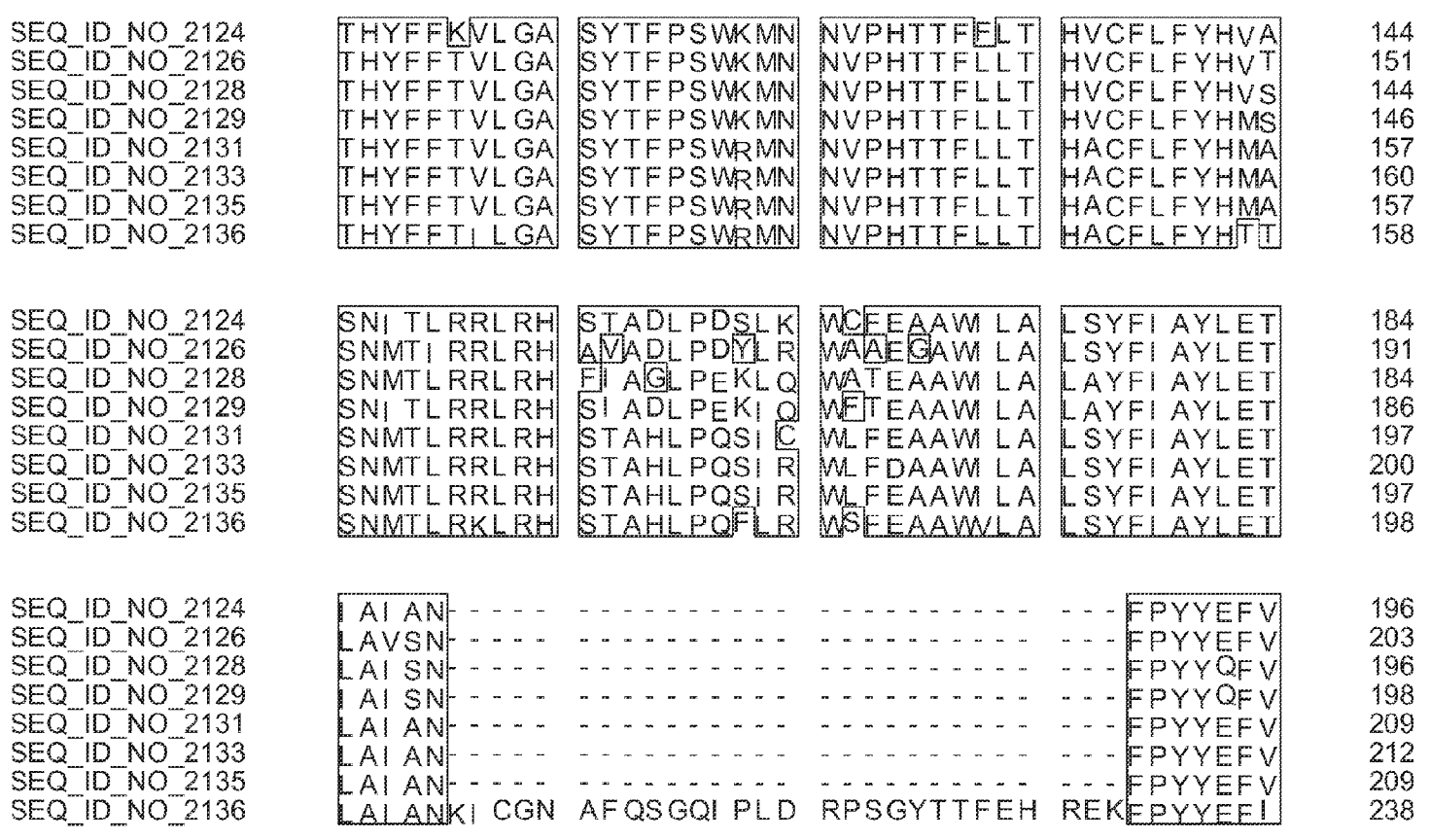

Examples of amino acid sequences of functional homologs of the polypeptide set forth in SEQ ID NO: 2124 are provided in FIG. 36 and in the Sequence Listing. Such functional homologs include, for example, CeresAnnot: 1527229 (SEQ ID NO:2126), CeresClone:716942 (SEQ ID NO:2128), GI:225456280 (SEQ ID NO:2129), CeresClone: 285554 (SEQ ID NO:2131), CeresClone:1818640 (SEQ ID NO:2133), CeresClone:904080 (SEQ ID NO:2135), GI:125534155 (SEQ ID NO:2136), GI:62320905 (SEQ ID NO:2137), CeresAnnot:8724644 (SEQ ID NO:2139), CeresAnnot:8724715 (SEQ ID NO:2141), GI:62732798 (SEQ ID NO:2142), CeresAnnot:1473809 (SEQ ID NO:2144), GI:168012270 (SEQ ID NO:2145), GI:159479658 (SEQ ID NO:2146), GI:116057462 (SEQ ID NO:2147), GI:66827159 (SEQ ID NO:2148), GI:297792349 (SEQ ID NO:2592), GI:209976078 (SEQ ID NO:2593), GI:242086735 (SEQ ID NO:2594), GI:255647881 (SEQ ID NO:2595), GI:217073736 (SEQ ID NO:2596), GI:302846059 (SEQ ID NO:2597), GI:302763909 (SEQ ID NO:2598), GI:323454458 (SEQ ID NO:2599), GI:298707227 (SEQ ID NO:2600), GI:303282359 (SEQ ID NO:2601), and GI:219128011 (SEQ ID NO:2602). In some cases, a functional homolog of SEQ ID NO: 2124 has an amino acid sequence with at least 45% sequence identity, e.g., 50%, 52%, 56%, 59%, 61%, 65%, 70%, 75%, 80%, 85%, 90%, 95%, 97%, 98%, or 99% sequence identity, to the amino acid sequence set forth in SEQ ID NO: 2124. In some cases, a functional homolog of SEQ ID NO: 2124 has an amino acid sequence with at least 45% sequence identity, e.g., 50%, 52%, 56%, 59%, 61%, 65%, 70%, 75%, 80%, 85%, 90%, 95%, 97%, 98%, or 99% sequence identity, to one or more functional homologs of SEQ ID NO: 2124 described above or set forth in the Sequence Listing.

Figure 37A:
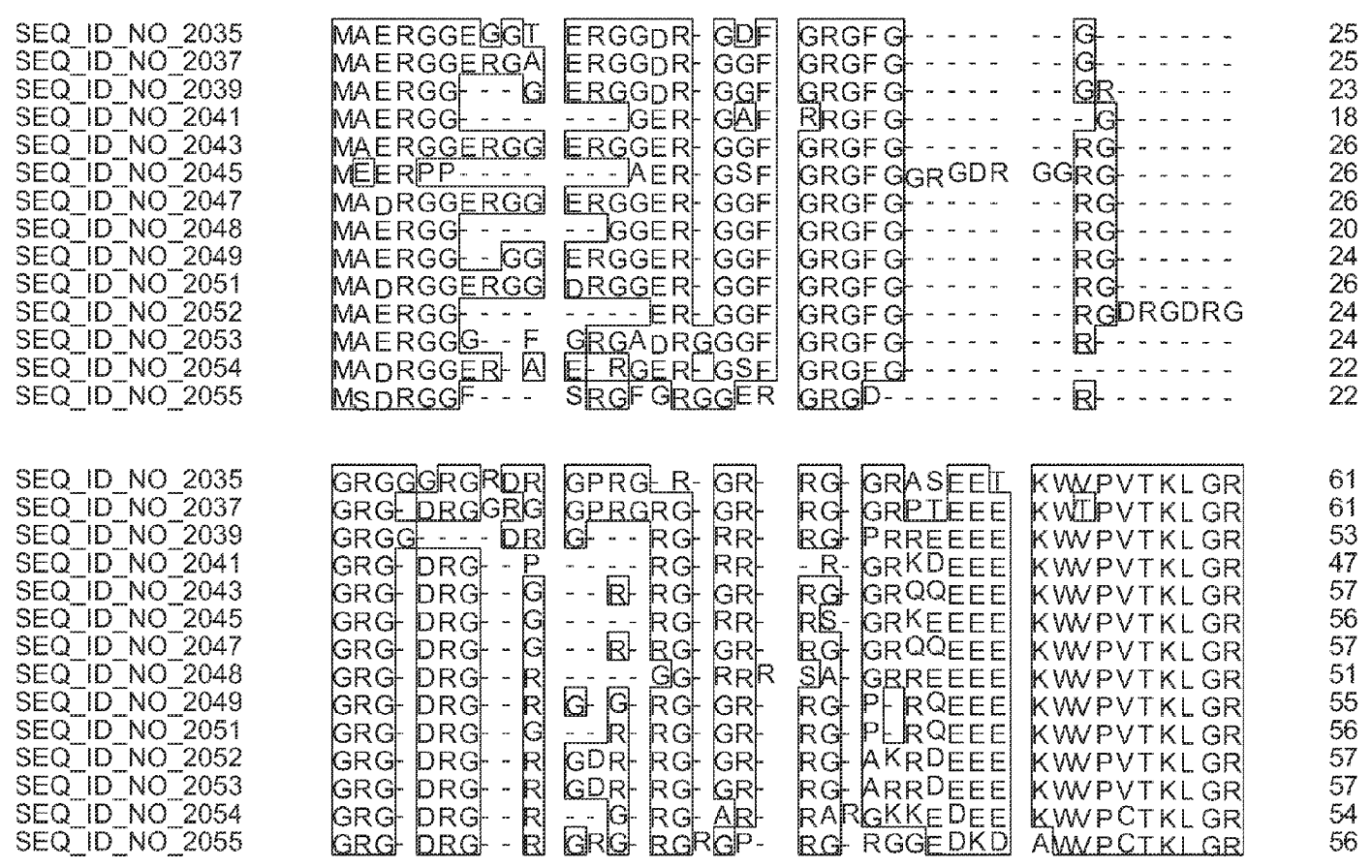

Examples of amino acid sequences of functional homologs of the polypeptide set forth in SEQ ID NO: 2035 are provided in FIG. 37 and in the Sequence Listing. Such functional homologs include, for example, CeresClone: 1070374 (SEQ ID NO:2037), CeresClone:1619978 (SEQ ID NO:2039), CeresClone:1869432 (SEQ ID NO:2041), CeresClone:295792 (SEQ ID NO:2043), CeresAnnot:1474944 (SEQ ID NO:2045), CeresClone:1819159 (SEQ ID NO:2047), GI:225441799 (SEQ ID NO:2048), GI:34393314 (SEQ ID NO:2049), CeresClone:1320533 (SEQ ID NO:2051), GI:168002136 (SEQ ID NO:2052), GI:116791016 (SEQ ID NO:2053), GI:159462880 (SEQ ID NO:2054), GI:116055788 (SEQ ID NO:2055), GI:15217951 (SEQ ID NO:2056), GI:21539457 (SEQ ID NO:2057), CeresClone:17415 (SEQ ID NO:2059), CeresClone:101250 (SEQ ID NO:2061), CeresClone:1243814 (SEQ ID NO:2063), CeresClone:1840067 (SEQ ID NO:2065), CeresClone:1853717 (SEQ ID NO:2067), CeresAnnot:1506849 (SEQ ID NO:2069), CeresClone:1895361 (SEQ ID NO:2071), CeresClone:1793726 (SEQ ID NO:2073), CeresClone:1448380 (SEQ ID NO:2075), CeresAnnot:1453696 (SEQ ID NO:2077), CeresClone:1725377 (SEQ ID NO:2079), GI:115456089 (SEQ ID NO:2080), CeresAnnot:8632056 (SEQ ID NO:2082), CeresClone: 100058895 (SEQ ID NO:2084), CeresClone:100925979 (SEQ ID NO:2086), CeresClone:841942 (SEQ ID NO:2088), CeresClone:1776801 (SEQ ID NO:2090), CeresClone:1732292 (SEQ ID NO:2092), GI:116780779 (SEQ ID NO:2093), CeresAnnot:1492957 (SEQ ID NO:2095), CeresClone:1073758 (SEQ ID NO:2097), GI:145355259 (SEQ ID NO:2098), CeresClone:2004511 (SEQ ID NO:2100), GI:126335470 (SEQ ID NO:2101), GI:148232341 (SEQ ID NO:2102), GI:213512306 (SEQ ID NO:2103), GI:74151470 (SEQ ID NO:2104), GI:124221922 (SEQ ID NO:2105), GI:56118428 (SEQ ID NO:2106), GI:47086117 (SEQ ID NO:2107), GI:114647215 (SEQ ID NO:2108), GI:91081061 (SEQ ID NO:2109), GI:47218049 (SEQ ID NO:2110), GI:90991375 (SEQ ID NO:2111), GI:72010709 (SEQ ID NO: 2112), GI:37577051 (SEQ ID NO:2113), GI:157125338 (SEQ ID NO:2114), GI:62083451 (SEQ ID NO:2115), GI:156404514 (SEQ ID NO:2116), GI:159145750 (SEQ ID NO:2117), GI:196000424 (SEQ ID NO:2118), GI:1350976 (SEQ ID NO:2119), GI:48103127 (SEQ ID NO:2120), GI:156550181 (SEQ ID NO:2121), and GI:56417564 (SEQ ID NO:2122). In some cases, a functional homolog of SEQ ID NO: 2035 has an amino acid sequence with at least 45% sequence identity, e.g., 50%, 52%, 56%, 59%, 61%, 65%, 70%, 75%, 80%, 85%, 90%, 95%, 97%, 98%, or 99% sequence identity, to the amino acid sequence set forth in SEQ ID NO: 2035. In some cases, a functional homolog of SEQ ID NO: 2035 has an amino acid sequence with at least 45% sequence identity, e.g., 50%, 52%, 56%, 59%, 61%, 65%, 70%, 75%, 80%, 85%, 90%, 95%, 97%, 98%, or 99% sequence identity, to one or more functional homologs of SEQ ID NO: 2035 described above or set forth in the Sequence Listing.

Examples of amino acid sequences of functional homologs of the polypeptide set forth in SEQ ID NO: 2425 are provided in FIG. 38 and in the Sequence Listing. Such functional homologs include, for example, GI:225424885 (SEQ ID NO:2426), CeresAnnot:1513435 (SEQ ID NO:2428), CeresAnnot:8458807 (SEQ ID NO:2430), GI:115489782 (SEQ ID NO:2431), CeresAnnot:8633356 (SEQ ID NO:2433), CeresAnnot:868948 (SEQ ID NO:2435), CeresClone:1381517 (SEQ ID NO:2437), GI:12325237 (SEQ ID NO:2438), GI:186478915 (SEQ ID NO:2439), GI:125537558 (SEQ ID NO:2440), CeresClone:1863500 (SEQ ID NO:2442), CeresAnnot:1468256 (SEQ ID NO:2444), GI:225456647 (SEQ ID NO:2445), CeresClone:792606 (SEQ ID NO:2447), CeresClone:1576419 (SEQ ID NO:2449), CeresAnnot:8723986 (SEQ ID NO:2451), CeresAnnot:1521620 (SEQ ID NO:2453), CeresClone:1570203 (SEQ ID NO:2455), CeresAnnot:1440475 (SEQ ID NO:2457), CeresAnnot:8644892 (SEQ ID NO:2459), CeresClone:1529998 (SEQ ID NO:2461), CeresClone:1823719 (SEQ ID NO:2463), GI:115489780 (SEQ ID NO:2464), GI:11933400 (SEQ ID NO:2465), GI:115454673 (SEQ ID NO:2466), GI:11933397 (SEQ ID NO:2467), GI:15221883 (SEQ ID NO:2468), CeresAnnot:1493344 (SEQ ID NO:2470), CeresAnnot:874402 (SEQ ID NO:2472), CeresAnnot:1475704 (SEQ ID NO:2474), CeresAnnot:8703346 (SEQ ID NO:2476), CeresAnnot:1455393 (SEQ ID NO:2478), GI:145358511 (SEQ ID NO:2479), CeresAnnot:1492266 (SEQ ID NO:2481), GI:225429973 (SEQ ID NO:2482), CeresClone:1944137 (SEQ ID NO:2484), GI:115440087 (SEQ ID NO:2485), CeresAnnot:875119 (SEQ ID NO:2487), GI:125527793 (SEQ ID NO:2488), GI:116788004 (SEQ ID NO:2489), GI:15391731 (SEQ ID NO:2490), and GI:168064734 (SEQ ID NO:2491). In some cases, a functional homolog of SEQ ID NO: 2425 has an amino acid sequence with at least 45% sequence identity, e.g., 50%, 52%, 56%, 59%, 61%, 65%, 70%, 75%, 80%, 85%, 90%, 95%, 97%, 98%, or 99% sequence identity, to the amino acid sequence set forth in SEQ ID NO: 2425. In some cases, a functional homolog of SEQ ID NO: 2425 has an amino acid sequence with at least 45% sequence identity, e.g., 50%, 52%, 56%, 59%, 61%, 65%, 70%, 75%, 80%, 85%, 90%, 95%, 97%, 98%, or 99% sequence identity, to one or more functional homologs of SEQ ID NO: 2425 described above or set forth in the Sequence Listing.

The identification of conserved regions in a biomass-modulating polypeptide facilitates production of variants of biomass-modulating polypeptides. Variants of biomass-modulating polypeptides typically have 10 or fewer conservative amino acid substitutions within the primary amino acid sequence, e.g., 7 or fewer conservative amino acid substitutions, 5 or fewer conservative amino acid substitutions, or between 1 and 5 conservative substitutions. A useful variant polypeptide can be constructed based on one of the alignments set forth in FIG. 1, FIG. 2, FIG. 3, FIG. 4, FIG. 5, FIG. 6, FIG. 7, FIG. 8, FIG. 9, FIG. 10, FIG. 11, FIG. 12, FIG. 13, FIG. 14, FIG. 15, FIG. 16, FIG. 17, FIG. 18, FIG. 19, FIG. 20, FIG. 21, FIG. 22, FIG. 23, FIG. 24, FIG. 25, FIG. 26, FIG. 27, FIG. 28, FIG. 29, FIG. 30, FIG. 31, FIG. 32, FIG. 33, FIG. 34, FIG. 35, FIG. 36, FIG. 37, or FIG. 38 and/or homologs identified in the Sequence Listing. Such a polypeptide includes the conserved regions, arranged in the order depicted in the Figure from amino-terminal end to carboxy-terminal end. Such a polypeptide may also include zero, one, or more than one amino acid in positions marked by dashes. When no amino acids are present at positions marked by dashes, the length of such a polypeptide is the sum of the amino acid residues in all conserved regions. When amino acids are present at a position marked by dashes, such a polypeptide has a length that is the sum of the amino acid residues in all conserved regions and all dashes.

C. Functional Homologs Identified by HMMER

In some embodiments, useful biomass-modulating polypeptides include those that fit a Hidden Markov Model based on the polypeptides set forth in any one of FIGS. 1-25. A Hidden Markov Model (HMM) is a statistical model of a consensus sequence for a group of functional homologs. See, Durbin et al., *Biological Sequence Analysis: Probabilistic Models of Proteins and Nucleic Acids*, Cambridge University Press, Cambridge, UK (1998). An HMM is generated by the program HMMER 2.3.2 with default program parameters, using the sequences of the group of functional homologs as input. The multiple sequence alignment is generated by ProbCons (Do et al., Genome Res., 15(2):330-40 (2005)) version 1.11 using a set of default parameters: -c, -consistency REPS of 2; -ir, -iterative-refinement REPS of 100; -pre, -pre-training REPS of 0. ProbCons is a public domain software program provided by Stanford University.

The default parameters for building an HMM (hmmbuild) are as follows: the default "architecture prior" (archpri) used by MAP architecture construction is 0.85, and the default cutoff threshold (idlevel) used to determine the effective sequence number is 0.62. HMMER 2.3.2 was released Oct. 3, 2003 under a GNU general public license, and is available from various sources on the World Wide Web such as hmmer.janelia.org; hmmer.wustl.edu; and fr.com/hmmer232/. Hmmbuild outputs the model as a text file.

The HMM for a group of functional homologs can be used to determine the likelihood that a candidate biomass-modulating polypeptide sequence is a better fit to that particular HMM than to a null HMM generated using a group of sequences that are not structurally or functionally related. The likelihood that a candidate polypeptide sequence is a better fit to an HMM than to a null HMM is indicated by the HMM bit score, a number generated when the candidate sequence is fitted to the HMM profile using the HMMER hmmsearch program. The following default parameters are used when running hmmsearch: the default E-value cutoff (E) is 10.0, the default bit score cutoff (T) is negative infinity, the default number of sequences in a database (Z) is the real number of sequences in the database, the default E-value cutoff for the per-domain ranked hit list (domE) is infinity, and the default bit score cutoff for the per-domain ranked hit list (domT) is negative infinity. A high HMM bit score indicates a greater likelihood that the candidate sequence carries out one or more of the biochemical or physiological function(s) of the polypeptides used to generate the HMM. A high HMM bit score is at least 20, and often is higher. Slight variations in the HMM bit score of a particular sequence can occur due to factors such as the order in which sequences are processed for alignment by multiple sequence alignment algorithms such as the Prob-Cons program. Nevertheless, such HMM bit score variation is minor.

The biomass-modulating polypeptides discussed below fit the indicated HMM with an HMM bit score greater than to 65 (e.g., greater than 70, 80, 90, 100, 120, 140, 200, 300, 500, 1000, 1500, or 2000). In some embodiments, the HMM bit score of a biomass-modulating polypeptide discussed below is about 50%, 60%, 70%, 80%, 90%, or 95% of the HMM bit score of a functional homolog provided in the Sequence Listing of this application. In some embodiments, a biomass-modulating polypeptide discussed below fits the indicated HMM with an HMM bit score greater than 210, and has a domain indicative of a biomass-modulating polypeptide. In some embodiments, a biomass-modulating polypeptide discussed below fits the indicated HMM with an HMM bit score greater than 210, and has 65% or greater sequence identity (e.g., 75%, 80%, 85%, 90%, 95%, or 100% sequence identity) to an amino acid sequence shown in any one of FIGS. 1-38.

Examples of polypeptides are shown in the sequence listing that have HMM bit scores greater than 700 (e.g., greater than 800) when fitted to an HMM generated from the amino acid sequences set forth in FIG. 1 are identified in the Sequence Listing of this application. Such polypeptides include, for example, SEQ ID NOs: 1333, 1334, 1335, 1336, 1337, 1339, 1341, 1343, 1345, 1347, 1348, 1349, 1350, 1352, 1354, 1356, 1358, 1360, 1362, and 1364.

Examples of polypeptides are shown in the sequence listing that have HMM bit scores greater than 450 (e.g., greater than 500, 600, 700, 800, 900, 1000, 1100, 1200, 1300, or 1400) when fitted to an HMM generated from the amino acid sequences set forth in FIG. 2 are identified in the Sequence Listing of this application. Such polypeptides include, for example, SEQ ID NOs: 1489, 1491, 1492, 1493, 1495, 1496, 1498, 1499, 1501, 1503, 1504, 1506, 1508, 1510, 1511, 1513, 1514, 1516, 1517, 1518, 1519, 1520, 1521, 1523, 1524, 1526, 1528, 1529, 1530, 1531, 1532, 1534, 1536, 1537, 1538, and 1539.

Examples of polypeptides are shown in the sequence listing that have HMM bit scores greater than 1200 (e.g., greater than 1300, 1400, 1500, 1600, 1700, 1800, or 1900) when fitted to an HMM generated from the amino acid sequences set forth in FIG. 3 are identified in the Sequence Listing of this application. Such polypeptides include, for example, SEQ ID NOs: 504, 506, 508, 509, 511, 512, 513, 514, 515, 516, 517, 519, 521, 522, 524, 525, 526, 527, 529, 530, 532, 533, 535, 536, 537, 539, 541, 543, 545, 546, 548, 550, 552, 553, 554, 555, 557, 558, 560, 562, 564, 566, 568, 570, 571, 572, 573, 574, 575, 576, 577, or 578.

Examples of polypeptides are shown in the sequence listing that have HMM bit scores greater than 229 (e.g., greater than 300, 400, 500, 600, or 700) when fitted to an HMM generated from the amino acid sequences set forth in FIG. 4 are identified in the Sequence Listing of this application. Such polypeptides include, for example, SEQ ID NOs: 198, 200, 202, 203, 205, 207, 208, 209, 210, 211, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, or 251.

Examples of polypeptides are shown in the sequence listing that have HMM bit scores greater than 748 (e.g., greater than 800, 900, 1000, 1100, or 1200) when fitted to an HMM generated from the amino acid sequences set forth in FIG. 5 are identified in the Sequence Listing of this application. Such polypeptides include, for example, SEQ ID NOs: 253, 255, 257, 258, 260, 261, 262, 264, 265, 267, 268, 269, 270, 271, 272, 274, 275, 276, 277, 278, 279, 281, 282, 283, 285, 287, 288, 289, 290, 291, 292, 294, 295, 296, 297, 299, 301, 303, 304, 305, 307, 309, 310, 312, 314, 316, 317, 318, 320, 321, 323, 325, 327, 328, 329, 331, 332, 334, 335, 337, 338, 339, 341, 342, 344, 345, 347, 349, 351, 353, 355, 357, 359, 361, 362, 363, 364, 365, or 366.

Examples of polypeptides are shown in the sequence listing that have HMM bit scores greater than 250 (e.g., greater than 300, 400, 500, 600, or 700) when fitted to an HMM generated from the amino acid sequences set forth in FIG. 6 are identified in the Sequence Listing of this application. Such polypeptides include, for example, SEQ ID NOs: 1541, 1542, 1544, 1545, 1547, 1548, 1550, 1552, 1553, 1555, 1556, 1557, 1558, 1559, 1561, 1563, 1564, 1565, 1567, 1568, 1570, 1571, 1573, 1575, 1576, or 1578.

Examples of polypeptides are shown in the sequence listing that have HMM bit scores greater than 490 (e.g., greater than 600, 700, 800, 900, 1000, 1100, or 1200), when fitted to an HMM generated from the amino acid sequences set forth in FIG. 7 are identified in the Sequence Listing of this application. Such polypeptides include, for example, SEQ ID NOs: 663, 665, 667, 668, 669, 670, 672, 674, 675, 677, 679, 680, 681, 682, 684, 685, 687, 689, 690, 691, 692, 694, 695, 696, 697, 698, 700, 701, 702, 703, 704, 706, 707, 709, 710, 711, 712, 713, 714, 715, 716, 717, 718, 720, 722, 724, 726, 727, 728, 730, 731, 733, 734, 735, 736, 737, 738, or 739.

Examples of polypeptides are shown in the sequence listing that have HMM bit scores greater than 534 (e.g., greater than 600, 700, 800, 900, or 1000) when fitted to an HMM generated from the amino acid sequences set forth in FIG. 8 are identified in the Sequence Listing of this application. Such polypeptides include, for example, SEQ ID NOs: 1366, 1368, 1370, 1371, 1372, 1374, 1375, 1377, 1378, 1379, 1381, 1383, 1384, 1386, 1388-1390, 1392, 1393, 1394, 1395, 1396, 1397, 1399, 1400, 1402, 1403, 1405, 1407, 1408, 1409, 1410, 1412, 1413, 1414, 1415, 1416, 1417, 1418, 1420, 1422, 1424, 1426, 1428, 1430, 1432, 1433, 1434, 1435, 1436, 1438, 1440, 1442, 1443, 1444, 1446, 1447, 1449, 1450, 1452, 1453, 1454, 1456, 1457, 1459, 1460, 1462, 1463, 1465, 1466, 1467, 1468, 1470, 1471, 1473, 1475, 1477, 1478, 1479, 1480, 1481, 1482, 1483, 1485, or 1487.

Examples of polypeptides are shown in the sequence listing that have HMM bit scores greater than 570 (e.g., greater than 600, 700, 800, 900, 1000, or 1100) when fitted to an HMM generated from the amino acid sequences set forth in FIG. 9 are identified in the Sequence Listing of this application. Such polypeptides include, for example, SEQ ID NOs: 928, 930, 932, 933, 935, 936, 937, 938, 940, 941, 943, 944, 945, 947, 949, 950, 952, 953, 954, 955, 957, 958, 959, 960, 961, 963, 965, 966, 967, 968, 969, 971, 972, 974, 975, 977, 978, 980, 982, 984, 986, 988, 990, 992, 994, 996, 998, 1000, 1001, 1002, 1003, 1004, 1005, 1006, 1007, 1008, 1009, 1010, 1011, 1012, 1013, or 1014.

Examples of polypeptides are shown in the sequence listing that have HMM bit scores greater than 830 (e.g., greater than 900, 1000, 1100, or 1200), when fitted to an HMM generated from the amino acid sequences set forth in FIG. 10 are identified in the Sequence Listing of this application. Such polypeptides include, for example, SEQ ID NOs: 1215, 217, 1218, 1219, 1220, 1221, 1223, 1224, 1225, 1226, 1227, 1228, 1230, 1231, 1233, 1234, 1235, 1236, 1237, 1238, 1239, 1240, 1241, 1243, 1245, 1247, 1249, 1250, 1251, 1252, 1254, 1255, 1257, 1258, 1259, 1261, 1263, 1264, 1266, 1267, 1268, 1269, 1270, 1271, 1272, 1274, 1275, 1276, 1278, 1280, 1282, 1283, 1284, 1285, 1286, 1288, 1289, 1291, 1292, 1293, 1294, 1295, 1296, 1297, 1298, 1299, 1300, 1301, 1302, 1303, 1304, 1305, 1306, 1307, 1308, 1309, 1310, 1311, 1312, 1313, 1314, 1315, 1316, 1317, 1318, 1319, 1320, 1321, 1322, 1323, 1324, 1325, 1326, 1327, 1328, 1329, 1330, or 1331.

Examples of polypeptides are shown in the sequence listing that have HMM bit scores greater than 1100 (e.g., greater than 1200, 1300, 1400, 1500, 1600, or 1700) when fitted to an HMM generated from the amino acid sequences set forth in FIG. 11 are identified in the Sequence Listing of this application. Such polypeptides include, for example, SEQ ID NOs: 4, 6, 7, 8, 9, 11, 13, 14, 15, 17, 18, 20, 21, 22, 23, 24, 25, 26, 27, 29, 31, 32, 33, 35, 36, 38, 39, 40, 41, 42, 43, 44, 45, 46, 47, 48, 49, 50, or 51.

Examples of polypeptides are shown in the sequence listing that have HMM bit scores greater than 364 (e.g., greater than 400 or 500) when fitted to an HMM generated from the amino acid sequences set forth in FIG. 12 are identified in the Sequence Listing of this application. Such polypeptides include, for example, SEQ ID NOs: 582, 584, 585, 587, 589, 591, 592, 594, 595, 596, 598, 600, 601, 603, 604, 606, 607, 608, 610, 611, 613, 615, 617, 619, 621, 623, 625, 626, 628, 629, 630, 631, or 632.

Examples of polypeptides are shown in the sequence listing that have HMM bit scores greater than 540 (e.g., greater than 600 or 700) when fitted to an HMM generated from the amino acid sequences set forth in FIG. 13 are identified in the Sequence Listing of this application. Such polypeptides include, for example, SEQ ID NOs: 53, 54, 56-61, 63-67, 69, 70, 72-76, 78, 80-83, 85, 86, 88-91, 93-97, 99-103, 105, 107, 109, 110, 112, 113, 115, 117, and 119-152.

Examples of polypeptides are shown in the sequence listing that have HMM bit scores greater than 451 (e.g., greater than 500 or 600) when fitted to an HMM generated from the amino acid sequences set forth in FIG. 14 are identified in the Sequence Listing of this application. Such polypeptides include, for example, SEQ ID NOs: 1112, 1114-1116, 1118, 1120-1123, 1125, 1127-1131, 1133, 1134, 1136, 1137, 1139-1145, 1147-1156, 1158-1161, 1163, 1165-1178, 1180-1188, 1190, 1191, 1193-1202, 1204, 1205-1207, 1209-1213.

Examples of polypeptides are shown in the sequence listing that have HMM bit scores greater than 283 when fitted to an HMM generated from the amino acid sequences set forth in FIG. 15 are identified in the Sequence Listing of this application. Such polypeptides include, for example, SEQ ID NOs: 634, 636, 638, 640, 642, 643, 645, 647, 649, 651, 653, 655, 657, 659, or 661.

Examples of polypeptides are shown in the sequence listing that have HMM bit scores greater than 225 (e.g., greater than 300, 400, 500, 600, 700, or 800) when fitted to an HMM generated from the amino acid sequences set forth in FIG. 16 are identified in the Sequence Listing of this application. Such polypeptides include, for example, SEQ ID NOs: 368, 370, 372, 373, 375-378, 380, 382-387, 389, 391, 393, 395, 396, 398-404, 406-414, 416, 418, 420, 421, 423, 425, 427, 429, 431, 433, 435, 437, 439, 441, 443, 445, 447, 449, 451, 453, 455, 457, 459, 461, 463, 465, 467, 469, 471, 473, 475, 477, 479, 481, 483, 485, 487, 489, 491, 493, 495, 497, 498, 499, 500, 501, or 502.

Examples of polypeptides are shown in the sequence listing that have HMM bit scores greater than 584 (e.g., greater than 600, 700, 800, 900, 1000, 1100, 1200, or 1300) when fitted to an HMM generated from the amino acid sequences set forth in FIG. 17 are identified in the Sequence Listing of this application. Such polypeptides include, for example, SEQ ID NOs: 1599, 1600, 1602-1606, 1608-1613, 1615, 1616, 1618-1626, 1628, 1629, 1631, 1633, 1634, 1636, 1637, 1639-1643, 1645, or 1646-1739.

Examples of polypeptides are shown in the sequence listing that have HMM bit scores greater than 100 when fitted to an HMM generated from the amino acid sequences set forth in FIG. 18 are identified in the Sequence Listing of this application. Such polypeptides include, for example, SEQ ID NOs: 154, 156, 158, 159, 161, 163, 165, 167, 168, 170, 172, 174, 176, 178, 180, 181, 182, 183, 184, or 185.

Examples of polypeptides are shown in the sequence listing that have HMM bit scores greater than 101 (e.g., greater than 200) when fitted to an HMM generated from the amino acid sequences set forth in FIG. 19 are identified in the Sequence Listing of this application. Such polypeptides include, for example, SEQ ID NOs: 1035, 1037, 1038, 1040, 1042, 1043, 1045, 1047, 1049, 1051, 1053, 1055, 1057, 1059, 1061, 1062, or 1063.

Examples of polypeptides are shown in the sequence listing that have HMM bit scores greater than 111 (e.g., greater than 200) when fitted to an HMM generated from the amino acid sequences set forth in FIG. 20 are identified in the Sequence Listing of this application. Such polypeptides include, for example, SEQ ID NOs: 741, 743, 745, 746, 748, 750, 752, 754, 756, 758, 760-764, 766, 768, 770, 772, 774, 776, 778, 780, 782, 784, 785, 787, 789, 791, 793-795, 797, 799, 801, 803, 805, 806, 808, 810, 812, 814, 816, 818-820, 822-824, 826, 828, 830, 832, 834, 836, 838-840, 842, 843, 845-847, or 849.

Examples of polypeptides are shown in the sequence listing that have HMM bit scores greater than 108 (e.g., greater than 200, 300, 400, 500, 600, or 700) when fitted to an HMM generated from the amino acid sequences set forth in FIG. 21 are identified in the Sequence Listing of this application. Such polypeptides include, for example, SEQ ID NOs: 187, 188, 190, 192-194, or 196.

Examples of polypeptides are shown in the sequence listing that have HMM bit scores greater than 534 (e.g., greater than 600, 700, 800, 900, 1000, or 1100) when fitted to an HMM generated from the amino acid sequences set forth in FIG. 22 are identified in the Sequence Listing of this application. Such polypeptides include, for example, SEQ ID NOs: 1065, 1067, 1069, 1070, 1072, 1073, 1075, 1076, 1078-1080, 1082, 1083, 1085, 1087, 1089, 1091, 1093, 1095, 1096, 1098, 1100, 1101, 1103, 1105, 1106, 1108, or 1110.

Examples of polypeptides are shown in the sequence listing that have HMM bit scores greater than 30 (e.g., greater than 40, 50, 60, 70, 80, 90, 100, 125, 150, 175, 200, 225, 250, 275, 300, 350, 400, 450, or 460) when fitted to an HMM generated from the amino acid sequences set forth in FIG. 23 are identified in the Sequence Listing of this application. Such polypeptides include, for example, SEQ ID NOs: 1580, 1582, 1583, 1585, 1587, 1589, 1590, 1592, 1593, 1595, 1597, 2604-2611, 2613, 2615, 2617, or 2619-2623.

Examples of polypeptides are shown in the sequence listing that have HMM bit scores greater than 359 (e.g., greater than 500, 600, 700, 800, 900, or 1000) when fitted to an HMM generated from the amino acid sequences set forth in FIG. 24 are identified in the Sequence Listing of this application. Such polypeptides include, for example, SEQ ID NOs: 851, 853, 854, 856-858, 860, 862, 863, 865, 866, 868, 870-873, 875-878, 880-882, 884-886, 888, 890, 892, 893, 895, 897, 899, 900, 902, 903, 905, 907, 909, 911, 912, 913, 915, 917, 919, 921, 923, 925, or 926.

Examples of polypeptides are shown in the sequence listing that have HMM bit scores greater than 324 (e.g., greater than 400 or 500) when fitted to an HMM generated from the amino acid sequences set forth in FIG. 25 are identified in the Sequence Listing of this application. Such polypeptides include, for example, SEQ ID NOs: 1016, 1018, 1020, 1021, 1023, 1024, 1026, 1027, 1029, 1030, 1032, 1033, 2578, 2579, 2581, 2583, 2584, 2585, 2587, or 2588.

Examples of polypeptides are shown in the sequence listing that have HMM bit scores greater than 105 (e.g., greater than 170, 183, or 260) when fitted to an HMM generated from the amino acid sequences set forth in FIG. 26 are identified in the Sequence Listing of this application. Such polypeptides include, for example, SEQ ID NOs: 2186, 2188, 2189, 2191, 2192, 2193, or 2194.

Examples of polypeptides are shown in the sequence listing that have HMM bit scores greater than 105 (e.g., greater than 170, 183, or 260) when fitted to an HMM generated from the amino acid sequences set forth in FIG. 27 are identified in the Sequence Listing of this application. Such polypeptides include, for example, SEQ ID NOs: 1955, 1956, 1957, 1958, 1960, 1962, 1964, 1966, 1967, 1968, 1970, 1972, 1973, 1974, 1975, 1976, or 1978.

Examples of polypeptides are shown in the sequence listing that have HMM bit scores greater than 10 (e.g., greater than 88, 106, 153, 190, 212, 230, or 260) when fitted to an HMM generated from the amino acid sequences set forth in FIG. 28 are identified in the Sequence Listing of this application. Such polypeptides include, for example, SEQ ID NOs: 2566, 2567, 2568, 2569, 2570, 2571, 2572, 2573, 2575, 2576, 2577, or 2591.

Examples of polypeptides are shown in the sequence listing that have HMM bit scores greater than 191 (e.g., greater than 200, 250, 320, 450, 550, 650, 700, or 730) when fitted to an HMM generated from the amino acid sequences set forth in FIG. 29 are identified in the Sequence Listing of this application. Such polypeptides include, for example, SEQ ID NOs: 2150, 2152, 2154, 2155, 2157, 2159-2161, 2163, 2165, 2166, 2168, 2170, 2172-2175, 2177, 2179, 2181, 2183, or 2184.

Examples of polypeptides are shown in the sequence listing that have HMM bit scores greater than 281 (e.g., greater than 320, 450, 500, 600, 700, 800, 900, 1000, 1050, 1100, 1150, or 1200) when fitted to an HMM generated from the amino acid sequences set forth in FIG. 30 are identified in the Sequence Listing of this application. Such polypeptides include, for example, SEQ ID NOs: 2196, 2197, 2199-2202, 2204, 2206-2208, 2210-2212, 2214, 2215, 2217-2220, 2222, 2224-2226, 2228, 2230-2232, 2234-2242, 2244-2254, or 2256-2269.

Examples of polypeptides are shown in the sequence listing that have HMM bit scores greater than 676 (e.g., greater than 728, 800, 850, or 900) when fitted to an HMM generated from the amino acid sequences set forth in FIG. 31 are identified in the Sequence Listing of this application. Such polypeptides include, for example, SEQ ID NOs: 2493-2498, 2500-2510, 2512-2515, 2517-2531, 2533-2536, 2538-2542, 2544-2548, 2550, 2551, 2553, 2555-2558, 2560, 2562, or 2564.

Examples of polypeptides are shown in the sequence listing that have HMM bit scores greater than 273 (e.g., greater than 300, 310, 320, 330, 340, 350, 375, 400, 425, 450, or 475) when fitted to an HMM generated from the amino acid sequences set forth in FIG. 32 are identified in the Sequence Listing of this application. Such polypeptides include, for example, SEQ ID NOs: 2271, 2273, 2274, 2276, 2278, 2280, 2281, 2283, 2285, 2286, 2288, 2290, 2292, 2294, 2296, 2297, 2299, 2301, 2303, 2305, 2307, 2309, 2311, 2313, 2314, 2316-2318, 2320, 2322, 2324, 2326, 2327, 2329, 2331, 2333, 2335, 2337, 2339, 2341, 2342, 2344, 2345, 2347-2349, 2351, 2353, 2355, 2357, 2359, 2361, 2363, 2365, 2367-2369, 2371, 2373, 2375, 2377, 2379, 2381, 2383, 2385, 2386, 2388, 2390, 2391, 2393, 2395, 2397, 2399, 2400, 2402, 2404, 2405, 2407, 2409, 2411, 2413, 2415, 2417, 2419, 2421, or 2423.

Examples of polypeptides are shown in the sequence listing that have HMM bit scores greater than 320 (e.g., greater than 350, 400, 450, 500, 600, 700, 800, or 900) when fitted to an HMM generated from the amino acid sequences set forth in FIG. 33 are identified in the Sequence Listing of this application. Such polypeptides include, for example, SEQ ID NOs: 1741, 1743, 1745, 1747-1756, 1758, 1760, 1762-1764, 1766, 1767, 1769, 1770, 1772-1774, 1776, 1778-1783, 1785-1792, 1794, 1796, 1798, 1799, 1801, 1802, 1804, 1806, or 1808-1810.

Examples of polypeptides are shown in the sequence listing that have HMM bit scores greater than 90 (e.g., greater than 95, 100, 125, 150, 175, 200, 250, 300, or 325) when fitted to an HMM generated from the amino acid sequences set forth in FIG. 34 are identified in the Sequence Listing of this application. Such polypeptides include, for example, SEQ ID NOs: 1980, 1982, 1984-1986, 1988, 1990, 1991, 1993, 1995, 1997, 1999, 2001, 2003, 2005, 2007, 2009, 2011, 2013, 2015, 2017, 2019, 2021, 2023-2027, 2029, 2031, or 2033.

Examples of polypeptides are shown in the sequence listing that have HMM bit scores greater than 399 (e.g., greater than 410, 425, 450, 475, 500, 550, 600, 650, 700, 750, or 800) when fitted to an HMM generated from the amino acid sequences set forth in FIG. 35 are identified in the Sequence Listing of this application. Such polypeptides include, for example, SEQ ID NOs: 1812, 1814, 1815, 1817, 1819, 1821, 1822, 1824, 1826-1830, 1832, 1834, 1835, 1837, 1839-1841, 1843, 1844, 1846, 1847, 1849, 1851, 1852, 1854, 1856, 1858, 1860-1863, or 1865-1953.

Examples of polypeptides are shown in the sequence listing that have HMM bit scores greater than 222 (e.g., greater than 225, 250, 300, 325, 350, 400, 450, 500, 600, 700, or 750) when fitted to an HMM generated from the amino acid sequences set forth in FIG. 36 are identified in the Sequence Listing of this application. Such polypeptides include, for example, SEQ ID NOs: 2124, 2126, 2128, 2129, 2131, 2133, 2135-2137, 2139, 2141, 2142, 2144-2148, or 2592-2602.

Examples of polypeptides are shown in the sequence listing that have HMM bit scores greater than 450 (e.g., greater than 475, 500, 525, 550, 575, 600, 625, 650, or 675) when fitted to an HMM generated from the amino acid sequences set forth in FIG. 37 are identified in the Sequence Listing of this application. Such polypeptides include, for example, SEQ ID NOs: 2035, 2037, 2039, 2041, 2043, 2045, 2047-2049, 2051-2057, 2059, 2061, 2063, 2065, 2067, 2069, 2071, 2073, 2075, 2077, 2079, 2080, 2082, 2084, 2086, 2088, 2090, 2092, 2093, 2095, 2097, 2098, or 2100-2122.

Examples of polypeptides are shown in the sequence listing that have HMM bit scores greater than 493 (e.g., greater than 500, 600, 700, 800, 900, 1000, 1100, 1200, 1300, 1400, 1500, 1600, 1700, 1750, or 1775) when fitted to an HMM generated from the amino acid sequences set forth in FIG. 38 are identified in the Sequence Listing of this application. Such polypeptides include, for example, SEQ ID NOs: 2425, 2426, 2428, 2430, 2431, 2433, 2435, 2437, 2438-2440, 2442, 2444, 2445, 2447, 2449, 2451, 2453, 2455, 2457, 2459, 2461, 2463-2468, 2470, 2472, 2474, 2476, 2478, 2479, 2481, 2482, 2484, 2485, or 2487-2491.

D. Percent Identity

In some embodiments, a biomass-modulating polypeptide has an amino acid sequence with at least 45% sequence identity, e.g., 50%, 52%, 56%, 59%, 61%, 65%, 70%, 75%, 80%, 85%, 90%, 95%, 97%, 98%, or 99% sequence identity, to one of the amino acid sequences set forth in SEQ ID NOs: 2, 4, 6-9, 11, 13-15, 17, 18, 20-27, 29, 31-33, 35, 36, 38-51, 53, 54, 56-61, 63-67, 69, 70, 72-76, 78, 80-83, 85, 86, 88-91, 93-97, 99-103, 105, 107, 109, 110, 112, 113, 115, 117, 119-152, 154, 156, 158, 159, 161, 163, 165, 167, 168, 170, 172, 174, 176, 178, 180-185, 187, 188, 190, 192-194, 196, 198, 200, 202, 203, 205, 207-211, 213-251, 253, 255, 257, 258, 260-262, 264, 265, 267-272, 274-279, 281-283, 285, 287-292, 294, 295-297, 299, 301, 303-305, 307, 309, 310, 312, 314, 316-318, 320, 321, 323, 325, 327-329, 331, 332, 334, 335, 337-339, 341, 342, 344, 345, 347, 349, 351, 353, 355, 357, 359, 361-366, 368, 370, 372, 373, 375-378, 380, 382-387, 389, 391, 393, 395, 396, 398-404, 406-414, 416, 418, 420, 421, 423, 425, 427, 429, 431, 433, 435, 437, 439, 441, 443, 445, 447, 449, 451, 453, 455, 457, 459, 461, 463, 465, 467, 469, 471, 473, 475, 477, 479, 481, 483, 485, 487, 489, 491, 493, 495, 497-502, 504, 506, 508, 509, 511-517, 519, 521, 522, 524-527, 529, 530, 532, 533, 535, 536, 537, 539, 541, 543, 545, 546, 548, 550, 552-555, 557, 558, 560, 562, 564, 566, 568, 570-578, 580, 582, 584, 585, 587, 589, 591, 592, 594-596, 598, 600, 601, 603, 604, 606-608, 610, 611, 613, 615, 617, 619, 621, 623, 625, 626, 628-632, 634, 636, 638, 640, 642, 643, 645, 647, 649, 651, 653, 655, 657, 659, 661, 663, 665, 667-670, 672, 674, 675, 677, 679-682, 684, 685, 687, 689-692, 694-698, 700-704, 706, 707, 709-718, 720, 722, 724, 726-728, 730, 731, 733-739, 741, 743, 745, 746, 748, 750, 752, 754, 756, 758, 760-764, 766, 768, 770, 772, 774, 776, 778, 780, 782, 784, 785, 787, 789, 791, 793-795, 797, 799, 801, 803, 805, 806, 808, 810, 812, 814, 816, 818-820, 822-824, 826, 828, 830, 832, 834, 836, 838-840, 842, 843, 845-847, 849, 851, 853, 854, 856-858, 860, 862, 863, 865, 866, 868, 870-873, 875-878, 880-882, 884-886, 888, 890, 892, 893, 895, 897, 899, 900, 902, 903, 905, 907, 909, 911, 912, 913, 915, 917, 919, 921, 923, 925, 926, 928, 930, 932, 933, 935, 936-938, 940, 941, 943-945, 947, 949, 950, 952-955, 957-961, 963, 965-969, 971, 972, 974, 975, 977, 978, 980, 982, 984, 986, 988, 990, 992, 994, 996, 998, 1000-1014, 1016, 1018, 1020, 1021, 1023, 1024, 1026, 1027, 1029, 1030, 1032, 1033, 1035, 1037, 1038, 1040, 1042, 1043, 1045, 1047, 1049, 1051, 1053, 1055, 1057, 1059, 1061-1063, 1065, 1067, 1069, 1070, 1072, 1073, 1075, 1076, 1078-1080, 1082, 1083, 1085, 1087, 1089, 1091, 1093, 1095, 1096, 1098, 1100, 1101, 1103, 1105, 1106, 1108, 1110, 1112, 1114-1116, 1118, 1120-1123, 1125, 1127-1131, 1133, 1134, 1136, 1137, 1139-1145, 1147-1156, 1158-1161, 1163, 1165-1178, 1180-1188, 1190, 1191, 1193-1202, 1204, 1205-1207, 1209-1213, 1215, 1217-1221, 1223-1228, 1230, 1231, 1233-1241, 1243, 1245, 1247, 1249-1252, 1254, 1255, 1257-1259, 1261, 1263, 1264, 1266-1272, 1274-1276, 1278, 1280, 1282-1286, 1288, 1289, 1291-1331, 1333-1337, 1339, 1341, 1343, 1345, 1347-1350, 1352, 1354, 1356, 1358, 1360, 1362, 1364, 1366, 1368, 1370-1372, 1374, 1375, 1377-1379, 1381, 1383, 1384, 1386, 1388-1390, 1392-1397, 1399, 1400, 1402, 1403, 1405, 1407-1410, 1412-1418, 1420, 1422, 1424, 1426, 1428, 1430, 1432-1436, 1438, 1440, 1442-1444, 1446, 1447, 1449, 1450, 1452-1454, 1456, 1457, 1459, 1460, 1462, 1463, 1465-1468, 1470, 1471, 1473, 1475, 1477-1483, 1485, 1487, 1489, 1491-1493, 1495, 1496, 1498, 1499, 1501, 1503, 1504, 1506, 1508, 1510, 1511, 1513, 1514, 1516-1521, 1523, 1524, 1526, 1528-1532, 1534, 1536-1539, 1541, 1542, 1544, 1545, 1547, 1548, 1550, 1552, 1553, 1555-1559, 1561, 1563-1565, 1567, 1568, 1570, 1571, 1573, 1575, 1576, 1578, 1580, 1582, 1583, 1585, 1587, 1589, 1590, 1592, 1593, 1595, 1597, 1599, 1600, 1602-1606, 1608-1613, 1615, 1616, 1618-1626, 1628, 1629, 1631, 1633, 1634, 1636, 1637, 1639-1643, 1645, or 1646-1739, 1741, 1743, 1745, 1747-1756, 1758, 1760, 1762-1764, 1766, 1767, 1769, 1770, 1772-1774, 1776, 1778-1783, 1785-1792, 1794, 1796, 1798, 1799, 1801, 1802, 1804, 1806, 1808-1810, 1812, 1814, 1815, 1817, 1819, 1821, 1822, 1824, 1826-1830, 1832, 1834, 1835, 1837, 1839-1841, 1843, 1844, 1846, 1847, 1849, 1851, 1852, 1854, 1856, 1858, 1860-1863, 1865-1953, 1955-1958, 1960, 1962, 1964, 1966-1968, 1970, 1972-1976, 1978, 1980, 1982, 1984-1986, 1988, 1990, 1991, 1993, 1995, 1997, 1999, 2001, 2003, 2005, 2007, 2009, 2011, 2013, 2015, 2017, 2019, 2021, 2023-2027, 2029, 2031, 2033, 2035, 2037, 2039, 2041, 2043, 2045, 2047-2049, 2051-2057, 2059, 2061, 2063, 2065, 2067, 2069, 2071, 2073, 2075, 2077, 2079, 2080, 2082, 2084, 2086, 2088, 2090, 2092, 2093, 2095, 2097, 2098, 2100-2122, 2124, 2126, 2128, 2129, 2131, 2133, 2135-2137, 2139, 2141, 2142, 2144-2148, 2150, 2152, 2154, 2155, 2157, 2159-2161, 2163, 2165, 2166, 2168, 2170, 2172-2175, 2177, 2179, 2181, 2183, 2184, 2186, 2188, 2189, 2191-2194, 2196, 2197, 2199-2202, 2204, 2206-2208, 2210-2212, 2214, 2215, 2217-2220, 2222, 2224-2226, 2228, 2230-2232, 2234-2242, 2244-2254, 2256-2269, 2271, 2273, 2274, 2276, 2278, 2280, 2281, 2283, 2285, 2286, 2288, 2290, 2292, 2294, 2296, 2297, 2299, 2301, 2303, 2305, 2307, 2309, 2311, 2313, 2314, 2316-2318, 2320, 2322, 2324, 2326, 2327, 2329, 2331, 2333, 2335, 2337, 2339, 2341, 2342, 2344, 2345, 2347-2349, 2351, 2353, 2355, 2357, 2359, 2361, 2363, 2365, 2367-2369, 2371, 2373, 2375, 2377, 2379, 2381, 2383, 2385, 2386, 2388, 2390, 2391, 2393, 2395, 2397, 2399, 2400, 2402, 2404, 2405, 2407, 2409, 2411, 2413, 2415, 2417, 2419, 2421, 2423, 2425, 2426, 2428, 2430, 2431, 2433, 2435, 2437, 2438-2440, 2442, 2444, 2445, 2447, 2449, 2451, 2453, 2455, 2457, 2459, 2461, 2463-2468, 2470, 2472, 2474, 2476, 2478, 2479, 2481, 2482, 2484, 2485, 2487-2491, 2493-2498, 2500-2510, 2512-2515, 2517-2531, 2533-2536, 2538-2542, 2544-2548, 2550, 2551, 2553, 2555-2558, 2560, 2562, 2564, 2566-2573, 2575-2579, 2581, 2583-2585, 2587-2602, 2604-2611, 2613, 2615, 2617, or 2619-2623. Polypeptides having such a percent sequence identity often have a domain indicative of a biomass-modulating polypeptide and/or have an HMM bit score that is greater than 65, as discussed above. Amino acid sequences of biomass-modulating polypeptides having at least 80% sequence identity to one of the amino acid sequences set forth in SEQ ID NOs: 2, 4, 6-9, 11, 13-15, 17, 18, 20-27, 29, 31-33, 35, 36, 38-51, 53, 54, 56-61, 63-67, 69, 70, 72-76, 78, 80-83, 85, 86, 88-91, 93-97, 99-103, 105, 107, 109, 110, 112, 113, 115, 117, 119-152, 154, 156, 158, 159, 161, 163, 165, 167, 168, 170, 172, 174, 176, 178, 180-185, 187, 188, 190, 192-194, 196, 198, 200, 202, 203, 205, 207-211, 213-251, 253, 255, 257, 258, 260-262, 264, 265, 267-272, 274-279, 281-283, 285, 287-292, 294, 295-297, 299, 301, 303-305, 307, 309, 310, 312, 314, 316-318, 320, 321, 323, 325, 327-329, 331, 332, 334, 335, 337-339, 341, 342, 344, 345, 347, 349, 351, 353, 355, 357, 359, 361-366, 368, 370, 372, 373, 375-378, 380, 382-387, 389, 391, 393, 395, 396, 398-404, 406-414, 416, 418, 420, 421, 423, 425, 427, 429, 431, 433, 435, 437, 439, 441, 443, 445, 447, 449, 451, 453, 455, 457, 459, 461, 463, 465, 467, 469, 471, 473, 475, 477, 479, 481, 483, 485, 487, 489, 491, 493, 495, 497-502, 504, 506, 508, 509, 511-517, 519, 521, 522, 524-527, 529, 530, 532, 533, 535, 536, 537, 539, 541, 543, 545, 546, 548, 550, 552-555, 557, 558, 560, 562, 564, 566, 568, 570-578, 580, 582, 584, 585, 587, 589, 591, 592, 594-596, 598, 600, 601, 603, 604, 606-608, 610, 611, 613, 615, 617, 619, 621, 623, 625, 626, 628-632, 634, 636, 638, 640, 642, 643, 645, 647, 649, 651, 653, 655, 657, 659, 661, 663, 665, 667-670, 672, 674, 675, 677, 679-682, 684, 685, 687, 689-692, 694-698, 700-704, 706, 707, 709-718, 720, 722, 724, 726-728, 730, 731, 733-739, 741, 743, 745, 746, 748, 750, 752, 754, 756, 758, 760-764, 766, 768, 770, 772, 774, 776, 778, 780, 782, 784, 785, 787, 789, 791, 793-795, 797, 799, 801, 803, 805, 806, 808, 810, 812, 814, 816, 818-820, 822-824, 826, 828, 830, 832, 834, 836, 838-840, 842, 843, 845-847, 849, 851, 853, 854, 856-858, 860, 862, 863, 865, 866, 868, 870-873, 875-878, 880-882, 884-886, 888, 890, 892, 893, 895, 897, 899, 900, 902, 903, 905, 907, 909, 911, 912, 913, 915, 917, 919, 921, 923, 925, 926, 928, 930, 932, 933, 935, 936-938, 940, 941, 943-945, 947, 949, 950, 952-955, 957-961, 963, 965-969, 971, 972, 974, 975, 977, 978, 980, 982, 984, 986, 988, 990, 992, 994, 996, 998, 1000-1014, 1016, 1018, 1020, 1021, 1023, 1024, 1026, 1027, 1029, 1030, 1032, 1033, 1035, 1037, 1038, 1040, 1042, 1043, 1045, 1047, 1049, 1051, 1053, 1055, 1057, 1059, 1061-1063, 1065, 1067, 1069, 1070, 1072, 1073, 1075, 1076, 1078-1080, 1082, 1083, 1085, 1087, 1089, 1091, 1093, 1095, 1096, 1098, 1100, 1101, 1103, 1105, 1106, 1108, 1110, 1112, 1114-1116, 1118, 1120-1123, 1125, 1127-1131, 1133, 1134, 1136, 1137, 1139-1145, 1147-1156, 1158-1161, 1163, 1165-1178, 1180-1188, 1190, 1191, 1193-1202, 1204, 1205-1207, 1209-1213, 1215, 1217-1221, 1223-1228, 1230, 1231, 1233-1241, 1243, 1245, 1247, 1249-1252, 1254, 1255, 1257-1259, 1261, 1263, 1264, 1266-1272, 1274-1276, 1278, 1280, 1282-1286, 1288, 1289, 1291-1331, 1333-1337, 1339, 1341, 1343, 1345, 1347-1350, 1352, 1354, 1356, 1358, 1360, 1362, 1364, 1366, 1368, 1370-1372, 1374, 1375, 1377-1379, 1381, 1383, 1384, 1386, 1388-1390, 1392-1397, 1399, 1400, 1402, 1403, 1405, 1407-1410, 1412-1418, 1420, 1422, 1424, 1426, 1428, 1430, 1432-1436, 1438, 1440, 1442-1444, 1446, 1447, 1449, 1450, 1452-1454, 1456, 1457, 1459, 1460, 1462, 1463, 1465-1468, 1470, 1471, 1473, 1475, 1477-1483, 1485, 1487, 1489, 1491-1493, 1495, 1496, 1498, 1499, 1501, 1503, 1504, 1506, 1508, 1510, 1511, 1513, 1514, 1516-1521, 1523, 1524, 1526, 1528-1532, 1534, 1536-1539, 1541, 1542, 1544, 1545, 1547, 1548, 1550, 1552, 1553, 1555-1559, 1561, 1563-1565, 1567, 1568, 1570, 1571, 1573, 1575, 1576, 1578, 1580, 1582, 1583, 1585, 1587, 1589, 1590, 1592, 1593, 1595, 1597, 1599, 1600, 1602-1606, 1608-1613, 1615, 1616, 1618-1626, 1628, 1629, 1631, 1633, 1634, 1636, 1637, 1639-1643, 1645, 1646-1739, 1741, 1743, 1745, 1747-1756, 1758, 1760, 1762-1764, 1766, 1767, 1769, 1770, 1772-1774, 1776, 1778-1783, 1785-1792, 1794, 1796, 1798, 1799, 1801, 1802, 1804, 1806, 1808-1810, 1812, 1814, 1815, 1817, 1819, 1821, 1822, 1824, 1826-1830, 1832, 1834, 1835, 1837, 1839-1841, 1843, 1844, 1846, 1847, 1849, 1851, 1852, 1854, 1856, 1858, 1860-1863, 1865-1953, 1955-1958, 1960, 1962, 1964, 1966-1968, 1970, 1972-1976, 1978, 1980, 1982, 1984-1986, 1988, 1990, 1991, 1993, 1995, 1997, 1999, 2001, 2003, 2005, 2007, 2009, 2011, 2013, 2015, 2017, 2019, 2021, 2023-2027, 2029, 2031, 2033, 2035, 2037, 2039, 2041, 2043, 2045, 2047-2049, 2051-2057, 2059, 2061, 2063, 2065, 2067, 2069, 2071, 2073, 2075, 2077, 2079, 2080, 2082, 2084, 2086, 2088, 2090, 2092, 2093, 2095, 2097, 2098, 2100-2122, 2124, 2126, 2128, 2129, 2131, 2133, 2135-2137, 2139, 2141, 2142, 2144-2148, 2150, 2152, 2154, 2155, 2157, 2159-2161, 2163, 2165, 2166, 2168, 2170, 2172-2175, 2177, 2179, 2181, 2183, 2184, 2186, 2188, 2189, 2191-2194, 2196, 2197, 2199-2202, 2204, 2206-2208, 2210-2212, 2214, 2215, 2217-2220, 2222, 2224-2226, 2228, 2230-2232, 2234-2242, 2244-2254, 2256-2269, 2271, 2273, 2274, 2276, 2278, 2280, 2281, 2283, 2285, 2286, 2288, 2290, 2292, 2294, 2296, 2297, 2299, 2301, 2303, 2305, 2307, 2309, 2311, 2313, 2314, 2316-2318, 2320, 2322, 2324, 2326, 2327, 2329, 2331, 2333, 2335, 2337, 2339, 2341, 2342, 2344, 2345, 2347-2349, 2351, 2353, 2355, 2357, 2359, 2361, 2363, 2365, 2367-2369, 2371, 2373, 2375, 2377, 2379, 2381, 2383, 2385, 2386, 2388, 2390, 2391, 2393, 2395, 2397, 2399, 2400, 2402, 2404, 2405, 2407, 2409, 2411, 2413, 2415, 2417, 2419, 2421, 2423, 2425, 2426, 2428, 2430, 2431, 2433, 2435, 2437, 2438-2440, 2442, 2444, 2445, 2447, 2449, 2451, 2453, 2455, 2457, 2459, 2461, 2463-2468, 2470, 2472, 2474, 2476, 2478, 2479, 2481, 2482, 2484, 2485, 2487-2491, 2493-2498, 2500-2510, 2512-2515, 2517-2531, 2533-2536, 2538-2542, 2544-2548, 2550, 2551, 2553, 2555-2558, 2560, 2562, 2564, 2566-2573, 2575-2579, 2581, 2583-2585, 2587-2602, 2604-2611, 2613, 2615, 2617, or 2619-2623 are provided in FIGS. 1-38 and in the Sequence Listing.

"Percent sequence identity" refers to the degree of sequence identity between any given reference sequence, e.g., SEQ ID NO: 1, and a candidate biomass-modulating sequence. A candidate sequence typically has a length that is from 80 percent to 200 percent of the length of the reference sequence, e.g., 82, 85, 87, 89, 90, 93, 95, 97, 99, 100, 105, 110, 115, 120, 130, 140, 150, 160, 170, 180, 190, or 200 percent of the length of the reference sequence. A percent identity for any candidate nucleic acid or polypeptide relative to a reference nucleic acid or polypeptide can be determined as follows. A reference sequence (e.g., a nucleic acid sequence or an amino acid sequence) is aligned to one or more candidate sequences using the computer program ClustalW (version 1.83, default parameters), which allows alignments of nucleic acid or polypeptide sequences to be carried out across their entire length (global alignment). Chenna et al., *Nucleic Acids Res.*, 31(13):3497-500 (2003).

ClustalW calculates the best match between a reference and one or more candidate sequences, and aligns them so that identities, similarities and differences can be determined. Gaps of one or more residues can be inserted into a reference sequence, a candidate sequence, or both, to maximize sequence alignments. For fast pairwise alignment of nucleic acid sequences, the following default parameters are used: word size: 2; window size: 4; scoring method: percentage; number of top diagonals: 4; and gap penalty: 5. For multiple alignment of nucleic acid sequences, the following parameters are used: gap opening penalty: 10.0; gap extension penalty: 5.0; and weight transitions: yes. For fast pairwise alignment of protein sequences, the following parameters are used: word size: 1; window size: 5; scoring method: percentage; number of top diagonals: 5; gap penalty: 3. For multiple alignment of protein sequences, the following parameters are used: weight matrix: blosum; gap opening penalty: 10.0; gap extension penalty: 0.05; hydrophilic gaps: on; hydrophilic residues: Gly, Pro, Ser, Asn, Asp, Gln, Glu, Arg, and Lys; residue-specific gap penalties: on. The ClustalW output is a sequence alignment that reflects the relationship between sequences. ClustalW can be run, for example, at the Baylor College of Medicine Search Launcher site on the World Wide Web (searchlauncher.bcm.tmc.edu/multi-align/multi-align.html) and at the European Bioinformatics Institute site on the World Wide Web (ebi.ac.uk/clustalw).

To determine percent identity of a candidate nucleic acid or amino acid sequence to a reference sequence, the sequences are aligned using ClustalW, the number of identical matches in the alignment is divided by the length of the reference sequence, and the result is multiplied by 100. It is noted that the percent identity value can be rounded to the nearest tenth. For example, 78.11, 78.12, 78.13, and 78.14 are rounded down to 78.1, while 78.15, 78.16, 78.17, 78.18, and 78.19 are rounded up to 78.2.

In some cases, a biomass-modulating polypeptide has an amino acid sequence with at least 45% sequence identity, e.g., 50%, 52%, 56%, 59%, 61%, 65%, 70%, 75%, 80%, 85%, 90%, 95%, 97%, 98%, or 99% sequence identity, to the amino acid sequence set forth in SEQ ID NO: 1333. Amino acid sequences of polypeptides having greater than 45% sequence identity to the polypeptide set forth in SEQ ID NO: 1333 are provided in FIG. 1 and in the Sequence Listing.

In some cases, a biomass-modulating polypeptide has an amino acid sequence with at least 45% sequence identity, e.g., 50%, 52%, 56%, 59%, 61%, 65%, 70%, 75%, 80%, 85%, 90%, 95%, 97%, 98%, or 99% sequence identity, to the amino acid sequence set forth in SEQ ID NO: 1489. Amino acid sequences of polypeptides having greater than 45% sequence identity to the polypeptide set forth in SEQ ID NO: 1489 are provided in FIG. 2 and in the Sequence Listing.

In some cases, a biomass-modulating polypeptide has an amino acid sequence with at least 45% sequence identity, e.g., 50%, 52%, 56%, 59%, 61%, 65%, 70%, 75%, 80%, 85%, 90%, 95%, 97%, 98%, or 99% sequence identity, to the amino acid sequence set forth in SEQ ID NO: 504. Amino acid sequences of polypeptides having greater than 45% sequence identity to the polypeptide set forth in SEQ ID NO: 504 are provided in FIG. 3 and in the Sequence Listing.

In some cases, a biomass-modulating polypeptide has an amino acid sequence with at least 45% sequence identity, e.g., 50%, 52%, 56%, 59%, 61%, 65%, 70%, 75%, 80%, 85%, 90%, 95%, 97%, 98%, or 99% sequence identity, to the amino acid sequence set forth in SEQ ID NO: 198. Amino acid sequences of polypeptides having greater than 45% sequence identity to the polypeptide set forth in SEQ ID NO: 198 are provided in FIG. 4 and in the Sequence Listing.

In some cases, a biomass-modulating polypeptide has an amino acid sequence with at least 45% sequence identity, e.g., 50%, 52%, 56%, 59%, 61%, 65%, 70%, 75%, 80%, 85%, 90%, 95%, 97%, 98%, or 99% sequence identity, to the amino acid sequence set forth in SEQ ID NO: 253. Amino acid sequences of polypeptides having greater than 45% sequence identity to the polypeptide set forth in SEQ ID NO: 253 are provided in FIG. 5 and in the Sequence Listing.

In some cases, a biomass-modulating polypeptide has an amino acid sequence with at least 45% sequence identity, e.g., 50%, 52%, 56%, 59%, 61%, 65%, 70%, 75%, 80%, 85%, 90%, 95%, 97%, 98%, or 99% sequence identity, to the amino acid sequence set forth in SEQ ID NO: 1541. Amino acid sequences of polypeptides having greater than 45% sequence identity to the polypeptide set forth in SEQ ID NO: 1541 are provided in FIG. 6 and in the Sequence Listing.

In some cases, a biomass-modulating polypeptide has an amino acid sequence with at least 45% sequence identity, e.g., 50%, 52%, 56%, 59%, 61%, 65%, 70%, 75%, 80%, 85%, 90%, 95%, 97%, 98%, or 99% sequence identity, to the amino acid sequence set forth in SEQ ID NO: 663. Amino acid sequences of polypeptides having greater than 45% sequence identity to the polypeptide set forth in SEQ ID NO: 663 are provided in FIG. 7 and in the Sequence Listing.

In some cases, a biomass-modulating polypeptide has an amino acid sequence with at least 45% sequence identity, e.g., 50%, 52%, 56%, 59%, 61%, 65%, 70%, 75%, 80%, 85%, 90%, 95%, 97%, 98%, or 99% sequence identity, to the amino acid sequence set forth in SEQ ID NO: 1366. Amino acid sequences of polypeptides having greater than 45% sequence identity to the polypeptide set forth in SEQ ID NO: 1366 are provided in FIG. 8 and in the Sequence Listing.

In some cases, a biomass-modulating polypeptide has an amino acid sequence with at least 45% sequence identity, e.g., 50%, 52%, 56%, 59%, 61%, 65%, 70%, 75%, 80%, 85%, 90%, 95%, 97%, 98%, or 99% sequence identity, to the amino acid sequence set forth in SEQ ID NO: 928. Amino acid sequences of polypeptides having greater than 45% sequence identity to the polypeptide set forth in SEQ ID NO: 928 are provided in FIG. 9 and in the Sequence Listing.

In some cases, a biomass-modulating polypeptide has an amino acid sequence with at least 45% sequence identity, e.g., 50%, 52%, 56%, 59%, 61%, 65%, 70%, 75%, 80%, 85%, 90%, 95%, 97%, 98%, or 99% sequence identity, to the amino acid sequence set forth in SEQ ID NO: 1215. Amino acid sequences of polypeptides having greater than 45% sequence identity to the polypeptide set forth in SEQ ID NO: 1215 are provided in FIG. 10 and in the Sequence Listing.

In some cases, a biomass-modulating polypeptide has an amino acid sequence with at least 45% sequence identity, e.g., 50%, 52%, 56%, 59%, 61%, 65%, 70%, 75%, 80%, 85%, 90%, 95%, 97%, 98%, or 99% sequence identity, to the amino acid sequence set forth in SEQ ID NO: 4. Amino acid sequences of polypeptides having greater than 45% sequence identity to the polypeptide set forth in SEQ ID NO: 4 are provided in FIG. 11 and in the Sequence Listing.

In some cases, a biomass-modulating polypeptide has an amino acid sequence with at least 45% sequence identity, e.g., 50%, 52%, 56%, 59%, 61%, 65%, 70%, 75%, 80%, 85%, 90%, 95%, 97%, 98%, or 99% sequence identity, to the amino acid sequence set forth in SEQ ID NO: 580. Amino acid sequences of polypeptides having greater than 45% sequence identity to the polypeptide set forth in SEQ ID NO: 580 are provided in FIG. 12 and in the Sequence Listing.

In some cases, a biomass-modulating polypeptide has an amino acid sequence with at least 45% sequence identity, e.g., 50%, 52%, 56%, 59%, 61%, 65%, 70%, 75%, 80%, 85%, 90%, 95%, 97%, 98%, or 99% sequence identity, to the amino acid sequence set forth in SEQ ID NO: 53. Amino acid sequences of polypeptides having greater than 45% sequence identity to the polypeptide set forth in SEQ ID NO: 53 are provided in FIG. 13 and in the Sequence Listing.

In some cases, a biomass-modulating polypeptide has an amino acid sequence with at least 45% sequence identity, e.g., 50%, 52%, 56%, 59%, 61%, 65%, 70%, 75%, 80%, 85%, 90%, 95%, 97%, 98%, or 99% sequence identity, to the amino acid sequence set forth in SEQ ID NO: 1112. Amino acid sequences of polypeptides having greater than 45% sequence identity to the polypeptide set forth in SEQ ID NO: 1112 are provided in FIG. 14 and in the Sequence Listing.

In some cases, a biomass-modulating polypeptide has an amino acid sequence with at least 45% sequence identity, e.g., 50%, 52%, 56%, 59%, 61%, 65%, 70%, 75%, 80%, 85%, 90%, 95%, 97%, 98%, or 99% sequence identity, to the amino acid sequence set forth in SEQ ID NO: 634. Amino acid sequences of polypeptides having greater than 45% sequence identity to the polypeptide set forth in SEQ ID NO: 634 are provided in FIG. 15 and in the Sequence Listing.

In some cases, a biomass-modulating polypeptide has an amino acid sequence with at least 45% sequence identity, e.g., 50%, 52%, 56%, 59%, 61%, 65%, 70%, 75%, 80%, 85%, 90%, 95%, 97%, 98%, or 99% sequence identity, to the amino acid sequence set forth in SEQ ID NO: 368. Amino acid sequences of polypeptides having greater than 45% sequence identity to the polypeptide set forth in SEQ ID NO: 368 are provided in FIG. 16 and in the Sequence Listing.

In some cases, a biomass-modulating polypeptide has an amino acid sequence with at least 45% sequence identity, e.g., 50%, 52%, 56%, 59%, 61%, 65%, 70%, 75%, 80%, 85%, 90%, 95%, 97%, 98%, or 99% sequence identity, to the amino acid sequence set forth in SEQ ID NO: 1599. Amino acid sequences of polypeptides having greater than 45% sequence identity to the polypeptide set forth in SEQ ID NO: 1599 are provided in FIG. 17 and in the Sequence Listing.

In some cases, a biomass-modulating polypeptide has an amino acid sequence with at least 45% sequence identity, e.g., 50%, 52%, 56%, 59%, 61%, 65%, 70%, 75%, 80%, 85%, 90%, 95%, 97%, 98%, or 99% sequence identity, to the amino acid sequence set forth in SEQ ID NO: 154. Amino acid sequences of polypeptides having greater than 45% sequence identity to the polypeptide set forth in SEQ ID NO: 154 are provided in FIG. 18 and in the Sequence Listing.

In some cases, a biomass-modulating polypeptide has an amino acid sequence with at least 45% sequence identity, e.g., 50%, 52%, 56%, 59%, 61%, 65%, 70%, 75%, 80%, 85%, 90%, 95%, 97%, 98%, or 99% sequence identity, to the amino acid sequence set forth in SEQ ID NO: 1035. Amino acid sequences of polypeptides having greater than 45% sequence identity to the polypeptide set forth in SEQ ID NO: 1035 are provided in FIG. 19 and in the Sequence Listing.

In some cases, a biomass-modulating polypeptide has an amino acid sequence with at least 45% sequence identity, e.g., 50%, 52%, 56%, 59%, 61%, 65%, 70%, 75%, 80%, 85%, 90%, 95%, 97%, 98%, or 99% sequence identity, to the amino acid sequence set forth in SEQ ID NO: 741. Amino acid sequences of polypeptides having greater than 45% sequence identity to the polypeptide set forth in SEQ ID NO: 741 are provided in FIG. 20 and in the Sequence Listing.

In some cases, a biomass-modulating polypeptide has an amino acid sequence with at least 45% sequence identity, e.g., 50%, 52%, 56%, 59%, 61%, 65%, 70%, 75%, 80%, 85%, 90%, 95%, 97%, 98%, or 99% sequence identity, to the amino acid sequence set forth in SEQ ID NO: 187. Amino acid sequences of polypeptides having greater than 45% sequence identity to the polypeptide set forth in SEQ ID NO: 187 are provided in FIG. 21 and in the Sequence Listing.

In some cases, a biomass-modulating polypeptide has an amino acid sequence with at least 45% sequence identity, e.g., 50%, 52%, 56%, 59%, 61%, 65%, 70%, 75%, 80%, 85%, 90%, 95%, 97%, 98%, or 99% sequence identity, to the amino acid sequence set forth in SEQ ID NO: 1065. Amino acid sequences of polypeptides having greater than 45% sequence identity to the polypeptide set forth in SEQ ID NO: 1065 are provided in FIG. 22 and in the Sequence Listing.

In some cases, a biomass-modulating polypeptide has an amino acid sequence with at least 45% sequence identity, e.g., 50%, 52%, 56%, 59%, 61%, 65%, 70%, 75%, 80%, 85%, 90%, 95%, 97%, 98%, or 99% sequence identity, to the amino acid sequence set forth in SEQ ID NO: 1592. Amino acid sequences of polypeptides having greater than 45% sequence identity to the polypeptide set forth in SEQ ID NO: 1592 are provided in FIG. 23 and in the Sequence Listing.

In some cases, a biomass-modulating polypeptide has an amino acid sequence with at least 45% sequence identity, e.g., 50%, 52%, 56%, 59%, 61%, 65%, 70%, 75%, 80%, 85%, 90%, 95%, 97%, 98%, or 99% sequence identity, to the amino acid sequence set forth in SEQ ID NO: 851. Amino acid sequences of polypeptides having greater than 45% sequence identity to the polypeptide set forth in SEQ ID NO: 851 are provided in FIG. 24 and in the Sequence Listing.

In some cases, a biomass-modulating polypeptide has an amino acid sequence with at least 45% sequence identity, e.g., 50%, 52%, 56%, 59%, 61%, 65%, 70%, 75%, 80%, 85%, 90%, 95%, 97%, 98%, or 99% sequence identity, to the amino acid sequence set forth in SEQ ID NO: 1016. Amino acid sequences of polypeptides having greater than 45% sequence identity to the polypeptide set forth in SEQ ID NO: 1016 are provided in FIG. 25 and in the Sequence Listing.

In some cases, a biomass-modulating polypeptide has an amino acid sequence with at least 45% sequence identity, e.g., 50%, 52%, 56%, 59%, 61%, 65%, 70%, 75%, 80%, 85%, 90%, 95%, 97%, 98%, or 99% sequence identity, to the amino acid sequence set forth in SEQ ID NO: 2186. Amino acid sequences of polypeptides having greater than 45% sequence identity to the polypeptide set forth in SEQ ID NO: 2186 are provided in FIG. 26 and in the Sequence Listing.

In some cases, a biomass-modulating polypeptide has an amino acid sequence with at least 45% sequence identity, e.g., 50%, 52%, 56%, 59%, 61%, 65%, 70%, 75%, 80%, 85%, 90%, 95%, 97%, 98%, or 99% sequence identity, to the amino acid sequence set forth in SEQ ID NO: 1955. Amino acid sequences of polypeptides having greater than 45% sequence identity to the polypeptide set forth in SEQ ID NO: 1955 are provided in FIG. 27 and in the Sequence Listing.

In some cases, a biomass-modulating polypeptide has an amino acid sequence with at least 45% sequence identity, e.g., 50%, 52%, 56%, 59%, 61%, 65%, 70%, 75%, 80%, 85%, 90%, 95%, 97%, 98%, or 99% sequence identity, to the amino acid sequence set forth in SEQ ID NO: 2566. Amino acid sequences of polypeptides having greater than 45% sequence identity to the polypeptide set forth in SEQ ID NO: 2566 are provided in FIG. 28 and in the Sequence Listing.

In some cases, a biomass-modulating polypeptide has an amino acid sequence with at least 45% sequence identity, e.g., 50%, 52%, 56%, 59%, 61%, 65%, 70%, 75%, 80%, 85%, 90%, 95%, 97%, 98%, or 99% sequence identity, to the amino acid sequence set forth in SEQ ID NO: 2150. Amino acid sequences of polypeptides having greater than 45% sequence identity to the polypeptide set forth in SEQ ID NO: 2150 are provided in FIG. 29 and in the Sequence Listing.

In some cases, a biomass-modulating polypeptide has an amino acid sequence with at least 45% sequence identity, e.g., 50%, 52%, 56%, 59%, 61%, 65%, 70%, 75%, 80%, 85%, 90%, 95%, 97%, 98%, or 99% sequence identity, to the amino acid sequence set forth in SEQ ID NO: 2196. Amino acid sequences of polypeptides having greater than 45% sequence identity to the polypeptide set forth in SEQ ID NO: 2196 are provided in FIG. 30 and in the Sequence Listing.

In some cases, a biomass-modulating polypeptide has an amino acid sequence with at least 45% sequence identity, e.g., 50%, 52%, 56%, 59%, 61%, 65%, 70%, 75%, 80%, 85%, 90%, 95%, 97%, 98%, or 99% sequence identity, to the amino acid sequence set forth in SEQ ID NO: 2493. Amino acid sequences of polypeptides having greater than 45% sequence identity to the polypeptide set forth in SEQ ID NO: 2493 are provided in FIG. 31 and in the Sequence Listing.

In some cases, a biomass-modulating polypeptide has an amino acid sequence with at least 45% sequence identity, e.g., 50%, 52%, 56%, 59%, 61%, 65%, 70%, 75%, 80%, 85%, 90%, 95%, 97%, 98%, or 99% sequence identity, to the amino acid sequence set forth in SEQ ID NO: 2271. Amino acid sequences of polypeptides having greater than 45% sequence identity to the polypeptide set forth in SEQ ID NO: 2271 are provided in FIG. 32 and in the Sequence Listing.

In some cases, a biomass-modulating polypeptide has an amino acid sequence with at least 45% sequence identity, e.g., 50%, 52%, 56%, 59%, 61%, 65%, 70%, 75%, 80%, 85%, 90%, 95%, 97%, 98%, or 99% sequence identity, to the amino acid sequence set forth in SEQ ID NO: 1741. Amino acid sequences of polypeptides having greater than 45% sequence identity to the polypeptide set forth in SEQ ID NO: 1741 are provided in FIG. 33 and in the Sequence Listing.

In some cases, a biomass-modulating polypeptide has an amino acid sequence with at least 45% sequence identity, e.g., 50%, 52%, 56%, 59%, 61%, 65%, 70%, 75%, 80%, 85%, 90%, 95%, 97%, 98%, or 99% sequence identity, to the amino acid sequence set forth in SEQ ID NO: 1980. Amino acid sequences of polypeptides having greater than 45% sequence identity to the polypeptide set forth in SEQ ID NO: 1980 are provided in FIG. 34 and in the Sequence Listing.

In some cases, a biomass-modulating polypeptide has an amino acid sequence with at least 45% sequence identity, e.g., 50%, 52%, 56%, 59%, 61%, 65%, 70%, 75%, 80%, 85%, 90%, 95%, 97%, 98%, or 99% sequence identity, to the amino acid sequence set forth in SEQ ID NO: 1812. Amino acid sequences of polypeptides having greater than 45% sequence identity to the polypeptide set forth in SEQ ID NO: 1812 are provided in FIG. 35 and in the Sequence Listing.

In some cases, a biomass-modulating polypeptide has an amino acid sequence with at least 45% sequence identity, e.g., 50%, 52%, 56%, 59%, 61%, 65%, 70%, 75%, 80%, 85%, 90%, 95%, 97%, 98%, or 99% sequence identity, to the amino acid sequence set forth in SEQ ID NO: 2124. Amino acid sequences of polypeptides having greater than 45% sequence identity to the polypeptide set forth in SEQ ID NO: 2124 are provided in FIG. 36 and in the Sequence Listing.

In some cases, a biomass-modulating polypeptide has an amino acid sequence with at least 45% sequence identity, e.g., 50%, 52%, 56%, 59%, 61%, 65%, 70%, 75%, 80%, 85%, 90%, 95%, 97%, 98%, or 99% sequence identity, to the amino acid sequence set forth in SEQ ID NO: 2935. Amino acid sequences of polypeptides having greater than 45% sequence identity to the polypeptide set forth in SEQ ID NO: 2035 are provided in FIG. 37 and in the Sequence Listing.

In some cases, a biomass-modulating polypeptide has an amino acid sequence with at least 45% sequence identity, e.g., 50%, 52%, 56%, 59%, 61%, 65%, 70%, 75%, 80%, 85%, 90%, 95%, 97%, 98%, or 99% sequence identity, to the amino acid sequence set forth in SEQ ID NO: 2425. Amino acid sequences of polypeptides having greater than 45% sequence identity to the polypeptide set forth in SEQ ID NO: 2425 are provided in FIG. 38 and in the Sequence Listing.

E. Other Sequences

It should be appreciated that a biomass-modulating polypeptide can include additional amino acids that are not involved in biomass modulation, and thus such a polypeptide can be longer than would otherwise be the case. For example, a biomass-modulating polypeptide can include a purification tag, a chloroplast transit peptide, a mitochondrial transit peptide, an amyloplast peptide, or a leader sequence added to the amino or carboxy terminus. In some embodiments, a biomass-modulating polypeptide includes an amino acid sequence that functions as a reporter, e.g., a green fluorescent protein or yellow fluorescent protein.

III. Nucleic Acids

Nucleic acids described herein include nucleic acids that are effective to modulate biomass levels when transcribed in a plant or plant cell. Such nucleic acids include, without limitation, those that encode a biomass-modulating polypeptide and those that can be used to inhibit expression of a biomass-modulating polypeptide via a nucleic acid based method.

A. Nucleic Acids Encoding Biomass-Modulating Polypeptides

Nucleic acids encoding biomass-modulating polypeptides are described herein. Examples of such nucleic acids include SEQ ID NOs: 1, 3, 5, 10, 12, 16, 19, 28, 30, 34, 37, 52, 55, 62, 68, 71, 77, 79, 84, 87, 92, 98, 104, 106, 108, 111, 114, 116, 118, 153, 155, 157, 160, 162, 164, 166, 169, 171, 173, 175, 177, 179, 186, 189, 191, 195, 197, 199, 201, 204, 206, 212, 252, 254, 256, 259, 263, 266, 273, 280, 284, 286, 293, 298, 300, 302, 306, 308, 311, 313, 315, 319, 322, 324, 326, 330, 333, 336, 340, 343, 346, 348, 350, 352, 354, 356, 358, 360, 367, 369, 371, 374, 379, 381, 388, 390, 392, 394, 397, 405, 415, 417, 419, 422, 424, 426, 428, 430, 432, 434, 436, 438, 440, 442, 444, 446, 448, 450, 452, 454, 456, 458, 460, 462, 464, 466, 468, 470, 472, 474, 476, 478, 480, 482, 484, 486, 488, 490, 492, 494, 496, 503, 505, 507, 510, 518, 520, 523, 528, 531, 534, 538, 540, 542, 544, 547, 549, 551, 556, 559, 561, 563, 565, 567, 569, 579, 581, 583, 586, 588, 590, 593, 597, 599, 602, 605, 609, 612, 614, 616, 618, 620, 622, 624, 627, 633, 635, 637, 639, 641, 644, 646, 648, 650, 652, 654, 656, 658, 660, 662, 664, 666, 671, 673, 676, 678, 683, 686, 688, 693, 699, 705, 708, 719, 721, 723, 725, 729, 732, 740, 742, 744, 747, 749, 751, 753, 755, 757, 759, 765, 767, 769, 771, 773, 775, 777, 779, 781, 783, 786, 788, 790, 792, 796, 798, 800, 802, 804, 807, 809, 811, 813, 815, 817, 821, 825, 827, 829, 831, 833, 835, 837, 841, 844, 848, 850, 852, 855, 859, 861, 864, 867, 869, 874, 879, 883, 887, 889, 891, 894, 896, 898, 901, 904, 906, 908, 910, 914, 916, 918, 920, 922, 924, 927, 929, 931, 934, 939, 942, 946, 948, 951, 956, 962, 964, 970, 973, 976, 979, 981, 983, 985, 987, 989, 991, 993, 995, 997, 999, 1015, 1017, 1019, 1022, 1025, 1028, 1031, 1034, 1036, 1039, 1041, 1044, 1046, 1048, 1050, 1052, 1054, 1056, 1058, 1060, 1064, 1066, 1068, 1071, 1074, 1077, 1081, 1084, 1086, 1088, 1090, 1092, 1094, 1097, 1099, 1102, 1104, 1107, 1109, 1111, 1113, 1117, 1119, 1124, 1126, 1132, 1135, 1138, 1146, 1157, 1162, 1164, 1179, 1189, 1192, 1203, 1208, 1214, 1216, 1222, 1229, 1232, 1242, 1244, 1246, 1248, 1253, 1256, 1260, 1262, 1265, 1273, 1277, 1279, 1281, 1287, 1290, 1332, 1338, 1340, 1342, 1344, 1346, 1351, 1353, 1355, 1357, 1359, 1361, 1363, 1365, 1367, 1369, 1373, 1376, 1380, 1382, 1385, 1387, 1391, 1398, 1401, 1404, 1406, 1411, 1419, 1421, 1423, 1425, 1427, 1429, 1431, 1437, 1439, 1441, 1445, 1448, 1451, 1455, 1458, 1461, 1464, 1469, 1472, 1474, 1476, 1484, 1486, 1488, 1490, 1494, 1497, 1500, 1502, 1505, 1507, 1509, 1512, 1515, 1522, 1525, 1527, 1533, 1535, 1540, 1543, 1546, 1549, 1551, 1554, 1560, 1562, 1566, 1569, 1572, 1574, 1577, 1579, 1581, 1584, 1586, 1588, 1591, 1594, 1596, 1598, 1601, 1607, 1614, 1617, 1627, 1630, 1632, 1635, 1638, 1644, 1740, 1742, 1744, 1746, 1757, 1759, 1761, 1765, 1768, 1771, 1775, 1777, 1784, 1793, 1795, 1797, 1800, 1803, 1805, 1807, 1811, 1813, 1816, 1818, 1820, 1823, 1825, 1831, 1833, 1836, 1838, 1842, 1845, 1848, 1850, 1853, 1855, 1857, 1859, 1864, 1954, 1959, 1961, 1963, 1965, 1969, 1971, 1977, 1979, 1981, 1983, 1987, 1989, 1992, 1994, 1996, 1998, 2000, 2002, 2004, 2006, 2008, 2010, 2012, 2014, 2016, 2018, 2020, 2022, 2028, 2030, 2032, 2034, 2036, 2038, 2040, 2042, 2044, 2046, 2050, 2058, 2060, 2062, 2064, 2066, 2068, 2070, 2072, 2074, 2076, 2078, 2081, 2083, 2085, 2087, 2089, 2091, 2094, 2096, 2099, 2123, 2125, 2127, 2130, 2132, 2134, 2138, 2140, 2143, 2149, 2151, 2153, 2156, 2158, 2162, 2164, 2167, 2169, 2171, 2176, 2178, 2180, 2182, 2185, 2187, 2190, 2195, 2198, 2203, 2205, 2209, 2213, 2216, 2221, 2223, 2227, 2229, 2233, 2243, 2255, 2270, 2272, 2275, 2277, 2279, 2282, 2284, 2287, 2289, 2291, 2293, 2295, 2298, 2300, 2302, 2304, 2306, 2308, 2310, 2312, 2315, 2319, 2321, 2323, 2325, 2328, 2330, 2332, 2334, 2336, 2338, 2340, 2343, 2346, 2350, 2352, 2354, 2356, 2358, 2360, 2362, 2364, 2366, 2370, 2372, 2374, 2376, 2378, 2380, 2382, 2384, 2387, 2389, 2392, 2394, 2396, 2398, 2401, 2403, 2406, 2408, 2410, 2412, 2414, 2416, 2418, 2420, 2422, 2424, 2427, 2429, 2432, 2434, 2436, 2441, 2443, 2446, 2448, 2450, 2452, 2454, 2456, 2458, 2460, 2462, 2469, 2471, 2473, 2475, 2477, 2480, 2483, 2486, 2492, 2499, 2511, 2516, 2532, 2537, 2543, 2549, 2552, 2554, 2559, 2561, 2563, 2565, 2574, 2580, 2582, 2586, 2603, 2612, 2614, 2616, and 2618 as described in more detail below. A nucleic acid also can be a fragment that is at least 40% (e.g., at least 45, 50, 55, 60, 65, 70, 75, 80, 85, 90, 95, or 99%) of the length of the full-length nucleic acid set forth in SEQ ID NOs: 1, 3, 5, 10, 12, 16, 19, 28, 30, 34, 37, 52, 55, 62, 68, 71, 77, 79, 84, 87, 92, 98, 104, 106, 108, 111, 114, 116, 118, 153, 155, 157, 160, 162, 164, 166, 169, 171, 173, 175, 177, 179, 186, 189, 191, 195, 197, 199, 201, 204, 206, 212, 252, 254, 256, 259, 263, 266, 273, 280, 284, 286, 293, 298, 300, 302, 306, 308, 311, 313, 315, 319, 322, 324, 326, 330, 333, 336, 340, 343, 346, 348, 350, 352, 354, 356, 358, 360, 367, 369, 371, 374, 379, 381, 388, 390, 392, 394, 397, 405, 415, 417, 419, 422, 424, 426, 428, 430, 432, 434, 436, 438, 440, 442, 444, 446, 448, 450, 452, 454, 456, 458, 460, 462, 464, 466, 468, 470, 472, 474, 476, 478, 480, 482, 484, 486, 488, 490, 492, 494, 496, 503, 505, 507, 510, 518, 520, 523, 528, 531, 534, 538, 540, 542, 544, 547, 549, 551, 556, 559, 561, 563, 565, 567, 569, 579, 581, 583, 586, 588, 590, 593, 597, 599, 602, 605, 609, 612, 614, 616, 618, 620, 622, 624, 627, 633, 635, 637, 639, 641, 644, 646, 648, 650, 652, 654, 656, 658, 660, 662, 664, 666, 671, 673, 676, 678, 683, 686, 688, 693, 699, 705, 708, 719, 721, 723, 725, 729, 732, 740, 742, 744, 747, 749, 751, 753, 755, 757, 759, 765, 767, 769, 771, 773, 775, 777, 779, 781, 783, 786, 788, 790, 792, 796, 798, 800, 802, 804, 807, 809, 811, 813, 815, 817, 821, 825, 827, 829, 831, 833, 835, 837, 841, 844, 848, 850, 852, 855, 859, 861, 864, 867, 869, 874, 879, 883, 887, 889, 891, 894, 896, 898, 901, 904, 906, 908, 910, 914, 916, 918, 920, 922, 924, 927, 929, 931, 934, 939, 942, 946, 948, 951, 956, 962, 964, 970, 973, 976, 979, 981, 983, 985, 987, 989, 991, 993, 995, 997, 999, 1015, 1017, 1019, 1022, 1025, 1028, 1031, 1034, 1036, 1039, 1041, 1044, 1046, 1048, 1050, 1052, 1054, 1056, 1058, 1060, 1064, 1066, 1068, 1071, 1074, 1077, 1081, 1084, 1086, 1088, 1090, 1092, 1094, 1097, 1099, 1102, 1104, 1107, 1109, 1111, 1113, 1117, 1119, 1124, 1126, 1132, 1135, 1138, 1146, 1157, 1162, 1164, 1179, 1189, 1192, 1203, 1208, 1214, 1216, 1222, 1229, 1232, 1242, 1244, 1246, 1248, 1253, 1256, 1260, 1262, 1265, 1273, 1277, 1279, 1281, 1287, 1290, 1332, 1338, 1340, 1342, 1344, 1346, 1351, 1353, 1355, 1357, 1359, 1361, 1363, 1365, 1367, 1369, 1373, 1376, 1380, 1382, 1385, 1387, 1391, 1398, 1401, 1404, 1406, 1411, 1419, 1421, 1423, 1425, 1427, 1429, 1431, 1437, 1439, 1441, 1445, 1448, 1451, 1455, 1458, 1461, 1464, 1469, 1472, 1474, 1476, 1484, 1486, 1488, 1490, 1494, 1497, 1500, 1502, 1505, 1507, 1509, 1512, 1515, 1522, 1525, 1527, 1533, 1535, 1540, 1543, 1546, 1549, 1551, 1554, 1560, 1562, 1566, 1569, 1572, 1574, 1577, 1579, 1581, 1584, 1586, 1588, 1591, 1594, 1596, 1598, 1601, 1607, 1614, 1617, 1627, 1630, 1632, 1635, 1638, 1644, 1740, 1742, 1744, 1746, 1757, 1759, 1761, 1765, 1768, 1771, 1775, 1777, 1784, 1793, 1795, 1797, 1800, 1803, 1805, 1807, 1811, 1813, 1816, 1818, 1820, 1823, 1825, 1831, 1833, 1836, 1838, 1842, 1845, 1848, 1850, 1853, 1855, 1857, 1859, 1864, 1954, 1959, 1961, 1963, 1965, 1969, 1971, 1977, 1979, 1981, 1983, 1987, 1989, 1992, 1994, 1996, 1998, 2000, 2002, 2004, 2006, 2008, 2010, 2012, 2014, 2016, 2018, 2020, 2022, 2028, 2030, 2032, 2034, 2036, 2038, 2040, 2042, 2044, 2046, 2050, 2058, 2060, 2062, 2064, 2066, 2068, 2070, 2072, 2074, 2076, 2078, 2081, 2083, 2085, 2087, 2089, 2091, 2094, 2096, 2099, 2123, 2125, 2127, 2130, 2132, 2134, 2138, 2140, 2143, 2149, 2151, 2153, 2156, 2158, 2162, 2164, 2167, 2169, 2171, 2176, 2178, 2180, 2182, 2185, 2187, 2190, 2195, 2198, 2203, 2205, 2209, 2213, 2216, 2221, 2223, 2227, 2229, 2233, 2243, 2255, 2270, 2272, 2275, 2277, 2279, 2282, 2284, 2287, 2289, 2291, 2293, 2295, 2298, 2300, 2302, 2304, 2306, 2308, 2310, 2312, 2315, 2319, 2321, 2323, 2325, 2328, 2330, 2332, 2334, 2336, 2338, 2340, 2343, 2346, 2350, 2352, 2354, 2356, 2358, 2360, 2362, 2364, 2366, 2370, 2372, 2374, 2376, 2378, 2380, 2382, 2384, 2387, 2389, 2392, 2394, 2396, 2398, 2401, 2403, 2406, 2408, 2410, 2412, 2414, 2416, 2418, 2420, 2422, 2424, 2427, 2429, 2432, 2434, 2436, 2441, 2443, 2446, 2448, 2450, 2452, 2454, 2456, 2458, 2460, 2462, 2469, 2471, 2473, 2475, 2477, 2480, 2483, 2486, 2492, 2499, 2511, 2516, 2532, 2537, 2543, 2549, 2552, 2554, 2559, 2561, 2563, 2565, 2574, 2580, 2582, 2586, 2603, 2612, 2614, 2616, and 2618.

A biomass-modulating nucleic acid can comprise the nucleotide sequence set forth in SEQ ID NO: 1. Alternatively, a biomass-modulating nucleic acid can be a variant of the nucleic acid having the nucleotide sequence set forth in SEQ ID NO: 1. For example, a biomass-modulating nucleic acid can have a nucleotide sequence with at least 80% sequence identity, e.g., 81%, 85%, 90%, 95%, 97%, 98%, or 99% sequence identity, to the nucleotide sequence set forth in SEQ ID NO: 1.

A biomass-modulating nucleic acid can comprise the nucleotide sequence set forth in SEQ ID NO: 1332. Alternatively, a biomass-modulating nucleic acid can be a variant of the nucleic acid having the nucleotide sequence set forth in SEQ ID NO: 1332. For example, a biomass-modulating nucleic acid can have a nucleotide sequence with at least 80% sequence identity, e.g., 81%, 85%, 90%, 95%, 97%, 98%, or 99% sequence identity, to the nucleotide sequence set forth in SEQ ID NO: 1332.

A biomass-modulating nucleic acid can comprise the nucleotide sequence set forth in SEQ ID NO: 1488. Alternatively, a biomass-modulating nucleic acid can be a variant of the nucleic acid having the nucleotide sequence set forth in SEQ ID NO: 1488. For example, a biomass-modulating nucleic acid can have a nucleotide sequence with at least 80% sequence identity, e.g., 81%, 85%, 90%, 95%, 97%, 98%, or 99% sequence identity, to the nucleotide sequence set forth in SEQ ID NO: 1488.

A biomass-modulating nucleic acid can comprise the nucleotide sequence set forth in SEQ ID NO: 503. Alternatively, a biomass-modulating nucleic acid can be a variant of the nucleic acid having the nucleotide sequence set forth in SEQ ID NO: 503. For example, a biomass-modulating nucleic acid can have a nucleotide sequence with at least 80% sequence identity, e.g., 81%, 85%, 90%, 95%, 97%, 98%, or 99% sequence identity, to the nucleotide sequence set forth in SEQ ID NO: 503.

A biomass-modulating nucleic acid can comprise the nucleotide sequence set forth in SEQ ID NO: 197. Alternatively, a biomass-modulating nucleic acid can be a variant of the nucleic acid having the nucleotide sequence set forth in SEQ ID NO: 197. For example, a biomass-modulating nucleic acid can have a nucleotide sequence with at least 80% sequence identity, e.g., 81%, 85%, 90%, 95%, 97%, 98%, or 99% sequence identity, to the nucleotide sequence set forth in SEQ ID NO: 197.

A biomass-modulating nucleic acid can comprise the nucleotide sequence set forth in SEQ ID NO: 252. Alternatively, a biomass-modulating nucleic acid can be a variant of the nucleic acid having the nucleotide sequence set forth in SEQ ID NO: 252. For example, a biomass-modulating nucleic acid can have a nucleotide sequence with at least 80% sequence identity, e.g., 81%, 85%, 90%, 95%, 97%, 98%, or 99% sequence identity, to the nucleotide sequence set forth in SEQ ID NO: 252.

A biomass-modulating nucleic acid can comprise the nucleotide sequence set forth in SEQ ID NO: 1540. Alternatively, a biomass-modulating nucleic acid can be a variant of the nucleic acid having the nucleotide sequence set forth in SEQ ID NO: 1540. For example, a biomass-modulating nucleic acid can have a nucleotide sequence with at least 80% sequence identity, e.g., 81%, 85%, 90%, 95%, 97%, 98%, or 99% sequence identity, to the nucleotide sequence set forth in SEQ ID NO: 1540.

A biomass-modulating nucleic acid can comprise the nucleotide sequence set forth in SEQ ID NO: 662. Alternatively, a biomass-modulating nucleic acid can be a variant of the nucleic acid having the nucleotide sequence set forth in SEQ ID NO: 662. For example, a biomass-modulating nucleic acid can have a nucleotide sequence with at least 80% sequence identity, e.g., 81%, 85%, 90%, 95%, 97%, 98%, or 99% sequence identity, to the nucleotide sequence set forth in SEQ ID NO: 662.

A biomass-modulating nucleic acid can comprise the nucleotide sequence set forth in SEQ ID NO: 1365. Alternatively, a biomass-modulating nucleic acid can be a variant of the nucleic acid having the nucleotide sequence set forth in SEQ ID NO: 1365. For example, a biomass-modulating nucleic acid can have a nucleotide sequence with at least 80% sequence identity, e.g., 81%, 85%, 90%, 95%, 97%, 98%, or 99% sequence identity, to the nucleotide sequence set forth in SEQ ID NO: 1365.

A biomass-modulating nucleic acid can comprise the nucleotide sequence set forth in SEQ ID NO: 927. Alternatively, a biomass-modulating nucleic acid can be a variant of the nucleic acid having the nucleotide sequence set forth in SEQ ID NO: 927. For example, a biomass-modulating nucleic acid can have a nucleotide sequence with at least 80% sequence identity, e.g., 81%, 85%, 90%, 95%, 97%, 98%, or 99% sequence identity, to the nucleotide sequence set forth in SEQ ID NO: 927.

A biomass-modulating nucleic acid can comprise the nucleotide sequence set forth in SEQ ID NO: 1214. Alternatively, a biomass-modulating nucleic acid can be a variant of the nucleic acid having the nucleotide sequence set forth in SEQ ID NO: 1214. For example, a biomass-modulating nucleic acid can have a nucleotide sequence with at least 80% sequence identity, e.g., 81%, 85%, 90%, 95%, 97%, 98%, or 99% sequence identity, to the nucleotide sequence set forth in SEQ ID NO: 1214.

A biomass-modulating nucleic acid can comprise the nucleotide sequence set forth in SEQ ID NO: 3. Alternatively, a biomass-modulating nucleic acid can be a variant of the nucleic acid having the nucleotide sequence set forth in SEQ ID NO: 3. For example, a biomass-modulating nucleic acid can have a nucleotide sequence with at least 80% sequence identity, e.g., 81%, 85%, 90%, 95%, 97%, 98%, or 99% sequence identity, to the nucleotide sequence set forth in SEQ ID NO: 3.

A biomass-modulating nucleic acid can comprise the nucleotide sequence set forth in SEQ ID NO: 579. Alternatively, a biomass-modulating nucleic acid can be a variant of the nucleic acid having the nucleotide sequence set forth in SEQ ID NO: 579. For example, a biomass-modulating nucleic acid can have a nucleotide sequence with at least 80% sequence identity, e.g., 81%, 85%, 90%, 95%, 97%, 98%, or 99% sequence identity, to the nucleotide sequence set forth in SEQ ID NO: 579.

A biomass-modulating nucleic acid can comprise the nucleotide sequence set forth in SEQ ID NO: 52. Alternatively, a biomass-modulating nucleic acid can be a variant of the nucleic acid having the nucleotide sequence set forth in SEQ ID NO: 52. For example, a biomass-modulating nucleic acid can have a nucleotide sequence with at least 80% sequence identity, e.g., 81%, 85%, 90%, 95%, 97%, 98%, or 99% sequence identity, to the nucleotide sequence set forth in SEQ ID NO: 52.

A biomass-modulating nucleic acid can comprise the nucleotide sequence set forth in SEQ ID NO: 1111. Alternatively, a biomass-modulating nucleic acid can be a variant of the nucleic acid having the nucleotide sequence set forth in SEQ ID NO: 1111. For example, a biomass-modulating nucleic acid can have a nucleotide sequence with at least 80% sequence identity, e.g., 81%, 85%, 90%, 95%, 97%, 98%, or 99% sequence identity, to the nucleotide sequence set forth in SEQ ID NO: 1111.

A biomass-modulating nucleic acid can comprise the nucleotide sequence set forth in SEQ ID NO: 633. Alternatively, a biomass-modulating nucleic acid can be a variant of the nucleic acid having the nucleotide sequence set forth in SEQ ID NO: 633. For example, a biomass-modulating nucleic acid can have a nucleotide sequence with at least 80% sequence identity, e.g., 81%, 85%, 90%, 95%, 97%, 98%, or 99% sequence identity, to the nucleotide sequence set forth in SEQ ID NO: 633.

A biomass-modulating nucleic acid can comprise the nucleotide sequence set forth in SEQ ID NO: 367. Alternatively, a biomass-modulating nucleic acid can be a variant of the nucleic acid having the nucleotide sequence set forth in SEQ ID NO: 367. For example, a biomass-modulating nucleic acid can have a nucleotide sequence with at least 80% sequence identity, e.g., 81%, 85%, 90%, 95%, 97%, 98%, or 99% sequence identity, to the nucleotide sequence set forth in SEQ ID NO: 367.

A biomass-modulating nucleic acid can comprise the nucleotide sequence set forth in SEQ ID NO: 1598. Alternatively, a biomass-modulating nucleic acid can be a variant of the nucleic acid having the nucleotide sequence set forth in SEQ ID NO: 1598. For example, a biomass-modulating nucleic acid can have a nucleotide sequence with at least 80% sequence identity, e.g., 81%, 85%, 90%, 95%, 97%, 98%, or 99% sequence identity, to the nucleotide sequence set forth in SEQ ID NO: 1598.

A biomass-modulating nucleic acid can comprise the nucleotide sequence set forth in SEQ ID NO: 153. Alternatively, a biomass-modulating nucleic acid can be a variant of the nucleic acid having the nucleotide sequence set forth in SEQ ID NO: 153. For example, a biomass-modulating nucleic acid can have a nucleotide sequence with at least 80% sequence identity, e.g., 81%, 85%, 90%, 95%, 97%, 98%, or 99% sequence identity, to the nucleotide sequence set forth in SEQ ID NO: 153.

A biomass-modulating nucleic acid can comprise the nucleotide sequence set forth in SEQ ID NO: 1034. Alternatively, a biomass-modulating nucleic acid can be a variant of the nucleic acid having the nucleotide sequence set forth in SEQ ID NO: 1034. For example, a biomass-modulating nucleic acid can have a nucleotide sequence with at least 80% sequence identity, e.g., 81%, 85%, 90%, 95%, 97%, 98%, or 99% sequence identity, to the nucleotide sequence set forth in SEQ ID NO: 1034.

A biomass-modulating nucleic acid can comprise the nucleotide sequence set forth in SEQ ID NO: 740. Alternatively, a biomass-modulating nucleic acid can be a variant of the nucleic acid having the nucleotide sequence set forth in SEQ ID NO: 740. For example, a biomass-modulating nucleic acid can have a nucleotide sequence with at least 80% sequence identity, e.g., 81%, 85%, 90%, 95%, 97%, 98%, or 99% sequence identity, to the nucleotide sequence set forth in SEQ ID NO: 740.

A biomass-modulating nucleic acid can comprise the nucleotide sequence set forth in SEQ ID NO: 186. Alternatively, a biomass-modulating nucleic acid can be a variant of the nucleic acid having the nucleotide sequence set forth in SEQ ID NO: 186. For example, a biomass-modulating nucleic acid can have a nucleotide sequence with at least 80% sequence identity, e.g., 81%, 85%, 90%, 95%, 97%, 98%, or 99% sequence identity, to the nucleotide sequence set forth in SEQ ID NO: 186.

A biomass-modulating nucleic acid can comprise the nucleotide sequence set forth in SEQ ID NO: 1064. Alternatively, a biomass-modulating nucleic acid can be a variant of the nucleic acid having the nucleotide sequence set forth in SEQ ID NO: 1064. For example, a biomass-modulating nucleic acid can have a nucleotide sequence with at least 80% sequence identity, e.g., 81%, 85%, 90%, 95%, 97%, 98%, or 99% sequence identity, to the nucleotide sequence set forth in SEQ ID NO: 1064.

A biomass-modulating nucleic acid can comprise the nucleotide sequence set forth in SEQ ID NO: 1591. Alternatively, a biomass-modulating nucleic acid can be a variant of the nucleic acid having the nucleotide sequence set forth in SEQ ID NO: 1591. For example, a biomass-modulating nucleic acid can have a nucleotide sequence with at least 80% sequence identity, e.g., 81%, 85%, 90%, 95%, 97%, 98%, or 99% sequence identity, to the nucleotide sequence set forth in SEQ ID NO: 1591.

A biomass-modulating nucleic acid can comprise the nucleotide sequence set forth in SEQ ID NO: 850. Alternatively, a biomass-modulating nucleic acid can be a variant of the nucleic acid having the nucleotide sequence set forth in SEQ ID NO: 850. For example, a biomass-modulating nucleic acid can have a nucleotide sequence with at least 80% sequence identity, e.g., 81%, 85%, 90%, 95%, 97%, 98%, or 99% sequence identity, to the nucleotide sequence set forth in SEQ ID NO: 850.

A biomass-modulating nucleic acid can comprise the nucleotide sequence set forth in SEQ ID NO: 1015. Alternatively, a biomass-modulating nucleic acid can be a variant of the nucleic acid having the nucleotide sequence set forth in SEQ ID NO: 1015. For example, a biomass-modulating nucleic acid can have a nucleotide sequence with at least 80% sequence identity, e.g., 81%, 85%, 90%, 95%, 97%, 98%, or 99% sequence identity, to the nucleotide sequence set forth in SEQ ID NO: 1015.

A biomass-modulating nucleic acid can comprise the nucleotide sequence set forth in SEQ ID NO: 2185. Alternatively, a biomass-modulating nucleic acid can be a variant of the nucleic acid having the nucleotide sequence set forth in SEQ ID NO: 2185. For example, a biomass-modulating nucleic acid can have a nucleotide sequence with at least 80% sequence identity, e.g., 81%, 85%, 90%, 95%, 97%, 98%, or 99% sequence identity, to the nucleotide sequence set forth in SEQ ID NO: 2185.

A biomass-modulating nucleic acid can comprise the nucleotide sequence set forth in SEQ ID NO: 1954. Alternatively, a biomass-modulating nucleic acid can be a variant of the nucleic acid having the nucleotide sequence set forth in SEQ ID NO: 1954. For example, a biomass-modulating nucleic acid can have a nucleotide sequence with at least 80% sequence identity, e.g., 81%, 85%, 90%, 95%, 97%, 98%, or 99% sequence identity, to the nucleotide sequence set forth in SEQ ID NO: 1954.

A biomass-modulating nucleic acid can comprise the nucleotide sequence set forth in SEQ ID NO: 2565. Alternatively, a biomass-modulating nucleic acid can be a variant of the nucleic acid having the nucleotide sequence set forth in SEQ ID NO: 2565. For example, a biomass-modulating nucleic acid can have a nucleotide sequence with at least 80% sequence identity, e.g., 81%, 85%, 90%, 95%, 97%, 98%, or 99% sequence identity, to the nucleotide sequence set forth in SEQ ID NO: 2565.

A biomass-modulating nucleic acid can comprise the nucleotide sequence set forth in SEQ ID NO: 2149. Alternatively, a biomass-modulating nucleic acid can be a variant of the nucleic acid having the nucleotide sequence set forth in SEQ ID NO: 2149. For example, a biomass-modulating nucleic acid can have a nucleotide sequence with at least 80% sequence identity, e.g., 81%, 85%, 90%, 95%, 97%, 98%, or 99% sequence identity, to the nucleotide sequence set forth in SEQ ID NO: 2149.

A biomass-modulating nucleic acid can comprise the nucleotide sequence set forth in SEQ ID NO: 2195. Alternatively, a biomass-modulating nucleic acid can be a variant of the nucleic acid having the nucleotide sequence set forth in SEQ ID NO: 2195. For example, a biomass-modulating nucleic acid can have a nucleotide sequence with at least 80% sequence identity, e.g., 81%, 85%, 90%, 95%, 97%, 98%, or 99% sequence identity, to the nucleotide sequence set forth in SEQ ID NO: 2195.

A biomass-modulating nucleic acid can comprise the nucleotide sequence set forth in SEQ ID NO: 2492. Alternatively, a biomass-modulating nucleic acid can be a variant of the nucleic acid having the nucleotide sequence set forth in SEQ ID NO: 2492. For example, a biomass-modulating nucleic acid can have a nucleotide sequence with at least 80% sequence identity, e.g., 81%, 85%, 90%, 95%, 97%, 98%, or 99% sequence identity, to the nucleotide sequence set forth in SEQ ID NO: 2492.

A biomass-modulating nucleic acid can comprise the nucleotide sequence set forth in SEQ ID NO: 2270. Alternatively, a biomass-modulating nucleic acid can be a variant of the nucleic acid having the nucleotide sequence set forth in SEQ ID NO: 2270. For example, a biomass-modulating nucleic acid can have a nucleotide sequence with at least 80% sequence identity, e.g., 81%, 85%, 90%, 95%, 97%, 98%, or 99% sequence identity, to the nucleotide sequence set forth in SEQ ID NO: 2270.

A biomass-modulating nucleic acid can comprise the nucleotide sequence set forth in SEQ ID NO: 1740. Alternatively, a biomass-modulating nucleic acid can be a variant of the nucleic acid having the nucleotide sequence set forth in SEQ ID NO: 1740. For example, a biomass-modulating nucleic acid can have a nucleotide sequence with at least 80% sequence identity, e.g., 81%, 85%, 90%, 95%, 97%, 98%, or 99% sequence identity, to the nucleotide sequence set forth in SEQ ID NO: 1740.

A biomass-modulating nucleic acid can comprise the nucleotide sequence set forth in SEQ ID NO: 1979. Alternatively, a biomass-modulating nucleic acid can be a variant of the nucleic acid having the nucleotide sequence set forth in SEQ ID NO: 1979. For example, a biomass-modulating nucleic acid can have a nucleotide sequence with at least 80% sequence identity, e.g., 81%, 85%, 90%, 95%, 97%, 98%, or 99% sequence identity, to the nucleotide sequence set forth in SEQ ID NO: 1979.

A biomass-modulating nucleic acid can comprise the nucleotide sequence set forth in SEQ ID NO: 1811. Alternatively, a biomass-modulating nucleic acid can be a variant of the nucleic acid having the nucleotide sequence set forth in SEQ ID NO: 1811. For example, a biomass-modulating nucleic acid can have a nucleotide sequence with at least 80% sequence identity, e.g., 81%, 85%, 90%, 95%, 97%, 98%, or 99% sequence identity, to the nucleotide sequence set forth in SEQ ID NO: 1811.

A biomass-modulating nucleic acid can comprise the nucleotide sequence set forth in SEQ ID NO: 2123. Alternatively, a biomass-modulating nucleic acid can be a variant of the nucleic acid having the nucleotide sequence set forth in SEQ ID NO: 2123. For example, a biomass-modulating nucleic acid can have a nucleotide sequence with at least 80% sequence identity, e.g., 81%, 85%, 90%, 95%, 97%, 98%, or 99% sequence identity, to the nucleotide sequence set forth in SEQ ID NO: 2123.

A biomass-modulating nucleic acid can comprise the nucleotide sequence set forth in SEQ ID NO: 2034. Alternatively, a biomass-modulating nucleic acid can be a variant of the nucleic acid having the nucleotide sequence set forth in SEQ ID NO: 2034. For example, a biomass-modulating nucleic acid can have a nucleotide sequence with at least 80% sequence identity, e.g., 81%, 85%, 90%, 95%, 97%, 98%, or 99% sequence identity, to the nucleotide sequence set forth in SEQ ID NO: 2034.

A biomass-modulating nucleic acid can comprise the nucleotide sequence set forth in SEQ ID NO: 2424. Alternatively, a biomass-modulating nucleic acid can be a variant of the nucleic acid having the nucleotide sequence set forth in SEQ ID NO: 2424. For example, a biomass-modulating nucleic acid can have a nucleotide sequence with at least 80% sequence identity, e.g., 81%, 85%, 90%, 95%, 97%, 98%, or 99% sequence identity, to the nucleotide sequence set forth in SEQ ID NO: 2424.

Isolated nucleic acid molecules can be produced by standard techniques. For example, polymerase chain reaction (PCR) techniques can be used to obtain an isolated nucleic acid containing a nucleotide sequence described herein. PCR can be used to amplify specific sequences from DNA as well as RNA, including sequences from total genomic DNA or total cellular RNA. Various PCR methods are described, for example, in *PCR Primer: A Laboratory Manual*, Dieffenbach and Dveksler, eds., Cold Spring Harbor Laboratory Press, 1995. Generally, sequence information from the ends of the region of interest or beyond is employed to design oligonucleotide primers that are identical or similar in sequence to opposite strands of the template to be amplified. Various PCR strategies also are available by which site-specific nucleotide sequence modifications can be introduced into a template nucleic acid. Isolated nucleic acids also can be chemically synthesized, either as a single nucleic acid molecule (e.g., using automated DNA synthesis in the 3' to 5' direction using phosphoramidite technology) or as a series of oligonucleotides. For example, one or more pairs of long oligonucleotides (e.g., >100 nucleotides) can be synthesized that contain the desired sequence, with each pair containing a short segment of complementarity (e.g., about 15 nucleotides) such that a duplex is formed when the oligonucleotide pair is annealed. DNA polymerase is used to extend the oligonucleotides, resulting in a single, double-stranded nucleic acid molecule per oligonucleotide pair, which then can be ligated into a vector. Isolated nucleic acids of the invention also can be obtained by mutagenesis of, e.g., a naturally occurring DNA.

B. Use of Nucleic Acids to Modulate Expression of Polypeptides i. Expression of a Biomass-Modulating Polypeptide A nucleic acid encoding one of the biomass-modulating polypeptides described herein can be used to express the polypeptide in a plant species of interest, typically by transforming a plant cell with a nucleic acid having the coding sequence for the polypeptide operably linked in sense orientation to one or more regulatory regions. It will be appreciated that because of the degeneracy of the genetic code, a number of nucleic acids can encode a particular biomass-modulating polypeptide; i.e., for many amino acids, there is more than one nucleotide triplet that serves as the codon for the amino acid. Thus, codons in the coding sequence for a given biomass-modulating polypeptide can be modified such that optimal expression in a particular plant species is obtained, using appropriate codon bias tables for that species.

In some cases, expression of a biomass-modulating polypeptide inhibits one or more functions of an endogenous polypeptide. For example, a nucleic acid that encodes a dominant negative polypeptide can be used to inhibit protein function. A dominant negative polypeptide typically is mutated or truncated relative to an endogenous wild type polypeptide, and its presence in a cell inhibits one or more functions of the wild type polypeptide in that cell, i.e., the dominant negative polypeptide is genetically dominant and confers a loss of function. The mechanism by which a dominant negative polypeptide confers such a phenotype can vary but often involves a protein-protein interaction or a protein-DNA interaction. For example, a dominant negative polypeptide can be an enzyme that is truncated relative to a native wild type enzyme, such that the truncated polypeptide retains domains involved in binding a first protein but lacks domains involved in binding a second protein. The truncated polypeptide is thus unable to properly modulate the activity of the second protein. See, e.g., US 2007/0056058. As another example, a point mutation that results in a non-conservative amino acid substitution in a catalytic domain can result in a dominant negative polypeptide. See, e.g., US 2005/032221. As another example, a dominant negative polypeptide can be a transcription factor that is truncated relative to a native wild type transcription factor, such that the truncated polypeptide retains the DNA binding domain(s) but lacks the activation domain(s). Such a truncated polypeptide can inhibit the wild type transcription factor from binding DNA, thereby inhibiting transcription activation.

ii. Inhibition of Expression of a Biomass-Modulating Polypeptide

Polynucleotides and recombinant constructs described herein can be used to inhibit expression of a biomass-modulating polypeptide in a plant species of interest. See, e.g., Matzke and Birchler, *Nature Reviews Genetics* 6:24-35 (2005); Akashi et al., *Nature Reviews Mol. Cell. Biology* 6:413-422 (2005); Mittal, *Nature Reviews Genetics* 5:355-365 (2004); and *Nature Reviews RNA interference collection*, October 2005 on the World Wide Web at nature.com/reviews/focus/mai. A number of nucleic acid based methods, including antisense RNA, ribozyme directed RNA cleavage, post-transcriptional gene silencing (PTGS), e.g., RNA interference (RNAi), and transcriptional gene silencing (TGS) are known to inhibit gene expression in plants. Suitable polynucleotides include full-length nucleic acids encoding biomass-modulating polypeptides or fragments of such full-length nucleic acids. In some embodiments, a complement of the full-length nucleic acid or a fragment thereof can be used. Typically, a fragment is at least 10 nucleotides, e.g., at least 12, 13, 14, 15, 16, 17, 18, 19, 20, 21, 22, 23, 24, 25, 26, 27, 30, 35, 40, 50, 80, 100, 200, 500 nucleotides or more. Generally, higher homology can be used to compensate for the use of a shorter sequence.

Antisense technology is one well-known method. In this method, a nucleic acid of a gene to be repressed is cloned and operably linked to a regulatory region and a transcription termination sequence so that the antisense strand of RNA is transcribed. The recombinant construct is then transformed into plants, as described herein, and the antisense strand of RNA is produced. The nucleic acid need not be the entire sequence of the gene to be repressed, but typically will be substantially complementary to at least a portion of the sense strand of the gene to be repressed.

In another method, a nucleic acid can be transcribed into a ribozyme, or catalytic RNA, that affects expression of an mRNA. See, U.S. Pat. No. 6,423,885. Ribozymes can be designed to specifically pair with virtually any target RNA and cleave the phosphodiester backbone at a specific location, thereby functionally inactivating the target RNA. Heterologous nucleic acids can encode ribozymes designed to cleave particular mRNA transcripts, thus preventing expression of a polypeptide. Hammerhead ribozymes are useful for destroying particular mRNAs, although various ribozymes that cleave mRNA at site-specific recognition sequences can be used. Hammerhead ribozymes cleave mRNAs at locations dictated by flanking regions that form complementary base pairs with the target mRNA. The sole requirement is that the target RNA contains a 5'-UG-3' nucleotide sequence. The construction and production of hammerhead ribozymes is known in the art. See, for example, U.S. Pat. No. 5,254,678 and WO 02/46449 and references cited therein. Hammerhead ribozyme sequences can be embedded in a stable RNA such as a transfer RNA (tRNA) to increase cleavage efficiency in vivo. Perriman et al., *Proc. Natl. Acad. Sci. USA*, 92(13):6175-6179 (1995); de Feyter and Gaudron, Methods in Molecular Biology, Vol. 74, Chapter 43, "Expressing Ribozymes in Plants", Edited by Turner, P. C., Humana Press Inc., Totowa, N.J. RNA endoribonucleases which have been described, such as the one that occurs naturally in *Tetrahymena thermophile*, can be useful. See, for example, U.S. Pat. Nos. 4,987,071 and 6,423,885.

PTGS, e.g., RNAi, can also be used to inhibit the expression of a gene. For example, a construct can be prepared that includes a sequence that is transcribed into an RNA that can anneal to itself, e.g., a double stranded RNA having a stem-loop structure. In some embodiments, one strand of the stem portion of a double stranded RNA comprises a sequence that is similar or identical to the sense coding sequence or a fragment thereof of a biomass-modulating polypeptide, and that is from about 10 nucleotides to about 2,500 nucleotides in length. The length of the sequence that is similar or identical to the sense coding sequence can be from 10 nucleotides to 500 nucleotides, from 15 nucleotides to 300 nucleotides, from 20 nucleotides to 100 nucleotides, or from 25 nucleotides to 100 nucleotides. The other strand of the stem portion of a double stranded RNA comprises a sequence that is similar or identical to the antisense strand or a fragment thereof of the coding sequence of the biomass-modulating polypeptide, and can have a length that is shorter, the same as, or longer than the corresponding length of the sense sequence. In some cases, one strand of the stem portion of a double stranded RNA comprises a sequence that is similar or identical to the 3' or 5' untranslated region, or a fragment thereof, of an mRNA encoding a biomass-modulating polypeptide, and the other strand of the stem portion of the double stranded RNA comprises a sequence that is similar or identical to the sequence that is complementary to the 3' or 5' untranslated region, respectively, or a fragment thereof, of the mRNA encoding the biomass-modulating polypeptide. In other embodiments, one strand of the stem portion of a double stranded RNA comprises a sequence that is similar or identical to the sequence of an intron, or a fragment thereof, in the pre-mRNA encoding a biomass-modulating polypeptide, and the other strand of the stem portion comprises a sequence that is similar or identical to the sequence that is complementary to the sequence of the intron, or a fragment thereof, in the pre-mRNA.

The loop portion of a double stranded RNA can be from 3 nucleotides to 5,000 nucleotides, e.g., from 3 nucleotides to 25 nucleotides, from 15 nucleotides to 1,000 nucleotides, from 20 nucleotides to 500 nucleotides, or from 25 nucleotides to 200 nucleotides. The loop portion of the RNA can include an intron or a fragment thereof. A double stranded RNA can have zero, one, two, three, four, five, six, seven, eight, nine, ten, or more stem-loop structures.

A construct including a sequence that is operably linked to a regulatory region and a transcription termination sequence, and that is transcribed into an RNA that can form a double stranded RNA, is transformed into plants as described herein. Methods for using RNAi to inhibit the expression of a gene are known to those of skill in the art. See, e.g., U.S. Pat. Nos. 5,034,323; 6,326,527; 6,452,067; 6,573,099; 6,753,139; and 6,777,588. See also WO 97/01952; WO 98/53083; WO 99/32619; WO 98/36083; and U.S. Patent Publications 20030175965, 20030175783, 20040214330, and 20030180945.

Constructs containing regulatory regions operably linked to nucleic acid molecules in sense orientation can also be used to inhibit the expression of a gene. The transcription product can be similar or identical to the sense coding sequence, or a fragment thereof, of a biomass-modulating polypeptide. The transcription product also can be unpolyadenylated, lack a 5' cap structure, or contain an unspliceable intron. Methods of inhibiting gene expression using a full-length cDNA as well as a partial cDNA sequence are known in the art. See, e.g., U.S. Pat. No. 5,231,020.

In some embodiments, a construct containing a nucleic acid having at least one strand that is a template for both sense and antisense sequences that are complementary to each other is used to inhibit the expression of a gene. The sense and antisense sequences can be part of a larger nucleic acid molecule or can be part of separate nucleic acid molecules having sequences that are not complementary.

The sense or antisense sequence can be a sequence that is identical or complementary to the sequence of an mRNA, the 3' or 5' untranslated region of an mRNA, or an intron in a pre-mRNA encoding a biomass-modulating polypeptide, or a fragment of such sequences. In some embodiments, the sense or antisense sequence is identical or complementary to a sequence of the regulatory region that drives transcription of the gene encoding a biomass-modulating polypeptide. In each case, the sense sequence is the sequence that is complementary to the antisense sequence.

The sense and antisense sequences can be a length greater than about 10 nucleotides (e.g., 12, 13, 14, 15, 16, 17, 18, 19, 20, 21, 22, 23, 24, 25, 26, 27, 28, 29, 30, or more nucleotides). For example, an antisense sequence can be 21 or 22 nucleotides in length. Typically, the sense and antisense sequences range in length from about 15 nucleotides to about 30 nucleotides, e.g., from about 18 nucleotides to about 28 nucleotides, or from about 21 nucleotides to about 25 nucleotides.

In some embodiments, an antisense sequence is a sequence complementary to an mRNA sequence, or a fragment thereof, encoding a biomass-modulating polypeptide described herein. The sense sequence complementary to the antisense sequence can be a sequence present within the mRNA of the biomass-modulating polypeptide. Typically, sense and antisense sequences are designed to correspond to a 15-30 nucleotide sequence of a target mRNA such that the level of that target mRNA is reduced.

In some embodiments, a construct containing a nucleic acid having at least one strand that is a template for more than one sense sequence (e.g., 2, 3, 4, 5, 6, 7, 8, 9, 10 or more sense sequences) can be used to inhibit the expression of a gene. Likewise, a construct containing a nucleic acid having at least one strand that is a template for more than one antisense sequence (e.g., 2, 3, 4, 5, 6, 7, 8, 9, 10 or more antisense sequences) can be used to inhibit the expression of a gene. For example, a construct can contain a nucleic acid having at least one strand that is a template for two sense sequences and two antisense sequences. The multiple sense sequences can be identical or different, and the multiple antisense sequences can be identical or different. For example, a construct can have a nucleic acid having one strand that is a template for two identical sense sequences and two identical antisense sequences that are complementary to the two identical sense sequences. Alternatively, an isolated nucleic acid can have one strand that is a template for (1) two identical sense sequences 20 nucleotides in length, (2) one antisense sequence that is complementary to the two identical sense sequences 20 nucleotides in length, (3) a sense sequence 30 nucleotides in length, and (4) three identical antisense sequences that are complementary to the sense sequence 30 nucleotides in length. The constructs provided herein can be designed to have a suitable arrangement of sense and antisense sequences. For example, two identical sense sequences can be followed by two identical antisense sequences or can be positioned between two identical antisense sequences.

A nucleic acid having at least one strand that is a template for one or more sense and/or antisense sequences can be operably linked to a regulatory region to drive transcription of an RNA molecule containing the sense and/or antisense sequence(s). In addition, such a nucleic acid can be operably linked to a transcription terminator sequence, such as the terminator of the nopaline synthase (nos) gene. In some cases, two regulatory regions can direct transcription of two transcripts: one from the top strand, and one from the bottom strand. See, for example, Yan et al., *Plant Physiol.*, 141: 1508-1518 (2006). The two regulatory regions can be the same or different. The two transcripts can form double-stranded RNA molecules that induce degradation of the target RNA. In some cases, a nucleic acid can be positioned within a T-DNA or plant-derived transfer DNA (P-DNA) such that the left and right T-DNA border sequences or the left and right border-like sequences of the P-DNA flank, or are on either side of, the nucleic acid. See, US 2006/0265788. The nucleic acid sequence between the two regulatory regions can be from about 15 to about 300 nucleotides in length. In some embodiments, the nucleic acid sequence between the two regulatory regions is from about 15 to about 200 nucleotides in length, from about 15 to about 100 nucleotides in length, from about 15 to about 50 nucleotides in length, from about 18 to about 50 nucleotides in length, from about 18 to about 40 nucleotides in length, from about 18 to about 30 nucleotides in length, or from about 18 to about 25 nucleotides in length.

In some nucleic-acid based methods for inhibition of gene expression in plants, a suitable nucleic acid can be a nucleic acid analog. Nucleic acid analogs can be modified at the base moiety, sugar moiety, or phosphate backbone to improve, for example, stability, hybridization, or solubility of the nucleic acid. Modifications at the base moiety include deoxyuridine for deoxythymidine, and 5-methyl-2'-deoxycytidine and 5-bromo-2'-deoxycytidine for deoxycytidine. Modifications of the sugar moiety include modification of the 2' hydroxyl of the ribose sugar to form 2'-O-methyl or 2'-O-allyl sugars. The deoxyribose phosphate backbone can be modified to produce morpholino nucleic acids, in which each base moiety is linked to a six-membered morpholino ring, or peptide nucleic acids, in which the deoxyphosphate backbone is replaced by a pseudopeptide backbone and the four bases are retained. See, for example, Summerton and Weller, *Antisense Nucleic Acid Drug Dev.*, 7:187-195 (1997); Hyrup et al., *Bioorgan. Med. Chem.*, 4:5-23 (1996). In addition, the deoxyphosphate backbone can be replaced with, for example, a phosphorothioate or phosphorodithioate backbone, a phosphoroamidite, or an alkyl phosphotriester backbone.

C. Constructs/Vectors

Recombinant constructs provided herein can be used to transform plants or plant cells in order to modulate biomass levels. A recombinant nucleic acid construct can comprise a nucleic acid encoding a biomass-modulating polypeptide as described herein, operably linked to a regulatory region suitable for expressing the biomass-modulating polypeptide in the plant or cell. Thus, a nucleic acid can comprise a coding sequence that encodes a biomass-modulating polypeptides as set forth in SEQ ID NOs: 2, 4, 6-9, 11, 13-15, 17, 18, 20-27, 29, 31-33, 35, 36, 38-51, 53, 54, 56-61, 63-67, 69, 70, 72-76, 78, 80-83, 85, 86, 88-91, 93-97, 99-103, 105, 107, 109, 110, 112, 113, 115, 117, 119-152, 154, 156, 158, 159, 161, 163, 165, 167, 168, 170, 172, 174, 176, 178, 180-185, 187, 188, 190, 192-194, 196, 198, 200, 202, 203, 205, 207-211, 213-251, 253, 255, 257, 258, 260-262, 264, 265, 267-272, 274-279, 281-283, 285, 287-292, 294, 295-297, 299, 301, 303-305, 307, 309, 310, 312, 314, 316-318, 320, 321, 323, 325, 327-329, 331, 332, 334, 335, 337-339, 341, 342, 344, 345, 347, 349, 351, 353, 355, 357, 359, 361-366, 368, 370, 372, 373, 375-378, 380, 382-387, 389, 391, 393, 395, 396, 398-404, 406-414, 416, 418, 420, 421, 423, 425, 427, 429, 431, 433, 435, 437, 439, 441, 443, 445, 447, 449, 451, 453, 455, 457, 459, 461, 463, 465, 467, 469, 471, 473, 475, 477, 479, 481, 483, 485, 487, 489, 491, 493, 495, 497-502, 504, 506, 508, 509, 511-517, 519, 521, 522, 524-527, 529, 530, 532, 533, 535, 536, 537, 539, 541, 543, 545, 546, 548, 550, 552-555, 557, 558, 560, 562, 564, 566, 568, 570-578, 580, 582, 584, 585, 587, 589, 591, 592, 594-596, 598, 600, 601, 603, 604, 606-608, 610, 611, 613, 615, 617, 619, 621, 623, 625, 626, 628-632, 634, 636, 638, 640, 642, 643, 645, 647, 649, 651, 653, 655, 657, 659, 661, 663, 665, 667-670, 672, 674, 675, 677, 679-682, 684, 685, 687, 689-692, 694-698, 700-704, 706, 707, 709-718, 720, 722, 724, 726-728, 730, 731, 733-739, 741, 743, 745, 746, 748, 750, 752, 754, 756, 758, 760-764, 766, 768, 770, 772, 774, 776, 778, 780, 782, 784, 785, 787, 789, 791, 793-795, 797, 799, 801, 803, 805, 806, 808, 810, 812, 814, 816, 818-820, 822-824, 826, 828, 830, 832, 834, 836, 838-840, 842, 843, 845-847, 849, 851, 853, 854, 856-858, 860, 862, 863, 865, 866, 868, 870-873, 875-878, 880-882, 884-886, 888, 890, 892, 893, 895, 897, 899, 900, 902, 903, 905, 907, 909, 911, 912, 913, 915, 917, 919, 921, 923, 925, 926, 928, 930, 932, 933, 935, 936-938, 940, 941, 943-945, 947, 949, 950, 952-955, 957-961, 963, 965-969, 971, 972, 974, 975, 977, 978, 980, 982, 984, 986, 988, 990, 992, 994, 996, 998, 1000-1014, 1016, 1018, 1020, 1021, 1023, 1024, 1026, 1027, 1029, 1030, 1032, 1033, 1035, 1037, 1038, 1040, 1042, 1043, 1045, 1047, 1049, 1051, 1053, 1055, 1057, 1059, 1061-1063, 1065, 1067, 1069, 1070, 1072, 1073, 1075, 1076, 1078-1080, 1082, 1083, 1085, 1087, 1089, 1091, 1093, 1095, 1096, 1098, 1100, 1101, 1103, 1105, 1106, 1108, 1110, 1112, 1114-1116, 1118, 1120-1123, 1125, 1127-1131, 1133, 1134, 1136, 1137, 1139-1145, 1147-1156, 1158-1161, 1163, 1165-1178, 1180-1188, 1190, 1191, 1193-1202, 1204, 1205-1207, 1209-1213, 1215, 1217-1221, 1223-1228, 1230, 1231, 1233-1241, 1243, 1245, 1247, 1249-1252, 1254, 1255, 1257-1259, 1261, 1263, 1264, 1266-1272, 1274-1276, 1278, 1280, 1282-1286, 1288, 1289, 1291-1331, 1333-1337, 1339, 1341, 1343, 1345, 1347-1350, 1352, 1354, 1356, 1358, 1360, 1362, 1364, 1366, 1368, 1370-1372, 1374, 1375, 1377-1379, 1381, 1383, 1384, 1386, 1388-1390, 1392-1397, 1399, 1400, 1402, 1403, 1405, 1407-1410, 1412-1418, 1420, 1422, 1424, 1426, 1428, 1430, 1432-1436, 1438, 1440, 1442-1444, 1446, 1447, 1449, 1450, 1452-1454, 1456, 1457, 1459, 1460, 1462, 1463, 1465-1468, 1470, 1471, 1473, 1475, 1477-1483, 1485, 1487, 1489, 1491-1493, 1495, 1496, 1498, 1499, 1501, 1503, 1504, 1506, 1508, 1510, 1511, 1513, 1514, 1516-1521, 1523, 1524, 1526, 1528-1532, 1534, 1536-1539, 1541, 1542, 1544, 1545, 1547, 1548, 1550, 1552, 1553, 1555-1559, 1561, 1563-1565, 1567, 1568, 1570, 1571, 1573, 1575, 1576, 1578, 1580, 1582, 1583, 1585, 1587, 1589, 1590, 1592, 1593, 1595, 1597, 1599, 1600, 1602-1606, 1608-1613, 1615, 1616, 1618-1626, 1628, 1629, 1631, 1633, 1634, 1636, 1637, 1639-1643, 1645, or 1646-1739, 1741, 1743, 1745, 1747-1756, 1758, 1760, 1762-1764, 1766, 1767, 1769, 1770, 1772-1774, 1776, 1778-1783, 1785-1792, 1794, 1796, 1798, 1799, 1801, 1802, 1804, 1806, 1808-1810, 1812, 1814, 1815, 1817, 1819, 1821, 1822, 1824, 1826-1830, 1832, 1834, 1835, 1837, 1839-1841, 1843, 1844, 1846, 1847, 1849, 1851, 1852, 1854, 1856, 1858, 1860-1863, 1865-1953, 1955-1958, 1960, 1962, 1964, 1966-1968, 1970, 1972-1976, 1978, 1980, 1982, 1984-1986, 1988, 1990, 1991, 1993, 1995, 1997, 1999, 2001, 2003, 2005, 2007, 2009, 2011, 2013, 2015, 2017, 2019, 2021, 2023-2027, 2029, 2031, 2033, 2035, 2037, 2039, 2041, 2043, 2045, 2047-2049, 2051-2057, 2059, 2061, 2063, 2065, 2067, 2069, 2071, 2073, 2075, 2077, 2079, 2080, 2082, 2084, 2086, 2088, 2090, 2092, 2093, 2095, 2097, 2098, 2100-2122, 2124, 2126, 2128, 2129, 2131, 2133, 2135-2137, 2139, 2141, 2142, 2144-2148, 2150, 2152, 2154, 2155, 2157, 2159-2161, 2163, 2165, 2166, 2168, 2170, 2172-2175, 2177, 2179, 2181, 2183, 2184, 2186, 2188, 2189, 2191-2194, 2196, 2197, 2199-2202, 2204, 2206-2208, 2210-2212, 2214, 2215, 2217-2220, 2222, 2224-2226, 2228, 2230-2232, 2234-2242, 2244-2254, 2256-2269, 2271, 2273, 2274, 2276, 2278, 2280, 2281, 2283, 2285, 2286, 2288, 2290, 2292, 2294, 2296, 2297, 2299, 2301, 2303, 2305, 2307, 2309, 2311, 2313, 2314, 2316-2318, 2320, 2322, 2324, 2326, 2327, 2329, 2331, 2333, 2335, 2337, 2339, 2341, 2342, 2344, 2345, 2347-2349, 2351, 2353, 2355, 2357, 2359, 2361, 2363, 2365, 2367-2369, 2371, 2373, 2375, 2377, 2379, 2381, 2383, 2385, 2386, 2388, 2390, 2391, 2393, 2395, 2397, 2399, 2400, 2402, 2404, 2405, 2407, 2409, 2411, 2413, 2415, 2417, 2419, 2421, 2423, 2425, 2426, 2428, 2430, 2431, 2433, 2435, 2437, 2438-2440, 2442, 2444, 2445, 2447, 2449, 2451, 2453, 2455, 2457, 2459, 2461, 2463-2468, 2470, 2472, 2474, 2476, 2478, 2479, 2481, 2482, 2484, 2485, 2487-2491, 2493-2498, 2500-2510, 2512-2515, 2517-2531, 2533-2536, 2538-2542, 2544-2548, 2550, 2551, 2553, 2555-2558, 2560, 2562, 2564, 2566-2573, 2575-2579, 2581, 2583-2585, 2587-2602, 2604-2611, 2613, 2615, 2617, or 2619-2623. Examples of nucleic acids encoding biomass-modulating polypeptides are set forth in SEQ ID NOs: 1, 3, 5, 10, 12, 16, 19, 28, 30, 34, 37, 52, 55, 62, 68, 71, 77, 79, 84, 87, 92, 98, 104, 106, 108, 111, 114, 116, 118, 153, 155, 157, 160, 162, 164, 166, 169, 171, 173, 175, 177, 179, 186, 189, 191, 195, 197, 199, 201, 204, 206, 212, 252, 254, 256, 259, 263, 266, 273, 280, 284, 286, 293, 298, 300, 302, 306, 308, 311, 313, 315, 319, 322, 324, 326, 330, 333, 336, 340, 343, 346, 348, 350, 352, 354, 356, 358, 360, 367, 369, 371, 374, 379, 381, 388, 390, 392, 394, 397, 405, 415, 417, 419, 422, 424, 426, 428, 430, 432, 434, 436, 438, 440, 442, 444, 446, 448, 450, 452, 454, 456, 458, 460, 462, 464, 466, 468, 470, 472, 474, 476, 478, 480, 482, 484, 486, 488, 490, 492, 494, 496, 503, 505, 507, 510, 518, 520, 523, 528, 531, 534, 538, 540, 542, 544, 547, 549, 551, 556, 559, 561, 563, 565, 567, 569, 579, 581, 583, 586, 588, 590, 593, 597, 599, 602, 605, 609, 612, 614, 616, 618, 620, 622, 624, 627, 633, 635, 637, 639, 641, 644, 646, 648, 650, 652, 654, 656, 658, 660, 662, 664, 666, 671, 673, 676, 678, 683, 686, 688, 693, 699, 705, 708, 719, 721, 723, 725, 729, 732, 740, 742, 744, 747, 749, 751, 753, 755, 757, 759, 765, 767, 769, 771, 773, 775, 777, 779, 781, 783, 786, 788, 790, 792, 796, 798, 800, 802, 804, 807, 809, 811, 813, 815, 817, 821, 825, 827, 829, 831, 833, 835, 837, 841, 844, 848, 850, 852, 855, 859, 861, 864, 867, 869, 874, 879, 883, 887, 889, 891, 894, 896, 898, 901, 904, 906, 908, 910, 914, 916, 918, 920, 922, 924, 927, 929, 931, 934, 939, 942, 946, 948, 951, 956, 962, 964, 970, 973, 976, 979, 981, 983, 985, 987, 989, 991, 993, 995, 997, 999, 1015, 1017, 1019, 1022, 1025, 1028, 1031, 1034, 1036, 1039, 1041, 1044, 1046, 1048, 1050, 1052, 1054, 1056, 1058, 1060, 1064, 1066, 1068, 1071, 1074, 1077, 1081, 1084, 1086, 1088, 1090, 1092, 1094, 1097, 1099, 1102, 1104, 1107, 1109, 1111, 1113, 1117, 1119, 1124, 1126, 1132, 1135, 1138, 1146, 1157, 1162, 1164, 1179, 1189, 1192, 1203, 1208, 1214, 1216, 1222, 1229, 1232, 1242, 1244, 1246, 1248, 1253, 1256, 1260, 1262, 1265, 1273, 1277, 1279, 1281, 1287, 1290, 1332, 1338, 1340, 1342, 1344, 1346, 1351, 1353, 1355, 1357, 1359, 1361, 1363, 1365, 1367, 1369, 1373, 1376, 1380, 1382, 1385, 1387, 1391, 1398, 1401, 1404, 1406, 1411, 1419, 1421, 1423, 1425, 1427, 1429, 1431, 1437, 1439, 1441, 1445, 1448, 1451, 1455, 1458, 1461, 1464, 1469, 1472, 1474, 1476, 1484, 1486, 1488, 1490, 1494, 1497, 1500, 1502, 1505, 1507, 1509, 1512, 1515, 1522, 1525, 1527, 1533, 1535, 1540, 1543, 1546, 1549, 1551, 1554, 1560, 1562, 1566, 1569, 1572, 1574, 1577, 1579, 1581, 1584, 1586, 1588, 1591, 1594, 1596, 1598, 1601, 1607, 1614, 1617, 1627, 1630, 1632, 1635, 1638, 1644, 1740, 1742, 1744, 1746, 1757, 1759, 1761, 1765, 1768, 1771, 1775, 1777, 1784, 1793, 1795, 1797, 1800, 1803, 1805, 1807, 1811, 1813, 1816, 1818, 1820, 1823, 1825, 1831, 1833, 1836, 1838, 1842, 1845, 1848, 1850, 1853, 1855, 1857, 1859, 1864, 1954, 1959, 1961, 1963, 1965, 1969, 1971, 1977, 1979, 1981, 1983, 1987, 1989, 1992, 1994, 1996, 1998, 2000, 2002, 2004, 2006, 2008, 2010, 2012, 2014, 2016, 2018, 2020, 2022, 2028, 2030, 2032, 2034, 2036, 2038, 2040, 2042, 2044, 2046, 2050, 2058, 2060, 2062, 2064, 2066, 2068, 2070, 2072, 2074, 2076, 2078, 2081, 2083, 2085, 2087, 2089, 2091, 2094, 2096, 2099, 2123, 2125, 2127, 2130, 2132, 2134, 2138, 2140, 2143, 2149, 2151, 2153, 2156, 2158, 2162, 2164, 2167, 2169, 2171, 2176, 2178, 2180, 2182, 2185, 2187, 2190, 2195, 2198, 2203, 2205, 2209, 2213, 2216, 2221, 2223, 2227, 2229, 2233, 2243, 2255, 2270, 2272, 2275, 2277, 2279, 2282, 2284, 2287, 2289, 2291, 2293, 2295, 2298, 2300, 2302, 2304, 2306, 2308, 2310, 2312, 2315, 2319, 2321, 2323, 2325, 2328, 2330, 2332, 2334, 2336, 2338, 2340, 2343, 2346, 2350, 2352, 2354, 2356, 2358, 2360, 2362, 2364, 2366, 2370, 2372, 2374, 2376, 2378, 2380, 2382, 2384, 2387, 2389, 2392, 2394, 2396, 2398, 2401, 2403, 2406, 2408, 2410, 2412, 2414, 2416, 2418, 2420, 2422, 2424, 2427, 2429, 2432, 2434, 2436, 2441, 2443, 2446, 2448, 2450, 2452, 2454, 2456, 2458, 2460, 2462, 2469, 2471, 2473, 2475, 2477, 2480, 2483, 2486, 2492, 2499, 2511, 2516, 2532, 2537, 2543, 2549, 2552, 2554, 2559, 2561, 2563, 2565, 2574, 2580, 2582, 2586, 2603, 2612, 2614, 2616, and 2618, or in the Sequence Listing. The biomass-modulating polypeptide encoded by a recombinant nucleic acid can be a native biomass-modulating polypeptide, or can be heterologous to the cell. In some cases, the recombinant construct contains a nucleic acid that inhibits expression of a biomass-modulating polypeptide, operably linked to a regulatory region. Examples of suitable regulatory regions are described in the section entitled "Regulatory Regions."

Vectors containing recombinant nucleic acid constructs such as those described herein also are provided. Suitable vector backbones include, for example, those routinely used in the art such as plasmids, viruses, artificial chromosomes, BACs, YACs, or PACs. Suitable expression vectors include, without limitation, plasmids and viral vectors derived from, for example, bacteriophage, baculoviruses, and retroviruses. Numerous vectors and expression systems are commercially available from such corporations as Novagen® (Madison, Wis.), Clontech® (Palo Alto, Calif.), Stratagene® (La Jolla, Calif.), and Invitrogen/Life Technologies® (Carlsbad, Calif.).

The vectors provided herein also can include, for example, origins of replication, scaffold attachment regions (SARs), and/or markers. A marker gene can confer a selectable phenotype on a plant cell. For example, a marker can confer biocide resistance, such as resistance to an antibiotic (e.g., kanamycin, G418, bleomycin, or hygromycin), or an herbicide (e.g., glyphosate, chlorsulfuron or phosphinothricin). In addition, an expression vector can include a tag sequence designed to facilitate manipulation or detection (e.g., purification or localization) of the expressed polypeptide. Tag sequences, such as luciferase, β-glucuronidase (GUS), green fluorescent protein (GFP), glutathione S-transferase (GST), polyhistidine, c-myc, hemagglutinin, or Flag™ tag (Kodak, New Haven, Conn.) sequences typically are expressed as a fusion with the encoded polypeptide. Such tags can be inserted anywhere within the polypeptide, including at either the carboxyl or amino terminus.

D. Regulatory Regions

The choice of regulatory regions to be included in a recombinant construct depends upon several factors, including, but not limited to, efficiency, selectability, inducibility, desired expression level, and cell- or tissue-preferential expression. It is a routine matter for one of skill in the art to modulate the expression of a coding sequence by appropriately selecting and positioning regulatory regions relative to the coding sequence. Transcription of a nucleic acid can be modulated in a similar manner.

Some suitable regulatory regions initiate transcription only, or predominantly, in certain cell types. Methods for identifying and characterizing regulatory regions in plant genomic DNA are known, including, for example, those described in the following references: Jordano et al., *Plant Cell*, 1:855-866 (1989); Bustos et al., *Plant Cell*, 1:839-854 (1989); Green et al., *EMBO J.*, 7:4035-4044 (1988); Meier et al., *Plant Cell*, 3:309-316 (1991); and Zhang et al., *Plant Physiology*, 110:1069-1079 (1996).

Examples of various classes of regulatory regions are described below. Some of the regulatory regions indicated below as well as additional regulatory regions are described in more detail in U.S. Patent Application Ser. Nos. 60/505,689; 60/518,075; 60/544,771; 60/558,869; 60/583,691; 60/619,181; 60/637,140; 60/757,544; 60/776,307; 10/957,569; 11/058,689; 11/172,703; 11/208,308; 11/274,890; 60/583,609; 60/612,891; 11/097,589; 11/233,726; 11/408,791; 11/414,142; 10/950,321; 11/360,017; PCT/US05/011105; PCT/US05/23639; PCT/US05/034308; PCT/US05/034343; and PCT/US06/038236; PCT/US06/040572; and PCT/US07/62762.

For example, the sequences of regulatory regions p326, YP0144, YP0190, p13879, YP0050, p32449, 21876, YP0158, YP0214, YP0380, PT0848, PT0633, YP0128, YP0275, PT0660, PT0683, PT0758, PT0613, PT0672, PT0688, PT0837, YP0092, PT0676, PT0708, YP0396, YP0007, YP0111, YP0103, YP0028, YP0121, YP0008, YP0039, YP0115, YP0119, YP0120, YP0374, YP0101, YP0102, YP0110, YP0117, YP0137, YP0285, YP0212, YP0097, YP0107, YP0088, YP0143, YP0156, PT0650, PT0695, PT0723, PT0838, PT0879, PT0740, PT0535, PT0668, PT0886, PT0585, YP0381, YP0337, PT0710, YP0356, YP0385, YP0384, YP0286, YP0377, PD1367, PT0863, PT0829, PT0665, PT0678, YP0086, YP0188, YP0263, PT0743 and YP0096 are set forth in the sequence listing of PCT/US06/040572; the sequence of regulatory region PT0625 is set forth in the sequence listing of PCT/US05/034343; the sequences of regulatory regions PT0623, YP0388, YP0087, YP0093, YP0108, YP0022 and YP0080 are set forth in the sequence listing of U.S. patent application Ser. No. 11/172,703; the sequence of regulatory region PR0924 is set forth in the sequence listing of PCT/US07/62762; and the sequences of regulatory regions p530c10, pOsFIE2-2, pOsMEA, pOsYp102, and pOsYp285 are set forth in the sequence listing of PCT/US06/038236.

It will be appreciated that a regulatory region may meet criteria for one classification based on its activity in one plant species, and yet meet criteria for a different classification based on its activity in another plant species.

i. Broadly Expressing Promoters

A promoter can be said to be "broadly expressing" when it promotes transcription in many, but not necessarily all, plant tissues. For example, a broadly expressing promoter can promote transcription of an operably linked sequence in one or more of the shoot, shoot tip (apex), and leaves, but weakly or not at all in tissues such as roots or stems. As another example, a broadly expressing promoter can promote transcription of an operably linked sequence in one or more of the stem, shoot, shoot tip (apex), and leaves, but can promote transcription weakly or not at all in tissues such as reproductive tissues of flowers and developing seeds. Non-limiting examples of broadly expressing promoters that can be included in the nucleic acid constructs provided herein include the p326, YP0144, YP0190, p13879, YP0050, p32449, 21876, YP0158, YP0214, YP0380, PT0848, and PT0633 promoters. Additional examples include the cauliflower mosaic virus (CaMV) 35S promoter, the mannopine synthase (MAS) promoter, the 1' or 2' promoters derived from T-DNA of *Agrobacterium tumefaciens*, the figwort mosaic virus 34S promoter, actin promoters such as the rice actin promoter, and ubiquitin promoters such as the maize ubiquitin-1 promoter. In some cases, the CaMV 35S promoter is excluded from the category of broadly expressing promoters.

ii. Root Promoters

Root-active promoters confer transcription in root tissue, e.g., root endodermis, root epidermis, or root vascular tissues. In some embodiments, root-active promoters are root-preferential promoters, i.e., confer transcription only or predominantly in root tissue. Root-preferential promoters include the YP0128, YP0275, PT0625, PT0660, PT0683, and PT0758 promoters. Other root-preferential promoters include the PT0613, PT0672, PT0688, and PT0837 promoters, which drive transcription primarily in root tissue and to a lesser extent in ovules and/or seeds. Other examples of root-preferential promoters include the root-specific subdomains of the CaMV 35S promoter (Lam et al., *Proc. Natl. Acad. Sci. USA,* 86:7890-7894 (1989)), root cell specific promoters reported by Conkling et al., *Plant Physiol.,* 93:1203-1211 (1990), and the tobacco RD2 promoter.

iii. Maturing Endosperm Promoters

In some embodiments, promoters that drive transcription in maturing endosperm can be useful. Transcription from a maturing endosperm promoter typically begins after fertilization and occurs primarily in endosperm tissue during seed development and is typically highest during the cellularization phase. Most suitable are promoters that are active predominantly in maturing endosperm, although promoters that are also active in other tissues can sometimes be used. Non-limiting examples of maturing endosperm promoters that can be included in the nucleic acid constructs provided herein include the napin promoter, the Arcelin-5 promoter, the phaseolin promoter (Bustos et al., *Plant Cell,* 1(9):839-853 (1989)), the soybean trypsin inhibitor promoter (Riggs et al., *Plant Cell,* 1(6):609-621 (1989)), the ACP promoter (Baerson et al., *Plant Mol. Biol.,* 22(2):255-267 (1993)), the stearoyl-ACP desaturase promoter (Slocombe et al., *Plant Physiol.,* 104(4):167-176 (1994)), the soybean α' subunit of β-conglycinin promoter (Chen et al., *Proc. Natl. Acad. Sci. USA,* 83:8560-8564 (1986)), the oleosin promoter (Hong et al., *Plant Mol. Biol.,* 34(3):549-555 (1997)), and zein promoters, such as the 15 kD zein promoter, the 16 kD zein promoter, 19 kD zein promoter, 22 kD zein promoter and 27 kD zein promoter. Also suitable are the Osgt-1 promoter from the rice glutelin-1 gene (Zheng et al., *Mol. Cell. Biol.,* 13:5829-5842 (1993)), the beta-amylase promoter, and the barley hordein promoter. Other maturing endosperm promoters include the YP0092, PT0676, and PT0708 promoters.

iv. Ovary Tissue Promoters

Promoters that are active in ovary tissues such as the ovule wall and mesocarp can also be useful, e.g., a polygalacturonidase promoter, the banana TRX promoter, the melon actin promoter, YP0396, and PT0623. Examples of promoters that are active primarily in ovules include YP0007, YP0111, YP0092, YP0103, YP0028, YP0121, YP0008, YP0039, YP0115, YP0119, YP0120, and YP0374.

v. Embryo Sac/Early Endosperm Promoters

To achieve expression in embryo sac/early endosperm, regulatory regions can be used that are active in polar nuclei and/or the central cell, or in precursors to polar nuclei, but not in egg cells or precursors to egg cells. Most suitable are promoters that drive expression only or predominantly in polar nuclei or precursors thereto and/or the central cell. A pattern of transcription that extends from polar nuclei into early endosperm development can also be found with embryo sac/early endosperm-preferential promoters, although transcription typically decreases significantly in later endosperm development during and after the cellularization phase. Expression in the zygote or developing embryo typically is not present with embryo sac/early endosperm promoters.

Promoters that may be suitable include those derived from the following genes: *Arabidopsis* viviparous-1 (see, GenBank No. U93215); *Arabidopsis* atmyc1 (see, Urao, *Plant Mol. Biol.,* 32:571-57 (1996); Conceicao, *Plant,* 5:493-505 (1994)); *Arabidopsis* FIE (GenBank No. AF129516); *Arabidopsis* MEA; *Arabidopsis* FIS2 (GenBank No. AF096096); and FIE 1.1 (U.S. Pat. No. 6,906,244). Other promoters that may be suitable include those derived from the following genes: maize MAC1 (see, Sheridan, *Genetics,* 142:1009-1020 (1996)); maize Cat3 (see, GenBank No. L05934; Abler, *Plant Mol. Biol.,* 22:10131-1038 (1993)). Other promoters include the following *Arabidopsis* promoters: YP0039, YP0101, YP0102, YP0110, YP0117, YP0119, YP0137, DME, YP0285, and YP0212. Other promoters that may be useful include the following rice promoters: p530c10, pOsFIE2-2, pOsMEA, pOsYp102, and pOsYp285.

vi. Embryo Promoters

Regulatory regions that preferentially drive transcription in zygotic cells following fertilization can provide embryo-preferential expression. Most suitable are promoters that preferentially drive transcription in early stage embryos prior to the heart stage, but expression in late stage and maturing embryos is also suitable. Embryo-preferential promoters include the barley lipid transfer protein (Ltp1) promoter (*Plant Cell Rep* 20:647-654 (2001)), YP0097, YP0107, YP0088, YP0143, YP0156, PT0650, PT0695, PT0723, PT0838, PT0879, and PT0740.

vii. Photosynthetic Tissue Promoters

Promoters active in photosynthetic tissue confer transcription in green tissues such as leaves and stems. Most suitable are promoters that drive expression only or predominantly in such tissues. Examples of such promoters include the ribulose-1,5-bisphosphate carboxylase (RbcS) promoters such as the RbcS promoter from eastern larch (*Larix laricina*), the pine cab6 promoter (Yamamoto et al., *Plant Cell Physiol.,* 35:773-778 (1994)), the Cab-1 promoter from wheat (Fejes et al., *Plant Mol. Biol.,* 15:921-932 (1990)), the CAB-1 promoter from spinach (Lubberstedt et al., *Plant Physiol.,* 104:997-1006 (1994)), the cab1R promoter from rice (Luan et al., *Plant Cell,* 4:971-981 (1992)), the pyruvate orthophosphate dikinase (PPDK) promoter from corn (Matsuoka et al., *Proc. Natl. Acad. Sci. USA,* 90:9586-9590 (1993)), the tobacco Lhcb1*2 promoter (Cerdan et al., *Plant Mol. Biol.,* 33:245-255 (1997)), the *Arabidopsis thaliana* SUC2 sucrose-H+ symporter promoter (Truernit et al., *Planta,* 196:564-570 (1995)), and thylakoid membrane protein promoters from spinach (psaD, psaF, psaE, PC, FNR, atpC, atpD, cab, rbcS). Other photosynthetic tissue promoters include PT0535, PT0668, PT0886, YP0144, YP0380 and PT0585.

viii. Vascular Tissue Promoters

Examples of promoters that have high or preferential activity in vascular bundles include YP0087, YP0093, YP0108, YP0022, and YP0080. Other vascular tissue-preferential promoters include the glycine-rich cell wall protein GRP 1.8 promoter (Keller and Baumgartner, *Plant Cell*, 3(10):1051-1061 (1991)), the Commelina yellow mottle virus (CoYMV) promoter (Medberry et al., *Plant Cell*, 4(2):185-192 (1992)), and the rice tungro bacilliform virus (RTBV) promoter (Dai et al., *Proc. Natl. Acad. Sci. USA*, 101(2):687-692 (2004)).

ix. Inducible Promoters

Inducible promoters confer transcription in response to external stimuli such as chemical agents or environmental stimuli. For example, inducible promoters can confer transcription in response to hormones such as giberellic acid or ethylene, or in response to light or drought. Examples of drought-inducible promoters include YP0380, PT0848, YP0381, YP0337, PT0633, YP0374, PT0710, YP0356, YP0385, YP0396, YP0388, YP0384, PT0688, YP0286, YP0377, PD1367, and PD0901. Examples of nitrogen-inducible promoters include PT0863, PT0829, PT0665, and PT0886. Examples of shade-inducible promoters include PR0924 and PT0678. An example of a promoter induced by salt is rd29A (Kasuga et al. (1999) Nature Biotech 17: 287-291).

x. Basal Promoters

A basal promoter is the minimal sequence necessary for assembly of a transcription complex required for transcription initiation. Basal promoters frequently include a "TATA box" element that may be located between about 15 and about 35 nucleotides upstream from the site of transcription initiation. Basal promoters also may include a "CCAAT box" element (typically the sequence CCAAT) and/or a GGGCG sequence, which can be located between about 40 and about 200 nucleotides, typically about 60 to about 120 nucleotides, upstream from the transcription start site.

xi. Stem Promoters

A stem promoter may be specific to one or more stem tissues or specific to stem and other plant parts. Stem promoters may have high or preferential activity in, for example, epidermis and cortex, vascular cambium, procambium, or xylem. Examples of stem promoters include YP0018 which is disclosed in US20060015970 and CryIA (b) and CryIA(c) (Braga et al. 2003, Journal of New Seeds 5:209-221).

xii. Other Promoters

Other classes of promoters include, but are not limited to, shoot-preferential, callus-preferential, trichome cell-preferential, guard cell-preferential such as PT0678, tuber-preferential, parenchyma cell-preferential, and senescence-preferential promoters. Promoters designated YP0086, YP0188, YP0263, PT0758, PT0743, PT0829, YP0119, and YP0096, as described in the above-referenced patent applications, may also be useful.

xiii. Other Regulatory Regions

A 5' untranslated region (UTR) can be included in nucleic acid constructs described herein. A 5' UTR is transcribed, but is not translated, and lies between the start site of the transcript and the translation initiation codon and may include the +1 nucleotide. A 3' UTR can be positioned between the translation termination codon and the end of the transcript. UTRs can have particular functions such as increasing mRNA stability or attenuating translation. Examples of 3' UTRs include, but are not limited to, polyadenylation signals and transcription termination sequences, e.g., a nopaline synthase termination sequence.

It will be understood that more than one regulatory region may be present in a recombinant polynucleotide, e.g., introns, enhancers, upstream activation regions, transcription terminators, and inducible elements. Thus, for example, more than one regulatory region can be operably linked to the sequence of a polynucleotide encoding a biomass-modulating polypeptide.

Regulatory regions, such as promoters for endogenous genes, can be obtained by chemical synthesis or by subcloning from a genomic DNA that includes such a regulatory region. A nucleic acid comprising such a regulatory region can also include flanking sequences that contain restriction enzyme sites that facilitate subsequent manipulation.

IV. Transgenic Plants and Plant Cells

A. Transformation

The invention also features transgenic plant cells and plants comprising at least one recombinant nucleic acid construct described herein. A plant or plant cell can be transformed by having a construct integrated into its genome, i.e., can be stably transformed. Stably transformed cells typically retain the introduced nucleic acid with each cell division. A plant or plant cell can also be transiently transformed such that the construct is not integrated into its genome. Transiently transformed cells typically lose all or some portion of the introduced nucleic acid construct with each cell division such that the introduced nucleic acid cannot be detected in daughter cells after a sufficient number of cell divisions. Both transiently transformed and stably transformed transgenic plants and plant cells can be useful in the methods described herein.

Transgenic plant cells used in methods described herein can constitute part or all of a whole plant. Such plants can be grown in a manner suitable for the species under consideration, either in a growth chamber, a greenhouse, or in a field. Transgenic plants can be bred as desired for a particular purpose, e.g., to introduce a recombinant nucleic acid into other lines, to transfer a recombinant nucleic acid to other species, or for further selection of other desirable traits. Alternatively, transgenic plants can be propagated vegetatively for those species amenable to such techniques. As used herein, a transgenic plant also refers to progeny of an initial transgenic plant provided the progeny inherits the transgene. Seeds produced by a transgenic plant can be grown and then selfed (or outcrossed and selfed) to obtain seeds homozygous for the nucleic acid construct.

Transgenic plants can be grown in suspension culture, or tissue or organ culture. For the purposes of this invention, solid and/or liquid tissue culture techniques can be used. When using solid medium, transgenic plant cells can be placed directly onto the medium or can be placed onto a filter that is then placed in contact with the medium. When using liquid medium, transgenic plant cells can be placed onto a flotation device, e.g., a porous membrane that contacts the liquid medium. A solid medium can be, for example, Murashige and Skoog (MS) medium containing agar and a suitable concentration of an auxin, e.g., 2,4-dichlorophenoxyacetic acid (2,4-D), and a suitable concentration of a cytokinin, e.g., kinetin.

When transiently transformed plant cells are used, a reporter sequence encoding a reporter polypeptide having a reporter activity can be included in the transformation procedure and an assay for reporter activity or expression can be performed at a suitable time after transformation. A suitable time for conducting the assay typically is about 1-21 days after transformation, e.g., about 1-14 days, about 1-7 days, or about 1-3 days. The use of transient assays is particularly convenient for rapid analysis in different species, or to confirm expression of a heterologous biomass-modulating polypeptide whose expression has not previously been confirmed in particular recipient cells.

Techniques for introducing nucleic acids into monocotyledonous and dicotyledonous plants are known in the art, and include, without limitation, *Agrobacterium*-mediated transformation, viral vector-mediated transformation, electroporation and particle gun transformation, e.g., U.S. Pat. Nos. 5,538,880; 5,204,253; 6,329,571 and 6,013,863. If a cell or cultured tissue is used as the recipient tissue for transformation, plants can be regenerated from transformed cultures if desired, by techniques known to those skilled in the art.

B. Screening/Selection

A population of transgenic plants can be screened and/or selected for those members of the population that have a trait or phenotype conferred by expression of the transgene. For example, a population of progeny of a single transformation event can be screened for those plants having a desired level of expression of a biomass-modulating polypeptide or nucleic acid. Physical and biochemical methods can be used to identify expression levels. These include Southern analysis or PCR amplification for detection of a polynucleotide; Northern blots, S1 RNase protection, primer-extension, or RT-PCR amplification for detecting RNA transcripts; enzymatic assays for detecting enzyme or ribozyme activity of polypeptides and polynucleotides; and protein gel electrophoresis, Western blots, immunoprecipitation, and enzyme-linked immunoassays to detect polypeptides. Other techniques such as in situ hybridization, enzyme staining, and immunostaining also can be used to detect the presence or expression of polypeptides and/or polynucleotides. Methods for performing all of the referenced techniques are known. As an alternative, a population of plants comprising independent transformation events can be screened for those plants having a desired trait, such as a modulated level of biomass. Selection and/or screening can be carried out over one or more generations, and/or in more than one geographic location. In some cases, transgenic plants can be grown and selected under conditions which induce a desired phenotype or are otherwise necessary to produce a desired phenotype in a transgenic plant. In addition, selection and/or screening can be applied during a particular developmental stage in which the phenotype is expected to be exhibited by the plant. Selection and/or screening can be carried out to choose those transgenic plants having a statistically significant difference in a biomass level relative to a control plant that lacks the transgene. Selected or screened transgenic plants have an altered phenotype as compared to a corresponding control plant, as described in the "Transgenic Plant Phenotypes" section herein.

C. Plant Species

The polynucleotides and vectors described herein can be used to transform a number of monocotyledonous and dicotyledonous plants and plant cell systems, including species from one of the following families: Acanthaceae, Alliaceae, Alstroemeriaceae, Amaryllidaceae, Apocynaceae, Arecaceae, Asteraceae, Berberidaceae, Bixaceae, Brassicaceae, Bromeliaceae, Cannabaceae, Caryophyllaceae, Cephalotaxaceae, Chenopodiaceae, Colchicaceae, Cucurbitaceae, Dioscoreaceae, Ephedraceae, Erythroxylaceae, Euphorbiaceae, Fabaceae, Lamiaceae, Linaceae, Lycopodiaceae, Malvaceae, Melanthiaceae, Musaceae, Myrtaceae, Nyssaceae, Papaveraceae, Pinaceae, Plantaginaceae, Poaceae, Rosaceae, Rubiaceae, Salicaceae, Sapindaceae, Solanaceae, Taxaceae, Theaceae, or Vitaceae.

Suitable species may include members of the genus *Abelmoschus, Abies, Acer, Agrostis, Allium, Alstroemeria, Ananas, Andrographis, Andropogon, Artemisia, Arundo, Atropa, Berberis, Beta, Bixa, Brassica, Calendula, Camellia, Camptotheca, Cannabis, Capsicum, Carthamus, Catharanthus, Cephalotaxus, Chrysanthemum, Cinchona, Citrullus, Coffea, Colchicum, Coleus, Cucumis, Cucurbita, Cynodon, Datura, Dianthus, Digitalis, Dioscorea, Elaeis, Ephedra, Erianthus, Erythroxylum, Eucalyptus, Festuca, Fragaria, Galanthus, Glycine, Gossypium, Helianthus, Hevea, Hordeum, Hyoscyamus, Jatropha, Lactuca, Linum, Lolium, Lupinus, Lycopersicon, Lycopodium, Manihot, Medicago, Mentha, Miscanthus, Musa, Nicotiana, Oryza, Panicum, Papaver, Parthenium, Pennisetum, Petunia, Phalaris, Phleum, Pinus, Poa, Poinsettia, Populus, Rauwolfia, Ricinus, Rosa, Saccharum, Salix, Sanguinaria, Scopolia, Secale, Solanum, Sorghum, Spartina, Spinacea, Tanacetum, Taxus, Theobroma, Triticosecale, Triticum, Uniola, Veratrum, Vinca, Vitis,* and *Zea*.

Suitable species include *Panicum* spp., *Sorghum* spp., *Miscanthus* spp., *Saccharum* spp., *Erianthus* spp., *Populus* spp., *Andropogon gerardii* (big bluestem), *Pennisetum purpureum* (elephant grass), *Phalaris arundinacea* (reed canarygrass), *Cynodon dactylon* (bermudagrass), *Festuca arundinacea* (tall fescue), *Spartina pectinata* (prairie cordgrass), *Medicago sativa* (alfalfa), *Arundo donax* (giant reed), *Secale cereale* (rye), *Salix* spp. (willow), *Eucalyptus* spp. (eucalyptus), *Triticosecale* (triticum—wheat X rye) and bamboo.

Suitable species also include *Helianthus annuus* (sunflower), *Carthamus tinctorius* (safflower), *Jatropha curcas* (jatropha), *Ricinus communis* (castor), *Elaeis guineensis* (palm), *Linum usitatissimum* (flax), and *Brassica juncea*.

Suitable species also include *Beta vulgaris* (sugarbeet), and *Manihot esculenta* (cassaya)

Suitable species also include *Lycopersicon esculentum* (tomato), *Lactuca sativa* (lettuce), *Musa paradisiaca* (banana), *Solanum tuberosum* (potato), *Brassica oleracea* (broccoli, cauliflower, Brussels sprouts), *Camellia sinensis* (tea), *Fragaria ananassa* (strawberry), *Theobroma cacao* (cocoa), *Coffea arabica* (coffee), *Vitis vinifera* (grape), *Ananas comosus* (pineapple), *Capsicum annum* (hot & sweet pepper), *Allium cepa* (onion), *Cucumis melo* (melon), *Cucumis sativus* (cucumber), *Cucurbita maxima* (squash), *Cucurbita moschata* (squash), *Spinacea oleracea* (spinach), *Citrullus lanatus* (watermelon), *Abelmoschus esculentus* (okra), and *Solanum melongena* (eggplant).

Suitable species also include *Papaver somniferum* (opium poppy), *Papaver orientale, Taxus baccata, Taxus brevifolia, Artemisia annua, Cannabis sativa, Camptotheca acuminate, Catharanthus roseus, Vinca rosea, Cinchona officinalis, Colchicum autumnale, Veratrum californica, Digitalis lanata, Digitalis purpurea, Dioscorea* spp., *Andrographis paniculata, Atropa belladonna, Datura stomonium, Berberis* spp., *Cephalotaxus* spp., *Ephedra sinica, Ephedra* spp., *Erythroxylum coca, Galanthus wornorii, Scopolia* spp., *Lycopodium serratum* (*Huperzia serrata*), *Lycopodium* spp., *Rauwolfia serpentina, Rauwolfia* spp., *Sanguinaria canadensis, Hyoscyamus* spp., *Calendula officinalis, Chrysanthemum parthenium, Coleus forskohlii,* and *Tanacetum parthenium*.

Suitable species also include *Parthenium argentatum* (guayule), *Hevea* spp. (rubber), *Mentha spicata* (mint), *Mentha piperita* (mint), *Bixa orellana*, and *Alstroemeria* spp.

Suitable species also include *Rosa* spp. (rose), *Dianthus caryophyllus* (carnation), *Petunia* spp. (petunia) and *Poinsettia pulcherrima* (poinsettia).

Suitable species also include *Nicotiana tabacum* (tobacco), *Lupinus albus* (lupin), *Uniola paniculata* (oats), bentgrass (*Agrostis* spp.), *Populus tremuloides* (aspen), *Pinus* spp. (pine), *Abies* spp. (fir), *Acer* spp. (maple), *Hordeum vulgare* (barley), *Poa pratensis* (bluegrass), *Lolium* spp. (ryegrass) and *Phleum pratense* (timothy).

In some embodiments, a suitable species can be a wild, weedy, or cultivated *Pennisetum* species such as, but not limited to, *Pennisetum alopecuroides, Pennisetum arnhemicum, Pennisetum caffrum, Pennisetum clandestinum, Pennisetum divisum, Pennisetum glaucum, Pennisetum latifolium, Pennisetum macrostachyum, Pennisetum macrourum, Pennisetum orientale, Pennisetum pedicellatum, Pennisetum polystachion, Pennisetum polystachion* ssp. *Setosum, Pennisetum purpureum, Pennisetum setaceum, Pennisetum subangustum, Pennisetum typhoides, Pennisetum villosum*, or hybrids thereof (e.g., *Pennisetum purpureum×Pennisetum typhoidum*).

In some embodiments, a suitable species can be a wild, weedy, or cultivated *Miscanthus* species and/or variety such as, but not limited to, *Miscanthus×giganteus, Miscanthus sinensis, Miscanthus×ogiformis, Miscanthus floridulus, Miscanthus transmorrisonensis, Miscanthus oligostachyus, Miscanthus nepalensis, Miscanthus sacchariflorus, Miscanthus×giganteus* 'Amuri', *Miscanthus×giganteus* 'Nagara', *Miscanthus×giganteus* 'Illinois', *Miscanthus sinensis* var. 'Goliath', *Miscanthus sinensis* var. 'Roland', *Miscanthus sinensis* var. 'Africa', *Miscanthus sinensis* var. 'Fern Osten', *Miscanthus sinensis* var. gracillimus, *Miscanthus sinensis* var. variegates, *Miscanthus sinensis* var. purpurascens, *Miscanthus sinensis* var. 'Malepartus', *Miscanthus sacchariflorus* var. 'Robusta', *Miscanthus sinensis* var. 'Silberfedher' (aka. Silver Feather), *Miscanthus transmorrisonensis, Miscanthus condensatus, Miscanthus yakushimanum, Miscanthus* var. 'Alexander', *Miscanthus* var. 'Adagio', *Miscanthus* var. 'Autumn Light', *Miscanthus* var. 'Cabaret', *Miscanthus* var. 'Condensatus', *Miscanthus* var. 'Cosmopolitan', *Miscanthus* var. 'Dixieland', *Miscanthus* var. 'Gilded Tower' (U.S. Pat. No. PP14,743), *Miscanthus* var. 'Gold Bar' (U.S. Pat. No. PP15,193), *Miscanthus* var. 'Gracillimus', *Miscanthus* var. 'Graziella', *Miscanthus* var. 'Grosse Fontaine', *Miscanthus* var. 'Hinjo aka Little Nicky'™, *Miscanthus* var. 'Juli', *Miscanthus* var. 'Kaskade', *Miscanthus* var. 'Kirk Alexander', *Miscanthus* var. 'Kleine Fontaine', *Miscanthus* var. 'Kleine Silberspinne' (aka. 'Little Silver Spider'), *Miscanthus* var. 'Little Kitten', *Miscanthus* var. 'Little Zebra' (U.S. Pat. No. PP13,008), *Miscanthus* var. 'Lottum', *Miscanthus* var. 'Malepartus', *Miscanthus* var. 'Morning Light', *Miscanthus* var. 'Mysterious Maiden' (U.S. Pat. No. PP16,176), *Miscanthus* var. 'Nippon', *Miscanthus* var. 'November Sunset', *Miscanthus* var. 'Parachute', *Miscanthus* var. 'Positano', *Miscanthus* var. 'Puenktchen' (aka 'Little Dot'), *Miscanthus* var. 'Rigoletto', *Miscanthus* var. 'Sarabande', *Miscanthus* var. 'Silberpfeil' (aka. Silver Arrow), *Miscanthus* var. 'Silverstripe', *Miscanthus* var. 'Super Stripe' (U.S. Pat. No. PP18,161), *Miscanthus* var. 'Strictus', or *Miscanthus* var. 'Zebrinus'.

In some embodiments, a suitable species can be a wild, weedy, or cultivated sorghum species and/or variety such as, but not limited to, *Sorghum almum, Sorghum amplum, Sorghum angustum, Sorghum arundinaceum, Sorghum bicolor* (such as bicolor, guinea, caudatum, kafir, and durra), *Sorghum brachypodum, Sorghum bulbosum, Sorghum burmahicum, Sorghum controversum, Sorghum drummondii, Sorghum ecarinatum, Sorghum exstans, Sorghum grande, Sorghum halepense, Sorghum interjectum, Sorghum intrans, Sorghum laxiflorum, Sorghum leiocladum, Sorghum macrospermum, Sorghum matarankense, Sorghum miliaceum, Sorghum nigrum, Sorghum nitidum, Sorghum plumosum, Sorghum propinquum, Sorghum purpureosericeum, Sorghum stipoideum, Sorghum sudanensese, Sorghum timorense, Sorghum trichocladum, Sorghum versicolor, Sorghum virgatum, Sorghum vulgare*, or hybrids such as *Sorghum× almum, Sorghum×sudangrass* or *Sorghum×drummondii*.

Thus, the methods and compositions can be used over a broad range of plant species, including species from the dicot genera *Brassica, Carthamus, Glycine, Gossypium, Helianthus, Jatropha, Parthenium, Populus*, and *Ricinus*; and the monocot genera *Elaeis, Festuca, Hordeum, Lolium, Oryza, Panicum, Pennisetum, Phleum, Poa, Saccharum, Secale, Sorghum, Triticosecale, Triticum*, and *Zea*. In some embodiments, a plant is a member of the species *Panicum virgatum* (switchgrass), *Sorghum bicolor* (sorghum, sudangrass), *Miscanthus giganteus* (miscanthus), *Saccharum* sp. (energycane), *Populus balsamifera* (poplar), *Zea mays* (corn), *Glycine max* (soybean), *Brassica napus* (canola), *Triticum aestivum* (wheat), *Gossypium hirsutum* (cotton), *Oryza sativa* (rice), *Helianthus annuus* (sunflower), *Medicago sativa* (alfalfa), *Beta vulgaris* (sugarbeet), or *Pennisetum glaucum* (pearl millet).

In certain embodiments, the polynucleotides and vectors described herein can be used to transform a number of monocotyledonous and dicotyledonous plants and plant cell systems, wherein such plants are hybrids of different species or varieties of a specific species (e.g., *Saccharum* sp.× *Miscanthus* sp., *Sorghum* sp.×*Miscanthus* sp., e.g., *Panicum virgatum×Panicum amarum, Panicum virgatum×Panicum amarulum*, and *Pennisetum purpureum×Pennisetum typhoidum*).

D. Transgenic Plant Phenotypes

In some embodiments, a plant in which expression of a biomass-modulating polypeptide is modulated can have increased levels of biomass in plants. For example, a biomass-modulating polypeptide described herein can be expressed in a transgenic plant, resulting in increased levels of vegetative tissue. The biomass level can be increased by at least 2 percent, e.g., 2, 3, 4, 5, 6, 7, 8, 9, 10, 11, 12, 13, 14, 15, 16, 17, 18, 19, 20, 25, 30, 35, 40, 45, 50, 55, 60, or more than 60 percent, as compared to the biomass level in a corresponding control plant that does not express the transgene. In some embodiments, a plant in which expression of a biomass-modulating polypeptide is modulated can have decreased levels of seed production. The level can be decreased by at least 2 percent, e.g., 2, 3, 4, 5, 10, 15, 20, 25, 30, 35, or more than 35 percent, as compared to the seed production level in a corresponding control plant that does not express the transgene.

Increases in seed production in such plants can provide improved nutritional availability in geographic locales where intake of plant foods is often insufficient, or for biofuel production. In some embodiments, decreases in biomass in such plants can be useful in situations where vegetative tissues are not the primary plant part that is harvested for human or animal consumption (i.e., seeds are harvested).

In some embodiments, a plant in which expression of a biomass-modulating polypeptide is modulated can have increased or decreased levels of biomass in one or more plant tissues, e.g., vegetative tissues, reproductive tissues, or root tissues. For example, the biomass level can be increased by at least 2 percent, e.g., 2, 3, 4, 5, 6, 7, 8, 9, 10, 11, 12, 13, 14, 15, 16, 17, 18, 19, 20, 25, 30, 35, 40, 45, 50, 55, 60, or more than 60 percent, as compared to the biomass level in a corresponding control plant that does not express the transgene. In some embodiments, a plant in which expression of a biomass-modulating polypeptide is modulated can have decreased levels of biomass in one or more plant tissues. The biomass level can be decreased by at least 2 percent, e.g., 2, 3, 4, 5, 10, 15, 20, 25, 30, 35, or more than 35 percent, as compared to the biomass level in a corresponding control plant that does not express the transgene.

Increases in biomass in such plants can provide improved food quantity, or improved energy production. Decreases in biomass can provide more efficient partitioning of nutrients to plant part(s) that are harvested for human or animal consumption.

Typically, a difference in the amount of biomass in a transgenic plant or cell relative to a control plant or cell is considered statistically significant at $p \leq 0.05$ with an appropriate parametric or non-parametric statistic, e.g., Chi-square test, Student's t-test, Mann-Whitney test, or F-test. In some embodiments, a difference in the amount of biomass is statistically significant at $p<0.01$, $p<0.005$, or $p<0.001$. A statistically significant difference in, for example, the amount of biomass in a transgenic plant compared to the amount of a control plant indicates that the recombinant nucleic acid present in the transgenic plant results in altered biomass levels.

The phenotype of a transgenic plant is evaluated relative to a control plant. A plant is said "not to express" a polypeptide when the plant exhibits less than 10%, e.g., less than 9%, 8%, 7%, 6%, 5%, 4%, 3%, 2%, 1%, 0.5%, 0.1%, 0.01%, or 0.001%, of the amount of polypeptide or mRNA encoding the polypeptide exhibited by the plant of interest. Expression can be evaluated using methods including, for example, RT-PCR, Northern blots, S1 RNase protection, primer extensions, Western blots, protein gel electrophoresis, immunoprecipitation, enzyme-linked immunoassays, chip assays, and mass spectrometry. It should be noted that if a polypeptide is expressed under the control of a tissue-preferential or broadly expressing promoter, expression can be evaluated in the entire plant or in a selected tissue. Similarly, if a polypeptide is expressed at a particular time, e.g., at a particular time in development or upon induction, expression can be evaluated selectively at a desired time period.

Biomass can include harvestable plant tissues such as leaves, stems, and reproductive structures, or all plant tissues such as leaves, stems, roots, and reproductive structures. In some embodiments, biomass encompasses only above ground plant parts. In some embodiments, biomass encompasses only stem plant parts. In some embodiments, biomass encompasses only above ground plant parts except inflorescence and seed parts of a plant. Biomass can be measured as described in the examples section. Biomass can be quantified as dry matter yield, which is the mass of biomass produced (usually reported in T/acre) if the contribution of water is subtracted from the fresh mater weight. Dry matter yield (DMY) yield is calculated using the fresh matter weight (FMW) and a measurement of weight percent moisture (M) in the following equation. DMY=((100−M)/100)*FMW. Biomass can be quantified as fresh matter yield, which is the mass of biomass produced (usually reported in T/acre) on an as-received basis, which includes the weight of moisture.

V. Modifying Endogenous Nucleic Acids Encoding Biomass-Modulating Polypeptides This document also features plant cells and plants in which an endogenous biomass-modulating nucleic acid described herein has been modified (e.g., a regulatory region, intron, or coding region of the biomass-modulating nucleic acid has been modified). The biomass of such plants is altered relative to the corresponding level of a control plant in which the endogenous nucleic acid is not modified. Such plants are referred to herein as modified plants and may be used to produce, for example, increased amounts of biomass.

Endogenous nucleic acid can be modified by homologous recombination techniques. For example, sequence specific endonucleases (e.g., zinc finger nucleases (ZFNs)) and meganucleases can be used to stimulate homologous recombination at endogenous plant genes. See, e.g., Townsend et al., Nature 459:442-445 (2009); Tovkach et al., Plant J., 57:747-757 (2009); and Lloyd et al., Proc. Natl. Acad. Sci. USA, 102:2232-2237 (2005). In particular, ZFNs engineered to create DNA double strand breaks at specific loci can be used to make targeted sequence changes in endogenous plant genes. For example, an endogenous plant gene can be replaced with a variant containing one or more mutations (e.g., produced using site-directed mutagenesis or directed evolution).

In some embodiments, endogenous nucleic acids can be modified by methylation or demethylation such that the expression of the modified endogenous nucleic acid is altered. For example, a double stranded RNA can be used to activate gene expression by targeting noncoding regulatory regions in gene promoters. See Shibuya et al., Proc Natl Acad Sci USA, 106(5): 1660-1665 (2009); and Li et al., Proc Natl Acad Sci USA, 103(46):17337-42 (2006).

In some embodiments, endogenous nucleic acids can be modified using activation tagging. For example, a vector containing multiple copies of an enhancer element from the constitutively active promoter of the cauliflower mosaic virus (CaMV) 35S gene can be used to activate an endogenous gene. See, Weigel et al., Plant Physiology, 122:1003-1013 (2000).

In some embodiments, endogenous nucleic acids can be modified by introducing an engineered transcription activation/repression factor (e.g., zinc finger protein transcription factor, or ZFP TF. See, for example, the world wide web at sangamo.com/tech/tech_plat_over.html#whatarezfp). An engineered transcription activation/repression factor (such as ZFP TF) can activate, repress, or switch the target endogenous biomass gene expression by binding specifically to the promoter region or coding region of the endogenous gene.

In some embodiments, endogenous nucleic acids can be modified by mutagenesis. Genetic mutations can be introduced within regenerable plant tissue using one or more mutagenic agents. Suitable mutagenic agents include, for example, ethyl methane sulfonate (EMS), N-nitroso-N-ethylurea (ENU), methyl N-nitrosoguanidine (MNNG), ethidium bromide, diepoxybutane, ionizing radiation, x-rays, UV rays and other mutagens known in the art. Suitable types of mutations include, for example, insertions or deletions of nucleotides, and transitions or transversions in the endogenous nucleic acid sequence. In one embodiment, TILLING (Targeted Induced Local Lesions In Genomes) can be used to produce plants having a modified endogenous nucleic acid. TILLING combines high-density mutagenesis with high-throughput screening methods. See, for example, McCallum et al., *Nat Biotechnol* 18: 455-457 (2000); reviewed by Stemple, *Nat Rev Genet.* 5(2):145-50 (2004).

In some embodiments, an endogenous nucleic acid can be modified via a gene silencing technique. See, for example, the section herein regarding "Inhibition of Expression of a Biomass-Modulating Polypeptide."

A population of plants can be screened and/or selected for those members of the population that have a modified nucleic acid. A population of plants also can be screened and/or selected for those members of the population that have a trait or phenotype conferred by expression of the modified nucleic acid. As an alternative, a population of plants can be screened for those plants having a desired trait, such as a modulated level of biomass. For example, a population of progeny can be screened for those plants having a desired level of expression of a biomass-modulating polypeptide or nucleic acid. Physical and biochemical methods can be used to identify modified nucleic acids and/or expression levels as described with transgenic plants. Selection and/or screening can be carried out over one or more generations, and/or in more than one geographic location. In some cases, plants can be grown and selected under conditions which induce a desired phenotype or are otherwise necessary to produce a desired phenotype in a modified plant. In addition, selection and/or screening can be applied during a particular developmental stage in which the phenotype is expected to be exhibited by the plant. Selection and/or screening can be carried out to choose those modified plants having a statistically significant difference in a biomass level relative to a control plant in which the nucleic acid has not been modified. Selected or screened modified plants have an altered phenotype as compared to a corresponding control plant, as described in the "Transgenic Plant Phenotypes" section herein.

Although a plant or plant cell in which an endogenous biomass-modulating nucleic acid has been modified is not transgenic for that particular nucleic acid, it will be appreciated that such a plant or cell may contain transgenes. For example, a modified plant can contain a transgene for other traits, such as herbicide tolerance or insect resistance. As another example, a modified plant can contain one or more transgenes that, in conjuction with modifications of one or more endogenous nucleic acids, exhibits an increase in biomass.

As with transgenic plant cells, modified plant cells can constitute part or all of a whole plant. Such plants can be grown in the same manner as described for transgenic plants and can be bred or propagated in the same manner as described for transgenic plants.

VI. Plant Breeding

Genetic polymorphisms that are useful in such methods include simple sequence repeats (SSRs, or microsatellites), rapid amplification of polymorphic DNA (RAPDs), single nucleotide polymorphisms (SNPs), amplified fragment length polymorphisms (AFLPs) and restriction fragment length polymorphisms (RFLPs). SSR polymorphisms can be identified, for example, by making sequence specific probes and amplifying template DNA from individuals in the population of interest by PCR. For example, PCR techniques can be used to enzymatically amplify a genetic marker associated with a nucleotide sequence conferring a specific trait (e.g., nucleotide sequences described herein). PCR can be used to amplify specific sequences from DNA as well as RNA, including sequences from total genomic DNA or total cellular RNA. When using RNA as a source of template, reverse transcriptase can be used to synthesize complementary DNA (cDNA) strands. Various PCR methods are described, for example, in *PCR Primer: A Laboratory Manual*, Dieffenbach and Dveksler, eds., Cold Spring Harbor Laboratory Press, 1995.

Generally, sequence information from polynucleotides flanking the region of interest or beyond is employed to design oligonucleotide primers that are identical or similar in sequence to opposite strands of the template to be amplified. Primers are typically 14 to 40 nucleotides in length, but can range from 10 nucleotides to hundreds of nucleotides in length. Template and amplified DNA is repeatedly denatured at a high temperature to separate the double strand, then cooled to allow annealing of primers and the extension of nucleotide sequences through the microsatellite, resulting in sufficient DNA for detection of PCR products. If the probes flank an SSR in the population, PCR products of different sizes will be produced. See, e.g., U.S. Pat. No. 5,766,847.

PCR products can be qualitative or quantitatively analyzed using several techniques. For example, PCR products can be stained with a fluorescent molecule (e.g., PicoGreen® or OliGreen®) and detected in solution using spectrophotometry or capillary electrophoresis. In some cases, PCR products can be separated in a gel matrix (e.g., agarose or polyacrylamide) by electrophoresis, and size-fractionated bands comprising PCR products can be visualized using nucleic acid stains. Suitable stains can fluoresce under UV light (e.g., Ethidium bromide, GR Safe, SYBR® Green, or SYBR® Gold). The results can be visualized via transillumination or epi-illumination, and an image of the fluorescent pattern can be acquired using a camera or scanner, for example. The image can be processed and analyzed using specialized software (e.g., ImageJ) to measure and compare the intensity of a band of interest against a standard loaded on the same gel.

Alternatively, SSR polymorphisms can be identified by using PCR product(s) as a probe against Southern blots from different individuals in the population. See, U. H. Refseth et al., (1997) *Electrophoresis* 18: 1519. Briefly, PCR products are separated by length through gel electrophoresis and transferred to a membrane. SSR-specific DNA probes, such as oligonucleotides labeled with radioactive, fluorescent, or chromogenic molecules, are applied to the membrane and hybridize to bound PCR products with a complementary nucleotide sequence. The pattern of hybridization can be visualized by autoradiography or by development of color on the membrane, for example.

In some cases, PCR products can be quantified using a real-time thermocycler detection system. For example, Quantitative real-time PCR can use a fluorescent dye that forms a DNA-dye-complex (e.g., SYBR® Green), or a fluorophore-containing DNA probe, such as single-stranded oligonucleotides covalently bound to a fluorescent reporter or fluorophore (e.g. 6-carboxyfluorescein or tetrachlorofluorescin) and quencher (e.g., tetramethylrhodamine or dihydrocyclopyrroloindole tripeptide minor groove binder). The fluorescent signal allows detection of the amplified product in real time, thereby indicating the presence of a sequence of interest, and allowing quantification of the copy number of a sequence of interest in cellular DNA or expression level of a sequence of interest from cellular mRNA.

The identification of RFLPs is discussed, for example, in Alonso-Blanco et al. (*Methods in Molecular Biology*, vol. 82, "Arabidopsis Protocols", pp. 137-146, J. M. Martinez-Zapater and J. Salinas, eds., c. 1998 by Humana Press, Totowa, N.J.); Burr ("Mapping Genes with Recombinant Inbreds", pp. 249-254, in Freeling, M. and V. Walbot (Ed.), *The Maize Handbook*, c. 1994 by Springer-Verlag New York, Inc.: New York, N.Y., USA; Berlin Germany; Burr et al. *Genetics* (1998) 118: 519; and Gardiner, J. et al., (1993) *Genetics* 134: 917). For example, to produce a RFLP library enriched with single- or low-copy expressed sequences, total DNA can be digested with a methylation-sensitive enzyme (e.g., PstI). The digested DNA can be separated by size on a preparative gel. Polynucleotide fragments (500 to 2000 bp) can be excised, eluted and cloned into a plasmid vector (e.g., pUC18). Southern blots of plasmid digests can be probed with total sheared DNA to select clones that hybridize to single- and low-copy sequences. Additional restriction endonucleases can be tested to increase the number of polymorphisms detected.

The identification of AFLPs is discussed, for example, in EP 0 534 858 and U.S. Pat. No. 5,878,215. In general, total cellular DNA is digested with one or more restriction enzymes. Restriction halfsite-specific adapters are ligated to all restriction fragments and the fragments are selectively amplified with two PCR primers that have corresponding adaptor and restriction site specific sequences. The PCR products can be visualized after size-fractionation, as described above.

In some embodiments, the methods are directed to breeding a plant line. Such methods use genetic polymorphisms identified as described above in a marker assisted breeding program to facilitate the development of lines that have a desired alteration in the biomass trait. Once a suitable genetic polymorphism is identified as being associated with variation for the trait, one or more individual plants are identified that possess the polymorphic allele correlated with the desired variation. Those plants are then used in a breeding program to combine the polymorphic allele with a plurality of other alleles at other loci that are correlated with the desired variation. Techniques suitable for use in a plant breeding program are known in the art and include, without limitation, backcrossing, mass selection, pedigree breeding, bulk selection, crossing to another population and recurrent selection. These techniques can be used alone or in combination with one or more other techniques in a breeding program. Thus, each identified plants is selfed or crossed a different plant to produce seed which is then germinated to form progeny plants. At least one such progeny plant is then selfed or crossed with a different plant to form a subsequent progeny generation. The breeding program can repeat the steps of selfing or outcrossing for an additional 0 to 5 generations as appropriate in order to achieve the desired uniformity and stability in the resulting plant line, which retains the polymorphic allele. In most breeding programs, analysis for the particular polymorphic allele will be carried out in each generation, although analysis can be carried out in alternate generations if desired.

In some cases, selection for other useful traits is also carried out, e.g., selection for fungal resistance or bacterial resistance. Selection for such other traits can be carried out before, during or after identification of individual plants that possess the desired polymorphic allele.

VII. Articles of Manufacture

Transgenic plants provided herein have various uses in the agricultural and energy production industries. For example, transgenic plants described herein can be used to make animal feed and food products. Such plants, however, are often particularly useful as a feedstock for energy production.

Transgenic plants described herein often produce higher yields of grain and/or biomass per hectare, relative to control plants that lack the exogenous nucleic acid or lack the modified endogenous nucleic acid. For example, transgenic plants described herein can have a grain yield that is increased about 5% to about 20% (e.g., increased 5% to 10%, 5% to 15%, 10% to 15%, 10% to 20%, or 15% to 20%) relative to that of control plants lacking the exogenous nucleic acid or lacking the modified endogenous nucleic acid. In some embodiments, such transgenic plants provide equivalent or even increased yields of grain and/or biomass per hectare relative to control plants when grown under conditions of reduced inputs such as fertilizer and/or water. Thus, such transgenic plants can be used to provide yield stability at a lower input cost and/or under environmentally stressful conditions such as drought. In some embodiments, plants described herein have a composition that permits more efficient processing into free sugars, and subsequently ethanol, for energy production. In some embodiments, such plants provide higher yields of ethanol, butanol, dimethyl ether, other biofuel molecules, and/or sugar-derived co-products per kilogram of plant material, relative to control plants. Such processing efficiencies are believed to be derived from the composition of the plant material, including, but not limited to, content of glucan, cellulose, hemicellulose, and lignin. By providing higher biomass yields at an equivalent or even decreased cost of production, the transgenic plants described herein improve profitability for farmers and processors as well as decrease costs to consumers.

Seeds from transgenic plants described herein can be conditioned and bagged in packaging material by means known in the art to form an article of manufacture. Packaging material such as paper and cloth are well known in the art. A package of seed can have a label, e.g., a tag or label secured to the packaging material, a label printed on the packaging material, or a label inserted within the package, that describes the nature of the seeds therein.

The invention will be further described in the following examples, which do not limit the scope of the invention described in the claims.

VIII. Examples

Example 1

Transgenic Rice Plants

The following symbols are used in with respect to rice transformation: $T_0$: plant regenerated from transformed tissue culture; $T_1$: first generation progeny of self-pollinated $T_0$ plants; $T_2$: second generation progeny of self-pollinated $T_1$ plants; $T_3$: third generation progeny of self-pollinated $T_2$ plants.

The following is a list of nucleic acids that were isolated from *Arabidopsis thaliana* plants: CeresAnnot: 553111_CW00758 (SEQ ID NO:1015), CeresAnnot: 838049_CW00759 (SEQ ID NO:850), CeresClone: 106263_CW00780 (SEQ ID NO:1064), CeresAnnot: 1298824_CW00817 (SEQ ID NO:1579), CeresClone:32753 (SEQ ID NO:1811), CeresClone:6639 (SEQ ID NO:1740), CeresAnnot:851842 (SEQ ID NO:2565), CeresClone:39378 (SEQ ID NO:2123), CeresAnnot:529860 (SEQ ID NO:1954), CeresAnnot:873343 (SEQ ID NO:2195), CeresAnnot:837788 (SEQ ID NO:2424), CeresAnnot:853198 (SEQ ID NO:2149), CeresClone:93867 (SEQ ID NO:2034), CeresAnnot:878887 (SEQ ID NO:2492), CeresClone:11830

(SEQ ID NO:1979), and CeresAnnot:1310682 (SEQ ID NO:1592). The following nucleic acids were isolated from *Zea mays* plants: CeresClone:896483_CW00787 (SEQ ID NO:740) and CeresClone:225681_CW00792 (SEQ ID NO:187). CeresClone:1773290_CW00761 (SEQ ID NO:153), CeresClone:1790897_CW00776 (SEQ ID NO:367), and CeresClone:1780416_CW00778 (SEQ ID NO:1598) were isolated from *Panicum virgatum* plants. CeresClone:1841236_CW00741 (SEQ ID NO:633) was isolated from *Gossypium hirsutum* plants. CeresClone:1744499_CW00813 (SEQ ID NO:1034) was isolated from *Musa acuminate* plants. CeresClone:1238706 (SEQ ID NO:2185) was isolated from *Glycine max* plants. CeresAnnot:1440417 (SEQ ID NO:2270) was isolated from *Populus balsamifera* subsp. *trichocarpa* plants.

Each isolated nucleic acid described above was cloned into a Ti plasmid vector containing a phosphinothricin acetyltransferase gene which confers Finale™ resistance to transformed plants. Constructs were made using the above mentioned nucleic acids that contained each operably linked to a 326F promoter construct was introduced into callus cells of the rice cultivar Kitaake by an *Agrobacterium*-mediated transformation protocol. Approximately 20-30 independent $T_0$ transgenic plants were generated from each transformation, as well as for the control plasmid (empty vector). Preliminary phenotypic analysis indicated that $T_0$ transformants did not show any significant phenotypic anomalies in vegetative organs, with a few exceptions where some plants appeared small with reduced fertility, most likely due to tissue culture effects.

$T_0$ plants were grown in a greenhouse, allowed to self-pollinate, and $T_1$ seeds collected. $T_1$ and $T_2$ plants were grown in a field. The presence of each construct was confirmed by PCR.

Rice seeds were soaked for 3-4 days before spring germination and transplanted to the field about one month later in Langfang, China. The distance between rows was 25 cm and the distance between plants was 15 cm. The combined fertilizer (16N-16P-16K) was applied at 25 kg/mu (666.7 m$^2$) just before transplanting. 12.5 kg/mu of urea was applied at two times during the growing season prior to panicle development.

Ten plants were grown per transgenic event within one row. Only those rows that were visibly different from control plants were measured. Plant height was measured at maturity.

Biomass (Dry weight) measurements were collected from $T_1$ plants. The stems with leaves and leaf sheaths but without panicles were dried in a greenhouse for at least a month, and then weighed for each plant (all tillers weighed together for each plant). Tiller number was counted after 4 months of growth.

Example 2

Results for Rice Events CW741-15, CeresClone:1841236_CW00741, (SEQ ID NO:633)

$T_1$ seed from one event of CW741-15 containing CeresClone:1841236_CW00741 was analyzed as described in Example 1. Table 1 contains the plant height, dry-weight biomass, panicle weight, and number of tillers that had inflorescence of transgenic $T_1$ plants in comparison to plants not containing the transgene grown at the same location. The table data row corresponds to a field row. The data points represent an average of 10 transgenic plants (1 row of same event) and an average of 40 control plants (4 rows). An increase in biomass was observed as indicated by the increased dry-weight biomass and plant height in the transgenic plants in comparison to plants not containing the transgene. The transgenic plants also had increased panicle weight in comparison to plants not containing the transgene.

TABLE 1

| Plant Height (cm) | | Dry-Weight Biomass (g) | | Panicle weight (g) | | No. of tillers | |
|---|---|---|---|---|---|---|---|
| CW741-15 | WT | CW741-15 | WT | CW741-15 | WT | CW741-15 | WT |
| 84.3 | 76.43 | 23.5 | 19.25 | 35.3 | 33.65 | 21.6 | 22.08 |

Example 3

Results for Rice Events CW00758, CeresAnnot:553111_CW00758 (SEQ ID NO:1015)

$T_1$ seed from one event of CW758-23 containing CeresAnnot:553111_CW00758 was analyzed as described in Example 1. Table 2 contains the plant height, biomass, panicle weight, and number of tillers that had inflorescence of transgenic $T_1$ plants in comparison to plants not containing the transgene grown at the same location. The table data row corresponds to a field row. The data points represent an average of 10 transgenic plants (1 row of same event) and an average of 40 control plants (4 rows). An increase in biomass was observed as indicated by the increased dry-weight biomass, plant height, and number of tillers in transgenic plants in comparison to plants not containing the transgene. The transgenic plants also had increased panicle weight in comparison to plants not containing the transgene.

TABLE 2

| Plant Height (cm) | | Dry-weight Biomass (g) | | Panicle weight (g) | | No. of tillers | |
|---|---|---|---|---|---|---|---|
| CW758-23 | WT | CW758-23 | WT | CW758-23 | WT | CW758-23 | WT |
| 81.8 | 76.6 | 23.8 | 20.13 | 40.1 | 33.08 | 26.4 | 23.50 |

Example 4

Results for Rice Events CW00759, CeresAnnot:838049_CW00759 (SEQ ID NO:850)

$T_1$ seed from one event of CW00759-01 containing CeresAnnot:838049 was analyzed as described in Example 1.

The plant height, dry-weight biomass, panicle weight, and number of tillers that had inflorescence of transgenic $T_1$ plants in comparison to plants not containing the transgene grown at the same location is shown in Table 3. The table data row corresponds to a field row. The data points represent an average of 10 transgenic plants (1 row of same event) and an average of 40 control plants (4 rows). An increase in biomass was observed as indicated by the increased plant height in the transgenic plants in comparison to plants not containing the transgene. The transgenic plants also had increased panicle weight in comparison to plants not containing the transgene.

TABLE 3

| Plant Height (cm) | | Dry-weight Biomass (g) | | Panicle weight (g) | | No. of tillers | |
|---|---|---|---|---|---|---|---|
| CW759-01 | WT | CW759-01 | WT | CW759-01 | WT | CW759-01 | WT |
| 81.9 | 76.73 | 18.3 | 20.13 | 38.4 | 33.9 | 24.2 | 23.93 |

Example 5

Results for Rice Events
CeresClone:1773290_CW00761 (SEQ ID NO:153)

$T_1$ seed from one event of CW00761-09 containing CeresClone:1773290 was analyzed as described in Example 1. The plant height, biomass, panicle weight, and number of tillers that had inflorescence of transgenic $T_1$ plants in comparison to plants not containing the transgene grown at the same location is shown in Table 4. The table data row corresponds to a field row. The data points represent an average of 10 transgenic plants (1 row of same event) and an average of 40 control plants (4 rows). An increase in biomass was observed as indicated by the increased dry-weight biomass and plant height in the transgenic plants in comparison to plants not containing the transgene. The transgenic plants also had increased panicle weight in comparison to plants not containing the transgene.

Example 6

Results for Rice Events CW00776-21,
CeresClone:1790897_CW00776 (SEQ ID NO:367)

$T_1$ seed from one event of CW00776-21 containing CeresClone:1790897 was analyzed as described in Example 1. The plant height, dry-weight biomass, panicle weight, and number of tillers that had inflorescence of transgenic $T_1$ plants in comparison to plants not containing the transgene grown at the same location is shown in Table 5. The table data row corresponds to a field row. The data points represent an average of 10 transgenic plants (1 row of same event) and an average of 40 control plants (4 rows). An increase in biomass was observed as indicated by the increased dry-weight biomass, plant height, and number of tillers in the transgenic plants in comparison to plants not containing the transgene. The transgenic plants also had increased panicle weight in comparison to plants not containing the transgene.

TABLE 5

| Plant Height (cm) | | Dry-weight Biomass (g) | | Panicle weight (g) | | No. of tillers | |
|---|---|---|---|---|---|---|---|
| CW776-21 | WT | CW776-21 | WT | CW776-21 | WT | CW776-21 | WT |
| 84.6 | 75.7 | 27.0 | 21.33 | 39.9 | 33.13 | 33.5 | 26.85 |

Example 7

Results for Rice Events CW00778,
CeresClone:1780416_CW00778 (SEQ ID NO:1598)

$T_1$ seed from one event of CW00778-08 containing CeresClone:1780416 was analyzed as described in Example 1. The plant height, dry-weight biomass, panicle weight, and number of tillers that had inflorescence of transgenic $T_1$ plants in comparison to plants not containing the transgene grown at the same location are shown in Table 6. Each table

TABLE 4

| Plant Height (cm) | | Dry-weight Biomass (g) | | Panicle weight (g) | | No. of tillers | |
|---|---|---|---|---|---|---|---|
| CW761-09 | WT | CW761-09 | WT | CW761-09 | WT | CW761-09 | WT |
| 86.2 | 77.03 | 25.2 | 18.053 | 36.4 | 29.35 | 25.8 | 24.0 | data row corresponds to a field row. The data points represent an average of 10 transgenic plants (1 row of same event) and an average of 40 control plants (4 rows). An increase in biomass was observed as indicated by the increased dry-weight biomass and plant height in the transgenic plants in comparison to plants not containing the transgene. The transgenic plants also had increased panicle weight in comparison to plants not containing the transgene.

TABLE 6

| Plant Height (cm) | | Dry-weight Biomass (g) | | Panicle weight (g) | | No. of tillers | |
| --- | --- | --- | --- | --- | --- | --- | --- |
| CW778-08 | WT | CW778-08 | WT | CW778-08 | WT | CW778-08 | WT |
| 82.5 | 75.11 | 26.5 | 20.74 | 31.9 | 31.77 | 24.5 | 24.74 |

Example 8

Results for Rice Events CW00780, CeresClone:106263_CW00780 (SEQ ID NO:1064)

$T_1$ seed from one event of CW00780-16 containing Ceres Clone: 638126 was analyzed as described in Example 1. The plant height, dry-weight biomass, panicle weight, and number of tillers of transgenic $T_1$ plants in comparison to plants not containing the transgene grown at the same location are shown in Table 7. The table data row corresponds to a field row. The data points represent an average of 10 transgenic plants (1 row of same event) and an average of 40 control plants (4 rows). An increase in biomass was observed as indicated by the increased dry-weight biomass and plant height in the transgenic plants in comparison to plants not containing the transgene.

TABLE 7

| Plant Height (cm) | | Dry-weight Biomass (g) | | Panicle weight (g) | | No. of tillers | |
| --- | --- | --- | --- | --- | --- | --- | --- |
| CW780-16 | WT | CW780-16 | WT | CW780-16 | WT | CW780-16 | WT |
| 88.8 | 76.30 | 34.5 | 24.54 | 33.8 | 36.60 | 21.0 | 28.18 |

Example 9

Results for Rice Events CW00787, CeresClone:896483_CW00787 (SEQ ID NO: 740)

$T_1$ seed from three events of CW00787-02 containing Ceres Clone: 896483 was analyzed as described in Example 1. The plant height, biomass, panicle weight, and number of tillers of transgenic T1 plants in comparison to plants not containing the transgene grown at the same location are shown in Table 8. The data points represent an average of 10 transgenic plants (1 row of same event) and an average of 40 control plants (4 rows). An increase in biomass was observed as indicated by the increased plant height in the transgenic plants in comparison to plants not containing the transgene.

TABLE 8

| Plant Height (cm) | | Dry-weight Biomass (g) | | Panicle weight (g) | | No. of tillers | |
| --- | --- | --- | --- | --- | --- | --- | --- |
| CW787-02 | WT | CW787-02 | WT | CW787-02 | WT | CW787-02 | WT |
| 83.3 | 78.11 | 23.5 | 24.58 | 33.0 | 34.75 | 25.2 | 28.77 |

Example 10

Results for Rice Events CW00813, CeresClone:1744499_CW00813 (SEQ ID NO:1034)

$T_1$ seed from one event of CW00813-09 containing Ceres Clone: 1744499 was analyzed as described in Example 1. The plant height, dry-weight biomass, panicle weight, and number of tillers that had inflorescence of transgenic $T_1$ plants in comparison to plants not containing the transgene grown at the same location is shown in Table 9. The table data row corresponds to a field row. The data points represent an average of 10 transgenic plants (1 row of same event) and an average of 40 control plants (4 rows). An increase in biomass was observed as indicated by the increased dry-weight biomass in the transgenic plants in comparison to plants not containing the transgene. The transgenic plants also had increased panicle weight in comparison to plants not containing the transgene.

TABLE 9

| Plant Height (cm) | | Dry-weight Biomass (g) | | Panicle weight (g) | | No. of tillers | |
|---|---|---|---|---|---|---|---|
| CW813-09 | WT | CW813-09 | WT | CW813-09 | WT | CW813-09 | WT |
| 83.3 | 74.64 | 19.8 | 22.06 | 37.2 | 36.17 | 20.0 | 24.47 |

Example 11

Results for Rice Events CW792, CeresClone:225681_CW00792 (SEQ ID NO:187)

T1 seed from one event of CW00792-10 containing Ceres Clone 225681 was analyzed as described in Example 1. The plant height, dry-weight biomass, panicle weight, and number of tillers that had inflorescence of transgenic T1 plants in comparison to plants not containing the transgene grown at the same location are shown in Table 10. The table data row corresponds to a field row. The data points represent an average of 10 transgenic plants (1 row of same event) and an average of 40 control plants (4 rows). An increase in biomass was observed as indicated by the increased plant height and dry-weight biomass in comparison to plants not containing the transgene.

TABLE 10

| Plant Height (cm) | | Dry-weight Biomass (g) | | Panicle weight (g) | | No. of tillers | |
|---|---|---|---|---|---|---|---|
| CW792-10 | WT | CW792-10 | WT | CW792-10 | WT | CW792-10 | WT |
| 82.6 | 74.97 | 26.7 | 20.82 | 33.2 | 35.19 | 25.2 | 26.69 |

Example 12

Results for Rice Events CW817, CeresAnnot:1298824_CW00817 (SEQ ID NO:1579)

$T_1$ seed from one event of CW00817-13 containing CeresAnnot:1298824 was analyzed as described in Example 1. This event was chosen to be quantitatively phenotyped from a number of events transformed with the same sequence that on visual inspection showed similar phenotypes compared to the wild type. Table 11 provides the plant height, dry-weight biomass, panicle weight, and number of tillers that had inflorescence of transgenic $T_1$ plants in comparison to plants not containing the transgene grown at the same location (WT). The table data row corresponds to a field row. The data points represent an average of 10 transgenic plants (1 row of same event) and an average of 40 control plants (4 rows). An increase in biomass was observed as indicated by the increased plant height and dry-weight biomass in the transgenic plants in comparison to plants not containing the transgene. The transgenic plants also had increased panicle weight in comparison to plants not containing the transgene.

The plant height, number of tillers that had inflorescence, panicle weight, and seed size of transgenic $T_2$ plants in comparison to plants not containing the transgene grown at the same location are shown in Table 12.

TABLE 11

| Plant Height (cm) | | Dry-weight Biomass (g) | | Panicle weight (g) | | No. of tillers | |
|---|---|---|---|---|---|---|---|
| CW817-13 | WT | CW817-13 | WT | CW817-13 | WT | CW817-13 | WT |
| 84.9 | 74.84 | 21.2 | 20.03 | 37.4 | 33.92 | 25.5 | 25.63 |

TABLE 12

| | | Rep I | Rep II | Rep III | Average |
|---|---|---|---|---|---|
| Panicle Wt (g) | WT | 23.6 | 21.4 | 24.5 | 23.2 |
| | CW00817 | 27.5 | 29.4 | 26.7 | 27.9 |
| No. of tillers | WT | 22.5 | 26.2 | 26.4 | 25.0 |
| | CW00817 | 24.3 | 28.42 | 24.9 | 25.9 |
| Plant Height (cm) | WT | 67.3 | 67.7 | 68.5 | 67.8 |
| | CW00817 | 76.5 | 76.1 | 76.7 | 76.4 |

TABLE 12-continued

| | | Rep I | Rep II | Rep III | Average |
|---|---|---|---|---|---|
| Seed size (wt/200 seeds) | WT | 4.8 | 4.7 | 4.7 | 4.7 |
| | CW00817 | 4.3 | 4.3 | 4.4 | 4.3 |

Example 13

Results for Rice Events CW00219, CW00676, and CW00691

Seeds from CW00219 plants containing CeresClone: 32753 (SEQ ID NO:1811), CW00676 plants containing CeresClone: 6639 (SEQ ID NO:1740), and CW00691 plants containing CeresAnnot:851842 (SEQ ID NO:2565) were analyzed as described in Example 1. The plant height, dry-weight biomass, and panicle weight of transgenic $T_2$ plants in comparison to plants not containing the transgene grown at the same location are shown in Table 13. The data points for each replicate represent an average of 10 transgenic plants (1 row of same event) and an average of 40 control plants (4 rows). For CW00219, an increase in biomass was observed as indicated by the increased plant height and dry-weight biomass in the transgenic plants in comparison to plants not containing the transgene. For CW00676, an increase in biomass was observed as indicated by the increased plant height in the transgenic plants in comparison to plants not containing the transgene. The CW00676 transgenic plants also had increased panicle weight in comparison to plants not containing the transgene. For CW00691, an increase in biomass was observed as indicated by the increased plant height and dry-weight biomass in the transgenic plants in comparison to plants not containing the transgene.

TABLE 13

|  |  | Rep I | Rep II | Rep III | Average |
|---|---|---|---|---|---|
| Panicle Wt (g) | WT | 356.9 | 343.2 | 366.7 | 355.6 |
|  | CW0219 | 339.0 | 348.8 | 347.7 | 345.2 |
| Dry-weight | WT | 17.1 | 15.1 | 14.6 | 15.6 |
| Biomass (g) | CW0219 | 19.0 | 20.6 | 21.1 | 20.2 |
| Plant Height | WT | 77.3 | 76.9 | 77.4 | 77.2 |
| (cm) | CW0219 | 82.2 | 83.0 | 80.6 | 81.9 |
| Panicle Wt (g) | WT | 395.4 | 385.0 | 361.6 | 380.7 |
|  | CW0676 | 412.4 | 374.8 | 410.4 | 399.2 |
| Dry-weight | WT | 16.6 | 20.0 | 16.6 | 17.7 |
| Biomass (g) | CW0676 | 18.0 | 15.9 | 18.4 | 17.4 |
| Plant Height | WT | 80.3 | 73.3 | 77.2 | 76.9 |
| (cm) | CW0676 | 99.5 | 96.5 | 98.1 | 98.0 |
| Panicle Wt (g) | WT | 395.4 | 385.0 | 361.6 | 380.7 |
|  | CW0691 | 343.2 | 322.1 | 316.2 | 327.2 |
| Dry-weight | WT | 16.6 | 20.0 | 16.6 | 17.7 |
| Biomass (g) | CW0691 | 26.8 | 23.2 | 24.8 | 24.9 |
| Plant Height | WT | 80.3 | 73.3 | 77.2 | 76.9 |
| (cm) | CW0691 | 82.8 | 76.6 | 83.2 | 80.9 |

Example 14

Results for Rice Events CW00018, CW00318, and CW00506-20

Seeds from two events of CW00018 containing Ceres-Clone:39378 (SEQ ID NO:2123), two events of CW00318 containing CeresAnnot:529860 (SEQ ID NO:1954), and one event of CW00506-20 containing CeresAnnot:873343 (SEQ ID NO:2195 were planted and grown under either low nitrogen (5.3 kg/mu; 34.2% of regular nitrogen supply) or regular nitrogen (15.5 kg/mu; 666.7 square meters) conditions. The plant height, dry-weight biomass, and panicle weight of transgenic CW00018 and CW00318 transgenic $T_3$ plants, and CW00506 $T_2$ plants in comparison to plants not containing the transgene grown at the same location are shown in Tables 14-16, respectively. The data points represent an average for three replicates of 40 transgenic plants each and an average of 40 control plants (4 rows). For CW00018 and CW00318, a statistically significant decrease in plant height was observed under both low and regular nitrogen conditions. For CW00506-20, a statistically significant decrease in plant height was observed under low nitrogen conditions. Dry weight biomass and panicle weight of CW00018, CW00318, and CW00506-20 plants were not significantly different from the control plants.

TABLE 14

|  | WT | | CW0018-1 | | CW0018-4 | |
|---|---|---|---|---|---|---|
| Genotype | Low N | Regular N | Low N | Regular N | Low N | Regular N |
| Plant Height (cm) | 83.68 | 80.93 | 75.55** | 72.28** | 64.18** | 66.14** |
| Dry weight biomass (g) | 16.01 | 14.6 | 18 | 13.59 | 14.05 | 12.47 |
| Panicle Wt/plant (g) | 29.98 | 31.51 | 32.7 | 28.1 | 28.64 | 25.47 |

**statistically significant at 1%

TABLE 15

|  | WT | | CW00318-2 | | CW0031894 | |
|---|---|---|---|---|---|---|
| Genotype | Low N | Regular N | Low N | Regular N | Low N | Regular N |
| Plant Height (cm) | 83.68 | 80.93 | 83.97 | 79.62 | 73.78** | 66.95** |
| Dry weight biomass (g) | 16.01 | 14.6 | 16.2 | 13.48 | 18.2 | — |
| Panicle Wt/plant(g) | 29.98 | 31.51 | 32.38 | 31.96 | 25.15 | 23.43 |

**statistically significant at 1%

TABLE 16

|  | WT | | CW00506-20 | |
|---|---|---|---|---|
| Genotype | Low N | Regular N | Low N | Regular N |
| Plant Height (cm) | 83.68 | 80.93 | 73.37* | 67.83 |
| Dry weight biomass (g) | 16.01 | 14.6 | 15.57 | 11.52 |
| Panicle Wt/plant (g) | 29.98 | 31.51 | 29.37 | 27.04 |

*statistically significant at 5%

Example 15

Results for Rice Events CW00232

Seeds from CW00232 plants containing CeresAnnot: 837788 (SEQ ID NO:2424) were analyzed as described in Example 1. The plant height, dry-weight biomass, and panicle weight of transgenic $T_2$ plants in comparison to plants not containing the transgene grown at the same location are shown in Table 17. The data points for each replicate represent an average of 40 transgenic plants and an average of 40 control plants (4 rows). For CW00232, a decrease in biomass was observed as indicated by the decreased dry-weight biomass in the transgenic plants in comparison to plants not containing the transgene.

TABLE 17

|  | Panicle Wt/Plot (g) | | Plant Height (cm) | | Dry-Weight Biomass (g) | |
|---|---|---|---|---|---|---|
|  | WT | CW0232 | WT | CW0232 | WT | CW0232 |
| Rep I | 395.4 | 361.9 | 80.3 | 76.3 | 16.6 | 15.8 |
| Rep II | 385.0 | 369.3 | 73.3 | 75.1 | 20.0 | 14.6 |

TABLE 17-continued

|  | Panicle Wt/Plot (g) | | Plant Height (cm) | | Dry-Weight Biomass (g) | |
|---|---|---|---|---|---|---|
|  | WT | CW0232 | WT | CW0232 | WT | CW0232 |
| Rep III | 361.8 | 364.7 | 77.2 | 74.9 | 16.6 | 15.1 |
| Average | 380.7 | 365.3 | 76.9 | 75.4 | 17.7 | 15.2* |

*statistically significant at 5%

Example 16

Results for Rice Events CW0703, CW0398, CW00551, CW00569, and CW00584

Seeds from CW00703 plants containing CeresAnnot: 853198, CW00398 plants containing CeresClone93867, CW00551 plants containing CeresClone:878887 (SEQ ID NO:2492), CW00569 plants containing CeresClone: 1238706 (SEQ ID NO:2185), and CW00584 plants containing CeresAnnot:1440417 (SEQ ID NO:2270) were analyzed as described in Example 1. The plant height, dry-weight biomass, and panicle weight of transgenic $T_2$ plants in comparison to plants not containing the transgene grown at the same location are shown in Tables 18 and 19. The data points for each replicate represent an average of 40 transgenic plants and an average of 40 control plants (4 rows). For CW00703 and CW00398, an increase in biomass was observed as indicated by the increased plant height in the transgenic plants in comparison to plants not containing the transgene. An increased panicle weight also was observed. For CW00676, an increase in biomass was observed as indicated by the increased plant height in the transgenic plants in comparison to plants not containing the transgene. The CW00676 transgenic plants also had increased panicle weight in comparison to plants not containing the transgene. For CW00551, an increase in biomass was observed as indicated by the increased plant height and dry-weight biomass in the transgenic plants in comparison to plants not containing the transgene. For CW00569 and CW0584, an increase in biomass was observed as indicated by the increased plant height and dry-weight biomass in the transgenic plants in comparison to plants not containing the transgene. The CW00569 transgenic plants also had increased panicle weight in comparison to plants not containing the transgene.

TABLE 18

| Trait | Replicate | WT | CW00703 | CW00398 |
|---|---|---|---|---|
| Panicle Wt (g) | I | 395.4 | 393.5 | 388.9 |
|  | II | 385.0 | 421.2 | 398.4 |
|  | III | 361.6 | — | 433.1 |
|  | Average | 380.7 | 407.4 | 406.8 |
| Dry-weight biomass (g) | I | 16.63 | 16.04 | 15.79 |
|  | II | 19.96 | 17.09 | 14.83 |
|  | III | 16.57 | 17.12 | 17.70 |
|  | Average | 17.72 | 16.75 | 16.11 |
| Plant Height (cm) | I | 80.25 | 83.17 | 85.50 |
|  | II | 73.25 | 81.17 | 79.60 |
|  | III | 77.17 | 79.10 | 82.83 |
|  | Average | 76.89 | 81.14 | 82.64 |

TABLE 19

| Trait | Replicate | WT | CW00551 | CW00569 | CW00584 |
|---|---|---|---|---|---|
| Panicle Wt (g) | I | 356.9 | 343.2 | 424.6 | 349.3 |
|  | II | 343.2 | 379.1 | 381.6 | 368.4 |
|  | III | 366.7 | 347.1 | 373.2 | 356.1 |
|  | Average | 355.6 | 356.5 | 393.1 | 357.9 |
| Dry-weight Biomass (g) | I | 17.1 | 18.4 | 26.4 | 23.3 |
|  | II | 15.1 | 16.8 | 23.7 | 24.5 |
|  | III | 14.6 | 18.4 | 25.4 | 24.0 |
|  | Average | 15.6 | 17.9 | 25.2 | 23.9 |
| Plant Height (cm) | I | 77.3 | 87.7 | 98.6 | 93.1 |
|  | II | 76.9 | 90.9 | 99.0 | 93.9 |
|  | III | 77.4 | 85.0 | 99.0 | 90.4 |
|  | Average | 77.2 | 87.9 | 98.9 | 92.5 |

Example 17

Transgenic *Arabidopsis* Plants

The following is a list of nucleic acids that were isolated from *Panicum virgatum* plants: CeresClone:1786268 (SEQ ID NO:1365), CeresClone:1769374 (SEQ ID NO:1214), CeresClone:1909354 (SEQ ID NO:1488), CeresClone: 1815762 (SEQ ID NO:252), CeresClone:1819917 (SEQ ID NO:197), CeresClone:1724480 (SEQ ID NO:579), CeresClone:1882035 (SEQ ID NO:503), CeresClone:1753603 (SEQ ID NO:927), CeresClone:1781794, CeresClone: 1791384 (SEQ ID NO:662), CeresClone:1724838 (SEQ ID NO:1), CeresClone:1871521 (SEQ ID NO:1332), and CeresClone:1792015 (SEQ ID NO:1540). CeresClone: 466497 (SEQ ID NO:1111) was isolated from *Zea mays* plants. CeresAnnot:1514289 (SEQ ID NO:52) was isolated from *Populus balsamifera* subsp. *trichocarpa* plants.

Each isolated nucleic acid described above was cloned into a binary or cointegration Ti plasmid vector containing a selectable marker conferring resistance to Finale®. The nucleic acid was operably linked to a 35S promoter. Each vector was introduced into *Arabidopsis* ecotype Wassilewskija (WS) via *Agrobacterium*-mediated transformation using the floral dip method essentially as described in Bechtold, N. et al., *C.R. Acad. Sci. Paris,* 316:1194-1199 (1993). The presence of each construct was verified by PCR. At least two independent events from each transformation were selected for further study. $T_0$ plants are plants from transformed tissue culture. $T_1$ plants are first generation progeny of self-pollinated $T_0$ plants. $T_2$ plants are second generation progeny of self-pollinated $T_1$ plants.

Biomass samples were collected and processed to determine the dry matter yield of transgenic plants. $T_2$ seeds from several transformation events of *Arabidopsis* were sown in a soil mixture composed of 60% Sunshine Mix and 40% medium-size vermiculite. Two lines were used as controls: (1) untransformed wild-type *Arabidopsis* and (2) wild-type transformed with construct Bin4-Ec6-Luc::NMCH-Luc, which contains a sequence conferring Finale® resistance, a Ec6 promoter to drive expression of a luciferase polypeptide, and a NMCH promoter to drive expression of a second luciferase polypeptide.

The sown seeds were vernalized for at least 3 days at 4° C. then transferred to either a greenhouse or a walk-in growth chamber for germination and growth. About one week post-germination, the experimental plants and the transgenic control were sprayed with Finale® to select for herbicide-resistant transgenic plants. Each pot was thinned-out by randomly removing seedlings to reduce the density of seedlings per pot to at least 10. Plants were allowed to grow until senescence.

Vegetative tissue (stems and undropped leaves) from ten senesced plants of each event were collected in a pre-labeled envelope and dried in a 42° C. oven overnight. Reproductive structures (siliques and seeds) from senesced plants of each event were collected separately. After cooling, each sample of vegetative tissue was milled, processed for composition analysis, and weighed to obtain the dry matter yield for each event. The dry matter yield for plants of each transgenic event was compared to the corresponding value for control lines. Table 20 provides the number of positive events containing a dry biomass ratio of 1.2 or greater relative to control.

TABLE 20

| Clone ID | Number of positive events containing a dry biomass ratio of 1.2 or greater |
|---|---|
| 1786268 | 4 out of 6 |
| 1769374 | 5 out of 6 |
| 1909354 | 3 out of 6 |
| 466497 | 3 out of 4 |
| 1815762 | 3 out of 3 |
| 1819917 | 2 out of 5 |
| 1724480 | 3 out of 6 |
| 1882035 | 4 out of 5 |

TABLE 20-continued

| Clone ID | Number of positive events containing a dry biomass ratio of 1.2 or greater |
|---|---|
| 1753603 | 2 out of 6 |
| 1781794 | 5 out of 6 |
| 1791384 | 4 out of 6 |
| 1724838 | 5 out of 6 |
| 1871521 | 1 out of 3 |
| 1792015 | 2 out of 6 |
| Annot.1514289 | 3 out of 6 |

These results indicate that the dry matter yield of a transgenic plant can be modulated relative to a control plant.

Example 18

Field Trial Data for CW00264 Rice Events

Table 21 summarizes field trial data for $T_2$ CW00264 plants containing CeresClone:11830 (SEQ ID NO:1979). In Table 21, well-watered indicates regular irrigation while rain-fed indicates rain was the only source of water as there was no irrigation after transplanting in field.

TABLE 21

| Line ID | Well-watered | | | | | Rain-fed | | | | | Difference well-water vs rain-fed (%) |
|---|---|---|---|---|---|---|---|---|---|---|---|
| | I | II | III | AVE | p-Value | I | II | III | AVE | p-Value | |
| Panicle Wt/plant (g) | | | | | | | | | | | |
| CW6-27A | 35.5 | 27.7 | 34.5 | 32.6 | 0.71 | 29.4 | 26.2 | 21.5 | 25.7 | 0.36 | 21.1 |
| CW264-13 | 32.5 | 32.8 | 31.0 | 32.1 | 0.66 | 20.6 | 26.4 | 20.9 | 22.6 | 0.87 | 29.5 |
| CW264-14 | 28.4 | 26.3 | 28.7 | 27.8 | 0.08 | 20.0 | 20.4 | 24.5 | 21.6 | 0.46 | 22.2 |
| CW264-16 | 29.2 | 31.1 | 27.6 | 29.3 | 0.26 | 26.2 | 22.2 | 23.1 | 23.8 | 0.63 | 18.8 |
| CW264-17 | 34.0 | 34.0 | 28.9 | 32.3 | 0.71 | 24.2 | 25.0 | 24.9 | 24.7 | 0.16 | 23.6 |
| Kitaake (wild-type) | 34.0 | 30.2 | 30.2 | 31.4 | | 24.6 | 22.6 | 22.0 | 23.0 | | 26.8 |
| Stem biomass/plant (g) | | | | | | | | | | | |
| CW6-27A | 18.1 | 15.2 | 16.0 | 16.4 | 0.91 | 14.3 | 11.3 | 10.7 | 12.1 | 0.52 | 26.1 |
| CW264-13 | 18.0 | 16.2 | 15.3 | 16.5 | 0.94 | 9.8 | 12.2 | 9.5 | 10.5 | 0.70 | 36.2 |
| CW264-14 | 13.6 | 13.2 | 13.1 | 13.3 | 0.06 | 8.6 | 8.6 | 11.1 | 9.4 | 0.28 | 29.1 |
| CW264-16 | 16.8 | 16.5 | 14.0 | 15.8 | 0.56 | 11.4 | 9.1 | 11.6 | 10.7 | 0.78 | 32.3 |
| CW264-17 | 15.8 | 16.3 | 13.4 | 15.2 | 0.33 | 10.0 | 10.0 | 10.1 | 10.0 | 0.42 | 33.8 |
| Kitaake (wild-type) | 17.7 | 14.8 | 17.2 | 16.6 | | 13.1 | 10.4 | 9.7 | 11.1 | | 33.2 |
| Total Dry Weight Biomass | | | | | | | | | | | |
| CW6-27A | 53.6 | 42.9 | 50.5 | 49.0 | 0.81 | 43.7 | 37.6 | 32.2 | 37.8 | 0.39 | 22.8 |
| CW264-13 | 50.5 | 49.0 | 46.3 | 48.6 | 0.82 | 30.4 | 38.7 | 30.4 | 33.2 | 0.79 | 31.8 |
| CW264-14 | 42.0 | 39.5 | 41.7 | 41.1 | 0.06 | 28.6 | 29.0 | 35.6 | 31.1 | 0.36 | 24.4 |
| CW264-16 | 46.0 | 47.6 | 41.6 | 45.1 | 0.34 | 37.5 | 31.2 | 34.7 | 34.5 | 0.89 | 23.5 |
| CW264-17 | 49.8 | 50.3 | 42.3 | 47.5 | 0.88 | 34.2 | 35.0 | 35.0 | 34.7 | 0.76 | 26.9 |
| Kitaake (wild type) | 51.7 | 45.0 | 47.4 | 48.0 | | 37.6 | 33.0 | 31.7 | 34.1 | | 29.0 |
| Plant Height (cm) | | | | | | | | | | | |
| CW6-27A | 76.5 | 76.2 | 76.0 | 76.2 | 0.38 | 69.2 | 66.4 | 64.2 | 66.6 | 0.35 | 12.6 |
| CW264-13 | 71.9 | 75.4 | 74.5 | 73.9 | 0.24 | 59.5 | 64.7 | 59.5 | 61.2 | 0.16 | 17.2 |
| CW264-14 | 69.3 | 70.6 | 72.0 | 70.6 | 0.01 | 59.8 | 64.3 | 63.7 | 62.6 | 0.25 | 11.4 |
| CW264-16 | 76.7 | 76.3 | 75.9 | 76.3 | 0.34 | 68.9 | 67.6 | 67.8 | 68.1 | 0.02 | 10.8 |
| CW264-17 | 74.6 | 76.8 | 76.0 | 75.8 | 0.90 | 67.7 | 66.6 | 64.7 | 66.3 | 0.24 | 12.5 |
| Kitaake (wild type) | 75.6 | 76.6 | 74.8 | 75.7 | | 66.1 | 64.2 | 64.2 | 64.8 | | 14.3 |

Example 19

Results for Rice Events CW00716

T₁ seeds from CW00716 events containing CeresAnnot: 1310682 (SEQ ID NO:1592) were analyzed as described in Example 1. A number of independent transgenic events were recovered from the transformation with CeresAnnot: 1310682 (SEQ ID NO:1592). Visual inspection of $T_1$ progeny from different transgenic events indicated that many of the $T_1$ progeny appeared to have a similar amount of biomass as plants not containing the transgene. Progeny from one CW00716 event were chosen to be quantitatively phenotyped and the dry-weight biomass of individual transgenic $T_1$ plants of the same self-pollinated $T_0$ plant are shown in Table 22 in comparison to plants not containing the transgene and grown in the same location (WT). Table 23 provides the grain yield (g), plant height (cm), and stem weight (g) of transgenic $T_2$ plants (from same event as Table 22) in comparison to plants not containing the transgene grown at the same location (WT). An increase in grain yield and an increase in plant height were observed in the transgenic plants in comparison to plants not containing the transgene.

TABLE 22

Dry-weight Biomass (g) of Individual Plants

| | Individual T₁ plants | | | | | | | | | | Avg. |
|---|---|---|---|---|---|---|---|---|---|---|---|
| CW00716 | 20.29 | 24.25 | 14.84 | / | 19.11 | 28.81 | 19.93 | 12.55 | 15.48 | 38.41 | 21.52 |
| WT | 23.16 | 13.71 | 16.27 | 8.39 | 12.62 | 14.86 | 24.93 | 10.86 | 17.19 | 26.18 | 16.11 |
| WT | 13.22 | 14.75 | 18.63 | 14.26 | 19.61 | 12.14 | 19.75 | 14.75 | 16.82 | 25.46 | 17.35 |
| WT | 16.39 | 23.31 | 18.95 | 16.46 | 18.28 | 12.8 | 15.77 | 19.52 | 12.27 | 30.33 | 18.63 |
| WT | 18.05 | 17.06 | 16.65 | 11.87 | 11.96 | 21.72 | 23.86 | 14.25 | 15.02 | 15.07 | 16.38 |

TABLE 23

| | | Rep I | Rep II | Rep III | Average |
|---|---|---|---|---|---|
| Grain yield (g) | WT | 395.4 | 385 | 361.6 | 380.7 |
| | CW00716 | 397 | 391.2 | 429.6 | 405.9 |
| Plant Height (cm) | WT | 80.3 | 73.3 | 77.2 | 76.9 |
| | CW00716 | 86.9 | 82.5 | 88.3 | 85.9 |
| Stem weight (g) | WT | 16.6 | 20.0 | 16.6 | 17.7 |
| | CW00716 | 17.4 | 17.1 | 16.1 | 16.9 |

Example 20

Determination of Functional Homologs by Reciprocal BLAST®

A candidate sequence was considered a functional homolog of a reference sequence if the candidate and reference sequences encoded proteins having a similar function and/or activity. A process known as Reciprocal BLAST® (Rivera et al., *Proc. Natl. Acad. Sci. USA*, 95:6239-6244 (1998)) was used to identify potential functional homolog sequences from databases consisting of all available public and proprietary peptide sequences, including NR from NCBI and peptide translations from Ceres clones.

Before starting a Reciprocal BLAST® process, a specific reference polypeptide was searched against all peptides from its source species using BLAST® in order to identify polypeptides having BLAST® sequence identity of 80% or greater to the reference polypeptide and an alignment length of 85% or greater along the shorter sequence in the alignment. The reference polypeptide and any of the aforementioned identified polypeptides were designated as a cluster.

The BLASTP® version 2.0 program from Washington University at Saint Louis, Mo., USA was used to determine BLAST® sequence identity and E-value. The BLASTP® version 2.0 program includes the following parameters: 1) an E-value cutoff of 1.0e-5; 2) a word size of 5; and 3) the -postsw option. The BLAST® sequence identity was calculated based on the alignment of the first BLAST® HSP (High-scoring Segment Pairs) of the identified potential functional homolog sequence with a specific reference polypeptide. The number of identically matched residues in the BLAST® HSP alignment was divided by the HSP length, and then multiplied by 100 to get the BLAST® sequence identity. The HSP length typically included gaps in the alignment, but in some cases gaps were excluded.

The main Reciprocal BLAST® process consists of two rounds of BLAST® searches; forward search and reverse search. In the forward search step, a reference polypeptide sequence, "polypeptide A," from source species SA was BLASTed® against all protein sequences from a species of interest. Top hits were determined using an E-value cutoff of $10^{-5}$ and a sequence identity cutoff of 35%. Among the top hits, the sequence having the lowest E-value was designated as the best hit, and considered a potential functional homolog or ortholog. Any other top hit that had a sequence identity of 80% or greater to the best hit or to the original reference polypeptide was considered a potential functional homolog or ortholog as well. This process was repeated for all species of interest.

In the reverse search round, the top hits identified in the forward search from all species were BLASTed® against all protein sequences from the source species SA. A top hit from the forward search that returned a polypeptide from the aforementioned cluster as its best hit was also considered as a potential functional homolog.

Functional homologs were identified by manual inspection of potential functional homolog sequences. Representative functional homologs for SEQ ID NOs: 1333, 1489, 504, 198, 253, 1541, 663, 1366, 928, 1215, 4, 580, 53, 1112, 634, 368, 1599, 154, 1035, 741, 187, 1065, 1592, 851, 1016, 2186, 1955, 2566, 2150, 2196, 2493, 2271, 1741, 1980, 1812, 2124, 2035, and 2425 are shown in FIGS. 1-38, respectively. Additional exemplary homologs are correlated to certain Figures in the Sequence Listing.

Example 21

Determination of Functional Homologs by Hidden Markov Models

Hidden Markov Models (HMMs) were generated by the program HMMER 2.3.2. To generate each HMM, the default HMMER 2.3.2 program parameters, configured for global alignments, were used.

An HMM was generated using the sequences shown in FIG. 1 as input. These sequences were fitted to the model and a representative HMM bit score for each sequence is shown in the Sequence Listing. Additional sequences were fitted to the model, and representative HMM bit scores for any such additional sequences are shown in the Sequence Listing. The results indicate that these additional sequences are functional homologs of SEQ ID NO: 1333.

The procedure above was repeated and an HMM was generated for each group of sequences shown in FIGS. 2-38, using the sequences shown in each Figure as input for that HMM. A representative bit score for each sequence is shown in the Sequence Listing. Additional sequences were fitted to certain HMMs, and representative HMM bit scores for such additional sequences are shown in the Sequence Listing. The results indicate that these additional sequences are functional homologs of the sequences used to generate that HMM.

OTHER EMBODIMENTS

It is to be understood that while the invention has been described in conjunction with the detailed description thereof, the foregoing description is intended to illustrate and not limit the scope of the invention, which is defined by the scope of the appended claims. Other aspects, advantages, and modifications are within the scope of the following claims.

SEQUENCE LISTING (2623 sequences)

SEQ ID NO: 1 - DNA, 1097 bp, Panicum virgatum
  misc_feature (1)..(1097): Ceres Clone ID no. 1724838
  misc_feature (1)..(1097): Encodes the peptide sequence at SEQ ID NO. 2
ctcctccgctccatccaaacctggcacccggcctccgcctccgtctccacctccagccgcctcctggcctccctctccctctctcccttccccaaacgcctcctacctagccaccatcgatggttacccctccctccctctccctctccacgcttgcgtggggctacggtgcggccagatctggcgcgggcggcaccctacacgccatgctgaaggggcgcacgatggcgccgcgaagccccgagcctggcgtggaggcggcgtgcgggtgtcgcccagagcagccatgcgcggcggccggacctcgagatggatggccaaggcaatcgtggatccagggacgggttgagctccggccccagcgcgttcaatcaggggctgctgtagcggagcttcgcccttgtgcgtcgcctctgccgcggctcagcgactcctctctgtggacggttgcggctgccggacgcctccccgacgaggcccagcgagccgtcccgaaggagccagggaggacggagatgaggagtgagccagcgtctggcaagggaggcgtggcggcgcgtaggagatctgcggcgggtggctggttcgcaggcgcgtcttgcgagggcgccctcggcagtctcttggcgtactgccacactggagtggataaggagctgaggagcggcaggcaagcagccaacaaccaggagcgattcggggaagggaagcagcaaggtaattgttttggcgtggtgcagaagcccaacaaacagctcatgccctactacttttaggaacaacatggttgtggatgtgaatgagatgggcgtcaagcatacatgcagatttctgctaggtcagagatgaagaagcaagctgtgttggaggcgcagcttgagcatttgctgtgtcaaaatggaccgagcaaagcgtcatggtggtatgttagcttttggtggaattaagcttttgcaggaaccaaacttgtgtttgtaattctgctgaaacctatctttttttttgttctgatgctacaatggacggcaagtgatactagatgaaaaaaatgtatgtgatctgttgatttaatacgatgctgaatggaaacgtgattc

SEQ ID NO: 2 - protein, 218 aa, Panicum virgatum
  misc_feature (1)..(218): Ceres Clone ID no. 1724838
MVTPPSLSLSTLAWGYGAARSGAGGTLHAMLKGRTMAPRSPEPGVEAACGCRPEQPCAAAGPRDGWPRQSWIQGRVELRPQRVQSGAAVAELRPCASPLPRLSDSSLWTVAAAGRLPDEAQRAVPKEPGRTEMRSEPASGKGGVAARRRSAAGGWFAGASCEGALGSLLAYCHTGVDKELRSGRQAANNQERFGEGKQQGNCFGVVQKPNKQLMPYYF

SEQ ID NO: 3 - DNA, 2255 bp, Panicum virgatum
  misc_feature (1)..(2255): Ceres Clone ID no. 1753603
  misc_feature (1)..(2255): Encodes the peptide sequence at SEQ ID NO. 4
tcctgcactcgctcgcctcttccgtcgggaggggaggtcttggatgctgcccgcatgacacacgggttcaattagagtttacaagtggaagcgtatgggtaccaaggaagcatcccctcctactgtcctctgcctcttctttctgttctgcttaggcggcaaatgcctagcgtcagaattccaagctacccagacagcaaccctcacggttgatgcctcaccgcagcttgctcggaagattcctgacacactatttgggatcttttttgaggagatcaaccatgcaggagctggtggaatatgggctgaactcgttagtaacagaggttttgaagctggaggcccccatactccatcgaacattggcccatggtccatcattggagatgactcttccatatttgtggcgactgatcgtacatcatgtttcagtcgaaacattgttgctctaaggatggaggtcctctgcgataactgtccagctgggggtgttggcatttacaacccaggattctggggcatgaacatagaagatggaaagacatacaacctagttatgtatgctaagtcgccagaaacaacagacttgacagtttcgctaacgagtgctgatgggtcacaaagtctggcttcagctacggtcacagtctctggcacattaaattggacaaaactggagcagaaattggttgccaaaggaaccaatagaacctcaaggcttcaaataacgactaacaagaaaggagttgtctggtttgatcaagtatcactcatgcctgaagacacatacaagggacacggttttcgcacagaacttatatccatgcttttggatttgaaaccacaattcttgagatttcctggaggctgctttgtagaaggtgattggttaaggaatgccttcaggtggagagaatctattggtccatgggaggagagacctggacacttcggggatgtttggcactactggactgatgatggccttggatattatgaatttcttcagcttgcggaggacctgggtgctgccccaatctgggtgttcaacaacggagtcagccacaatgatgaagttgatactgttgctattgctccttttgtaaaggatgtattggacagtctagagtttgcaagggggagtgcaaactcaacatggggctctgttagggcttcaatgggtcaccctgaacccttcccagtgaaatatgttgcaattggaaatgaagactgcgggaaaaagttttaccgtggtaactacctcaagttctacaatgctataagacaggcctatcctgacattcaaatgatctcaaactgtgatggttcatctaaaccacttgatcatcctgctgatttatacgacttccatgtctacactgactcgaagactttgtttaacatgaggagcacatttgacagaacatctcgtagtggacccaaggcttttgtgagtgagtacgctgtttggagaagtgacgcaggtagaggaagtcttcttgcttcgttggcagaagctgctttccttactgggctggagaagaatagtgacattgttcagatggcaagttatgctccactgttcgtgaacgacaatgatcaaacgtggaacccagatgctattgtctttaactcgtggcagcattatggaactccgagttactggatgcaaacccttttccgtgagtccagtggtgccatgattcatccaatcaaaatcagttccaactactctggttctctggcggcatctgcaattacttggcaagattcagagaatagtttcctaagagtaaaggttgtaaactttggatcagatgctggtagccttacaatctccacaagcggacttcaagctagtgttaatgctctgggatcaacagccactgttctcacatccgggaatgtgatggatgaaaattctttcagtaacccaaacaaggttgcgccagttaagagcgagctgagcaatgccgcagagcagatgcaggtcacgctggctcctcactccttcagttcattcgatctcgcgctggctcagtccaaacttattgcggagatgtgaagtggcatgacccatagtaggctggtgacagatacacgagcaatacacactacagatggtgtgatacgcgaataccagcaaccagggagttgctgctgttagcatcttgataaaagctttgtatagtgtaacacgatgcagatacacagtactaaataaaaatcacatcaggttggtttggtgttgactc

SEQ ID NO: 4 - protein, 656 aa, Panicum virgatum
  misc_feature (454)..(639): Pfam Name: Alpha-L-AF_C Pfam Description: Alpha-L-arabinofuranosidase C-terminus
  misc_feature (71)..(229): Pfam Name: CBM_4_9 Pfam Description: Carbohydrate binding domain
  misc_feature (1)..(656): Ceres Clone ID no. 1753603
  misc_feature (1)..(656): Bit score of 1655.4 for HMM based on sequences of Figure 11
  misc_feature (1)..(656): in Figure 11
MGTKEASPPTVLCLFFLFCLGGKCLASEFQATQTATLTVDASPQLARKIPDTLFGIFFEEINHAGAGGIWAELVSNRGFEAGGPHTPSNIGPWSIIGDDSSIFVATDRTSCFSRNIVALRMEVLCDNCPAGGVGIYNPGFWGMNIEDGKTYNLVMYAKSPETTDLTVSLTSADGSQSLASATVTVSGTLNWTKLEQKLVAKGTNRTSRLQITTNKKGVVWFDQVSLMPEDTYKGHGFRTELISMLLDLKPQFLRFPGGCFVEGDWLRNAFRWRESIGPWEERPGHFGDVWHYWTDDGLGYYEFLQLAEDLGAAPIWVFNNGVSHNDEVDTVAIAPFVKDVLDSLEFARGSANSTWGSVRASMGHPEPFPVKYVAIGNEDCGKKFYRGNYLKFYNAIRQAYPDIQMISNCDGSSKPLDHPADLYDFHVYTDSKTLFNMRSTFDRTSRSGPKAFVSEYAVWRSDAGRGSLLASLAEAAFLTGLEKNSDIVQMASYAPLFVNDNDQTWNPDAIVFNSWQHYGTPSYWMQTLFRESSGAMIHPIKISSNYSGSLAASAITWQDSENSFLRVKVVNFGSDAGSLTISTSGLQASVNALGSTATVLTSGNVMDENSFSNPNKVAPVKSELSNAAEQMQVTLAPHSFSSFDLALAQSKLIAEM

SEQ ID NO: 5 - DNA, 1950 bp, Sorghum bicolor
  misc_feature (1)..(1950): Ceres Annot ID no. 8682811
  misc_feature (1)..(1950): Encodes the peptide sequence at SEQ ID NO. 6
atgggtaccggcaaggacgcagcccctcgcgccatcctctgcttcttgtttctgttctgcttaggctgcaaatgcctggcatcagagttggaggccacccagacggcgaccctcacggtcgatgcctcgccgcagcttgctcggaagatccctgatacactatttgggatcttctttgaggagatcaaccatgcaggagctggtggcatatgggctgaacttgttagtaacagagggtttgaagctggaggcctccatactccatcaaacattgacccatggtccatcattggagatgactcttctatatatgtggagactgatcggacatcatgtttcagtcgaaacatcattgctctgaggatggaggtcctttgcgataactgtcctactggtggtgttggtatttacaacccagggttctggggcatgaacatagaagatggaaaggcctacaatcttgttatgtatgttaagtcaccagaaacaaccgacttgatagtttcactaacaagctctgatgggttgcaaaatctggcttcagctacaataacagtttccggcgaatcaaattggacaaaagtggagcaaaagttggttgctaaaggaaccaatagaacctcaaggcttcaaataacaactaacaagaaaggagttgtttggtttgatcaagtatcactcatgcctgaagacacatacaagggacatggctttcgcacagaacttatatccatgattttggatttaaaaccacgattcttgagatttcctggaggttgctttgtagaaggtgagtggttaagaaatgcctttaggtggagagaatctattggtccatgggaagagagacctggacacttcggggatgtttggcattactggactgatgatggccttggatactatgaatttcttcagaaagttccctcttgtaactcaggagtcagccacaatgatgaagttgatactgctgctattgctccttttgtaaaggatgtattggacagcatagaatttgcaagggggagtgcaaattcaacatggggctctgttagggctgcaatggggcaccctgaaccattcccagtgaaatatgttgcgattggaaatgaagattgtgggaaaaaattttaccgcggtaactacctgaagttctacaatgctataagacaggcctacccagacattcaaatgatttcaaactgcgatggttcatctacaccacttgatcatcctgctgatttgtacgacttccatgtctatactgattctaagactttgttcaacatgaagagtacatttgacagaacatctcgcagtggacccaaggcttttgtgagtgagtacgctgtttggagaggtgatgcaggtagaggaagtcttcttgcttcattggcagaagctgctttccttactggactggagaagaatagtgacattgtttacatggcgagttatgcaccactgttcgtaaataacaatgaccaaacgtggaacccagacgctatcgtcttcaactcctggcagcattacggcactcctagttactggatgcagacgcttttccgtgagtctagtggtgctatgttacatccaactacaatcagctccagctactctggttcgctcgcagcgtctgcgattacctggcaggactcagagaacagcttccttagagtaaaggtcataaactttgggtcagatgctgtgaccctgacaatctccacgactggactccaggccagtatcaacgctctgggatcaaccgccactgttctcacatcagcaaacgtgatggatgaaaattccttcagtaacccaaccaaggttgtgccggtgaagagcgatatgagcaatgctgcagagcagatgcaggtcacgttggctcctcactccttcagctcgttcgatctcgccctggctcagtccaaacttgtcgccgagatgtga

SEQ ID NO: 6 - protein, 649 aa, Sorghum bicolor
  misc_feature (447)..(632): Pfam Name: Alpha-L-AF_C Pfam Description: Alpha-L-arabinofuranosidase C-terminus
  misc_feature (72)..(230): Pfam Name: CBM_4_9 Pfam Description: Carbohydrate binding domain
  misc_feature (1)..(649): Ceres Annot ID no. 8682811
  misc_feature (1)..(649): Bit score of 1613.1 for HMM based on sequences of Figure 11
  misc_feature (1)..(649): Functional Homolog Of SEQ ID NO. 4
  misc_feature (1)..(649): in Figure 11
MGTGKDAAPRAILCFLFLFCLGCKCLASELEATQTATLTVDASPQLARKIPDTLFGIFFEEINHAGAGGIWAELVSNRGFEAGGLHTPSNIDPWSIIGDDSSIYVETDRTSCFSRNIIALRMEVLCDNCPTGGVGIYNPGFWGMNIEDGKAYNLVMYVKSPETTDLIVSLTSSDGLQNLASATITVSGESNWTKVEQKLVAKGTNRTSRLQITTNKKGVVWFDQVSLMPEDTYKGHGFRTELISMILDLKPRFLRFPGGCFVEGEWLRNAFRWRESIGPWEERPGHFGDVWHYWTDDGLGYYEFLQKVPSCNSGVSHNDEVDTAAIAPFVKDVLDSIEFARGSANSTWGSVRAAMGHPEPFPVKYVAIGNEDCGKKFYRGNYLKFYNAIRQAYPDIQMISNCDGSSTPLDHPADLYDFHVYTDSKTLFNMKSTFDRTSRSGPKAFVSEYAVWRGDAGRGSLLASLAEAAFLTGLEKNSDIVYMASYAPLFVNNNDQTWNPDAIVFNSWQHYGTPSYWMQTLFRESSGAMLHPTTISSSYSGSLAASAITWQDSENSFLRVKVINFGSDAVTLTISTTGLQASINALGSTATVLTSANVMDENSFSNPTKVVPVKSDMSNAAEQMQVTLAPHSFSSFDLALAQSKLVAEM

SEQ ID NO: 7 - protein, 658 aa, Oryza sativa subsp. japonica
  misc_feature (456)..(641): Pfam Name: Alpha-L-AF_C Pfam Description: Alpha-L-arabinofuranosidase C-terminus
  misc_feature (73)..(231): Pfam Name: CBM_4_9 Pfam Description: Carbohydrate binding domain
  misc_feature (1)..(658): Public GI ID no. 115483997
  misc_feature (1)..(658): Bit score of 1648.4 for HMM based on sequences of Figure 11
  misc_feature (1)..(658): Functional Homolog Of SEQ ID NO. 4
  misc_feature (1)..(658): in Figure 11
MASRESFMSTIFFFLLLFSLGCKCIASELHLHATQTAVLKVDASPQLARQIPDTLFGIFFEEINHAGAGGIWAELVSNRGFEAGGPHTPSNIDPWSIIGDDSSIFVATDRTSCFSRNTVALRMEVLCDNCPAGGVGIYNPGFWGMNIEDGKIYNLVMYVKSPETVELTVSLTSSDGSQNLASTTIPVSGASNWTKLEQKLVAQGTNRTSRLQITTNKKGVVWFDQVSLMPADTYKGHGFRTELISMMLDLKPRFLRFPGGCFVEGEWLRNAFRWRESIGPWEERPGHFGDVWHYWTDDGLGYYEFLQLSEDLGAAPIWVFNNGISHNDEVDTAAIAPFVKDVLDSLEFARGNADSTWGSVRAAMGHPEPFPVKYVAIGNEDCGKKFYRGNYLKFYNAIREAYPDIQMISNCDASSSPLDHPADLYDFHVYTDSKTLFSMKNTFDRSSRNGPKAFVSEYAVWRSDAGRGSLLASLAEAAFLTGLEKNSDVVQMASYAPLFVNNNDQTWNPDAIVFNSWQQYGTPSYWMQTLFGESSGAMFHPVTITSSYSGSLAASAITWQDSENSFLRVKIINFGSDPVSLTISATGLQARVNALGSTATVLTSSNVMDENSFSNPNKVVPVKSQLSNAAEQMQVTLAPHSFSSFDLALAQSKLVAEM

SEQ ID NO: 8 - protein, 675 aa, Pyrus communis
  misc_feature (460)..(648): Pfam Name: Alpha-L-AF_C Pfam Description: Alpha-L-arabinofuranosidase C-terminus
  misc_feature (70)..(235): Pfam Name: CBM_4_9 Pfam Description: Carbohydrate binding domain
  misc_feature (1)..(675): Public GI ID no. 119507455
  misc_feature (1)..(675): Bit score of 1722.7 for HMM based on sequences of Figure 11
  misc_feature (1)..(675): Functional Homolog Of SEQ ID NO. 4
  misc_feature (1)..(675): in Figure 11
MGSCKSPHIVLLLYVLLCSVYRCFAIGVDANQTANLLIDASQASARPISDTLFGIFFEEINHAGAGGVWAELVSNRGFEAGGPNTPSNIDPWAIIGNESFLIVSTDRSSCFDRNKVALRMEVLCDTQGANSCPAGGVGIYNPGFWGMNIEKGKTYNTVLYVRSSGSINVSVSLTGSDGLQKLAAANIIASGSEVSNWTKFEVQLIAQGTNPNSRLQLTTTSKGVIWFDQVSAIPLDTYKGHGFRKDLVQMLADLKPQFFRFPGGCFVEGEWLRNAFRWKETIGPWEERPGHFGDVWMYWTDDGLGYFEFLQLSEDLGSLPIWVFNNGISHNDQVDTSSVLPFVQEALDGIEFARGSPNSTWGSLRAAMGHPEPFDLRYVAIGNEDCGKKNYRGNYLKFFSAIRNAYPDIKMISNCDGSSRQLDHPADMYDFHIYTSASNLFSMANHFDHTSRNGPKAFVSEYAVTGKDAGRGSLLAALAEAGFLIGLEKNSDIVEMASYAPLFVNTHDRRWNPDAIVFDSSQLYGTPSYWVQCLFNESSGATLYNSTLQMNSSTSLLASAISWQNSENENTYLRIKVVNLGTNTVNLQVFVDGLEPNSISLSGSTKTVLTSNNQMDENSFNDPTKVIPKQSLLESAGEEMEVVISPRSFTSIDLLMESSDIIRTTGADSVSVSSI

SEQ ID NO: 9 - protein, 675 aa, Malus x domestica
  misc_feature (460)..(648): Pfam Name: Alpha-L-AF_C Pfam Description: Alpha-L-arabinofuranosidase C-terminus
  misc_feature (70)..(235): Pfam Name: CBM_4_9 Pfam Description: Carbohydrate binding domain
  misc_feature (1)..(675): Public GI ID no. 33151175
  misc_feature (1)..(675): Bit score of 1724.7 for HMM based on sequences of Figure 11
  misc_feature (1)..(675): Functional Homolog Of SEQ ID NO. 4
  misc_feature (1)..(675): in Figure 11
MGSCKSPHVVLLLHVLLCSVYRCFAIGVDANQTANLLIDASQASARPISDTLFGIFFEEINHAGAGGVWAELVSNRGFEAGGPNTPSNIDPWAIIGNESSLIVSTDRSSCFDRNKVALRMEVLCDTQGANSCPAGGVGIYNPGFWGMNIEKGKTYNAVLYVRSSGSINVSVSLTGSDGLQKLAAANIIASGSEVSNWTKFEVQLKAQGTNPNSRLQLTTTSKGVIWFDQVSAIPLDTYKGHGFRKDLVQMLADLKPRFFRFPGGCFVEGEWLRNAFRWKETIGPWEERPGHFGDVWMYWTDDGLGYFEFLQLSEDLGSLPIWVFNNGISHNDQVDTSSVLPFVQEALDGIEFARGSPNSTWGSLRAAMGHPEPFDLRYVAIGNEDCGKKNYRGNYLKFYSAIRNAYPDIKMISNCDGSSRQLDHPADMYDFHIYTSASNLFSMANHFDHTSRNGPKAFVSEYAVTGKDAGRGSLLAALAEAGFLIGLEKNSDIVEMASYAPLFVNTHDRRWNPDAIVFDSSQLYGTPSYWVQCLFNESSGATLYNSTLQMNSSTSLLASAISWQNSENENTYLRIKVVNLGTYTVNLKVFVDGLEPNSVSLSGSTKTVLTSNNQMDENSFNEPKKVIPKRSLLESAGEEMEVVISPRSFTSIDLLMESSDVIRTTGADSVSVSSI

SEQ ID NO: 10 - DNA, 2013 bp, Populus balsamifera subsp. trichocarpa
  misc_feature (1)..(2013): Ceres Annot ID no. 1506572
  misc_feature (1)..(2013): Encodes the peptide sequence at SEQ ID NO. 11
atgggttattggaaggcctcctgcagtgttcttctggtctgcttctttgttggtctttgttccgtgtatcaatgctctgctgctgaagttgatgcatatcagacagcaaaattgatcgttaatgcctccagtggtcggcctattcctgaaacactctttggaattttcttcgaggagataaaccatgccggagctggtgggatatgggcagagcttgtaagcaatcggggttttgaagctgggggccaaaatactccctcaaatattgctccctggtctataattggtgatcagtcatctttaactgtatctactgatcgttcttcttgctttgagcgcaataaggttgcactccgaatgcatgtgctctgtgacagcgagggcagtaatatttgcccagctggcggagttggaatatataatccagggttttggggcatgaatattgaacaagggaagatctacaaagtagttctttatgttcgttctcttggatcaatcaatgtatctgtatcattgacgagctcagatgggctgcagatattggcgactgctaacattgtagattctgatgtttcaaactggacaaagaccgaggttctattggaagccaaaggaacaaatcctaattcaaggcttcagttgacaacatccaggaaaggtgtaatatggtttgatcaagtgtcagctatgcctttggagacatacaaggggcatggtttccaaaaggagctcattgaaatgcttgaagatataaaaccccaatttatcagatttcctggtggatgcttcgtcgaaggtgaatggttgagaaatgcatttcgctggaaggaaagcattggaccctgggaggagagacctgggcattttggtgatgtttggatgtattggactgatgatggacttggttactttgagtttcttcaactatctgaagatcttggtgcacggcctatatgggtgttcaacaatggaatcagccatcgggatgaagttgataccaccactgtctcaccttttgtacaagaagcccttgatggtcttgagtttgctagaggcgcttctgattctaaatggggttctgtaagagcagcaatggggcatccagagccgtttgacttgaaatatgttgctgttgggaacgaggactgttggaagaagaattaccgaggaaattatctcaagttctacgatgctataaaaagtgcctatcccgacatcaaaataatctcaaactgtgatgggtcttctcattctttggatcatcctgctgattactatgattttcatatttatacatctgccagccacctgttttctatgactcatcaatttgatcacacatcccgctctggtccaaaggcttttgtgagtgagtatgctgtgactggaaaagatgctggcacaggaagtcttttagcagcacttgctgaagctggattcctcattgggctggaaaagaacagtgatattgtggagatggcaagctacgcaccacttttcgtgaatgacaatgacaggaggtggaatccagatgcaattgtcttcaactcctcaatgcactatggaactccaagctactgggtgctgaaattcttcagagagtcgagtggagcaactctgcttgatgctaaactacaaacaaattcctcttcacttgttgcatctgcaattacctggacaaactcagtggatggtgaaacttacctgaaaataaagattgtgaattttgggaacaggcacgtgagtctcaaagtttcagttgatggattggggctcaactcacaattgtctggatcaacaaaaactgtgctcacttcttcgaatgtaatggacgagaattccttcacggatccaaacaaggtggtgccagacctcagtctgcttgagaatgctgacaaagacatgaacattataatcgctccatattctttgacttcacttgatttattaacagaatcaaacaatatcaggatgccacaaaccgattcttcagctagatcatcaatttag

SEQ ID NO: 11 - protein, 670 aa, Populus balsamifera subsp. trichocarpa
  misc_feature (458)..(644): Pfam Name: Alpha-L-AF_C Pfam Description: Alpha-L-arabinofuranosidase C-terminus
  misc_feature (70)..(233): Pfam Name: CBM_4_9 Pfam Description: Carbohydrate binding domain
  misc_feature (1)..(670): Ceres Annot ID no. 1506572
  misc_feature (1)..(670): Bit score of 1683.6 for HMM based on sequences of Figure 11
  misc_feature (1)..(670): Functional Homolog Of SEQ ID NO. 4
  misc_feature (1)..(670): in Figure 11
MGYWKASCSVLLVCFFVGLCSVYQCSAAEVDAYQTAKLIVNASSGRPIPETLFGIFFEEINHAGAGGIWAELVSNRGFEAGGQNTPSNIAPWSIIGDQSSLTVSTDRSSCFERNKVALRMHVLCDSEGSNICPAGGVGIYNPGFWGMNIEQGKIYKVVLYVRSLGSINVSVSLTSSDGLQILATANIVDSDVSNWTKTEVLLEAKGTNPNSRLQLTTSRKGVIWFDQVSAMPLETYKGHGFQKELIEMLEDIKPQFIRFPGGCFVEGEWLRNAFRWKESIGPWEERPGHFGDVWMYWTDDGLGYFEFLQLSEDLGARPIWVFNNGISHRDEVDTTTVSPFVQEALDGLEFARGASDSKWGSVRAAMGHPEPFDLKYVAVGNEDCWKKNYRGNYLKFYDAIKSAYPDIKIISNCDGSSHSLDHPADYYDFHIYTSASHLFSMTHQFDHTSRSGPKAFVSEYAVTGKDAGTGSLLAALAEAGFLIGLEKNSDIVEMASYAPLFVNDNDRRWNPDAIVFNSSMHYGTPSYWVLKFFRESSGATLLDAKLQTNSSSLVASAITWTNSVDGETYLKIKIVNFGNRHVSLKVSVDGLGLNSQLSGSTKTVLTSSNVMDENSFTDPNKVVPDLSLLENADKDMNIIIAPYSLTSLDLLTESNNIRMPQTDSSARSSI

SEQ ID NO: 12 - DNA, 2106 bp, Glycine max
  misc_feature (1)..(2106): Ceres Clone ID no. 549408
  misc_feature (1)..(2106): Encodes the peptide sequence at SEQ ID NO. 13
gaccttgtgttgtttcagattgcatttgcagatagattgaatgttgtgaacaaacaatgggttcatccaaggccttatgcagtgtttctctgctccatttgttcatagtggtttgccttgtcttccaatgctttgctactaaaaaccatgctgacctgaccacaactctaactgtgaatgcttctgatgcatctggaaagccaataccagagacactttttggcatattctttgaggagattaatcatgctggagctgggggattgtgggctgagcttgtgagcaacagaggatttgaagctggcggtcctaacactccttcaaatattgatccttggtcaattattggaaatgaatcattgataaatgttgaaactgatcgtacctcttgctttgaccgtaataaggttgcacttcgattggaggtatcatgtgacagcgaaggtgacaacatctgcccagctgatggtgttggtgtttataatcctggtttctggggcatgaatattgagcaagggaagaaatacaaagtggtcttctatgttcgttcaactgaatcacttaatctaacagtttcattgactggatccaatggtgtaggaaacctggcttcatctgtgatcacaggttctgcacttgatttttcaaactggacaaaggtggagaagatactggttgccaaggcaacagataataactcaagacttcaattaacaaccaccaccaaaggtgtgatatggttggaccaagtgtctgctatgccactggacacatataagggacatggtttccgaactgaccttgttgaaatgctgacagctttgaaaccaagatttatcagatttccgggcggttgttttgttgaaggagaatggttaagaaatgcatttcgatggaaaacatccattggaccatgggaggagagacctgggcactttggtgatgtttggatgtactggactgatgatggacttggttattatgagtttctccaacttgcagaggacttgggtgcttcaccaatatgggtatttaataatggtgtcagtcataatgatcaagttgatacatcggcggtcttacctcttgtgcaagaagcccttgatggaattgagttcgcgagaggtgatcccacttcaaaatggggttcccttagagctgctatgggacatcctgagccatttgacctcagatatgttgctgttgggaatgaagattgtggaaaaaagaattatcgaggaaactacctgaaattctatagtgcaataaaaagtgcttatccagatatccaaattatctcaaactgtgatggttcttctcgacctttagatcatccagctgatatgtatgattatcatgtttatacaaatgcgaatgacatgttttatagagctaacacatttgatcatacatcacgaaatggtccaaaggcttttgtaagtgagtatgccgtgactggaaaagatgctgggacaggaagcctcttggcagccctagctgaagctggcttcctaattggactggaaaagaacagtgatgttatccaaatggccagctatgctccactttttgttaatgccaatgataggaggtggaacctggatgcaattgtattcaactcctttcagctctatggaactcctagctattgggtgcaactatttttctcagagtcaagtggagcaacacttctaagtacatcacttcaagcaccttcctcaaattcacttgttgcatcagcaattacatttcaaaattctgtagataagaaaaattacatacgaataaaggttgtgaacttcggtaccactgccgtgaacctcaaaatctctcttgatggactggaaccaaactcattgcagttatctgggtcaacaaagactgtgcttacatctgcaaatgtaatggatgagaactccttctcacagccaaagaaggtggtgccaatccaaagtctacttcagaatgttgagaaggacatgaatgtcacagtcccacctcgttcgttcacatcatttgatctgctgaaacaatccagtaatttgaagatggcagggagcgattcttccacgtggtcttctatttaacgttattaaaaatttgacc

SEQ ID NO: 13 - protein, 676 aa, Glycine max
  misc_feature (462)..(650): Pfam Name: Alpha-L-AF_C Pfam Description: Alpha-L-arabinofuranosidase C-terminus
  misc_feature (72)..(237): Pfam Name: CBM_4_9 Pfam Description: Carbohydrate binding domain
  misc_feature (1)..(676): Ceres Clone ID no. 549408
  misc_feature (1)..(676): Bit score of 1694.6 for HMM based on sequences of Figure 11
  misc_feature (1)..(676): Functional Homolog Of SEQ ID NO. 4
  misc_feature (1)..(676): in Figure 11
MGSSKALCSVSLLHLFIVVCLVFQCFATKNHADLTTTLTVNASDASGKPIPETLFGIFFEEINHAGAGGLWAELVSNRGFEAGGPNTPSNIDPWSIIGNESLINVETDRTSCFDRNKVALRLEVSCDSEGDNICPADGVGVYNPGFWGMNIEQGKKYKVVFYVRSTESLNLTVSLTGSNGVGNLASSVITGSALDFSNWTKVEKILVAKATDNNSRLQLTTTTKGVIWLDQVSAMPLDTYKGHGFRTDLVEMLTALKPRFIRFPGGCFVEGEWLRNAFRWKTSIGPWEERPGHFGDVWMYWTDDGLGYYEFLQLAEDLGASPIWVFNNGVSHNDQVDTSAVLPLVQEALDGIEFARGDPTSKWGSLRAAMGHPEPFDLRYVAVGNEDCGKKNYRGNYLKFYSAIKSAYPDIQIISNCDGSSRPLDHPADMYDYHVYTNANDMFYRANTFDHTSRNGPKAFVSEYAVTGKDAGTGSLLAALAEAGFLIGLEKNSDVIQMASYAPLFVNANDRRWNLDAIVFNSFQLYGTPSYWVQLFFSESSGATLLSTSLQAPSSNSLVASAITFQNSVDKKNYIRIKVVNFGTTAVNLKISLDGLEPNSLQLSGSTKTVLTSANVMDENSFSQPKKVVPIQSLLQNVEKDMNVTVPPRSFTSFDLLKQSSNLKMAGSDSSTWSSI

SEQ ID NO: 14 - protein, 677 aa, Prunus persica
  misc_feature (460)..(651): Pfam Name: Alpha-L-AF_C Pfam Description: Alpha-L-arabinofuranosidase C-terminus
  misc_feature (70)..(235): Pfam Name: CBM_4_9 Pfam Description: Carbohydrate binding domain
  misc_feature (1)..(677): Public GI ID no. 157313302
  misc_feature (1)..(677): Bit score of 1719.7 for HMM based on sequences of Figure 11
  misc_feature (1)..(677): Functional Homolog Of SEQ ID NO. 4
  misc_feature (1)..(677): in Figure 11
MGSRKSPHVVLLLYVLVCFVYQSFAIGVDTNQTAKLLVDASEASGRPISETLFGIFFEEINHAGAGGLWAELVSNRGFEAGGPNVPSNIDPWSIIGNESSLIVSTDRSSCFDRNKVALRIEVLCDSQGASSCPDGGVGIYNPGFWGMNIEKGKTYSVVLYVRSSGSINVSVSLTGSDGLQKLAAANIIASDSEVSNWTKVEVMLEAQGTNPNSRLQLTTTRKGFIWFDQVSVMPLDTYKGHGFRKDLVEMLEDLKPQFIRFPGGCFVEGEWLRNAFRWKETIGPWEERPGHFGDVWMYWTDDGIGYFEFLQLAEDLGTLPIWVFNNGISHTDQVDTSSVLPFVQEALDGLEFARGSPNSTWGCLRAAMGHPEPFDLRYVAIGNEDCGKKNYRGNYLKFYSAIKRAYPDIKIISNCDGSSRKLDHPADLYDFHVYTDAKNMFSMAHQFDHTSRSGPKAFVSEYAVTGKDAGTGSLLAALGEAGFLIGLEKNSDVVEMASYAPLFVNANNRRWNPDAIVFNSSHLYGTPSYWVQCLFNESSGATIFNATLQTNLSTSLLASAISWKNSENGNSYLRIKIVNFGTNIVNLKIVVDGLEPNSINLSESTKTVLTSTNLMDENSFNEPKKVIPNRILLEKAGEDGEDMEVAISPHSFTSIDFLIESSFIRTTGADSVSVSSI

SEQ ID NO: 15 - protein, 665 aa, Fragaria x ananassa
  misc_feature (452)..(640): Pfam Name: Alpha-L-AF_C Pfam Description: Alpha-L-arabinofuranosidase C-terminus
  misc_feature (62)..(227): Pfam Name: CBM_4_9 Pfam Description: Carbohydrate binding domain
  misc_feature (1)..(665): Public GI ID no. 157072586
  misc_feature (1)..(665): Bit score of 1677.0 for HMM based on sequences of Figure 11
  misc_feature (1)..(665): Functional Homolog Of SEQ ID NO. 4
  misc_feature (1)..(665): in Figure 11
MGVLDVLLCCCCCLVLPCFAVEAQTAQLIVDASQASGRPISPTLFGLFFEEINHAGAGGLWAELVNNRGFEAGGPNTPSNIDPWSIIGSESSLLVSTDRSSCFERNKVALRMEVLCDSQGANICPAGGVGIYNPGFWGMNVEKGKTYSVTLYVRSSGAINVSVSLTSSNGLQTLAAENIMASVSEVSNWTKFNVLLVAKGTNPSSRLQLTTARKGLIWFDQVSAMPLDTYKGHGFRKDLVDMLADMKPQFLRFPGGCFVEGEWLRNAFRWKETIGQWEERPGHFGDVWMYWTDDGLGYFEFLQLAEDLGTRPIWVFNNGISHNDQVDTSNILPFVQEALDGIEFATGSPDSTWGSIRAAMGHPEPFDLRYVAVGNEDCGKKNYRGNYLKFYSAIKHAYPDIQIISNCDGSSHPLDHPADLYDFHVYTSASNMFSMAHQFDRTPRKGPKAFVSEYAVTGKDAGGGSLLAALAEAGFLIGLEKNSDVVEMASYAPLFVNANNKRWSPDAIVFNSSQLYGTPSYWVQCFFSESSGATIFNATLQTESSTSLLASAILWKSSEDQKTYLRIKIVNFGSNIVNLRIRVDGLEPNSVSMSGSTKTVLTSKNVMDENSFDEPKKVIPNLGLLENAGEEMDVGLSAHSFTSIDLLVEPSHLTTGADSSSISSS

SEQ ID NO: 16 - DNA, 2696 bp, Panicum virgatum
  misc_feature (1)..(2696): Ceres Clone ID no. 1786359
  misc_feature (1)..(2696): Encodes the peptide sequence at SEQ ID NO. 17
acaaggtacaccaacccaaagatgcggccacagccagatcaagtcgttccatgacgacggccttggctcgctccatgattagtactccggcagtaatgcttgataattaaggaaaaaataaattaaaaatccaaatgagccggataaggcgacagtgctgttcatcgggcccacatgaccgcagccgcgcgcagccaaccgccgccgaaccaagcccgctccggcaagcaactcgccgcggcgcgtccccctgacgtccgccgtctccggcatcggatgggcgtctagaccgcggagggctccaccacactccttgcgtggcttccgtagtccggaggcacacttcccttcaaagccactgcttcgtcttcctctacttaagcgcacgccccccgggccctgccctgtactcgcgtccgggaccgggagctcgcctcttcttcctgaggaggtgttggatggtgaatgcatgacactctcattgcattagttcttacaaaggaagcctatgggtttcaaggaagtgtcatctgctacaatcttctgcctcttgcttctattctgcctgggctgcagatgcctggcatcagaactagtgacctcacaggcagcaactctcaatgttgacgcctcaccgcagtcagcccgaaagatccctgaaacactatttgggatatttttcgaggagatcaatcatgcaggagctggtggaatttgggcagagcttgttagtaacagaggtttcgaagctggaggcccacatactccctcaaatattgacccatggtccattattggagatgactcttctgtatttgtggcgactgatcgtacatcatgtttcagtcgaaacattgttgctctgaggatggaggtcctctgtgatgactgtcctactggtggtgttggtatttacaacccggggttctggggcatgaacatagaagatggaaaggcgtacaatcttgttatgtacgttaagtcaccagaaacaacagacttgactgtttcactaacaagctctgatgggttgcaaaacctggcttcaactactataacagtttctggtacatcaaattggacaaaagtggagcagaagttggttgctaatggaaccaatagaacctcaaggcttcaaataacaactaacaagaaaggagttgtttggtttgatcaagtttcactcatgcctgaagacacatacaagggacatggttttcgcacagaacttatatccatgcttttggatttgaaaccgcgattcttgagattttctggcggatgctttgtagaaggcgattggttaagaaatgcattcaggtggagagaatctattggtccatgggaaaagaggcctggacactttggggatgtttggcattactggactgatgacggcctcggatattatgaatttcttcagcttgcggaggacctgggtgctgccccaatctgggtattcaacaatggagttagccacaatgatgaagttgataccgctgctattgctccatttgtaaaggatgtattggacagtctagaatttgcaagggggagtgcagattcgacatggggctctgttagggctgcgatggggcaccctgaaccattcccagtgaaatatgttgcaattggaaatgaagattgtgggaaaaaattttaccgcggtaattacctcaagttctacaatgctataaggcaggcctatccagatattcaaatgatttcgaactgtgatggttcatctagaccacttgatcatcctgctgatttatacgacttccatgtatataccgattctaagactttgtttaacatgaggagcacattcgacagcacatctcgtagtggaccaaaggcttttgtgagtgaatacgccgtttggagaagtgatgcaggtagaggaagtcttcttgcttcattggcggaagctgctttccttactggtctggagaagaacagtgacattgttcagatggcaagttatgctccattatttgtaaacgacaatgacagaacgtggaaccctgatgctatcgtcttcaactcgtggcaacattatggaactcctagttactggatgcagacacttttccgtgagtccagcggtgctatggttcatccaattacagtcaattccagctactctggttcgctagcagcatctgcaattacttggcaggattcagagaacagcttcctaagagtaaaggttgtaaattttggatcagatgccgttagccttacaatctccacaagtggacttcaggccagtgttaatgctctgggatcaaccaccactgttctcacatccgggaatgttatggatgaaaattctttcagtaacccaaacaaggttgtgccggtgaagagcgagctgagcaatgccgcagagcagatgcaggtcacgctggctcctcactccttcagtgcgttcgatctcgcgttggctcagtccaaacttgttgcggagatgtgaagtggtatcacccttactaggctggtgacagatacacgaggaataccctacgcatggtgtgatacgcaaataacagttcttttccaaaaaaaaaaggatacgcaaataccagccaccagggagttgctgctgttagcatcttgataaagctttgtatagtgtaacacgatgcagatatactaaataaaaatcacatcatgttggtttgggttgactg

SEQ ID NO: 17 - protein, 656 aa, Panicum virgatum
  misc_feature (454)..(639): Pfam Name: Alpha-L-AF_C Pfam Description: Alpha-L-arabinofuranosidase C-terminus
  misc_feature (71)..(229): Pfam Name: CBM_4_9 Pfam Description: Carbohydrate binding domain
  misc_feature (1)..(656): Ceres Clone ID no. 1786359
  misc_feature (1)..(656): Bit score of 1638.2 for HMM based on sequences of Figure 11
  misc_feature (1)..(656): Functional Homolog Of SEQ ID NO. 4
MGFKEVSSATIFCLLLLFCLGCRCLASELVTSQAATLNVDASPQSARKIPETLFGIFFEEINHAGAGGIWAELVSNRGFEAGGPHTPSNIDPWSIIGDDSSVFVATDRTSCFSRNIVALRMEVLCDDCPTGGVGIYNPGFWGMNIEDGKAYNLVMYVKSPETTDLTVSLTSSDGLQNLASTTITVSGTSNWTKVEQKLVANGTNRTSRLQITTNKKGVVWFDQVSLMPEDTYKGHGFRTELISMLLDLKPRFLRFSGGCFVEGDWLRNAFRWRESIGPWEKRPGHFGDVWHYWTDDGLGYYEFLQLAEDLGAAPIWVFNNGVSHNDEVDTAAIAPFVKDVLDSLEFARGSADSTWGSVRAAMGHPEPFPVKYVAIGNEDCGKKFYRGNYLKFYNAIRQAYPDIQMISNCDGSSRPLDHPADLYDFHVYTDSKTLFNMRSTFDSTSRSGPKAFVSEYAVWRSDAGRGSLLASLAEAAFLTGLEKNSDIVQMASYAPLFVNDNDRTWNPDAIVFNSWQHYGTPSYWMQTLFRESSGAMVHPITVNSSYSGSLAASAITWQDSENSFLRVKVVNFGSDAVSLTISTSGLQASVNALGSTTTVLTSGNVMDENSFSNPNKVVPVKSELSNAAEQMQVTLAPHSFSAFDLALAQSKLVAEM

SEQ ID NO: 18 - protein, 658 aa, Hordeum vulgare
  misc_feature (456)..(641): Pfam Name: Alpha-L-AF_C Pfam Description: Alpha-L-arabinofuranosidase C-terminus
  misc_feature (146)..(215): Pfam Name: CBM_4_9 Pfam Description: Carbohydrate binding domain
  misc_feature (1)..(658): Public GI ID no. 13398412
  misc_feature (1)..(658): Bit score of 1547.0 for HMM based on sequences of Figure 11
  misc_feature (1)..(658): Functional Homolog Of SEQ ID NO. 4
MGSKEMPRRTRTILCFLLLFCVSCKCLASEFEITQVASLGVDSSPHLARKIPDTLFGIFFEEINHAGAGGIWAELVSNRGFEAGGPHTPSNINPWSIIGDDSSIFVGTDRTSCFSRNKVALRMEVLCDNCPVGGVGIYNPGFWGMNIEDGKTYNLVMHVKSPETIEMTVSLTSSDGLQVLASAAIRVPGGSNWIKLDQKLVAKGTDRTSRLQITARTKGVVWLDQVSLMPSDTYKGHGFRTELISMLLDLKPRFLRFPGGCFVEGSWLRNAFRWRDSIGPWEERPGHYGDVWNYWTDDGLGYYEFLQLAEDLGAAPVWVFNNGISHHDEVDTTAIAPFVKDILDSLEFARGSAESTWGSVRAAMGHPEPFPVKYVAIGNEDCGKENYRGNYLKFYNAIREAYPDIQMISNCDGSSTPLDHPADLYDFHVYTGSSALFSMKNTFDNTSRSGPKAFVSEYAVTGNDAGRGSLLASLAEAAFLTGLEKNSDVVQMASYAPLFINDNDRTWNPDAIVFNSWQQYGTPSYWMQTLFRESSGATVHPISLSSSCSGLLAASAITWHDDENSFLRVKIVNFGPDAVGLTISATGLQGSINAFGSTATVLTSGGVMDENSFANPNKVVPVTVELRDAAEEMQVTLPPHSLTAFDLALAQSRLVADV

SEQ ID NO: 19 - DNA, 2339 bp, Panicum virgatum
  misc_feature (1)..(2339): Ceres Clone ID no. 1789981
  misc_feature (1)..(2339): Encodes the peptide sequence at SEQ ID NO. 20
aaagctatagtttgcatagttgaagtggatgggttccatggaagggctttctcgtacggtcatccacttcttgctccttttctgcatagtctgtaaatgtctggcatcagatttggaggcaacccagaaggcaaccctcaagattgatgcctcaccaaagcttgctcgaaaaatccctgatacactactcggagtattttttaaggagatgggccgtggtggagctggtggactatgggctgaacttgttagtaacagaggtttcgaagcaggaggccccaatactccgtcaaacattgacccatggctcattattggaaatgaatcttccatttttgtggagactgatcgtacatcatgtttcagtcgaaacattgttgctttaaggatggaggtcatctgcaataactgtccagctggtggtgttggcatttacaacccaggtttctggggcatgaacatagaagatggaaagacatacaatctagttatgtatgtgaagtcagctgaaaccgcacccttgacagtttcactaacaagctctgatgggtcgcaaaatctggcttcagtcgcgataatggttgctggcaaatcgaaatggataaaggtagagcaaaagatggttgctaaaggaaccaatagaacctcaaggcttcaaataacgtctaagaagaaaggagttgtgtggtttgaccaagtatcactcatgcctgcagacacatacaagggacatggtttccgcgacgaacttgtatccatgcttttggatttaaaaccacagttcttaagatttcctggaggttgctttgtacaaggtggctggctaagaaacgcattcaggtggagagagtctattggtccttgggaagagaggcccggacacttcggagattgttggaattattggactgatgatggccttggatattttgaatttctacagctttctgaggacctgggtgctgccccaatctgggtattcaacagcggattgagctacaatgatgaagttgatacagctgctattgccccttttgtaaaggatgtactggacagcctagaatttgcaagggggagtgcaaattcatcatggggctctgttagagctgcaatgggacaccctgaaccgttccctgtcaagtatgctgcaattggaaatgaagactgtgggaagaagttttacaatggtaattacctcaagttttacaatgctataagagaggcatatccagacattcaactgatttcaaattgtgatggctcatctggaccacttgatcatccggctgatttatatgatttccatgtctatgctgatgcaaagactctgttttccatgaagaacacatttgacaagacatcgcgttccggacccaaggcttttgtcagcgagtatgcagtttggaaaactgatgcaggtcgaggaactcttcttgcttcactggcagaagctgccttccttactgggctggagaagaatagtgatgttgttgagatggcttgccatgctccactattcgtaaatgacgatattgagaaaaagtggaacccagacgttattgtcttcaatacttggcaacattatgggactcctagttactggatgcaggtgcttttccgtgagtctagcggtgctattgttcatccaacaacgatcagttccagcagctctggtaatagttctctagcagcatctgcaattacatggcaggattcagacaatagctcattcctaagagtaaagatcataaactttgaatctgttgctgttcaaatcacaatctccacgactggacttcaggctagcattgacgtgttgcgatcgactgccactgttctcacatctagcaatgtgatggatgaaaattcttttagtaaccaagacaaggtctcgccagtcaagagccagctttttgatgcaggagcgcatatgcaagtcacactagctcctcactcattcacatcctttgatcttgcgctggctccgtctaaacttgtcacgttggcaggaagagtcaacaaatacttgatatctgaactgtgagacacccaagtgccagtaattaaggacttgccagtacggtgtaaggcaatgtgttatgcaacaccgaggagaaattaaataaaaatgtcactggaatttatatttttttatttccttgaggatgccattcaaaagtttctttagttagtgtctgatttagcacgaatattcacatctatagtcaattattgtttaaattggtaggtgatacgtccttggacattgaggcatctgtggtaatttatgttttgcgaccaaaaaaaagaatttatagttttgtggtgattttttggcg

SEQ ID NO: 20 - protein, 671 aa, Panicum virgatum
  misc_feature (454)..(643): Pfam Name: Alpha-L-AF_C Pfam Description: Alpha-L-arabinofuranosidase C-terminus
  misc_feature (71)..(229): Pfam Name: CBM_4_9 Pfam Description: Carbohydrate binding domain
  misc_feature (1)..(671): Ceres Clone ID no. 1789981
  misc_feature (1)..(671): Bit score of 1487.5 for HMM based on sequences of Figure 11
  misc_feature (1)..(671): Functional Homolog Of SEQ ID NO. 4
MGSMEGLSRTVIHFLLLFCIVCKCLASDLEATQKATLKIDASPKLARKIPDTLLGVFFKEMGRGGAGGLWAELVSNRGFEAGGPNTPSNIDPWLIIGNESSIFVETDRTSCFSRNIVALRMEVICNNCPAGGVGIYNPGFWGMNIEDGKTYNLVMYVKSAETAPLTVSLTSSDGSQNLASVAIMVAGKSKWIKVEQKMVAKGTNRTSRLQITSKKKGVVWFDQVSLMPADTYKGHGFRDELVSMLLDLKPQFLRFPGGCFVQGGWLRNAFRWRESIGPWEERPGHFGDCWNYWTDDGLGYFEFLQLSEDLGAAPIWVFNSGLSYNDEVDTAAIAPFVKDVLDSLEFARGSANSSWGSVRAAMGHPEPFPVKYAAIGNEDCGKKFYNGNYLKFYNAIREAYPDIQLISNCDGSSGPLDHPADLYDFHVYADAKTLFSMKNTFDKTSRSGPKAFVSEYAVWKTDAGRGTLLASLAEAAFLTGLEKNSDVVEMACHAPLFVNDDIEKKWNPDVIVFNTWQHYGTPSYWMQVLFRESSGAIVHPTTISSSSSGNSSLAASAITWQDSDNSSFLRVKIINFESVAVQITISTTGLQASIDVLRSTATVLTSSNVMDENSFSNQDKVSPVKSQLFDAGAHMQVTLAPHSFTSFDLALAPSKLVTLAGRVNKYLISEL

SEQ ID NO: 21 - protein, 654 aa, Oryza sativa subsp. indica
  misc_feature (454)..(639): Pfam Name: Alpha-L-AF_C Pfam Description: Alpha-L-arabinofuranosidase C-terminus
  misc_feature (71)..(229): Pfam Name: CBM_4_9 Pfam Description: Carbohydrate binding domain
  misc_feature (1)..(654): Public GI ID no. 116310992
  misc_feature (1)..(654): Bit score of 1458.6 for HMM based on sequences of Figure 11
  misc_feature (1)..(654): Functional Homolog Of SEQ ID NO. 4
MGSKEAFRRIIFCVLLLLCVSCKCLTSEVNTTQLAVLKVDASPQHARKIPETLFGIFFEEINHAGAGGIWAELVSNRGFEAGGPNTPSSIDPWSIIGNESVISVATDRSSCFSRNIIALRMEVLCGDCQAGGVGIYNPGFWGMNIEDGKNYSLVMYAKSLENTELTVSLTSSDGLQNLSSATIQVAGTSNWTKLEQKLVAKGTNRTSRLQITTNKKGVIWLDQISLMPSDTYKGHGFRKELVSMLLDLKPQFMRFPGGCFVEGQWLRNAFRWRESVGPWEERPGHFGDVWGYWTDDGLGYYEFLQLSEDLGAAPIWVFNNGFSHNEEINTTAIAPFVKDILDSLEFARGSTNSTWGSLRVAMGHPEPFPVKYVTIGNEDCTKKFYHGNYLKFHRAIREAYPDIQIISNCDGSSKPLDHPADIYDFHVYGDSNTLFSMRNKFDSTPRNGTKAFVSEYAVSSNGVGRGTLLASLAEAAFLTGLEKNSDVVQMASYAPLFMNDNDRSWNPAAVVFNSWKQYGSPSYWMQTIFRESSGAVLHPVTINSMYSNSLAASAITWKASNSSFLRVKIVNIGSNPVNLIVSTTGLEALVNMRKSTITILTSKNLSDENSFSKPTNVVPVTRELPNAGEEMFAFLGPYSFTSFDLALGQQKHVS

SEQ ID NO: 22 - protein, 654 aa, Oryza sativa subsp. japonica
  misc_feature (454)..(639): Pfam Name: Alpha-L-AF_C Pfam Description: Alpha-L-arabinofuranosidase C-terminus
  misc_feature (71)..(229): Pfam Name: CBM_4_9 Pfam Description: Carbohydrate binding domain
  misc_feature (1)..(654): Public GI ID no. 38347003
  misc_feature (1)..(654): Bit score of 1454.6 for HMM based on sequences of Figure 11
  misc_feature (1)..(654): Functional Homolog Of SEQ ID NO. 4
MGSKEAFRRIIFCVLLLLCVSCKCLTSEVNTTQLAVLKVDASPQHARKIPETLFGIFFEEINHAGAGGIWAELVSNRGFEAGGPNTPSSIDPWSIIGNESVISVATDRSSCFSRNIIALRMEVLCGDCQAGGVGIYNPGFWGMNIEDGKNYSLVMYAKSLENTELTVSLTSSDGLQNLSSATIQVAGTSNWTKLEQKLVAKGTNRTSRLQITTNKKGVIWLDQISLMPSDTYKGHGFRKELVSMLLDLKPQFMRFPGGCFVEGQWLRNAFRWRESVGPWEERPGHFGDVWGYWTDDGLGYYEFLQLSEDLGAAPIWVFNNGFSHNEEINTTAIAPFVKDILDSLEFARGSTNSTWGSLRVAMGHPEPFPVKYVTIGNEDCTKKFYHGNYLKFHRAIREAYPDIQIISNCDGSSKPLDHPADIYDFHVYGDSNTLFSMRNKFDSTPRNGTKAFVSEYAVSSNGVGRGTLLASLAEAAFLTGLEKNSDVVQMASYAPLFMNDNDLSWNPAAVVFNSWKQYGSPSYWMQTIFRESSGAVLHPVTINSMYSNSLAASAITWKASNSSFLRVKIVNIGSNPVNLIVSTTGLEALVNMRKSTITILTSKNLSDENSFSKPTNVVPVTRELPNAGEEMFAFLGPYSFTSFDLALGQQKHVS

SEQ ID NO: 23 - protein, 657 aa, Oryza sativa subsp. japonica
  misc_feature (453)..(639): Pfam Name: Alpha-L-AF_C Pfam Description: Alpha-L-arabinofuranosidase C-terminus
  misc_feature (1)..(657): Pfam Name: CBM_4_9 Pfam Description: Carbohydrate binding domain
  misc_feature (1)..(657): Public GI ID no. 115484005
  misc_feature (1)..(657): Bit score of 1469.0 for HMM based on sequences of Figure 11
  misc_feature (1)..(657): Functional Homolog Of SEQ ID NO. 4
MGFEETYFSAFCYLLLFSVSWKCQAAELDMAQTAVLEVDASWNLSRKIPDTLFGLFFEEINHAGAGGIWAELVSNRGFEAGGPHTPSNIDPWSIIGDESSIYVTTDCSSCFRQNIVALRMEILCDNCPAGGVGIYNPGFWGMNIEEGKAYNLVMYIRSLESVELTASLTCSDGMQNLASVSIQGIDLSNWTKIELQLLAEGTCRTSRLELTSMKKGIIWFDQVSLMPSDTYKGHGFRKELLYMLLELKPQFLRFPGGCFVEGDWLRNAFRWRETIGPWEQRPGHFGDVWNYWTDDGLGYYEFLQLSEDLGAAPIWVFNVGISHHDEVDTTIIEPFVKDVLDSLEFARGRAESTWGSVRAAMGHPERFPLKYVAIGNEDCDKGFYRGNYLKFYDAIRKAYPDIQMISNCDGSSRPLDHPADLYDFHVYTSAANLFIMKNKFDRTSRIGSKVFVSEYAVNEQRDAGKGSLLASLAEAAFLTGLEKNSDLVQMASYAPLFVNDNDRTWNPDAIVFNSWQQYGTPSYWMQTYFRESSGSVIHPITIGSSYSDSLAASAITWKDTHDIFLRIKIVNFGPNAVNLAISSRGLQAGVNTAKSTVTVLTSGNLLDENSFAEPNKVVPVKSELPDASEEMEAALSPYSFTSFDLALDQYSKLVAEM

SEQ ID NO: 24 - protein, 674 aa, Pyrus pyrifolia
  misc_feature (460)..(647): Pfam Name: Alpha-L-AF_C Pfam Description: Alpha-L-arabinofuranosidase C-terminus
  misc_feature (70)..(235): Pfam Name: CBM_4_9 Pfam Description: Carbohydrate binding domain
  misc_feature (1)..(674): Public GI ID no. 37777015
  misc_feature (1)..(674): Bit score of 1670.8 for HMM based on sequences of Figure 11
  misc_feature (1)..(674): Functional Homolog Of SEQ ID NO. 4
MGSCKSPHIVLLLYVLLCSVYRCFAIGVDANQTANLLIDASQASARPISDTLFGIFFEEINHAGAGGVWAELVSNRGFEAGGPNTPSNIDPWAIIGNESFLIVSTDRSSCFDRNKVALRMEVLCDTQGANSCPAGGVGIYNPGFWGMNIEKGKTYNAVLYVRSSGSINVSVSLTGSDGLQKLAAANIIASGSEVSNWTKFEVQLEAQGTNPNSRLQLTTTSKGVIWFDQVSAIPLDTYKGHGFRKDLVQMLADLKPRFFRFPGGCFVEGEWLRNAFRWKETIGPWEERPGHFGDVWKYWTDDGLGYFEFLQLSEDLGSLPIWVFNNGISHNDQVDTSSVLPFVQEALDGIEFARGSPNSTWGSLRAAMGHPEPFDLRYVAIGNEDCGKKNYRGNYLKFFSAIRNAYPDIKMISNCDGSSRQLDHPADMYDFHIYTSASNLFSMANHFDHTSRNGPKAFVSEYAVTGKDAGRGSLLAALAEAGFLIGLEKNSDIVESGHLRPPLRQHDRRWNPDAIVFDSSQLYGTPSYWVQCLFNESSGATLYNSTLQMNSSTPLLASAISWQNSENENTYLRIKVVNLGTDTVNLKVFVDGLDPNSISLSGSTKTVLTSNNQMDENSFNEPTKVIPKQSLLESASEEMEVVISPRSFTSIDLLMESSDIIRTTGADSVSVSSI

SEQ ID NO: 25 - protein, 677 aa, Prunus persica
  misc_feature (460)..(651): Pfam Name: Alpha-L-AF_C Pfam Description: Alpha-L-arabinofuranosidase C-terminus
  misc_feature (70)..(235): Pfam Name: CBM_4_9 Pfam Description: Carbohydrate binding domain
  misc_feature (1)..(677): Public GI ID no. 116739148
  misc_feature (1)..(677): Bit score of 1697.3 for HMM based on sequences of Figure 11
  misc_feature (1)..(677): Functional Homolog Of SEQ ID NO. 4
MGSRKSPHVVLLLYVLVCFVYQSFAIGVDTNQTAKLLVDASEASGRPISETLFGIFFEEINHAGAGGLWAELVSNRGFEAGGPNVPSNIDPWSIIGNESSLIVSTDRSSCFDRNKVALRIEVLCDSQGASSCPDGGVGIYNPGFWGMNIEKGKTYSVVLYVRSSGSINVSVSLTGSDGLQKLAAANIIASDSEVSNWTKVEVMLEAQGTNPNSRLQLTTTRKGFIWFDQVSVMPLDTYKGHGFRKDLVEMLEDLKPQFIRFPGGCFVEGEWLRNAFRWKETIGPWEERPGHFGDVWMYWTDDGIGYFEFLQLAEDLGTLPIWVFNNGISHTDQVDTSSVLPFVQEALDGLEFARGSPNSTWGSLRAAMGHPEPFDLRYVAIGNEDCGKKNYLGNYLKFYSAIKRAYPDIKMISNCDGSSRKLDHPADLYDFHVNTDAKNMFSMAHQFDHTSRSGPKAFVSEYAVTGKDAGTGSLLAALGVAGFLIGLEKNSDVVEMACYAPLFVNANNRRWNPDAIVFNSSHLYGTPSYWVQRLFNESSGATIFNATLQTNLSTSLLASAISWKNSENGNSYLRIKIVNFGTNIVNLKIAVDGLEPNSINLSESTKTVLTSTNLMDENSFNEPKKVIPNRILLEKAGEDGEDMEVAISPRSFTTIDFLIESSFIRTTGADSVSVSSI

SEQ ID NO: 26 - protein, 663 aa, Fragaria x ananassa
  misc_feature (450)..(638): Pfam Name: Alpha-L-AF_C Pfam Description: Alpha-L-arabinofuranosidase C-terminus
  misc_feature (60)..(225): Pfam Name: CBM_4_9 Pfam Description: Carbohydrate binding domain
  misc_feature (1)..(663): Public GI ID no. 157072584
  misc_feature (1)..(663): Bit score of 1654.5 for HMM based on sequences of Figure 11
  misc_feature (1)..(663): Functional Homolog Of SEQ ID NO. 4
MGVLEVLLCCCLVLPCFAVEVQTAQLIVDASQASGRPISPTLFGLFFEEINHAGAGGLWAELVNNRGFEAGGPNTPSNIDPWSIIGSESSLLVSTDRSSCFERNKVALRMEVLCDSQGANICPAGGVGIYNPGFWGMNVEKGKTYSVTLYVRSSGAINVSVSLTSSNGLQTLAAENIMASVSEVSNWTKFNVLLEAKGTNPSSRLQLTTARKGLIWFDQVSAMPLDTYKGHGFRKDLVDMLADMKPQFLRFPGGCFVEGEWLRNAFRWKETIGQWEERTGHFGDVWMYWTDDGLGYFEFLQLAEDLGTLPIWVFNNGISHNDQVDTSNILPFVQEALDGIEFARGSPDSSWGSIRATMGHPEPFDLRYVAVGNEDCGKKNYQGNYLKFYSAIKHAYPDIQIISNCDGSSHPLDHPADLYDFHVYTSASNMFSMAHQFDRTPRKGPKAFVSEYAVTGKDAGGGSLLAALAEAGFLIGLEKNSDVVEMASYAPLFVNANNKRWSPDAIVFNSSQLYGTPSYWVQCFFSESSGATIFNATLQTESSTSLLASAILWKSSEDQKTYLRIKIVNFGSNIVNLRIRVDGLEPNSVSMSGSTKTVLTSKNVMDENSFDEPKKVIPNLGLLENAGEEMDVGLSAHSFTSIDLLVEPSHLTTGTNSSSISSS

SEQ ID NO: 27 - protein, 674 aa, Solanum lycopersicum
  misc_feature (459)..(648): Pfam Name: Alpha-L-AF_C Pfam Description: Alpha-L-arabinofuranosidase C-terminus
  misc_feature (71)..(234): Pfam Name: CBM_4_9 Pfam Description: Carbohydrate binding domain
  misc_feature (1)..(674): Public GI ID no. 37777013
  misc_feature (1)..(674): Bit score of 1469.6 for HMM based on sequences of Figure 11
  misc_feature (1)..(674): Functional Homolog Of SEQ ID NO. 4
MESRHSIHHVLLLVLFGLSALCQCSATGVEANQTAVLLVNASEASARRIPDTLFGIFFEEINHAGAGGLWAELVNNRGFEGGGPNVPSNIDPWSIIGDESKVIVSTDRSSCFDRNKIAVQVQVLCDHTGANICPDGGVGIYNPGFWGMNIEQGKSYKLVLYVRSEESVNVSVALTGSNGLQKLAAANIVAADVSSWTKVEILLEATGTDPNSRLELRSSKKGVIWFDQVSLMPTDTYKGHGFRKDLFGMLKDLKPAFIRFPGGCFVEGDWLRNAFRWKETIGQWEERPGHFGDVWNYWTDDGLGHFEFLQLAEDLDSLPVWVFNNGVSHHDQVDTSSILPFVQEILDGLEFARGDPTSTWGSIRAKMGHPEPFDLRYVAIGNEDCGKTQYRGNYLKFYTAIKDKYPDIKIISNCDGSTRPLDHPADLYDFHIYSSASSVFSNARHFDSAPRRGPKAFVSEYAVTGNDAGKGSLLAALGEAGFLIGVEKNSEAIEMASYAPLFVNDNDRRWNPDAIVFTSSQMYGTPSYWMQHFFKEPNGATLLSSSLQANPSNSLIASAITWRNSLDNNDYLRIKVVNFGATAAITKISLTGLGQSSLETLFGAVMTELTSNNVMDENSFREPNKVIPVKTQVEKVSDNMDVVLAPRSLNSIDFLLRKSINNNVDTASVLKSSC

SEQ ID NO: 28 - DNA, 2037 bp, Arabidopsis thaliana
  misc_feature (1)..(2037): Ceres Annot ID no. 556941
  misc_feature (1)..(2037): Encodes the peptide sequence at SEQ ID NO. 29
atggatatggagtcttggaagttgctcagaagtgtttgtgtgctttcttttctccttggctcttgttttgtgtatcaaagccttcgtgttgttgatgctcaagaagatccaaaaccagccgtgactttgcaagtagatgcttctaatggaggtggacgacccattcctgaaacgctatttgggattttcttcgaggagatcaaccatgctggtgccggtggattatgggccgaacttgttagcaacagagggtttgaagctggtgggcaaaacacaccctctaatatttggccatggtccattgttggtgatcattcatccatatatgtagctacagaccgttcatcatgttttgaacggaataaaatcgcactgagaatggatgtgctttgtgatagcaaaggttgtccatcgggaggtgtcggagtttataaccctggttactggggcatgaatattgaagaaggaaagaagtacaaggtggctctttatgtgcgttcgactggtgatatcgatttgtctgtgtcgttgacgagctcgaatggatcacggactcttgcttctgaaaagatcatagcttctgcttctgatgtttcgaaatggattaaaaaagaggttcttttggaggcaaaagcgaccgatcctagtgcaagacttcagttaacaacaaccaagaaagggtcaatatggattgaccaagtctcggccatgccagtggatactcacaagggacatggttttagaaacgatcttttccaaatgatggccgatataaaaccccgtttcatccggttcccaggtggttgttttgtcgagggtgaatggttaagtaatgccttccgctggaaagaaaccgtaggaccttgggaagagagaccgggccattttggtgatgtttggaagtattggaccgatgatggccttggccactttgagttctttcaaatggcagaagacatcggtgcagccccgatatgggtgtttaacaacgggataagtcacaatgatgaagttgaaactgccagtatcatgccctttgttcaagaagcactcgacggtatcgagtttgcccgaggagatgccaattctacttggggatctgttcgagctaaaatgggacgccaagaaccttttgaacttaaatacgttgctattggaaatgaagattgtgggaaaacttactacagaggaaactacattgtgttctatgatgctatcaagaaagcctatccagatatcaaaatcatctccaactgcgatggatcctctcatccactcgaccacccagctgattactatgactatcacatttacacttctgctagcaatttgttttccatgtatcatcaatttgatcgcacttcacgcaaaggtccaaaggcttttgtcagtgaatatgctgttactggaaaagatgctggtacaggaagccttcttgcctctcttgcagaagctgcgtttctcattggtcttgaaaagaatagtgacattgttgaaatggcaagttatgctccactctttgtgaacacaaatgatagacggtggaaccctgatgcaatagtcttcaactcctctcatctatatggaacacctagctattgggttcaacggttttttgcagagtcaagcggagcaactcttctcacttcaacactcaagggaaactctacttctcttgttgcatctgctatctcttggaaaaacaatggcaaagattacatacgcataaaggctgtaaacttcggagctaactcagaaaatatgcaagtgttggtaactggattggacccgaacgtgatgagagtttcgggatcaaagaagacagtacttacctctaccaatgtgatggatgaaaattccttctcacagccagagaaggttgtaccacatgaaagcttgctagagttggcagaggaggatatgaccgttgttctcccgccacattccttttcttcattcgatttgttgaaggaatctgcaaagataagaatgccaatctctgattcttcttcccatcagaaaactaccactgtgtga

SEQ ID NO: 29 - protein, 678 aa, Arabidopsis thaliana
  misc_feature (464)..(649): Pfam Name: Alpha-L-AF_C Pfam Description: Alpha-L-arabinofuranosidase C-terminus
  misc_feature (77)..(239): Pfam Name: CBM_4_9 Pfam Description: Carbohydrate binding domain
  misc_feature (1)..(678): Ceres Annot ID no. 556941
  misc_feature (1)..(678): Bit score of 1478.8 for HMM based on sequences of Figure 11
  misc_feature (1)..(678): Functional Homolog Of SEQ ID NO. 4
MDMESWKLLRSVCVLSFLLGSCFVYQSLRVVDAQEDPKPAVTLQVDASNGGGRPIPETLFGIFFEEINHAGAGGLWAELVSNRGFEAGGQNTPSNIWPWSIVGDHSSIYVATDRSSCFERNKIALRMDVLCDSKGCPSGGVGVYNPGYWGMNIEEGKKYKVALYVRSTGDIDLSVSLTSSNGSRTLASEKIIASASDVSKWIKKEVLLEAKATDPSARLQLTTTKKGSIWIDQVSAMPVDTHKGHGFRNDLFQMMADIKPRFIRFPGGCFVEGEWLSNAFRWKETVGPWEERPGHFGDVWKYWTDDGLGHFEFFQMAEDIGAAPIWVFNNGISHNDEVETASIMPFVQEALDGIEFARGDANSTWGSVRAKMGRQEPFELKYVAIGNEDCGKTYYRGNYIVFYDAIKKAYPDIKIISNCDGSSHPLDHPADYYDYHIYTSASNLFSMYHQFDRTSRKGPKAFVSEYAVTGKDAGTGSLLASLAEAAFLIGLEKNSDIVEMASYAPLFVNTNDRRWNPDAIVFNSSHLYGTPSYWVQRFFAESSGATLLTSTLKGNSTSLVASAISWKNNGKDYIRIKAVNFGANSENMQVLVTGLDPNVMRVSGSKKTVLTSTNVMDENSFSQPEKVVPHESLLELAEEDMTVVLPPHSFSSFDLLKESAKIRMPISDSSSHQKTTTV

SEQ ID NO: 30 - DNA, 2103 bp, Populus balsamifera subsp. trichocarpa
  misc_feature (1)..(2103): Ceres Annot ID no. 1453426
  misc_feature (1)..(2103): Encodes the peptide sequence at SEQ ID NO. 31
atgggttattggaaggcctcctgcagtgttcttctggtctgcttctttgttggtctttgttccgtgtatcaatgctctgctgctgaagttgatgcatatcagacagcaaaattgatcgttaatgcctccagtggtcggcctattcctgaaacactctttggaattttcttcgaggagataaaccatgccggagctggtgggatatgggcagagcttgtaagcaatcggggttttgaagctgggggccaaaatactccctcaaatattgctccctggtctataattggtgatcagtcatctttaactgtatctactgatcgttcttcttgctttgagcgcaataaggttgcactccgaatgcatgtgctctgtgacagcgagggcagtaatatttgcccagctggcggagttggaatatataatccagggttttggggcatgaatattgaacaagggaagatctacaaagtagttctttatgttcgttctcttggatcaatcaatgtatctgtatcattgacgagctcagatgggctgcagatattggcgactgctaacattgtagattctgatgtttcaaactggacaaagaccgaggttctattggaagccaaaggaacaaatcctaattcaaggcttcagttgacaacatccaggaaaggtgtaatatggtttgatcaagtgtcagctatgcctttggagacatacaaggggcatggtttccaaaaggagctcattgaaatgcttgaagatataaaaccccaatttatcagatttcctggtggatgcttcgtcgaaggtgaatggttgagaaatgcatttcgctggaaggaaagcattggaccctgggaggagagacctgggcattttggtgatgtttggatgtattggactgatgatggacttggttactttgagtttcttcaactatctgaagatcttggtgcacggcctatatgggtgttcaacaatgtatggaagaaggttcaggattcaccagtgttgaagctacagactcacgcacgcacgtctaatggtgctttatcagtttctaatatcatttgttttgaaagccacaacctgcttgcaggttgttcaattgttcagtcgtcaacggaagcccttgatggtcttgagtttgctagaggcgcttctgattctaaatggggttctgtaagagcagcaatggggcatccagagccgtttgacttgaaatatgttgctgttgggaacgaggactgttggaagaagaattaccgaggaaattatctcaagttctacgatgctataaaaagtgcctatcccgacatcaaaataatctcaaactgtgatgggtcttctcattctttggatcatcctgctgattactatgattttcatatttatacatctgccagccacctgttttctatgactcatcaatttgatcacacatcccgctctggtccaaaggcttttgtgagtgagtatgctgtgactggaaaagatgctggcacaggaagtcttttagcagcacttgctgaagctggattcctcattgggctggaaaagaacagtgatattgtggagatggcaagctacgcaccacttttcgtgaatgacaatgacaggaggtggaatccagatgcaattgtcttcaactcctcaatgcactatggaactccaagctactgggtgctgaaattcttcagagagtcgagtggagcaactctgcttgatgctaaactacaaacaaattcctcttcacttgttgcatctgcaattacctggacaaactcagtggatggtgaaacttacctgaaaataaagattgtgaattttgggaacaggcacgtgagtctcaaagtttcagttgatggattggggctcaactcacaattgtctggatcaacaaaaactgtgctcacttcttcgaatgtaatggacgagaattccttcacggatccaaacaaggtggtgccagacctcagtctgcttgagaatgctgacaaagacatgaacattataatcgctccatattctttgacttcacttgatttattaacagaatcaaacaatatcaggatgccacaaaccgattcttcagctagatcatcaatttag

SEQ ID NO: 31 - protein, 700 aa, Populus balsamifera subsp. trichocarpa
  misc_feature (488)..(674): Pfam Name: Alpha-L-AF_C Pfam Description: Alpha-L-arabinofuranosidase C-terminus
  misc_feature (70)..(233): Pfam Name: CBM_4_9 Pfam Description: Carbohydrate binding domain
  misc_feature (1)..(700): Ceres Annot ID no. 1453426
  misc_feature (1)..(700): Bit score of 1594.8 for HMM based on sequences of Figure 11
  misc_feature (1)..(700): Functional Homolog Of SEQ ID NO. 4
MGYWKASCSVLLVCFFVGLCSVYQCSAAEVDAYQTAKLIVNASSGRPIPETLFGIFFEEINHAGAGGIWAELVSNRGFEAGGQNTPSNIAPWSIIGDQSSLTVSTDRSSCFERNKVALRMHVLCDSEGSNICPAGGVGIYNPGFWGMNIEQGKIYKVVLYVRSLGSINVSVSLTSSDGLQILATANIVDSDVSNWTKTEVLLEAKGTNPNSRLQLTTSRKGVIWFDQVSAMPLETYKGHGFQKELIEMLEDIKPQFIRFPGGCFVEGEWLRNAFRWKESIGPWEERPGHFGDVWMYWTDDGLGYFEFLQLSEDLGARPIWVFNNVWKKVQDSPVLKLQTHARTSNGALSVSNIICFESHNLLAGCSIVQSSTEALDGLEFARGASDSKWGSVRAAMGHPEPFDLKYVAVGNEDCWKKNYRGNYLKFYDAIKSAYPDIKIISNCDGSSHSLDHPADYYDFHIYTSASHLFSMTHQFDHTSRSGPKAFVSEYAVTGKDAGTGSLLAALAEAGFLIGLEKNSDIVEMASYAPLFVNDNDRRWNPDAIVFNSSMHYGTPSYWVLKFFRESSGATLLDAKLQTNSSSLVASAITWTNSVDGETYLKIKIVNFGNRHVSLKVSVDGLGLNSQLSGSTKTVLTSSNVMDENSFTDPNKVVPDLSLLENADKDMNIIIAPYSLTSLDLLTESNNIRMPQTDSSARSSI

SEQ ID NO: 32 - protein, 676 aa, Vitis vinifera
  misc_feature (462)..(650): Pfam Name: Alpha-L-AF_C Pfam Description: Alpha-L-arabinofuranosidase C-terminus
  misc_feature (70)..(237): Pfam Name: CBM_4_9 Pfam Description: Carbohydrate binding domain
  misc_feature (1)..(676): Public GI ID no. 225440254
  misc_feature (1)..(676): Bit score of 1440.7 for HMM based on sequences of Figure 11
  misc_feature (1)..(676): Functional Homolog Of SEQ ID NO. 4
MGCFRASCKVLFCFFFLVSSVYQFLPIGADGNQTAQLIVDTKGPGRKMPETLFGLFFEEINHAGAGGLWAELVSNRGFEAGGPITPSNIDPWAVIGNESYVVVATDRSSPFERNKVALRVEVLCGNDSNSTNICPAGGVGVYNPGYWGMNVEQNKWFTVVMHVRSEGAVNISVALTSSNGVDTLAATNFVANACTVGNWTKYTANLRATATNSNARLQLTTTKKGVIWFDQVSLMPVDTYRNHNFRKDLSQMIADLKPRFLRFPGGCFVEGDWLRNAFRWKQTIGPWEERPGHFGDVWKYWTDDGLGYFEFLQLAEDIGALPVWVFNNGISHNDEVDTTSIGPFVQEVLDSIEFARGASNSTWGSVRTAMGHEDPFNLKYIAVGNEDCWKKNYRGNYMRFYDAIKRVYPDIKLITNCDASSRKLNHPADYYDFHIYTSATNLYSMAHQFDRTSRDAPKAFVSEYAVTGKDAGSGTLLAALAEAAFLIGVEKNSDVVEMASYAPLFVNSNDRTWSPDAIVFNSSFVYGTPSYWMQHFFSNSSGATLLNSTLTNNSSSSLIASAITWKSSQDNKTYIKLKVVNFRNVSVSLKISVDGLQTNSLQLSGATKTVLTSSNVMDENSFKEPTKVAPFRFELKDVGKDLDAELPAYSFTAFDLLTDSSSLQTVETDAGYKSSI

SEQ ID NO: 33 - protein, 674 aa, Arabidopsis thaliana
  misc_feature (463)..(646): Pfam Name: Alpha-L-AF_C Pfam Description: Alpha-L-arabinofuranosidase C-terminus
  misc_feature (1)..(674): Pfam Name: CBM_4_9 Pfam Description: Carbohydrate binding domain
  misc_feature (1)..(674): Public GI ID no. 22327075
  misc_feature (1)..(674): Bit score of 1366.4 for HMM based on sequences of Figure 11
  misc_feature (1)..(674): Functional Homolog Of SEQ ID NO. 4
MDMETSWRFLRSVCLLSFILGSFSVYQTLCLVDAQEDAIVTLQVDASNVTRRPIPETLFGIFFEEINHAGAGGLWAELVSNRGFEAGGQIIPSNIWPWSIIGDESSIYVVTDRSSCFERNKIALRMEVLCDSNSCPLGGVGVYNPGYWGMNIEEGKKYKVVLYVRSTGDIDVSVSFTSSNGSVTLASENIIALASDLLNWTKKEMLLEANGTDNGARLQFTTTKKGSIWFDQVSAMPMDTYKGHGFRNDLFQMMVDLKPRFIRFPGGCFVEGDWLGNAFRWKETVRAWEERPGHYGDVWKYWTDDGLGHFEFFQLAEDLGASPIWVFNNGISHNDQVETKNVMPFVQEAIDGIEFARGDSNSTWGSVRAAMGHPEPFELKYVAVGNEDCFKSYYRGNYLEFYNAIKKAYPDIKIISNCDASAKPLDHPADYFDYHIYTLARDLFSKSHDFDNTPRNGPKAFVSEYAVNKADAKNGNLLAALGEAAFLLGLEKNSDIVEMVSYAPLFVNTNDRRWIPDAIVFNSSHLYGTPSYWVQHFFTESSGATLLNSTLKGKTSSVEASAISFQTNGKDYIQIKAVNFGEQSVNLKVAVTGLMAKFYGSKKKVLTSASVMDENSFSNPNMIVPQESLLEMTEQEDLMFVLPPHSFSSFDLLTESENVIKMPISDSYKKTSTM

SEQ ID NO: 34 - DNA, 2049 bp, Populus balsamifera subsp. trichocarpa
  misc_feature (1)..(2049): Ceres Annot ID no. 1528070
  misc_feature (1)..(2049): Encodes the peptide sequence at SEQ ID NO. 35
atgagtagttgcaaggcctcttgcagtgttcttttggcgtgcttcattgttggtctttgttctgtgtgccaatgttctgctgctgaagttgatgcaaaccagacagcaaacttgatcatcaatggctccagtacccggcctattcctgaaacactctttggaattttcttcgaggagataaaccatgctggagctggtgggatatgggcagagcttgtaaacaatcggggttttgaagccgggggccaaaacactccctcaaatattgctccctggtctatcattggtgatcagtcatctttaattgtatctactgaccgttcttcttgcttcgagcgaaacaaggttgctctccgaatggatgtgctctgtgacagcacgggcggtaatatttgcccagctggtggagttggtatatacaatccagggttttggggcatgaatattgaacaagggaaggcctataaagtggttctttatgtccgttctctgggatcaatcaatgtttctgtatcattgacgagctcagatgggtcgcagatattggcatctgctaacattgtagattctgatgtttcaaactggacaaaggctgaggttctattggaagccaaaggaacaaatcctaattcaaggcttcaattgactacatccagaaaaggtgtaatatggtttgatcaagtgtcagctatgcctctggacacatacaaggggcatggtttccgaaatgagctcattgaaatgatcgatgatataaaaccccaatttgtcagatttccaggtggctgctttgttgagggtgaatggttgagaaacgcatttcgctggaaggaaagcattggaccctgggaggagagacctgggcactttggtgatgtttggatgtattggactgatgatggacttggatactttgagtttcttcaattaactgaagatcttggtgcacggccaatatgggtgttcaacaatggaatcagtcatcaggatcaagttgatactactgcagtctcaccttttgtacaagaagcccttgatggtcttgagtttgccagaggcgattctaattctaagtggggttctgtcagagccgcaatggggcatccagagccttttgacttgaaatatgttgctgttgggaatgaggattgcgggaagaagaattaccgagcattactgcatcactcatttttgcatttaccttttaggggacgtattatggaagatagaccagtttcagaactcaaattcatgtgcttttttctaccaggaaattatctcaagttctacaatgccataagaagtgcctatcctgacatcaaaataatctcaaactgtgatgggtcttctcgttctttggatcacccagctgattactatgattatcatgtttatacatctgccagcaacctgttttctatgactcataagtttgattgcacatcccgcagttgtccaaaggcttctgtgagcaacgatgctgtgactggaaaagatgcgggcacaggaagtcttttagctgcactcgctgaagccggattcctcattggtctaaaaaggaacaggtggaatccagatgcaattgtcttcaactcatcaaagcactatggaactccgagctactgggtgcaaaaattcttcagagagtcaagtggagcaactcttcttgacgctaagctacagacaaattcctctacacttgttgcatctgcaattacttggcaaaattcagatcaaacttacctgaaaataaagattgtgaattttgggaacagcaaagtgaatctcaaagtttccattgatggattggggctcagctcacaattgtctggatcaacaaaaactgtgctcacttcttctaacttaatggacgagaattccttcgcgaatccaaaaaaggtggtgccagcacaaactatgctcgagaatgctgacaaagacatggatgttgtactctctccatattccttaacttcatttgatttgttaacagaatcaaacaatatcaggatgccacaaactgattctctctcaagatcatcaatttag

SEQ ID NO: 35 - protein, 682 aa, Populus balsamifera subsp. trichocarpa
  misc_feature (494)..(656): Pfam Name: Alpha-L-AF_C Pfam Description: Alpha-L-arabinofuranosidase C-terminus
  misc_feature (70)..(233): Pfam Name: CBM_4_9 Pfam Description: Carbohydrate binding domain
  misc_feature (1)..(682): Ceres Annot ID no. 1528070
  misc_feature (1)..(682): Bit score of 1486.8 for HMM based on sequences of Figure 11
  misc_feature (1)..(682): Functional Homolog Of SEQ ID NO. 4
MSSCKASCSVLLACFIVGLCSVCQCSAAEVDANQTANLIINGSSTRPIPETLFGIFFEEINHAGAGGIWAELVNNRGFEAGGQNTPSNIAPWSIIGDQSSLIVSTDRSSCFERNKVALRMDVLCDSTGGNICPAGGVGIYNPGFWGMNIEQGKAYKVVLYVRSLGSINVSVSLTSSDGSQILASANIVDSDVSNWTKAEVLLEAKGTNPNSRLQLTTSRKGVIWFDQVSAMPLDTYKGHGFRNELIEMIDDIKPQFVRFPGGCFVEGEWLRNAFRWKESIGPWEERPGHFGDVWMYWTDDGLGYFEFLQLTEDLGARPIWVFNNGISHQDQVDTTAVSPFVQEALDGLEFARGDSNSKWGSVRAAMGHPEPFDLKYVAVGNEDCGKKNYRALLHHSFLHLPFRGRIMEDRPVSELKFMCFFLPGNYLKFYNAIRSAYPDIKIISNCDGSSRSLDHPADYYDYHVYTSASNLFSMTHKFDCTSRSCPKASVSNDAVTGKDAGTGSLLAALAEAGFLIGLKRNRWNPDAIVFNSSKHYGTPSYWVQKFFRESSGATLLDAKLQTNSSTLVASAITWQNSDQTYLKIKIVNFGNSKVNLKVSIDGLGLSSQLSGSTKTVLTSSNLMDENSFANPKKVVPAQTMLENADKDMDVVLSPYSLTSFDLLTESNNIRMPQTDSLSRSSI

SEQ ID NO: 36 - protein, 664 aa, Oryza sativa subsp. japonica
  misc_feature (461)..(648): Pfam Name: Alpha-L-AF_C Pfam Description: Alpha-L-arabinofuranosidase C-terminus
  misc_feature (71)..(236): Pfam Name: CBM_4_9 Pfam Description: Carbohydrate binding domain
  misc_feature (1)..(664): Public GI ID no. 22324432
  misc_feature (1)..(664): Bit score of 1283.0 for HMM based on sequences of Figure 11
  misc_feature (1)..(664): Functional Homolog Of SEQ ID NO. 4
MAVQRTDAASWLRELVLVYAMCWTVSLGFVAGQTGQLNVDASPQNARKIPDKMFGIFFEEINHAGAGGLWAELVSNRGFEAGGPNTPSNIDPWLIIGNESSIIVGTDRTSCFEKNPVALRMEVLCDSKGTNNCPSGGVGVYNPGYWGMNIERRRVYKVGLHIRSSDAVSLTVSLTSSDGLQKLASHTITASKKQFAKWTKIEFHLKSSQTNTNSRLQLTTSKSGVIWLDQVSVMPSDTYMGHGFRKDLASMLANLKPQFLKFPGGNYAMGNYLRNAFRWSETVGPWEERPGHFNDAWGYWTDDGLGFFEFLQLAEDLGASPVWVVNDGASQNEEVSTATIASLVKDVVDGIEFARGGPKTTWGSVRAAMGHPQPFNLDYVSIGNQECWMLYYRGNYQKFYSAIKAAYPDINVVSSCDKSTISPSNPADLYDVHVYTSSSDMFSRTSMFDNTTRSGPKAIVSEYAVTGKDAGKGTLVEALAEAAFLVGLERNSDVVEMASCAPLFVNDNDRRWSPDAIVFNSWQNYGCPNYWMLHFFKDSCGATFHPSNIQISSYNQLVASAITWQNSKDKSTYLKIKLVNFGNQAVNLSISVSGLDEGIKSSGSKKTVLTSSGPLDENSFQQPQKVAPVSSPVDNANEQMGVLVDPYSLTSFDLLLQPSKHSTI

SEQ ID NO: 37 - DNA, 2001 bp, Sorghum bicolor
  misc_feature (1)..(2001): Ceres Annot ID no. 8657414
  misc_feature (1)..(2001): Encodes the peptide sequence at SEQ ID NO. 38
atgggcgtgcagagagccaatggcgcttccttgctccgtgcactagttgttgtgtgcgccctgtgctgggcattgtcttctcggtgtgcggaggggcagaactcaaatggtcagctgagtgtgaatgcctcgccacagaatgctaggaagatccctgataagatgtttggtatctttttcgaggagatcaaccatgctggagctggtgggttgtgggcagagcttgtaagcaacagaggattcgaggccggtgggcctaatacaccttccaatattgatccatggctgatcattggggatgaatcaagtatcattgttggaactgatcggacatcatgctttgaacgtaacccggttgcacttcggatggaagttctttgtgcttctaagaaaactaatgcctgcccgtcaggaggtgttggggtctataatcctggttactggggcatgaacattgaaaaaggaaaggtttataaggtgagcctgcatattaggtcatcagacacagtgtccttgactgtttccttgacaagctccgatggtctacaaaaacttgctgctcacaccatcacaggtagcaagaaaacctttgcaaaatggacaaagatagaatttcatttgagatccaaccaaaataacaccaactcaaggcttcaacttacaacaagtaaaagtggggtagtttggcttgatcaagtatcagttatgccaatggacacttacatggggcatggttttcggaaagatcttgcttctatgttggccaatctcaagcctcagtttctcaagtttccaggcggcaactatgccatgggaaattatctacgaaatgcatttcggtggagtgagactgttgggccatgggaggaaagacctggtcactttaatgatgcctggggatactggactgatgatggacttggattttttgagttccttcagttggctgaagaccttggtgcttccccagtttgggtggtgaatgatggagcaagccttaatgaagaagtttccacaaaaacaattgcttcattggttaaggatgttgttaatggcatagagtttgccaggggaggacccaagacaacttggggttcagttcgcgcatcaatgggacacccagaatcgtttaagcttgattatgtttcaataggaaatcaagaatgttggatgctgtactacagaggaaattaccaaaagttttactctgcgattaaatctgcctacccagacatcaacattatatcaagttgtgataggccaactatttcaccatccaaccctgccgatctttatgatgttcatgtctacacctctttgactaatatgttttcaaaaactagtatgtttgacaacacaccacgtggagcaccgaaggcaattgttagtgagtacgctgtgactgggaatgatgctggcaaaggaacactggtagcagcacttgcagaagctgcatttctcattggattggaaaggaacagtgatgtggttgagatggcaagctgtgcacccctttttgtaaatgacaatgatcgcaggtggagcccagatgccatcgtcttcaactcatggcagcactatgggtgtcccaactattggatgctacacttcttcaaggaatctagtggcgccacccttcatcctacagccatccagatctccaactatgatcagctgcttgcgtctgccatcacttggcagaatgctaaggacaggagcacttacctcaggataaaggtggtcaattttggcaaccaagctgtggatctcaacatatccattgcggaactgcccactggcatcaagaagtctggatcgaaacagatggttctaacatccagcagcccgcttgacgagaactccttccagcagccagagaaggtggtgccagtgttgagcccaatggtgaacgtggggcagcagatgggcgcgtccgtggggccctactccctcacctcgtttgatctgctgctggagccgagcaagcatgacagcatttga

SEQ ID NO: 38 - protein, 666 aa, Sorghum bicolor
  misc_feature (463)..(650): Pfam Name: Alpha-L-AF_C Pfam Description: Alpha-L-arabinofuranosidase C-terminus
  misc_feature (73)..(238): Pfam Name: CBM_4_9 Pfam Description: Carbohydrate binding domain
  misc_feature (1)..(666): Ceres Annot ID no. 8657414
  misc_feature (1)..(666): Bit score of 1251.1 for HMM based on sequences of Figure 11
  misc_feature (1)..(666): Functional Homolog Of SEQ ID NO. 4
MGVQRANGASLLRALVVVCALCWALSSRCAEGQNSNGQLSVNASPQNARKIPDKMFGIFFEEINHAGAGGLWAELVSNRGFEAGGPNTPSNIDPWLIIGDESSIIVGTDRTSCFERNPVALRMEVLCASKKTNACPSGGVGVYNPGYWGMNIEKGKVYKVSLHIRSSDTVSLTVSLTSSDGLQKLAAHTITGSKKTFAKWTKIEFHLRSNQNNTNSRLQLTTSKSGVVWLDQVSVMPMDTYMGHGFRKDLASMLANLKPQFLKFPGGNYAMGNYLRNAFRWSETVGPWEERPGHFNDAWGYWTDDGLGFFEFLQLAEDLGASPVWVVNDGASLNEEVSTKTIASLVKDVVNGIEFARGGPKTTWGSVRASMGHPESFKLDYVSIGNQECWMLYYRGNYQKFYSAIKSAYPDINIISSCDRPTISPSNPADLYDVHVYTSLTNMFSKTSMFDNTPRGAPKAIVSEYAVTGNDAGKGTLVAALAEAAFLIGLERNSDVVEMASCAPLFVNDNDRRWSPDAIVFNSWQHYGCPNYWMLHFFKESSGATLHPTAIQISNYDQLLASAITWQNAKDRSTYLRIKVVNFGNQAVDLNISIAELPTGIKKSGSKQMVLTSSSPLDENSFQQPEKVVPVLSPMVNVGQQMGASVGPYSLTSFDLLLEPSKHDSI

SEQ ID NO: 39 - protein, 675 aa, Oryza sativa subsp. japonica
  misc_feature (462)..(649): Pfam Name: Alpha-L-AF_C Pfam Description: Alpha-L-arabinofuranosidase C-terminus
  misc_feature (72)..(237): Pfam Name: CBM_4_9 Pfam Description: Carbohydrate binding domain
  misc_feature (1)..(675): Public GI ID no. 108707861
  misc_feature (1)..(675): Bit score of 1287.9 for HMM based on sequences of Figure 11
  misc_feature (1)..(675): Functional Homolog Of SEQ ID NO. 4
MGVRRGRLDSSLFHMLVLVCALSQVLFVGLVTGQTAQLSVDASSQNGRTIPDKMFGIFFEELNHAGAGGLWAELVSNRGFEAGGINTPSNIDPWLIIGDESNIIVETDRSSCFASNPIALRMEVLCGATGTNACPSGGVGIYNPGYWGMNIEKTKVYKVSMYIRSSDSVDLAVSLTSSDGLQNLATHTITAEKGDFAGWTKVEFDLQSSERNTSSRLQLTTTKNGIIWFDQVSVMPSDTYMGHGFRKDLATMLANLKPRFLKFPGGNYVMGNYLLNAFRWSETIGPWEERPGHFNDVWNYWTDDGLGFFEFLQLAEDLDACPVWVINDGASLNEQIPSATIAAFVKDVVDGIEFARGDPKTTWGSVRAAMGHPEPFPLYYISVGNQECSKPYYKEKYVKFYSAIKASYPDIKIISSCDISSISAVNPADLYDVHVYTSSGDMFSKTRMFDSTPRSGPKAFVSEYAVTGNDAGRGTLVAALAEAAFLIGLERNSDVVEMASCAPLFINDNDRGFSPDAIVFNSWQHYGCPNYWMLHFFKDSSGATLHPLTIQVSNYDQLAASALTWQNSNDGNTYLKIKVVNFGNKAVNLNIAVAGLENGIQEFGSIKTVLTSGWLRDENSFQQPDKVVPAASPITNAGEKMGVIVDPYSLTSFDLLLDTNTDKYPLLESSFHSSM

SEQ ID NO: 40 - protein, 654 aa, Daucus carota
  misc_feature (455)..(645): Pfam Name: Alpha-L-AF_C Pfam Description: Alpha-L-arabinofuranosidase C-terminus
  misc_feature (145)..(214): Pfam Name: CBM_4_9 Pfam Description: Carbohydrate binding domain
  misc_feature (1)..(654): Public GI ID no. 50507838
  misc_feature (1)..(654): Bit score of 1304.2 for HMM based on sequences of Figure 11
  misc_feature (1)..(654): Functional Homolog Of SEQ ID NO. 4
MGFSRGPCSVLVCILVGLCSFYPCSGTDITAQLFVNASKQSARTIPDTLFGIFFEEINHAGAGGLWAELVDNRGFEAGGQATPSDIAPWFIIGDESLVVLSTDRSSCFDRNKIALRMDVLCDSKGPLICPAGGVGVYNPGFWGMNIEQGKSYKLILYLRSYNPINVSVSLTDSTGSQPLATSNIIASSVSNWTRMEFLFVAKATNPNSRLQFTTTQAGVIWFDQVSLMPVDTYKGLGFREDLFQLLADLKPAFLRFPGGCFVEGGRLPNAVRWKDTIGPWEERPGHYGDVWDYWTDDGLGHFEFFQLAEDLGALPIWVFNNGISLHGEVNMSVILPFIHEVLDGLEFAKGDASTTWGSVRAALGHPEPFDLRYVAIGNEECPIQGYRGNYLKFYQAIKHYYPEIKIISNCDGSSQKLDHPADLYDYHIYTSANNMFSKYNAFDYVARDGPKAFVSEYAVTPKEDAGTGSLLAALAEAGFLLGLERNSDIVEMASYAPLFVNTNDRHWNPDAIVLNSAKAYGTPSYWMQQFFIESNGATLLNSTLQASSTNSLHASAIIWKNTDDATYYLRLKFVNIGSVPVSMKISIDGVKINTKSALSTVLTSDNVMDENSFDKPAKVTPVRAPLTANVELDGTEMTFTLAQHSLTSIDVLTT

SEQ ID NO: 41 - protein, 679 aa, Physcomitrella patens subsp. patens
  misc_feature (454)..(645): Pfam Name: Alpha-L-AF_C Pfam Description: Alpha-L-arabinofuranosidase C-terminus
  misc_feature (62)..(224): Pfam Name: CBM_4_9 Pfam Description: Carbohydrate binding domain
  misc_feature (1)..(679): Public GI ID no. 168060089
  misc_feature (1)..(679): Bit score of 1117.4 for HMM based on sequences of Figure 11
  misc_feature (1)..(679): Functional Homolog Of SEQ ID NO. 4
MANSLLCILVVAFTTHLVVPALAQSTVTLKVNATNPGRQIPSTLFGLFFEEINHAGDGGLWAELVQNRGFEAGGLNVPSIIEPWYKIGTAAQITIGTECSSPHARNPVALKIEVLCDNNDASLQCPKGGVGVANPGFWGMNILSGSKYRVEYWLKTTSSFNLSVAFTSANGTVLAQEHVSLNAGEWRKYSVVLMATSTDHNARLSLTSGTRSVFWVDQVSGMPTDTFKARKGLGHGFRKELATMISDLKPGFLRFPGGCYVEGARLVNAFRWRDSVGPYENRPGHYGDVWYYWSDDGFGYFEGLQLAEDLGAAPIWVFNNGISHEQSVSTDVIGPWVQDVLEGIEFARGPVSSKYGAMRASMGHPDPFPLHHVAIGNEDCYKPYYKENYMEFYKAIKLLYPDIQVISNCDGSGAALDHPADLYDYHIYTNANNLFSMRHQFDKTSRSGPKAFVSEYAVTGSDSGKGSLLASLAEGAFLIGLELNSDVVHMASYAPLFVNDNDRRWNPDAIVFNSWQQYGTPSYWVQQFFKKSNGAYLISSTMEADSASALANLATSAVRTYNASTGMEYMIVKAVNFGSSALNLSIAVSGISANNVVAADSHITVMTSGAVMDENSFTNPKKVVPQVSQAENAAPNMQILLPAHSITALELGLLPTKSSTATLEVTQVTSKDSKAPFLV

SEQ ID NO: 42 - protein, 680 aa, Zea mays
  misc_feature (478)..(663): Pfam Name: Alpha-L-AF_C Pfam Description: Alpha-L-arabinofuranosidase C-terminus
  misc_feature (95)..(253): Pfam Name: CBM_4_9 Pfam Description: Carbohydrate binding domain
  misc_feature (1)..(680): Bit score of 1625.1 for HMM based on sequences of Figure 11
  misc_feature (1)..(680): Functional Homolog Of SEQ ID NO. 4
MVDACMHGRHAGPTRIDKWKRMGITSNDAAPRAVLLRFLFLLCIGCKCLASEVEATQTATLAVDASPQLARKIPDTLFGIFFEEINHAGAGGIWAELVSNRGFEAGGLHTPSNIDPWSIIGDDSSVFVETDRTSCFSRNIVALRMEVLCDNCPTGGVGVYNPGFWGMNIEEGKVYNLVMFVKSPETTDLTVSLTSSNGLQNLASATVTVSGESNWIKVEQKLVAKGTNRTSRLQITTNKKGVVWFDQVSLMPEDTYKGHGFRTELISMILDLKPRFLRFPGGCFVEGGWLRNAFRWRESIGPWEERPGHFGDVWHYWTDDGLGYYEFLQLAEDLGTEPIWVFNNGVSHNDEVDTVAIAPFVKDVLDSIEFARGSANSTWGSVRAAMGHPEPFPVKYVAIGNEDCGKKFYRGNYLKFYNAIRQAYPDIQMISNCDGSSTPLDHPADLYDFHVYNDSKTLFNMKSTFDRTSRSGPKAFVSEYAVWRGDAGRGSLLASLAEAAFLTGLEKNSDIVSMASYAPLFVNDNDQTWNPDAIVFNSWQHYGTPSYWMQTLFRESSGAMFHPTTISSSYSGSLAASAITWQDSENSFLRVKVINFGSDAVTLTISTSGLQASINALGSTATVLTSADVMDENSFSNPTKVVPVKSDLSNAAEQMQVTLAPRSFSSFDLALAQSKLVAEM

SEQ ID NO: 43 - protein, 657 aa, Zea mays
  misc_feature (455)..(640): Pfam Name: Alpha-L-AF_C Pfam Description: Alpha-L-arabinofuranosidase C-terminus
  misc_feature (71)..(229): Pfam Name: CBM_4_9 Pfam Description: Carbohydrate binding domain
  misc_feature (1)..(657): Bit score of 1618.8 for HMM based on sequences of Figure 11
  misc_feature (1)..(657): Functional Homolog Of SEQ ID NO. 4
  misc_feature (377)..(377): Xaa is any aa, unknown, or other
MDLKQASSGTIFCLLLLFCVGCRCRPSEIEATQTAALKVDASPQLARKIPETLFGIFFEEINHAGAGGIWAELVSNRGFEAGGSHTPSNIDPWSIIGDDSSVFVATDRTSCFSRNIVALRMEVLCDECPAGGVGVYNPGFWGMNIEDGKAYNLVMYVQSPETKDLTVSLTSSDGLQNLASATITVSGTSNWTKVEQKLVAKGTNRTSRLQITTNKKGVVWLDQVSLMPEDTYKGHGFRTELISMLLDLKPRFLRFPGGCFVEGDWLRNAFRWRESIGPWEERPGHFGDVWHYWTDDGLGYYEFLQLAEDLGAAPIWVFNNGISHNDEVDTVAIAPFVKDVLDSLEFARGSADSTWGSVRAAMGHPEPFLVKHVAIGXNEDCGKKFYRGNYLKFYNAIREAYPDIQMISNCDGSSRPLDHPADLYDFHVYTDSKTLFNMRSTFDRTSRSGPKAFVSEYAVWRSDAGRGSLLASLAEAAFLTGLEKNSDIVQMASYAPLFVNDNDQTWNPDAIVFNSWQHYGTPSYWMQTIFRESSGAMIHPVNISSRYSSSLAASAITWQDAENSFLRVKVVNFGSDTVNLTVSTSGLGASVNALGSTATVLTSGNVMDENSFSNPNKVAPVKSQLSNAAEQMQVTLAPHSFTAFDLALAEPKLVAEI

SEQ ID NO: 44 - protein, 656 aa, Zea mays
  misc_feature (454)..(639): Pfam Name: Alpha-L-AF_C Pfam Description: Alpha-L-arabinofuranosidase C-terminus
  misc_feature (71)..(229): Pfam Name: CBM_4_9 Pfam Description: Carbohydrate binding domain
  misc_feature (1)..(656): Bit score of 1625.8 for HMM based on sequences of Figure 11
  misc_feature (1)..(656): Functional Homolog Of SEQ ID NO. 4
MDLKQAFSGTIFCLLLLFCVGCRCRTLEIEATQTAALKVDASPQLARKIPETLFGIFFEEINHAGAGGIWAELVSNRGFEAGGSHTPSNIDPWSIIGDDSSVFVATDRTSCFSRNIVALRMEVLCDDCPAGGVGVYNPGFWGMNIEDGKAYNLVMYVQSPETKDLTVSLTSSDGLQNLASATITVSGTSNWTKVEQKLVAKGTNRTSRLQITTNKKGVVWLDQVSLMPEDTYKGHGFRTELISMLLDLKPRFLRFPGGCFVEGDWLRNAFRWRESIGPWEERPGHFGDVWHYWTDDGLGYYEFLQLAEDLGAAPIWVFNNGISHNDEVDTVAIAPFVKDVLDSLEFARGSADSTWGSVRAAMGHPEPFLVKHVAIGNEDCGKKFYRGNYLKFYNAIREAYPDIQMISNCDGSSRPLDHPADLYDFHVYTDSKTLFNMRSTFDRTSRSGPKAFVSEYAVWRSDAGRGSLLASLAEAAFLTGLEKNSDIVQMASYAPLFVNDNDQTWNPDAIVFNSWQHYGTPSYWMQTIFRESSGAMIHPVNISSRYSSSLAASAITWQDAENSFLRVKVVNFGSDTVNLTVSTSGLGASVNALGSTATVLTSGNVMDENSFSNPNKVAPVKSQLSNAAEQMQVTLAPHSFTAFDLALAEPKLVAEI

SEQ ID NO: 45 - protein, 656 aa, Sorghum bicolor
  misc_feature (454)..(639): Pfam Name: Alpha-L-AF_C Pfam Description: Alpha-L-arabinofuranosidase C-terminus
  misc_feature (71)..(229): Pfam Name: CBM_4_9 Pfam Description: Carbohydrate binding domain
  misc_feature (1)..(656): Bit score of 1618.9 for HMM based on sequences of Figure 11
  misc_feature (1)..(656): Functional Homolog Of SEQ ID NO. 4
MDLKQSFSTTIFCVLLLFCVGCRCRPLEIEATQTATLKVDATPQLARKIPETLFGIFFEEINHAGAGGIWAELVNNRGFEAGGPHTPSNIDPWSIIGDDSSIFVATDRTSCFSRNIVALRMEVLCNDCPAGGVGVYNPGFWGMNIEDGKAYNLVMYVKSPETTDLTVSLTSSDGLQNLASATITVSGASNWTKVEQKLVAKGTNRTSRLQIKTNKKGVVWLDQVSLMPEDTYKGHGFRTELISMLLDLTPRFLRFPGGCFVEGEWLRNAFRWRESIGPWEERPRRFGDVWHYWTDDGLGYYEFLQLAEDLGAAPIWVFNNGISHNDEVDTVAIAPFVKDVLDSLEFARGSADSTWGSVRAAMGHPEPFPVKHVAIGNEDCGKKFYRGNYLKFYNAIREAYPDIQMISNCDGSSRPLDHPADLYDFHVYTDSKTLFNMRSQFDRTSRSGPKAFVSEYAVWRSDAGRGSLLASLAEAAFLTGLEKNSDIVQMASYAPLFVNNNDQTWNPDAIVFNSWQHYGTPSYWMQTLFRESSGAMIHPINMSSRYSSSLAASAITWQDSENSFLRVKVVNFGSDTVSLTISTSGLQASVNSLGSTATVLTSGNVMDENSFSNPNKVAPVKSQLSNAGEQMQVTLAPHSFTTFDLALAQSKLVAEM

SEQ ID NO: 46 - protein, 660 aa, Oryza sativa
  misc_feature (458)..(643): Pfam Name: Alpha-L-AF_C Pfam Description: Alpha-L-arabinofuranosidase C-terminus
  misc_feature (75)..(233): Pfam Name: CBM_4_9 Pfam Description: Carbohydrate binding domain
  misc_feature (1)..(660): Bit score of 1636.2 for HMM based on sequences of Figure 11
  misc_feature (1)..(660): Functional Homolog Of SEQ ID NO. 4
MGSREPFLSAIFFFFFLLLFCLGCKCIASELHLHTTQTAVLKVDASLQHARQIPDTLFGIFFEEINHAGAGGIWAELVSNRGFEAGGPHTPSNIDPWSIIGDDSSIFVATDRTSCFSRNTVALRMEVLCDNCPAGGVGIYNPGFWGMNIEDGKTYNLVMYVKSPETVELTVSLTSSDGSQNLASSTIPVSGASNWTKLEQKLVAKGTNRTSRLQITTTKKGVVWFDQVSLMSADTYKGHGFRTELISMMLDLKPRFLRFPGGCFVEGEWLRNAFRWRESIGPWEERPGHFGDVWHYWTDDGLGYYEFLQLSEDLGAAPIWVFNNGISHNDEVDTAAIAPFVKDVLDSLEFARGSADSTWGSVRAAMGHPEPFPVKYVAIGNEDCGKKFYRGNYLKFYNAIREAYPDIQMISNCDASSRPLDHPADLYDFHVYTDSKTLFSMKSAFDRSSRNGPKAFVSEYAVWRSDAGRGSLLASLAEAAFLTGLEKNSDVVQMASYAPLFVNNNDQTWNPDAIVFNSWQQYGTPSYWMQTLFRESSGAMFHPITITSSYSGSLAASAITWQDSENSFLRVKIINFGSDPVSLTISATGLQARVNALGSTATVITSSNVMDENSFSNPNKVVPVKSQLSNAAEQMQVTLAPHSFSSFDLALAQSKLVAEM

SEQ ID NO: 47 - protein, 676 aa, Oryza sativa
  misc_feature (485)..(659): Pfam Name: Alpha-L-AF_C Pfam Description: Alpha-L-arabinofuranosidase C-terminus
  misc_feature (73)..(260): Pfam Name: CBM_4_9 Pfam Description: Carbohydrate binding domain
  misc_feature (1)..(676): Bit score of 1564.8 for HMM based on sequences of Figure 11
  misc_feature (1)..(676): Functional Homolog Of SEQ ID NO. 4
  misc_feature (647)..(647): Xaa is any aa, unknown, or other
MASRESFMSTIFFFLLLFSLGCKCIASELHLHATQTAVLKVDASPQLARQIPDTLFGIFFEEINHAGAGGIWAELVSNRGFEAGGPHTPSNIDPWSIIGDDSSIFVATDRTSCFSRNTVALRMEVLCDNCPAGGVGIYNPGFWGMNIEDGKIYNLVMYVKSPETVELTVSLTSSDGSQNLASTTIPLVPFLSILGQENKDVCPFPLVLKGLYCCRVSGASNWTKLEQKLVAQGTNRTSRLQITTNKKGVVWFDQVSLMPADTYKGHGFRTELISMMLDLKPRFLRFPGGCFVEGEWLRNAFRWRESIGPWEERPGHFGDVWHYWTDDGLGYYEFLQLSEDLGAAPIWVFNNGISHNDEVDTAAIAPFVKDVLDSLEFARGNADSTWGSVRAAMGHPEPFPVKYVAIGNEDCGKKFYRGNYLKFYNAIREAYPDIQMISNCDASSSPLDHPADLYDFHVYTDSKTLFSMKNTFDRSSRNGPKAFVSEYAVWRSDAGRGSLLASLAEAAFLTGLEKNSDVVQMASYAPLFVNNNDQTWNPDAIVFNSWQQYGTPSYWMQTLFGESSGAMFHPVTITSSYSGSLAASAITWQDSENSFLRVKIINFGSDPVSLTISATGLQARVNALGSTATVLTSSNVMDENSFSNPNXAEQMQVTLAPHSFSSFDLALAQSKLVAEM

SEQ ID NO: 48 - protein, 657 aa, Oryza sativa
  misc_feature (453)..(639): Pfam Name: Alpha-L-AF_C Pfam Description: Alpha-L-arabinofuranosidase C-terminus
  misc_feature (70)..(228): Pfam Name: CBM_4_9 Pfam Description: Carbohydrate binding domain
  misc_feature (1)..(657): Bit score of 1467.6 for HMM based on sequences of Figure 11
  misc_feature (1)..(657): Functional Homolog Of SEQ ID NO. 4
MGFEETYFSAFCYLLLFPVSWKCQAAELDMAQTAVLEVDASWNLSRKIPDTLFGLFFEEINHAGAGGIWAELVSNRGFEAGGPHTPSNIDPWSIIGDESSIYVTTDCSSCFRQNIVALRMEILCDNCPAGGVGIYNPGFWGMNIEEGKAYNLVMYIRSLESVELTASLTCSDGMQNLASVSIQGIDLSNWTKIELQLLAEGTCRTSRLELTSMKKGIIWFDQVSLMPSDTYKGHGFRKELLYMLLELKPQFLRFPGGCFVEGDWLRNAFRWRETIGPWEQRPGHFGDVWNYWTDDGLGYYEFLQLSEDLGAAPIWVFNVGISHHDEVDTTIIEPFVKDVLDSLEFARGRAESTWGSVRAAMGHPERFPLKYVAIGNEDCDKGFYRGNYLKFYDAIRKAYPDIQMISNCDGSSRPLDHPADLYDFHVYTSAANLFIMKNKFDRTSRIGSKVFVSEYAVNEQRDAGKGSLLASLAEAAFLTGLEKNSDLVQMASYAPLFVNDNDRTWNPDAIVFNSWQQYGTPSYWMQTYFRESSGSVIHPITIGSSYSDSLAASAITWKDTHDIFLRIKIVNFGPNAVNLAISSRGLQAGVNTAKSTVTVLTSGNLLDENSFAEPNKVVPVKSELPDASEEMEAALSPYSFTSFDLALDQYSKLVAEM

SEQ ID NO: 49 - protein, 678 aa, Ricinus communis
  misc_feature (464)..(652): Pfam Name: Alpha-L-AF_C Pfam Description: Alpha-L-arabinofuranosidase C-terminus
  misc_feature (74)..(239): Pfam Name: CBM_4_9 Pfam Description: Carbohydrate binding domain
  misc_feature (1)..(678): Bit score of 1610.1 for HMM based on sequences of Figure 11
  misc_feature (1)..(678): Functional Homolog Of SEQ ID NO. 4
MNIMASCKASFTILFLYLFLIGLWFTYTCSAVEFEANPTAQLLVDASVSRPIPETLFGIFFEEINHAGAGGIWGELVNNRGFEAGGPNIPSNIDPWSIIGDESTIIVSTDRSSCFERNKVALRMDVLCDSKGSNNCPDGGVGIYNPGFWGMNIEEGKTYKVVLYVRSLGSINISVSLTDSSGLQILATANIIASASDVLNWTKAEVLLEAKGTNHNSRLQLKTSQKGVTWFDQVSAMPIDTYKGHGFRKDLVQMLVDIKPRFFRFPGGCFVEGEWLRNAFRWKETIGPWEERPGHFGDVWMYWTDDGLGYFEFLQLSEDLGASPIWVFNNGISHNDQVDTTSILPFVQEALDGIEFARGDSNSKWGSVRAAMGHPEPFDLRYVAVGNEDCGKKNYRGNYLKFYDAIKRVYPDIKIISNCDGSSHSLDHPADYYDFHVYTSANNLFSMAHQFDRTSRKGPKAFVSEYAVTGKDAGTGSLLAGLAEAAFLIGLEKNSDIVEMASYAPLFVHSNNRRWNPDAIVFNSSQLYGTPSYWVQRFFMDSSGATLINTTLQTNSSTSLIASAIIWQNSVDSKNYLKIKVVNFGSSTVNLKISIDGLGLNSIQLSGSTKMLLTSANVMDENSFNDPKKVLPTLSMLDHAGKDMDVVLPPYSLTSYDLLTESSNIKITGTDSLSRSSI

SEQ ID NO: 50 - protein, 710 aa, Carica papaya
  misc_feature (497)..(684): Pfam Name: Alpha-L-AF_C Pfam Description: Alpha-L-arabinofuranosidase C-terminus
  misc_feature (89)..(259): Pfam Name: CBM_4_9 Pfam Description: Carbohydrate binding domain
  misc_feature (1)..(710): Bit score of 1456.2 for HMM based on sequences of Figure 11
  misc_feature (1)..(710): Functional Homolog Of SEQ ID NO. 4
MLWADYAKFLCGEVTMSSCKAASSFSSFLCFFLGACCVYQCFALEVGANVTARLIVDASQGASRPMPETLFGIFFEQEINHAGAGGLWDELVSNRGGFEAGGPNTPSNIDPWSIIGDESSVTVSTERSSCFERNKVALRMEVLCDSRGANICPSGGVGVYNPGFWGIFLCQNIEQGKKYKVVLYVRSPGAIDLSVSLTSSNGSRTLASSNVIASSSDVSNWTKKELLLEAKGTDPHSRLQLTTARKGVIWLDQVSAMPLDTYKVQGHGFRSDLVEMLLDIKPRFIRFPGGGCFVEGEWLRNAFRWKESIGPWEERPGHFGDVWNYWTDDGLGYFEFLQVGLAEDLGALPIWVFNNGIGISHNDQVDTSTVLPFVQLQEALDSIEFARGDPDSRWGSVRAAMGHPEPFDLRFVALGNEDCWKKNYWPGNYLRFYYAIKRAFPDIKIISNCDGSSRQLDHPTDYYDFHVVYTSSSNLFSMSHKFDHASRNGPKVWAFVSEYAVTGKDAGTGSLLAALAEAGFLIGLEKNSDLVEMTSYAPLFVNVNDRRWNPDAIVFDSYRQYGTPSYWVQQFFAESSGATLLNSTLQIDSTSLIASAISWQDEKADKKYIRINVNFGSNAVTLRIYVDGMDPNVARLSGLTETVLRSDNVMDENSFENPEKVRLLFLFLLENAGEDIEVELSPHSFTSFDLLKEYANIRIAGFDSFSKSST

SEQ ID NO: 51 - protein, 667 aa, Populus trichocarpa
  misc_feature (465)..(641): Pfam Name: Alpha-L-AF_C Pfam Description: Alpha-L-arabinofuranosidase C-terminus
  misc_feature (74)..(237): Pfam Name: CBM_4_9 Pfam Description: Carbohydrate binding domain
  misc_feature (1)..(667): Bit score of 1541.1 for HMM based on sequences of Figure 11
  misc_feature (1)..(667): Functional Homolog Of SEQ ID NO. 4
MGEKMSSCKASCSVLLACFIVGLCSVCQCSAAEVDANQTANLIINGSSTRPIPETLFGIFFEEINHAGAGGIWAELVNNRGFEAGGQNTPSNIAPWSIIGDQSSLIVSTDRSSCFERNKVALRMDVLCDSTGGNICPAGGVGIYNPGFWGMNIEQGKAYKVVLYVRSLGSINVSVSLTSSDGSQILASANIVDSDVSNWTKAEVLLEAKGTNPNSRLQLTTSRKGVIWFDQVSAMPLDTYKGHGFRNELIEMIDDIKPQFVRFPGGCFVEGEWLRNAFRWKESIGPWEERPGHFGDVWMYWTDDGLGYFEFLQLTEDLGARPIWVFNNGISHQDQVDTTAVSPFVQEALDGLEFARGDSNSKWGSVRAAMGHPEPFDLKYVAVGNEDCGKKNYRGNYLKFYNAIRSAYPDIKIISNCDGSSRSLDHPADYYDYHVYTSASNLFSMTHKFDCTSRSCPKASVSNDAVTGKDAGTGSLLAALAEAGFLIGLKRNRFVILVPAILSYLSMWNPDAIVFNSSKHYGTPSYWVQKFFRESSGATLLDAKLQTNSSTLVASAITWQNSDQTYLKIKIVNFGNSKVNLKVSIDGLGLSSQLSGSTKTVLTSSNLMDENSFANPKKVVPAQTMLENADKDMDVVLSPYSLTSFDLLTESNNIRMPQTDSLSRSSI

SEQ ID NO: 52 - DNA, 744 bp, Populus balsamifera subsp. trichocarpa
  misc_feature (1)..(744): Ceres Annot ID no. 1514289
  misc_feature (1)..(744): Encodes the peptide sequence at SEQ ID NO. 53
atggccaccaacggagaggaacagcaaagccaggcaggaaggcaccaggaagttggccacaagagccttttgcaaagtgatgctctttaccagtatattctcgagactagtgtgtatccaagagagcctgaatgcatgaaggagctcagggaggtgactgccaagcatccttggaacatcatgaccacatctgctgatgaagggcaattcttgaatatgcttttgaagcttgtcaatgccaaaaacaccatggagatcggtgtttacactggctattctctcttggccactgccctggctatccctgaggatggcaagatcttggctatggacatcaacagagaaaactatgaattgggtctcccagtaattcagaaagctggtgttgcgcacaagattgatttcaaggaaggccctgctctaccagttcttgatcaaatgattgaagatgggaagtgccatggaagttttgatttcatctttgtggatgctgacaaggacaattatataaattatcacaagaggttgattgagcttgtaaaagttggtgggctgattgggtacgacaacactctgtggaatggatctgtggtggctccacctgatgcaccaatgaggaagtatgtgaggtactacagggactttgttttggagctcaacaaggcacttgctgctgaccccaggattgaaatttgcatgcttcctgttggtgatggcatcactctctgccgtcggatccaatga

SEQ ID NO: 53 - protein, 247 aa, Populus balsamifera subsp. trichocarpa
  misc_feature (34)..(246): Pfam Name: Methyltransf_3 Pfam Description: O-methyltransferase
  misc_feature (1)..(247): Ceres Annot ID no. 1514289
  misc_feature (1)..(247): Bit score of 739.2 for HMM based on sequences of Figure 13
  misc_feature (1)..(247): in Figure 13
MATNGEEQQSQAGRHQEVGHKSLLQSDALYQYILETSVYPREPECMKELREVTAKHPWNIMTTSADEGQFLNMLLKLVNAKNTMEIGVYTGYSLLATALAIPEDGKILAMDINRENYELGLPVIQKAGVAHKIDFKEGPALPVLDQMIEDGKCHGSFDFIFVDADKDNYINYHKRLIELVKVGGLIGYDNTLWNGSVVAPPDAPMRKYVRYYRDFVLELNKALAADPRIEICMLPVGDGITLCRRIQ

SEQ ID NO: 54 - protein, 247 aa, Broussonetia papyrifera
  misc_feature (34)..(246): Pfam Name: Methyltransf_3 Pfam Description: O-methyltransferase
  misc_feature (1)..(247): Public GI ID no. 47680455
  misc_feature (1)..(247): Bit score of 738.7 for HMM based on sequences of Figure 13
  misc_feature (1)..(247): Functional Homolog Of SEQ ID NO. 53
  misc_feature (1)..(247): in Figure 13
MATNGEGKQNEAGRHQEVGHKSLLQSDALYQYILETSVYPREPEAMKELREITAKHPWNIMTTSADEGQFLNMLLKLINAKNTMEIGVYTGYSLLATALALPDDGKILAMDINRENYELGLPVIEKAGVAHKIDFREGPALPVLDQMIEDGKYHGSFDFIFVDADKDNYLNYHKRLIELVKVGGVIGYDNTLWNGSVVAPPDAPLRKYVRYYRDFVLELNKALAADPRIEICMLPVGDGITVCRRVS

SEQ ID NO: 55 - DNA, 1189 bp, Gossypium hirsutum
  misc_feature (1)..(1189): Ceres Clone ID no. 1843515
  misc_feature (1)..(1189): Encodes the peptide sequence at SEQ ID NO. 56
aggtttccaattcaaaggaaattgaaactcgctcaggtccataaacaaaggaaagcaaagagaaagaagcttttcatttcaagggttttagcaatggcaaccaatacgcaagagcagcaatctcaggctggtaggcaccaggaagttggccacaagagccttttgcaaagtgatgctctttaccagtatatcctcgagaccagtgtgtatccgagggagcctgaacccatgaaggagctcagagagttgactgccaagcacccatggaaccttatgacaacatcagccgatgaaggccagttcttgaacatgcttcttaagttgatcaatgccaagaacaccatggagattggtgtctacactggctattctctcttagccactgcccttgctatccctgatgatggaaagatcctagccatggatgttaacagagaaaactacgagctgggtctgcctgtaatccaaaaggctggtgttgcacacaaaattgatttcaaagagggccctgctttgccagttcttgatcaattagtggaagatgaaaagaaccacggatcctttgacttcatctttgtggatgctgataaagacaattacctaaactaccacaagaggctaattgagctggtgaaagtaggcggtttgatcggctacgacaataccctatggaatgggtcggtggtagcaccacctgatgcgcctctcaggaagtacgttaggtattacagagacttcgtcatggaactcaacaaggctcttgctgttgatcccaggattgagatctgcatgctcccggttggtgatggcatcaccctttgccgtcgcgttaaatgaacaaccctcaccaccaccaaagcttgacccacctcttacattcggcacaaaaaagttgacacccaccttctttttctttcctcatctttatattgtgtatgtttatttttatcataatgtcacggtggttggatgattgaagaatgccatattttttaaacatgatctgacgtatcgaatcataatgattttctcagtattatacaccatggcgggcgaccgttctaacttggttgtataattgcgtggtttccttccacccaccactaaaggaaaaaactttatgttccattcagacagaaacgggtacttgtcagattttacttccagtaatcaactttttaattctctc

SEQ ID NO: 56 - protein, 247 aa, Gossypium hirsutum
  misc_feature (34)..(246): Pfam Name: Methyltransf_3 Pfam Description: O-methyltransferase
  misc_feature (1)..(247): Ceres Clone ID no. 1843515
  misc_feature (1)..(247): Bit score of 729.2 for HMM based on sequences of Figure 13
  misc_feature (1)..(247): Functional Homolog Of SEQ ID NO. 53
  misc_feature (1)..(247): in Figure 13
MATNTQEQQSQAGRHQEVGHKSLLQSDALYQYILETSVYPREPEPMKELRELTAKHPWNLMTTSADEGQFLNMLLKLINAKNTMEIGVYTGYSLLATALAIPDDGKILAMDVNRENYELGLPVIQKAGVAHKIDFKEGPALPVLDQLVEDEKNHGSFDFIFVDADKDNYLNYHKRLIELVKVGGLIGYDNTLWNGSVVAPPDAPLRKYVRYYRDFVMELNKALAVDPRIEICMLPVGDGITLCRRVK

SEQ ID NO: 57 - protein, 249 aa, Eucalyptus gunnii
  misc_feature (34)..(245): Pfam Name: Methyltransf_3 Pfam Description: O-methyltransferase
  misc_feature (1)..(249): Public GI ID no. 3023419
  misc_feature (1)..(249): Bit score of 722.5 for HMM based on sequences of Figure 13
  misc_feature (1)..(249): Functional Homolog Of SEQ ID NO. 53
  misc_feature (1)..(249): in Figure 13
MATAGEESQTQAGRHQEVGHKSLLQSDALYQYILETSVYPREPEPMKELREITAKHPWNIMTTSADEGQFLNMLLKLINAKNTMEIGVFTGYSLLATALALPDDGKILAMDINRENYELGLPVIQKAGVADKIDFREGPALPILDQLIEDGKQGSFDFIFVDADKDNYLNYHKRLIELVKVGGLIGYDNTLWNGSVVAPPDAPLRKYVRYYRDFVLELNKALAADPRIEICMLPVGDGITLCRRIQLSI

SEQ ID NO: 58 - protein, 247 aa, Codonopsis lanceolata
  misc_feature (34)..(246): Pfam Name: Methyltransf_3 Pfam Description: O-methyltransferase
  misc_feature (1)..(247): Public GI ID no. 82941443
  misc_feature (1)..(247): Bit score of 727.7 for HMM based on sequences of Figure 13
  misc_feature (1)..(247): Functional Homolog Of SEQ ID NO. 53
  misc_feature (1)..(247): in Figure 13
MATNGDSNAEQTTRHQEVGHKSLLQSDALYQYILETSVYPREPESMKELREATAKHPWNIMTTSADEGQFLNMLLKLINAKNTMEIGVFTGYSLLATALALPDDGKILAMDINRENYDIGRPIIEKAGVAHKIDFREGPALPVLDQMIEDGKYHGTFDFVFVDADKDNYINYHKRIIDLVKVGGLIGYDNTLWNGSVVAPPDAPMRKYVRYYRDFVLELNKALAADPRIEICMLPVGDGITLCRRVS

SEQ ID NO: 59 - protein, 247 aa, Boehmeria nivea
  misc_feature (34)..(246): Pfam Name: Methyltransf_3 Pfam Description: O-methyltransferase
  misc_feature (1)..(247): Public GI ID no. 55724835
  misc_feature (1)..(247): Bit score of 726.9 for HMM based on sequences of Figure 13
  misc_feature (1)..(247): Functional Homolog Of SEQ ID NO. 53
  misc_feature (1)..(247): in Figure 13
MANNGEGKQNEVSRHQEVGHKSLLQSDALYQYILETSVYPREPESMKELREITAKHPWNLMTTSADEGQFLSMLLKLINAKNTMEIGVFTGYSLLATALALPEDGKILAMDINRENYELGLPVIEKAGLAHKIDFREGPALPALDQMIEDGKYHGSFDFIFVDADKDNYLNYHKRLIELVKVGGVIGYDNTLWNGSVVAPPDAPLRKYVRYYRDFVLELNKALAADPRIEICMLPVGDGIPICRRVS

SEQ ID NO: 60 - protein, 247 aa, Humulus lupulus
  misc_feature (34)..(246): Pfam Name: Methyltransf_3 Pfam Description: O-methyltransferase
  misc_feature (1)..(247): Public GI ID no. 167613943
  misc_feature (1)..(247): Bit score of 727.4 for HMM based on sequences of Figure 13
  misc_feature (1)..(247): Functional Homolog Of SEQ ID NO. 53
  misc_feature (1)..(247): in Figure 13
  misc_feature (10)..(10): Xaa is any aa, unknown, or other
  misc_feature (144)..(144): Xaa is any aa, unknown, or other
  misc_feature (188)..(188): Xaa is any aa, unknown, or other
MANNGEGEQXQVSRHQEVGHKSLLQSDALYQYILETSVYPREPESMKELREVTAKHPWNIMTTSADEGQFLNMLLKLINAKNTMEIGVYTGYSLLATALAIPEDGKILAMDINRENYELGLPIIEKAGVAHKIDFREGPALPVXDQMIEDGKYHGSFDFIFVDADKDNYLNYHKRLIDLVKVGGVIGXDNTLWNGSVVAPPDAPLRKYVRYYRDFVIELNKALAADPRIEICTLPVGDGVTICHRIS

SEQ ID NO: 61 - protein, 242 aa, Solanum tuberosum
  misc_feature (29)..(241): Pfam Name: Methyltransf_3 Pfam Description: O-methyltransferase
  misc_feature (1)..(242): Public GI ID no. 30580349
  misc_feature (1)..(242): Bit score of 714.0 for HMM based on sequences of Figure 13
  misc_feature (1)..(242): Functional Homolog Of SEQ ID NO. 53
  misc_feature (1)..(242): in Figure 13
MASNGENGRHQEVGHKSLLQSDALYQYILETSVYPREPEAMKELREITAKHPWNLMTTSADEGQFLNMLLKLINAKNTMEIGVFTGYSLLATAMALPDDGKILAMDINRENYEIGLPVIEKAGLAHKIDFREGPALPVLDQMIEDGKYHGSYDFIFVDADKDNYLNYHKRLIDLVKVGGLIGYDNTLWNGSVVAPPDAPLRKYVRYYRDFVLELNKALAADPRIEICQLPVGDGITLCRRIS

SEQ ID NO: 62 - DNA, 1070 bp, Brassica napus
  misc_feature (1)..(1070): Ceres Clone ID no. 1365873
  misc_feature (1)..(1070): Encodes the peptide sequence at SEQ ID NO. 63
atcaccaaaaaccacaatcgtcaatctcagcaaaaagaaaacaaatacagagagagagatggcgacgacaacagcagaggcaacaaagacatctagtactaatgtagaagacaagcaatcacagaatctccgacatcaagaagtcggccacaagagtctcttacagagcgacgatctctaccagtatattctggagacaagtgtgtatccaagagaaccagaatcaatgaaggaactcagggaagtgacagcaaaacacccttggaacataatgaccacgtcagcagacgaaggacagtttctgaacatgctcatcaagctcgttaacgccaagaacacaatggagatcggtgtttacactggctactctctcctcgccaccgctcttgctctccccgaagacggcaaaattctggctatggatgttaacagagagaattacgaattgggtttgccgatcatcgagaaagccggcgttgctcacaagatcgatttcagggaaggccctgctctacctgttcttgatcaacttgttgctgacgagaagaaccatggaacatatgactttattttcgttgatgctgacaaggacaactatatcaactaccacaagcgtttgattgatcttgtgaaagttggaggagtgattggctacgacaacactctgtggaacggttctgtcgtggctcctcctgatgcaccgatgaggaagtacgttcgttactacagggactttgttcttgagcttaacaaggctcttgctgctgaccctaggattgagatttgcatgctcccggttggtgatggaatcactatctgccgtcggatcagttgattgatatggaatacccccaaccctatgagtttgtcccaagtggttcaattcttctctctctagtaccctacctttcaaatgcattttcaccaactaccaccaaattggaccactccctttgtattttgttaagtaatatctccattgtcttttgtttttgcttttcttctgaacaaagaaataatgtaccctgcctttcttgtttcgtttgtttttactttatgatacaacatct

SEQ ID NO: 63 - protein, 258 aa, Brassica napus
  misc_feature (45)..(257): Pfam Name: Methyltransf_3 Pfam Description: O-methyltransferase
  misc_feature (1)..(258): Ceres Clone ID no. 1365873
  misc_feature (1)..(258): Bit score of 723.1 for HMM based on sequences of Figure 13
  misc_feature (1)..(258): Functional Homolog Of SEQ ID NO. 53
  misc_feature (1)..(258): in Figure 13
MATTTAEATKTSSTNVEDKQSQNLRHQEVGHKSLLQSDDLYQYILETSVYPREPESMKELREVTAKHPWNIMTTSADEGQFLNMLIKLVNAKNTMEIGVYTGYSLLATALALPEDGKILAMDVNRENYELGLPIIEKAGVAHKIDFREGPALPVLDQLVADEKNHGTYDFIFVDADKDNYINYHKRLIDLVKVGGVIGYDNTLWNGSVVAPPDAPMRKYVRYYRDFVLELNKALAADPRIEICMLPVGDGITICRRIS

SEQ ID NO: 64 - protein, 247 aa, Populus tremuloides
  misc_feature (34)..(246): Pfam Name: Methyltransf_3 Pfam Description: O-methyltransferase
  misc_feature (1)..(247): Public GI ID no. 3023436
  misc_feature (1)..(247): Bit score of 740.1 for HMM based on sequences of Figure 13
  misc_feature (1)..(247): Functional Homolog Of SEQ ID NO. 53
MATNGEEQQSQAGRHQEVGHKSLLQSDALYQYILETSVYPREPECMKELREVTAKHPWNIMTTSADEGQFLNMLLKLVNAKNTMEIGVYTGYSLLATALAIPEDGKILAMDINRENYELGLPVIQKAGVAHKIDFKEGPALPVLDQMIEDGKYHGSFDFIFVDADKDNYINYHKRLIELVKVGGLIGYDNTLWNGSVVAPPDAPMRKYVRYYRDFVLELNKALAADPRIEICMLPVGDGITLCRRIQ

SEQ ID NO: 65 - protein, 247 aa, Populus tomentosa
  misc_feature (34)..(246): Pfam Name: Methyltransf_3 Pfam Description: O-methyltransferase
  misc_feature (1)..(247): Public GI ID no. 190710715
  misc_feature (1)..(247): Bit score of 723.4 for HMM based on sequences of Figure 13
  misc_feature (1)..(247): Functional Homolog Of SEQ ID NO. 53
MATNGEEQQTQAGRHQEVGHKSLLQSDALYQYILETSVYPREPECMKELRELTAKHPWNIMTTSADEGQFLNMLLKLINAKNTMEIGVYTGYSLLATALAIPEDGKILAMDINRENYELGPPVIEKAGVANKIEFKEGPALPVLDQMIEDGKYHGSYDFIFVDADKDNYINYHKRLIELVKVGGLIGYDNTLWNGSVVAPADAPMRKYVRYYRDFVLELNKALAADPRIEICMLPVGDGITLCRRIQ

SEQ ID NO: 66 - protein, 247 aa, Populus alba x Populus glandulosa
  misc_feature (34)..(246): Pfam Name: Methyltransf_3 Pfam Description: O-methyltransferase
  misc_feature (1)..(247): Public GI ID no. 13249171
  misc_feature (1)..(247): Bit score of 717.4 for HMM based on sequences of Figure 13
  misc_feature (1)..(247): Functional Homolog Of SEQ ID NO. 53
  misc_feature (130)..(130): Xaa is any aa, unknown, or other
MATNGEEQQSQAGRHQEVGHKSLLQSDALYQYILETSVYPREPECMKELREVTAKHPWNIMTTSADEGQFLNMLLKLVNAKNTMEIGVYTGYSLLATALAIPEDGEILAMDINRENYELGLPVIEKAGVXNKIEFKEGPALPVLDQMIEDGKYHGSYDFIFVDADKKNYINYHKRLIELVKVGGLIGYDNTLWNGSVVAPPDAPMRKYVRYYRDFVLELNKALAADSRIEICMLPVGDGITLCRRIQ

SEQ ID NO: 67 - protein, 247 aa, Populus deltoides
  misc_feature (34)..(246): Pfam Name: Methyltransf_3 Pfam Description: O-methyltransferase
  misc_feature (1)..(247): Public GI ID no. 119655556
  misc_feature (1)..(247): Bit score of 718.6 for HMM based on sequences of Figure 13
  misc_feature (1)..(247): Functional Homolog Of SEQ ID NO. 53
MATNGEEQQTQAGRHQEVGHKSLLQSDALYQYILETSVYPREPECMKELRELTAKHPWNIMTTSADEGQFLNMLLKLINAKNTMEIGVFTGYSLLATALAIPEDGKILAMDINRENYELGLPVIQKAGLEHKIEFKEGPALPVLDQMIEDGKYHGTYDFIFVDADKDNYINYHKRLFELVKVGGLIGYDNTLWNGSVVAPADAPMRKYVRYYRDFVLELNKALAADPRIEICMLPVGDGITLCRRMQ

SEQ ID NO: 68 - DNA, 744 bp, Populus balsamifera subsp. trichocarpa
  misc_feature (1)..(744): Ceres Annot ID no. 1441117
  misc_feature (1)..(744): Encodes the peptide sequence at SEQ ID NO. 69
atggccgccaacggagaggaacagcagactcaggccggaaggcatcaagaagttggccacaagagccttttgcaaagtgatgctctttaccagtatattcttgagaccagtgtgtacccaagagagcctgaatgcatgaaggagcttagagagttgactgccaagcatccttggaacatcatgaccacatctgctgatgaagggcaattcttgaacatgcttttaaagcttatcaatgccaagaacaccatggagattggtgttttcactggctattctctcttggccactgctcttgctatccctgaggatggaaagatcttggctatggacatcaacagagaaaactatgaactgggtctcccggtgattcagaaagctggtctggaacacaagattgagttcaaggaaggccctgctctgccagttctcgatcaaatgattgaagatggaaagtaccatggaacttatgacttcatctttgtggatgctgacaaggacaattatattaactaccacaagaggttgattgagcttgtcaaagtcggagggttgattgggtatgacaacaccctgtggaatggatctgtggtggcaccagccgatgcgccgatgaggaagtatgtgaggtactatagggactttgttctggagctcaataaggcacttgcagctgaccccaggattgaaatttgcatgcttcctgttggtgatggtatcactctctgccgtcggatcaagtga

SEQ ID NO: 69 - protein, 247 aa, Populus balsamifera subsp. trichocarpa
  misc_feature (34)..(246): Pfam Name: Methyltransf_3 Pfam Description: O-methyltransferase
  misc_feature (1)..(247): Ceres Annot ID no. 1441117
  misc_feature (1)..(247): Bit score of 721.9 for HMM based on sequences of Figure 13
  misc_feature (1)..(247): Functional Homolog Of SEQ ID NO. 53
MAANGEEQQTQAGRHQEVGHKSLLQSDALYQYILETSVYPREPECMKELRELTAKHPWNIMTTSADEGQFLNMLLKLINAKNTMEIGVFTGYSLLATALAIPEDGKILAMDINRENYELGLPVIQKAGLEHKIEFKEGPALPVLDQMIEDGKYHGTYDFIFVDADKDNYINYHKRLIELVKVGGLIGYDNTLWNGSVVAPADAPMRKYVRYYRDFVLELNKALAADPRIEICMLPVGDGITLCRRIK

SEQ ID NO: 70 - protein, 242 aa, Vitis vinifera
  misc_feature (29)..(241): Pfam Name: Methyltransf_3 Pfam Description: O-methyltransferase
  misc_feature (1)..(242): Public GI ID no. 3023437
  misc_feature (1)..(242): Bit score of 711.7 for HMM based on sequences of Figure 13
  misc_feature (1)..(242): Functional Homolog Of SEQ ID NO. 53
MATNQEAGRHQEVGHKSLLQSDALYQYILETSVYPREPESMKELRELTAQHPWNIMTTSADEGQFLNMLLKLINAKNTMEIGVYTGYSLLATALALPDDGKILAMDINKENYELGLPVIQKAGVAHKIDFKEGPALPVLDQMIEDGKYHGSFDFIFVDADKDNYLNYHKRLIDLVKVGGIIGYDNTLWNGSVVAPPDAPLRKYVRYYRDFVLELNKALAADPRIEICMLPVGDGITLCRRLS

SEQ ID NO: 71 - DNA, 829 bp, Gossypium hirsutum
  misc_feature (1)..(829): Ceres Clone ID no. 100036370
  misc_feature (1)..(829): Encodes the peptide sequence at SEQ ID NO. 72
caaaggcataatacacagttcccacaaaagaaagaaggtttagaagagtagtggcaaatggcaaccaacaaaacagaagagcagcagcagcaatctcaggcgggtaggcaccaagaagttggccataagagccttttacaaagcgatgctctttaccagtatatcctggagacaagtgtatatcccagggagcctgaacccatgaaagagctcagagagataacagccaagcatccatggaaccttatgacaacatcagctgatgaaggccaattcttgaacatgcttcttaagttgatcaatgccaagaacaccatggagattggtgtttacactggctactctcttttagccacggcccttgctctccccgatgatgggaagatcttcgccatggatattaacagagaaaactacgagttgggtctacctgtaatccaaaaagctggtgttgctcacaaaattgatttcaaagaagggcctgcaatgccagttcttgatgaacttgtccaagatgaaaagaatcacggatcctttgacttcatattcgtggatgctgataaggacaactacttaaactaccataagaggttgattgagttggtgaaagtgggaggtttaatcggctacgacaacaccctatggaacggctcggtggtggcgccgcctgatgctccgctcaggaagtacgtcaggtattatagagactttgttttggaactcaacaaggctcttgctgttgaccctagtattgagatctgcatgctccctgttggtgatggaatcaccctttgccgtcgcctcaaatgaaccaccgttaccgccgccg

SEQ ID NO: 72 - protein, 250 aa, Gossypium hirsutum
  misc_feature (37)..(249): Pfam Name: Methyltransf_3 Pfam Description: O-methyltransferase
  misc_feature (1)..(250): Ceres Clone ID no. 100036370
  misc_feature (1)..(250): Bit score of 706.4 for HMM based on sequences of Figure 13
  misc_feature (1)..(250): Functional Homolog Of SEQ ID NO. 53
MATNKTEEQQQQSQAGRHQEVGHKSLLQSDALYQYILETSVYPREPEPMKELREITAKHPWNLMTTSADEGQFLNMLLKLINAKNTMEIGVYTGYSLLATALALPDDGKIFAMDINRENYELGLPVIQKAGVAHKIDFKEGPAMPVLDELVQDEKNHGSFDFIFVDADKDNYLNYHKRLIELVKVGGLIGYDNTLWNGSVVAPPDAPLRKYVRYYRDFVLELNKALAVDPSIEICMLPVGDGITLCRRLK

SEQ ID NO: 73 - protein, 242 aa, Vitis vinifera
  misc_feature (29)..(241): Pfam Name: Methyltransf_3 Pfam Description: O-methyltransferase
  misc_feature (1)..(242): Public GI ID no. 225428851
  misc_feature (1)..(242): Bit score of 708.6 for HMM based on sequences of Figure 13
  misc_feature (1)..(242): Functional Homolog Of SEQ ID NO. 53
MATKQEAGRHQEVGHKSLLQSDALYQYILETSVYPREPESMKELRELTAQHPWNIMTTSADEGQFLNMLLKLINAKNTMEIGVYTGYSLLATALALPDDGKILAMDINKENYELGLPVIQKAGVAHKIDFKEGPALPVLDQMIEDGKYHGSFDFIFVDADKDNYLNYHKRLIDLVKVGGIIGYDNTLWNGSVVAPPDAPLRKYVRYYRDFVLELNKALAADPRIEICMLPVGDGITLCRRLS

SEQ ID NO: 74 - protein, 244 aa, Leucaena leucocephala
  misc_feature (31)..(243): Pfam Name: Methyltransf_3 Pfam Description: O-methyltransferase
  misc_feature (1)..(244): Public GI ID no. 91771911
  misc_feature (1)..(244): Bit score of 704.1 for HMM based on sequences of Figure 13
  misc_feature (1)..(244): Functional Homolog Of SEQ ID NO. 53
MADQNQSEAGRHQEVGHKSLLQSDALYQYILETSVYPREPEPMKEIREITAKHPWNIMTTSADEGQFLNMLLKLINAKNTMEIGVYTGYSLLATALALPEDGKILAMDINRENYELGLPVIQKAGVAHKIEFKEGPALPVLDELVKDEKNHGSYDFIFVDADKDNYLNYHKRLIDLVKVGGVIGYDNTLWNGSVVAPPDAPLRKYVRYYRDFVLELNKALAVDPRIEICMLPVGDGITLCRRIS

SEQ ID NO: 75 - protein, 257 aa, Isatis indigotica
  misc_feature (44)..(256): Pfam Name: Methyltransf_3 Pfam Description: O-methyltransferase
  misc_feature (1)..(257): Public GI ID no. 74053616
  misc_feature (1)..(257): Bit score of 718.9 for HMM based on sequences of Figure 13
  misc_feature (1)..(257): Functional Homolog Of SEQ ID NO. 53
MATTTTEATKTSTNGEDKQSQNLRHQEVGHKSLLQSDDLYQYILETSVYPREPESMKELREVTAKHPWNIMTTSADEGQFLNMLIKLINAKNTMEIGVYTGYSLLATALALPEDGKILAMDVNRENYELGLPIIEKAGVAHKIDFREGPALPVLDQLVADEKNHGTYDFIFVDADKDNYINYHKRLIDLVKVGGVIGYDNTLWNGSVVAAPDAPMRKYVRYYRDFVLELNKALAADPRIEICMLPVGDGITICRRIN

SEQ ID NO: 76 - protein, 244 aa, Leucaena leucocephala
  misc_feature (31)..(243): Pfam Name: Methyltransf_3 Pfam Description: O-methyltransferase
  misc_feature (1)..(244): Public GI ID no. 105671415
  misc_feature (1)..(244): Bit score of 707.4 for HMM based on sequences of Figure 13
  misc_feature (1)..(244): Functional Homolog Of SEQ ID NO. 53
MADQNQSEAGRHQEVGHKSLLQSDALYQYILETSVYPREPEPMKELREITAKHPWNIMTTSADEGQFLNMLLKLINAKNTMEIGVYTGYSLLATALALPEDGKILAMDINRENYELGLPVIQKAGVAHKIEFREGPALPVLDELVKDEKNHGSYDFIFVDADKDNYLNYHKRLIDLVKVGGVIGYDNTLWNGSVVAPPDAPLRKYVRYYRDFVLELNKALAVDPRIEICMLPVGDGITLCRRIS

SEQ ID NO: 77 - DNA, 1032 bp, Arabidopsis thaliana
  misc_feature (1)..(1032): Ceres Clone ID no. 8049
  misc_feature (1)..(1032): Encodes the peptide sequence at SEQ ID NO. 78
accaagaaaaacacaatcgtttaatctcacccaagaagacaaaaacacagagagagaaagagagagaaatggcgacgacaacaacagaagcaacgaagacatcatcgaccaatggagaagatcagaagcagtctcagaatcttcgacatcaagaagttggtcacaagagtctcttacagagcgatgatctctaccagtatatactggagacaagtgtgtatcctagagaaccagaatcaatgaaggaactcagggaagtgacagcaaaacatccatggaacataatgaccacatcagctgatgaaggacagttcttaaacatgcttatcaagctcgttaacgccaagaacacaatggagatcggagtttacactggctactctcttctcgccaccgctcttgctctccctgaagacggcaaaattctggctatggatgtcaacagagagaattacgaattgggtttaccgatcattgagaaagccggcgttgctcacaagatcgacttcagggaaggccctgctcttcccgttcttgatgaaatcgttgctgacgagaagaaccatggaacatatgactttatattcgttgatgctgacaaagacaactacatcaactaccacaagcgtttgatcgatcttgtgaaaattggaggagtgattggctacgacaacactctgtggaatggttctgtcgtggctcctcctgatgcaccaatgaggaagtacgttcgttactacagagactttgttcttgagcttaacaaggctcttgctgctgaccctcggatcgagatctgtatgctccctgttggtgatggaatcactatctgccgtcggatcagttgatttgactcctccctactctgagtttgtccacagtggattactttccatcttcttatacctttcaatcgcattttcaccaaccactaaaatggacctttttatgtatttgtgttaagtaatatctccattgtccttgttttgctttcttctgaacaaagaaataatatgtaccttacttttcttc

SEQ ID NO: 78 - protein, 259 aa, Arabidopsis thaliana
  misc_feature (46)..(258): Pfam Name: Methyltransf_3 Pfam Description: O-methyltransferase
  misc_feature (1)..(259): Ceres Clone ID no. 8049
  misc_feature (1)..(259): Bit score of 713.3 for HMM based on sequences of Figure 13
  misc_feature (1)..(259): Functional Homolog Of SEQ ID NO. 53
MATTTTEATKTSSTNGEDQKQSQNLRHQEVGHKSLLQSDDLYQYILETSVYPREPESMKELREVTAKHPWNIMTTSADEGQFLNMLIKLVNAKNTMEIGVYTGYSLLATALALPEDGKILAMDVNRENYELGLPIIEKAGVAHKIDFREGPALPVLDEIVADEKNHGTYDFIFVDADKDNYINYHKRLIDLVKIGGVIGYDNTLWNGSVVAPPDAPMRKYVRYYRDFVLELNKALAADPRIEICMLPVGDGITICRRIS

SEQ ID NO: 79 - DNA, 1022 bp, Glycine max
  misc_feature (1)..(1022): Ceres Clone ID no. 541352
  misc_feature (1)..(1022): Encodes the peptide sequence at SEQ ID NO. 80
gatcaagctccaatcaactcttcaaaagggagaagaaaaggaaagaaaactctcaaaaaactattatagcaatggcagaacaaaaccaaaaccaaacaactgaagctggaaggcaccaagaggttggtcacaagagccttctccagagtgatgctctttaccagtatattctggagacaagtgtctacccaagagaacctgaatccatgaaagaactgagagagttgacagcaaaacacccatggaacatcatgacaacctctgcagacgaagggcagttcttgaacatgctccttaagctcatcaatgccaagaacaccatggaaattggtgtctacactgggtattcacttcttgccaccgctctcgctcttcctgaagatggaaagatcttggccatggacattaacagggagaattatgaattgggtttgcctgtaattaaaaaagctggtgttgaccacaaaattgaattcagagaaggtcctgctctaccagttcttgatgaaatgattaaagatgagaagaaccatggaagctatgacttcatctttgttgatgcggacaaggacaactacctcaactaccacaagaggttgatagagcttgtaaaagttgggggcgtgatcgggtacgacaacaccctatggaacggatctgtggtggcaccccctgatgctcctcttaggaagtatgttaggtactacagggacttcgtgctggagctcaacaaagccctcgctgtggaccccaggatcgagatttgcatgctcccggttggtgatggaatcactatctgccgtcggatcaagtgatttctgatcatcataatcgtggaccaccgttgcttcttctgcacaccctatagtgatgactggtcatcattgagtggcacctgctaatgcatttaaaagcaatcaatacttttctttcaaaaaaaatatgtgtctgtacttttctctattactcgtgtggaaaactgtggacaattaaacgttctatatgcaagtgacttttttctt

SEQ ID NO: 80 - protein, 247 aa, Glycine max
  misc_feature (34)..(246): Pfam Name: Methyltransf_3 Pfam Description: O-methyltransferase
  misc_feature (1)..(247): Ceres Clone ID no. 541352
  misc_feature (1)..(247): Bit score of 710.4 for HMM based on sequences of Figure 13
  misc_feature (1)..(247): Functional Homolog Of SEQ ID NO. 53
MAEQNQNQTTEAGRHQEVGHKSLLQSDALYQYILETSVYPREPESMKELRELTAKHPWNIMTTSADEGQFLNMLLKLINAKNTMEIGVYTGYSLLATALALPEDGKILAMDINRENYELGLPVIKKAGVDHKIEFREGPALPVLDEMIKDEKNHGSYDFIFVDADKDNYLNYHKRLIELVKVGGVIGYDNTLWNGSVVAPPDAPLRKYVRYYRDFVLELNKALAVDPRIEICMLPVGDGITICRRIK

SEQ ID NO: 81 - protein, 250 aa, Corchorus capsularis
  misc_feature (34)..(249): Pfam Name: Methyltransf_3 Pfam Description: O-methyltransferase
  misc_feature (1)..(250): Public GI ID no. 40795556
  misc_feature (1)..(250): Bit score of 690.0 for HMM based on sequences of Figure 13
  misc_feature (1)..(250): Functional Homolog Of SEQ ID NO. 53
MATNGEEQQSQAGRHQEVEHKSVLQSDALYQYILETSVYPREPEPMKELRELTAKHPWNLMTTSADEWQFLNMLLKLINAKNTMEIGVYTGYSLLATALALPDDAKILAMDINRENYELGLPVIQKAGVAHKIEFKEGPALPVLDKLVEDEKNHESYDFIFVDADKDNYINYINYHKRLIDLVKVGGLIGYDNTLWNGSVVAPPDAPMRKYVRYYRDFVLEINKALAADPRIEICMLPVEDGITVCRRIQ

SEQ ID NO: 82 - protein, 247 aa, Medicago sativa
  misc_feature (34)..(246): Pfam Name: Methyltransf_3 Pfam Description: O-methyltransferase
  misc_feature (1)..(247): Public GI ID no. 30580341
  misc_feature (1)..(247): Bit score of 705.9 for HMM based on sequences of Figure 13
  misc_feature (1)..(247): Functional Homolog Of SEQ ID NO. 53
MATNEDQKQTESGRHQEVGHKSLLQSDALYQYILETSVFPREHEAMKELREVTAKHPWNIMTTSADEGQFLSMLLKLINAKNTMEIGVYTGYSLLATALAIPEDGKILAMDINKENYELGLPVIKKAGVDHKIDFREGPALPVLDEMIKDEKNHGSYDFIFVDADKDNYLNYHKRLIDLVKVGGVIGYDNTLWNGSVVAPPDAPLRKYVRYYRDFVLELNKALAVDPRIEICMLPVGDGITICRRIK

SEQ ID NO: 83 - protein, 247 aa, Capsicum annuum
  misc_feature (34)..(246): Pfam Name: Methyltransf_3 Pfam Description: O-methyltransferase
  misc_feature (1)..(247): Public GI ID no. 193290676
  misc_feature (1)..(247): Bit score of 708.7 for HMM based on sequences of Figure 13
  misc_feature (1)..(247): Functional Homolog Of SEQ ID NO. 53
MAENGAAQENQVAKHQEVGHKSLLQSDALYQYILETSVYPREPEPMKELRELTAKHPWNLMTTSADEGQFLSMLLKLINAKNTMEIGVYTGYSLLATALALPDDGQILAMDINRENYELGLPIIQKAGVAHKIDFREGPALPVLDRLVEDKNNHGTYDFIFVDADKDNYINYHKRIIELVKVGGVIGYDNTLWNGSVVAPPDAPMRKYVRYYRDFVLELNKALAADPRIEICMLPVGDGITLCRRIS

SEQ ID NO: 84 - DNA, 729 bp, Solanum lycopersicum
  misc_feature (1)..(729): Ceres Annot ID no. 8454550
  misc_feature (1)..(729): Encodes the peptide sequence at SEQ ID NO. 85
atggcaaccaacggagaaaatggaagacatcaagaagttggacacaagagtctattgcaaagtgatgccctttatcagtatattcttgaaaccagtgtgtacccaagagagcctgaagccatgaaagagctaagagagattactgcaaaacacccttggaaccttatgaccacttctgctgacgaagggcagttcttgaatatgcttctcaaactcatcaatgccaaaaacacaatggaaattggggtttttactggttactctctgcttgctactgccatggctcttcctgatgatggcaagattctagccatggatatcaaccgcgataactatgagattggacttccagtaattgaaaaggctggtctagcgcacaaaattgaattcagagaaggccctgcactacctgttcttgaccaaatgattgaagacggccaataccatggatcatatgatttcatatttgtggatgctgacaaggacaattacttgaactatcacaagagattaatcgacttggtcaagattggtggattaattggctatgacaacaccctatggaatggatcagtagttgcaccacctgatgcacccctcaggaaatatgttaggtattacagggatttcgtattggaacttaacaaggcgttggctgctgatcccagaatcgaaatttgccagcttcctgttggtgatggcatcactctttgccgtcgcatcagttaa

SEQ ID NO: 85 - protein, 242 aa, Solanum lycopersicum
  misc_feature (29)..(241): Pfam Name: Methyltransf_3 Pfam Description: O-methyltransferase
  misc_feature (1)..(242): Ceres Annot ID no. 8454550
  misc_feature (1)..(242): Bit score of 704.3 for HMM based on sequences of Figure 13
  misc_feature (1)..(242): Functional Homolog Of SEQ ID NO. 53
MATNGENGRHQEVGHKSLLQSDALYQYILETSVYPREPEAMKELREITAKHPWNLMTTSADEGQFLNMLLKLINAKNTMEIGVFTGYSLLATAMALPDDGKILAMDINRDNYEIGLPVIEKAGLAHKIEFREGPALPVLDQMIEDGQYHGSYDFIFVDADKDNYLNYHKRLIDLVKIGGLIGYDNTLWNGSVVAPPDAPLRKYVRYYRDFVLELNKALAADPRIEICQLPVGDGITLCRRIS

SEQ ID NO: 86 - protein, 259 aa, Arabidopsis thaliana
  misc_feature (46)..(258): Pfam Name: Methyltransf_3 Pfam Description: O-methyltransferase
  misc_feature (1)..(259): Public GI ID no. 21595512
  misc_feature (1)..(259): Bit score of 709.0 for HMM based on sequences of Figure 13
  misc_feature (1)..(259): Functional Homolog Of SEQ ID NO. 53
  misc_feature (180)..(180): Xaa is any aa, unknown, or other
MATTTTEATKTSSTNGEDQKQSQNLRHQEVGHKSLLQSDDLYQYILETSVYPREPESMKELREVTAKHPWNIMTTSADEGQFLNMLIKLVNAKNTMEIGVYTGYSLLATALALPEDGKILAMDVNRENYELGLPIIEKAGVAHKIDFREGPALPVLDEIVADEKNHGTYDFIFVDADKDXYINYHKRLIDLVKIGGVIGYDNTLWNGSVVAPPDAPMRKYVRYYRDFVLELNKALAADPRIEICMLPVGDGITICRRIS

SEQ ID NO: 87 - DNA, 729 bp, Solanum lycopersicum
  misc_feature (1)..(729): Ceres Annot ID no. 8454548
  misc_feature (1)..(729): Encodes the peptide sequence at SEQ ID NO. 88
atggcaagcaatggagaaaatggtagacaccaagaagttggacacaagagtctcttgcaaagcgatgccctatatcagtacattcttgaaacaagtgtgtacccgagagagcctgaagccatgaaagagctaagagagattactgcaaaacacccttggaaccttatgaccacctctgctgatgaaggtcaatttttgaatatgcttctcaaactcatcaatgccaaaaacaccatggaaattggggtttttactggttactctctgctggcaactgctatggctcttcctgatgatggcaagattctagcaatggatattaaccgcgataactatgagattggtcttccagtaattgaaaaggctggtctagcgcacaaaattgaattcagagaaggccctgcacttcctgttcttgaccaaatgattgaagacggccaataccatggatcatatgatttcatatttgtggatgctgacaaggacaactatttgaattatcacaagagattaattgacttggttaaggttggtggagtaattggctacgataacaccttatggaacggatcagtagtggcaccacctgatgcaccccttagaaaatacgttaggtattatagggatttcgtattggaactcaacaaggccttagctgctgatcccagaattgaaatctgccagcttcccgttggtgatggcattaccctttgccgtcgtatcagttaa

SEQ ID NO: 88 - protein, 242 aa, Solanum lycopersicum
  misc_feature (29)..(241): Pfam Name: Methyltransf_3 Pfam Description: O-methyltransferase
  misc_feature (1)..(242): Ceres Annot ID no. 8454548
  misc_feature (1)..(242): Bit score of 705.2 for HMM based on sequences of Figure 13
  misc_feature (1)..(242): Functional Homolog Of SEQ ID NO. 53
MASNGENGRHQEVGHKSLLQSDALYQYILETSVYPREPEAMKELREITAKHPWNLMTTSADEGQFLNMLLKLINAKNTMEIGVFTGYSLLATAMALPDDGKILAMDINRDNYEIGLPVIEKAGLAHKIEFREGPALPVLDQMIEDGQYHGSYDFIFVDADKDNYLNYHKRLIDLVKVGGVIGYDNTLWNGSVVAPPDAPLRKYVRYYRDFVLELNKALAADPRIEICQLPVGDGITLCRRIS

SEQ ID NO: 89 - protein, 247 aa, Nicotiana tabacum
  misc_feature (34)..(246): Pfam Name: Methyltransf_3 Pfam Description: O-methyltransferase
  misc_feature (1)..(247): Public GI ID no. 30580343
  misc_feature (1)..(247): Bit score of 703.8 for HMM based on sequences of Figure 13
  misc_feature (1)..(247): Functional Homolog Of SEQ ID NO. 53
MAENGAAQENQVTKHQEVGHKSLLQSDALYQYILETSVYPREPEPMKELRELTAKHPWNLMTTSADEGQFLSMLLKLIIAKNTMEIGVYTGYSLLATALALPDDGKILAMDINKENYELGLPVIQKAGVAHKIDFREGPALPVLDLMIEDKNNHGTYDFIFVDADKDNYINYHKRIIELVKVGGVIGYDNTLWNGSVVAPPDAPMRKYVRYYRDFVLELNKALAADPRIEICMLPVGDGITLCRRIS

SEQ ID NO: 90 - protein, 247 aa, Eucalyptus globulus
  misc_feature (34)..(246): Pfam Name: Methyltransf_3 Pfam Description: O-methyltransferase
  misc_feature (1)..(247): Public GI ID no. 30580381
  misc_feature (1)..(247): Bit score of 701.6 for HMM based on sequences of Figure 13
  misc_feature (1)..(247): Functional Homolog Of SEQ ID NO. 53
MAANAEPQQTQPAKHSEVGHKSLLQSDALYQYILETSVYPREPESMKELREITAKHPWNLMTTSADEGQFLNMLLKLINAKNTMEIGVYTGYSLLATALALPDDGKILAMDINRENFEIGLPVIEKAGLAHKIDFREGPALPLLDQLVQDEKNHGTYDFIFVDADKDNYINYHKRLIDLVKVGGLIGYDNTLWNGSVVAPADAPLRKYVRYYRDFVLELNKALAVDPRVEICMLPVGDGITLCRRVS

SEQ ID NO: 91 - protein, 240 aa, Nicotiana tabacum
  misc_feature (27)..(239): Pfam Name: Methyltransf_3 Pfam Description: O-methyltransferase
  misc_feature (1)..(240): Public GI ID no. 30580324
  misc_feature (1)..(240): Bit score of 694.7 for HMM based on sequences of Figure 13
  misc_feature (1)..(240): Functional Homolog Of SEQ ID NO. 53
MAENGIKHQEVGHKSLLQSDALYQYILETSVYPREPESMKELREVTAKHPWNLMTTSADEGQFLNMLLKLINAKNTMEIGVYTGYSLLATALAIPDDGKILAMDINRENYEIGLPIIEKAGVAHKIEFREGPALPVLDQLVEDKKNHGTYDFIFVDADKDNYINYHKRIIDLVKVGGLIGYDNTLWNGSVVAPPDAPMRKYVRYYRDFVLELNKALAADPRIEICMLPVGDGITLCRRIT

SEQ ID NO: 92 - DNA, 989 bp, Parthenium argentatum
  misc_feature (1)..(989): Ceres Clone ID no. 1605906
  misc_feature (1)..(989): Encodes the peptide sequence at SEQ ID NO. 93
aagctcaccacttcatctcctaaacaagtttgtttatttcaagttataaaacatttgatcacatggcggcggtcaacggtggcagtgatagtcaaccggcaaaacaccaagaagttggccacaagagtcttcttcaaagtgatgcactttaccaatacattcttgaaacaagtgtctacccaagagaacccgaacccatgaaagagctacgcgaggtcaccgctaaacacccttggaaccttatgacgacatcagccgatgaaggacaatttttgaacatgcttcttaaactcatcaatgccaaaaacaccatggagatcggtgtctataccggctattcacttctgtccactgctctagctctccctgatgatggaaagatactggctttggacatcaaccgcgaaaattatgaaatcggtcttcccatcattcaaaaggctggtgttgctcacaagatcgattttagagaaggtcctgcccttcctcttcttgaccaaatgatcgaagatgaaaaattccatgggacttttgattttatttttgtggatgctgataaagataactaccttaactaccacaaaagattaactgatcttgtcaagattggtggagtgattggctatgacaacactctttggaatggatccttggtggcaccacctgatgcacctcttaggaaatatgttcggtattatagagacttcgtgttggaacttaataaagccttggctgctgatccgagggtcgagatttgtcagcttcctgttggcgatgggattactctatgtcgtcgcgtaagctaaagttaaagaccgatcgatcaaaagatcgaggtggtcatgaccaggccatggttgatgcttcttcgtgatgtttatgtctcaaaatttgtttaaatgtttatgttgagtgtaaggccctgattagctcgtttaccatgtactcttctcgattatatgtttgtttttctttataaaaatattatc

SEQ ID NO: 93 - protein, 247 aa, Parthenium argentatum
  misc_feature (34)..(246): Pfam Name: Methyltransf_3 Pfam Description: O-methyltransferase
  misc_feature (1)..(247): Ceres Clone ID no. 1605906
  misc_feature (1)..(247): Bit score of 695.5 for HMM based on sequences of Figure 13
  misc_feature (1)..(247): Functional Homolog Of SEQ ID NO. 53
MAAVNGGSDSQPAKHQEVGHKSLLQSDALYQYILETSVYPREPEPMKELREVTAKHPWNLMTTSADEGQFLNMLLKLINAKNTMEIGVYTGYSLLSTALALPDDGKILALDINRENYEIGLPIIQKAGVAHKIDFREGPALPLLDQMIEDEKFHGTFDFIFVDADKDNYLNYHKRLTDLVKIGGVIGYDNTLWNGSLVAPPDAPLRKYVRYYRDFVLELNKALAADPRVEICQLPVGDGITLCRRVS

SEQ ID NO: 94 - protein, 239 aa, Nicotiana tabacum
  misc_feature (26)..(238): Pfam Name: Methyltransf_3 Pfam Description: O-methyltransferase
  misc_feature (1)..(239): Public GI ID no. 30580325
  misc_feature (1)..(239): Bit score of 690.4 for HMM based on sequences of Figure 13
  misc_feature (1)..(239): Functional Homolog Of SEQ ID NO. 53
MATNGRHQEVGHKSLLQSDALYQYILETSVYPREPEPMKELREITAKHPWNLMTTSADEGQFLSMLIKLINAKNTMEIGVFTGYSLLATAMALPDDGKILAMDINRENYEIGLPVIEKAGLAHKIEFKEGPALPVLDQMIEDGKYHGSYDFIFVDADKDNYLNYHKRLIDLVKIGGLIGYDNTLWNGSVVAPPDAPLRKYVRYYRDFVLELNKALAADSRIEICQLPVGDGITLCRRIS

SEQ ID NO: 95 - protein, 241 aa, Petroselinum crispum
  misc_feature (28)..(240): Pfam Name: Methyltransf_3 Pfam Description: O-methyltransferase
  misc_feature (1)..(241): Public GI ID no. 115559
  misc_feature (1)..(241): Bit score of 683.2 for HMM based on sequences of Figure 13
  misc_feature (1)..(241): Functional Homolog Of SEQ ID NO. 53
MASNGESKHSEVGHKSLLQSDALYQYILETSVYPREPEAMKELREVTAKHPWNLMTTSADEGQFLNMLLKLINAKNTMEIGVYTGYSLLATALALPDDGKILAMDINRENYEIGLPIIEKAGVGHKIDFREGPALPVLDHMLEDGKYHGTFDFVFVDADKDNYINYHKRLIDLVKIGGLIGYDNTLWNGSVAQPADAPMRKYVRYYRDFVIELNKALAADPRIEICMLPVGDGVTLCRRIS

SEQ ID NO: 96 - protein, 246 aa, Linum usitatissimum
  misc_feature (33)..(245): Pfam Name: Methyltransf_3 Pfam Description: O-methyltransferase
  misc_feature (1)..(246): Public GI ID no. 68271859
  misc_feature (1)..(246): Bit score of 695.4 for HMM based on sequences of Figure 13
  misc_feature (1)..(246): Functional Homolog Of SEQ ID NO. 53
MAEQQQSGENVSRHQEVGHKSLLQSDDLYQYILETSVYPREPESMKELREVTAKHPWNIMTTSADEGQFLNMLLKLINAKNTMEIGVYTGYSLLATALALPDDGKILAMDINRENYEIGLPIIEKAGLAHKIEFKEGPALPALDKMVEDKANHGAYDFIFVDADKDNYINYHKRLIDLVKIGGVIGYDNTLWNGSVVAPPDAPLRKYVRYYRDFVLELNKALAADPRIEICMLPVGDGITLCRRIS

SEQ ID NO: 97 - protein, 241 aa, Ammi majus
  misc_feature (28)..(240): Pfam Name: Methyltransf_3 Pfam Description: O-methyltransferase
  misc_feature (1)..(241): Public GI ID no. 48093469
  misc_feature (1)..(241): Bit score of 684.3 for HMM based on sequences of Figure 13
  misc_feature (1)..(241): Functional Homolog Of SEQ ID NO. 53
MASNGESKHSEVGHKSLLQSDALYQYILETSVYPREPEAMKELREVTAKHPWNLMTTSADEGQFLNMLLKLINAKNTMEIGVYTGYSLLATALALPDDGKILAMDINRENYEIGLPIIEKAGVGHKIDFREGPALPVLDQTLEDGKYHGTFDFVFVDADKDNYINYHKRLIDLVKVGGLIGYDNTLWNGSVAQPADAPMRKYVRYYRDFVIELNKALAADPRIEICMLPVGDGVTLCRRIS

SEQ ID NO: 98 - DNA, 729 bp, Solanum lycopersicum
  misc_feature (1)..(729): Ceres Annot ID no. 8454545
  misc_feature (1)..(729): Encodes the peptide sequence at SEQ ID NO. 99
atgatgagcaatggagaaaacagtagacaccaagaagttggacacaagagtctcttgcaaagcgatgccctatatcagtacattcttgaaacaagtgtgtacccgagagagcctgaagccatgaaagagctaagagagattactgcaaaacacccttggaaccttatgaccacctctgctgatgaaggtcaatttttgaatatgcttctcaaactcatcaatgccaaaaacaccatggaaattggggtttttactggttactctctgctggcaactgctatggctcttcctgatgatggcaagattctagcaatggatattaaccgcgataactatgagattggtcttccagtaattgaaaaggctggtctagcgcacaaaattgaattcagagaaggccctgcacttcctgttcttgaccaaatgattgaagacggccaataccatggatcatatgatttcatatttgtggatgctgacaaggacaactatttgaattatcacaagagattaatcgacttggttaaggttggtggagtaattgggtatgacaatactctatggaacggatcagtggtggcaccacctgatgcaccccttagaaaatacgttaggtattatagggatttcgtattggaactcaacaaggccttggctgctgattccagaattgaaatctgtcagcttcctgttggtgatggtatcactttgtgtcgccgcatcagttaa

SEQ ID NO: 99 - protein, 242 aa, Solanum lycopersicum
  misc_feature (29)..(241): Pfam Name: Methyltransf_3 Pfam Description: O-methyltransferase
  misc_feature (1)..(242): Ceres Annot ID no. 8454545
  misc_feature (1)..(242): Bit score of 696.4 for HMM based on sequences of Figure 13
  misc_feature (1)..(242): Functional Homolog Of SEQ ID NO. 53
MMSNGENSRHQEVGHKSLLQSDALYQYILETSVYPREPEAMKELREITAKHPWNLMTTSADEGQFLNMLLKLINAKNTMEIGVFTGYSLLATAMALPDDGKILAMDINRDNYEIGLPVIEKAGLAHKIEFREGPALPVLDQMIEDGQYHGSYDFIFVDADKDNYLNYHKRLIDLVKVGGVIGYDNTLWNGSVVAPPDAPLRKYVRYYRDFVLELNKALAADSRIEICQLPVGDGITLCRRIS

SEQ ID NO: 100 - protein, 242 aa, Solanum lycopersicum
  misc_feature (29)..(241): Pfam Name: Methyltransf_3 Pfam Description: O-methyltransferase
  misc_feature (1)..(242): Public GI ID no. 157863689
  misc_feature (1)..(242): Bit score of 692.1 for HMM based on sequences of Figure 13
  misc_feature (1)..(242): Functional Homolog Of SEQ ID NO. 53
MASNGENGRHQEVGHKSLLQSDALYQYILETSVYPREPEAMKELREITAKHPWNLMTTSADEGQFLSMLLKLINAKNTMEIGVFTGYSLLATAMALPDDGKILAMDINRENYVIGLPVIEKAGLAHKIVFREGPALPVLDQMIDDGKYHGSYEFIFVDADKDNYLNYHKRLIDLVNVGGIIGYDNTLWNGSVVAPPDAPLRKYVRYYRDFVLELNKALAADPRIEICQLPVGDGITLCRRIS

SEQ ID NO: 101 - protein, 245 aa, Zinnia elegans
  misc_feature (32)..(244): Pfam Name: Methyltransf_3 Pfam Description: O-methyltransferase
  misc_feature (1)..(245): Public GI ID no. 30580342
  misc_feature (1)..(245): Bit score of 672.5 for HMM based on sequences of Figure 13
  misc_feature (1)..(245): Functional Homolog Of SEQ ID NO. 53
MATPTGETQPAKHQEVGHKSLLQSDALYQYILETSVYPREPQPMKELRRITAKHPWNLMTTSADEGQFLNLLLKLINAKNTMEIGVYTGYSLLSTALALPEDGKILALDINRENYEIGLPIIQKAGVAHKIDFREGPALPLLDQMLQDEKCHGSFDFIFVDADKDNYLNYHKRLIDLVKFGGVIGYDNTLWNGSLVAPADAPLRKYVRYYRDFVLELNKALAVDPRVEICQLPVGDGITLCRRIS

SEQ ID NO: 102 - protein, 259 aa, Picea sitchensis
  misc_feature (46)..(258): Pfam Name: Methyltransf_3 Pfam Description: O-methyltransferase
  misc_feature (1)..(259): Public GI ID no. 116780030
  misc_feature (1)..(259): Bit score of 664.2 for HMM based on sequences of Figure 13
  misc_feature (1)..(259): Functional Homolog Of SEQ ID NO. 53
MASTAVQQTEMKAETTKAEEPAKVARHQEVGHKSLLQSDALYQYILETSVYPREPEPLKELREVTAKHPWNLMTTSADEGQFLGLLLKLINAKNTMEIGVYTGYSLLSTALALPDDGKILAMDINRENYDLGLPMIEKAGVAHKIDFREGPALPLLDQMIQNEELHGSFDFVFVDADKDNYLNYHKRLIDLVKVGGVIAYDNTLWNGSVVAPPDAPLRKYVRYYRDFVLELNKALAADPRIEISQIPVGDGVTLCRRVY

SEQ ID NO: 103 - protein, 260 aa, Oryza sativa subsp. japonica
  misc_feature (47)..(259): Pfam Name: Methyltransf_3 Pfam Description: O-methyltransferase
  misc_feature (1)..(260): Public GI ID no. 115466622
  misc_feature (1)..(260): Bit score of 639.9 for HMM based on sequences of Figure 13
  misc_feature (1)..(260): Functional Homolog Of SEQ ID NO. 53
MAEAASAAAAATTEQANGSSGGEQKTRHSEVGHKSLLKSDDLYQYILETSVYPREHECMKELREVTANHPWNLMTTSADEGQFLNLLLKLIGAKKTMEIGVYTGYSLLATALAIPDDGTILAMDINRENYELGLPSIEKAGVAHKIDFREGPALPVLDQLVEEEGNHGSFDFVFVDADKDNYLNYHERLMKLVKVGGLVGYDNTLWNGSVVLPADAPMRKYIRYYRDFVLELNKALAADHRVEICQLPVGDGITLCRRVK

SEQ ID NO: 104 - DNA, 786 bp, Sorghum bicolor
  misc_feature (1)..(786): Ceres Annot ID no. 8735228
  misc_feature (1)..(786): Encodes the peptide sequence at SEQ ID NO. 105
atggccaccacggcgaccgaggcggccaaggccgcgccggcggagcaggccaacggcaacgccaacggcgagcagaagacgcgccactccgaggtcggacacaagagcctgctcaagagcgacgacctctaccagtacatcctggacacgagcgtgtacccgcgggagccggagagcatgaaggagctccgcgagatcaccgccaagcacccatggaacctgatgacgacctccgccgacgaggggcagttcctcaacatgctcatcaagctcatcggcgccaagaagaccatggagatcggcgtctacaccggctactccctcctcgccaccgcgctcgctctcccggaggacggcacgatcttggccatggacatcaaccgcgagaactacgagctgggcctgccctgcatcgagaaggccggcgtcgcccacaagatcgacttccgcgagggccccgcgctccccgtcctcgacgacctcatcgccgacgagaagaaccacgggtcgttcgacttcgtcttcgtggacgccgacaaggacaactacctcaactaccacgaccggctgctcaagctggtgaagctggggggcctcatcggctacgacaacacgctgtggaacggctctgtcgtgctccccgacgacgcccccatgcgcaagtacatccgcttctaccgcgacttcgtgctcgtcctcaacaaggcgctcgccgccgacgagcgcgtcgagatctgccagctccccgtcggcgacggcgtcaccctctgccgccgcgtcaagtga

SEQ ID NO: 105 - protein, 261 aa, Sorghum bicolor
  misc_feature (48)..(260): Pfam Name: Methyltransf_3 Pfam Description: O-methyltransferase
  misc_feature (1)..(261): Ceres Annot ID no. 8735228
  misc_feature (1)..(261): Bit score of 646.6 for HMM based on sequences of Figure 13
  misc_feature (1)..(261): Functional Homolog Of SEQ ID NO. 53
MATTATEAAKAAPAEQANGNANGEQKTRHSEVGHKSLLKSDDLYQYILDTSVYPREPESMKELREITAKHPWNLMTTSADEGQFLNMLIKLIGAKKTMEIGVYTGYSLLATALALPEDGTILAMDINRENYELGLPCIEKAGVAHKIDFREGPALPVLDDLIADEKNHGSFDFVFVDADKDNYLNYHDRLLKLVKLGGLIGYDNTLWNGSVVLPDDAPMRKYIRFYRDFVLVLNKALAADERVEICQLPVGDGVTLCRRVK

SEQ ID NO: 106 - DNA, 1169 bp, Zea mays
  misc_feature (1)..(1169): Ceres Clone ID no. 1281422
  misc_feature (1)..(1169): Encodes the peptide sequence at SEQ ID NO. 107
gccttcgccttcgccttgccgccgcgcgttatataagccgccccggcaggcaaggtcggtcaatccagcaatacccgagtacccaacgcgctagctagttctattgccgcaccccagatctccaggagggactcgttctttcagctaactacactgcacgcaatggccaccacggcgaccgaggcggcgccggcgcaggagcagcaggccaacggcaacggcgagcagaagacgcggcactccgaggtcggccacaagagcctgctcaagagcgacgacctctaccagtacatcctggacacgagcgtgtacccgcgggagccggagagcatgaaggagctccgcgaggtcaccgccaagcacccatggaacctgatgacgacctccgccgacgaggggcagttcctgaacatgctcatcaagctcatcggcgccaagaagaccatggagatcggcgtctacaccggctactccctcctcgccacggcgctcgccctcccggaggacggcacgatcttggccatggacatcaaccgcgagaactacgagctgggcctgccctgcatcgagaaggccggcgtcgcccacaagatcgacttccgcgagggtcccgcgctccccgtcctcgacgacctcatcgcggaggagaagaaccacgggtcgttcgacttcgtcttcgtggacgccgacaaggacaactacctcaactaccacgagcggctgctgaagctggtgaagctgggcggcctcatcggctacgacaacacgctgtggaacggctccgtcgtgctccccgacgacgcgcccatgcgcaagtacatccgcttctaccgcgacttcgtgctcgtcctcaacaaggcgctcgccgccgacgaccgcgtcgagatctgccagctccccgtcggcgacggcgtcaccctctgccgccgcgtcaagtgaaaacatgccctggcctggcctgccccaccaccgccaccgacggcgccgccggccgcatcctcattccaatcataatagacgacccgcagcattaattatccaccggcttttttttttggctctttcttgcccctgttatctttctcctcctcttcttcttgggaattgtcgctgccgtttcgatacgtaaatcacgagatcggtaatacagtaatgctcctcaattttac

SEQ ID NO: 107 - protein, 258 aa, Zea mays
  misc_feature (45)..(257): Pfam Name: Methyltransf_3 Pfam Description: O-methyltransferase
  misc_feature (1)..(258): Ceres Clone ID no. 1281422
  misc_feature (1)..(258): Bit score of 642.1 for HMM based on sequences of Figure 13
  misc_feature (1)..(258): Functional Homolog Of SEQ ID NO. 53
MATTATEAAPAQEQQANGNGEQKTRHSEVGHKSLLKSDDLYQYILDTSVYPREPESMKELREVTAKHPWNLMTTSADEGQFLNMLIKLIGAKKTMEIGVYTGYSLLATALALPEDGTILAMDINRENYELGLPCIEKAGVAHKIDFREGPALPVLDDLIAEEKNHGSFDFVFVDADKDNYLNYHERLLKLVKLGGLIGYDNTLWNGSVVLPDDAPMRKYIRFYRDFVLVLNKALAADDRVEICQLPVGDGVTLCRRVK

SEQ ID NO: 108 - DNA, 1142 bp, Zea mays
  misc_feature (1)..(1142): Ceres Clone ID no. 239406
  misc_feature (1)..(1142): Encodes the peptide sequence at SEQ ID NO. 109
gacagccacggccgcgacggcgtccgcgtgcaccggacaccacggccagacccagacggcaacgggaggccacacagccctctgaccaaacgcacggatccggccagccacccaccccgcccccctagcggccgccacccacccgtgcgcgcggcgcaccaaggcctggcccggcagtggcagccaggctctcacacgcctcgcctagtcgccttgccgccgcgcgttatataagccgccccggcaggcacggtcggtcgatccagcaatacccgacgcgcaagccagtgccgcgcccagatctccgcgacagatcagtcgttcgtccagctaactgcactgcacgcaatggccaccacggcgaccgaggcgaccaagacgactgcaccggcgcaggagcagcaggccaacggcaacggcaacggcgagcagaagacgcgccactccgaggtcggccacaagagcctgctcaagagcgacgacctctaccagtacatcctggacacgagcgtgtacccgcgggagccggagagcatgaaggagctgcgcgagatcaccgccaagcacccatggaacctgatgaccacctccgccgacgagggccagttcctcaacatgctcatcaagctcatcggcgccaagaagaccatggagatcggcgtctacaccggctactcgctcctcgccaccgcgctcgcactcccggaggacggcacgatcttggccatggacatcaaccgcgagaactacgagctaggccttccctgcatcaacaaggccggcgtgggccacaagatcgacttccgcgagggccccgcgctccccgtcctggacgacctcgtggcggacaaggagcagcacgggtcgttcgacttcgccttcgtggacgccgacaaggacaactacctcaactaccacgagcggctcctgaagctggtgaggcccggcggcctcatcggctacgacaacacgctgtggaacggctccgtcgtgctccccgacgacgcgcccatgcgcaagtacatccgcttctaccgcgacttcgtcctcgccctcaacagcgcgctcgccgccgacgaccgcgtcgagatctgccagctccccgtcggcgacggcgtcacgctctgccgccgcgtcaagtg

SEQ ID NO: 109 - protein, 264 aa, Zea mays
  misc_feature (51)..(263): Pfam Name: Methyltransf_3 Pfam Description: O-methyltransferase
  misc_feature (1)..(264): Ceres Clone ID no. 239406
  misc_feature (1)..(264): Bit score of 626.7 for HMM based on sequences of Figure 13
  misc_feature (1)..(264): Functional Homolog Of SEQ ID NO. 53
MATTATEATKTTAPAQEQQANGNGNGEQKTRHSEVGHKSLLKSDDLYQYILDTSVYPREPESMKELREITAKHPWNLMTTSADEGQFLNMLIKLIGAKKTMEIGVYTGYSLLATALALPEDGTILAMDINRENYELGLPCINKAGVGHKIDFREGPALPVLDDLVADKEQHGSFDFAFVDADKDNYLNYHERLLKLVRPGGLIGYDNTLWNGSVVLPDDAPMRKYIRFYRDFVLALNSALAADDRVEICQLPVGDGVTLCRRVK

SEQ ID NO: 110 - protein, 232 aa, Citrus natsudaidai
  misc_feature (19)..(231): Pfam Name: Methyltransf_3 Pfam Description: O-methyltransferase
  misc_feature (1)..(232): Public GI ID no. 30580380
  misc_feature (1)..(232): Bit score of 609.0 for HMM based on sequences of Figure 13
  misc_feature (1)..(232): Functional Homolog Of SEQ ID NO. 53
MAKGHKSKLQSDALRQYILETSVYPREPESMKELREVTAKHPWNLMRTSADEGQFLNMSLKLINAKNTMEIGVYTDYSLLATALAIPDDGKILAMDINRENYEIGLPKIEKAGVAHRIQFREGPALPVLDQLVEDKKNHGTYDFIFVDADKDNYINYHKRIIDLVKVGGLIGYDNTLWNGSVVGPPDAPMRKYLRYCRDFVLELIKALAVDPRIEICMLPVGDGITLSRRIT

SEQ ID NO: 111 - DNA, 1107 bp, Zea mays
  misc_feature (1)..(1107): Ceres Clone ID no. 100834883
  misc_feature (1)..(1107): Encodes the peptide sequence at SEQ ID NO. 112
accagatctccgcgacatatcagtcgttcgtccagctaactgcactgcactgcactgcacgcaatggccaccacggcgaccgaggcggccaaggctgcaccggcgcaggagcagcaggccaacggcaacggcaacggcgagcagaagacgcgccactccgaggtcggccacaagagcctgctcaagagcgacgacctgtaccagtacatcctggacacgagcgtgtacccgcgggagccggagagcatgaaggagctgcgcgagatcaccgccaagcacccatggaacctgatgaccacctccgccgacgagggccagttcctcaacatgctcatcaagctcatcggcgccaagaagaccatggagatcggcgtctacaccggctactcgctcctcgccaccgcgctcgcactcccggaggacggcacgatcttggccatggacatcaaccgcgagaactacgagctaggccttccctgcatcaacaaggccggcgtgggccacaagatcgacttccgcgagggccccgcgctccccgtcctggacgacctcgtggcggacaaggagcagcacgggtcgttcgacttcgccttcgtggacgccgacaaggacaactacctcagctaccacgagcggctcctgaagctggtgaggcccggcggcctcatcggctacgacaacacgctgtggaacggctccgtcgtgctccccgacgacgcgcccatgcgcaagtacatccgcttctaccgcgacttcgtcctcgccctcaacagcgcgctcgccgccgacgaccgcgtcgagatctgccagctccccgtcggcgacggcgtcacgctctgccgccgcgtcaagtgaaaaaaagaagaagaagaaaaaaaacataataccctgcgttcctgctgccccggctgtctggcccccactactgccaccgacggcggcgccgaacccccgttccaatcatcatatcgtagacgacgcgcagcattaaactatcaatcaccggatctggctctttcttggccctgtactgtactattaatgttccgttcttgtttttttattcggaattgtcgccgtttcagtatacgtaaatctcgaggtcga

SEQ ID NO: 112 - protein, 263 aa, Zea mays
  misc_feature (50)..(262): Pfam Name: Methyltransf_3 Pfam Description: O-methyltransferase
  misc_feature (1)..(263): Ceres Clone ID no. 100834883
  misc_feature (1)..(263): Bit score of 622.1 for HMM based on sequences of Figure 13
  misc_feature (1)..(263): Functional Homolog Of SEQ ID NO. 53
MATTATEAAKAAPAQEQQANGNGNGEQKTRHSEVGHKSLLKSDDLYQYILDTSVYPREPESMKELREITAKHPWNLMTTSADEGQFLNMLIKLIGAKKTMEIGVYTGYSLLATALALPEDGTILAMDINRENYELGLPCINKAGVGHKIDFREGPALPVLDDLVADKEQHGSFDFAFVDADKDNYLSYHERLLKLVRPGGLIGYDNTLWNGSVVLPDDAPMRKYIRFYRDFVLALNSALAADDRVEICQLPVGDGVTLCRRVK

SEQ ID NO: 113 - protein, 267 aa, Zea mays
  misc_feature (54)..(266): Pfam Name: Methyltransf_3 Pfam Description: O-methyltransferase
  misc_feature (1)..(267): Public GI ID no. 32347427
  misc_feature (1)..(267): Bit score of 618.6 for HMM based on sequences of Figure 13
  misc_feature (1)..(267): Functional Homolog Of SEQ ID NO. 53
MATTATKTTAPAQEQQANGNGNGNGNGNGEQKTRHSEVGRKSLLKSDDLYQYILDTSVYPREPESMKELREITAKHPWNLMTTSADEGQFLNMLIKLIGAKKTMEIGVYTGYSLLATALALPEDGTILAMDINRENYELGLPCINKAGVGHKIDFREGPALPVLDDLVADKEQHGSFDFAFVDADKDNYLSYHERLLKLVRPGGLIGYDNTLWNGSVVLPDDAPMRKYIRFYRDFVLALNSALAADDRVEICQLPVGDGVTLCRRVK

SEQ ID NO: 114 - DNA, 1059 bp, Glycine max
  misc_feature (1)..(1059): Ceres Clone ID no. 558470
  misc_feature (1)..(1059): Encodes the peptide sequence at SEQ ID NO. 115
aaatattcagagaattccaactgataaaaagaatattcagagaattccaaagacagagatgactgtcattaaggaagagcaacaaccaaaccaaatagctggccacaaagaacttggtcacaaaagtctccttcagagcgatgcactctatcagtatatacttgaaaccagtgtgtacccaagagagcatgagagcttgaaggagctacgagagttgacggaaaaacacccttggaacctgatggctacaccacctgacgaaggacaacttctaggcatgctccttaagcttatcaatgccaagaacaccatggaaataggcgtcttcactggttactccttgctttccactgcccttgccctcccttctgacggaaagatcttagctatggatgttaaccgggaatattatgaattggggttgcccgtgattgaaaaggctggagtggctcacaagattgacttcagagaaggacccgctcttcctcttcttgacgttctcattaaagacgaaaagaataagggagctttcgatttcatctatgtggatgctgataaggacaattacttgaactaccacaagagggtgattgagcttgtgaagcttgggggattgatcggctacgataacaccctatggaatgggtccgtggtggccccacccgatgctcctctcatggattatgttaagtattatcgcgattttgttatggagctcaacaaagctcttgcacttgattcaagggtcgagatttgccagcttcccgttggtgatgggattaccctgtgccgccgcatcatctgatcattctgctccttccctccccttttacctacttcacctgccacatatggaaaaaacacaaccttctactattttacctaatccttaaataaacataatgtgtgtctgcttggatagttactctgttgttgagttttagtcttctacgcaattatattcataatgtttctcttccttaaaacaaacacatgttttgaatcaaaatcgtataagatatatatatggaatgtgtaagcaattattagctaaattat

SEQ ID NO: 115 - protein, 248 aa, Glycine max
  misc_feature (35)..(247): Pfam Name: Methyltransf_3 Pfam Description: O-methyltransferase
  misc_feature (1)..(248): Ceres Clone ID no. 558470
  misc_feature (1)..(248): Bit score of 612.7 for HMM based on sequences of Figure 13
  misc_feature (1)..(248): Functional Homolog Of SEQ ID NO. 53
MTVIKEEQQPNQIAGHKELGHKSLLQSDALYQYILETSVYPREHESLKELRELTEKHPWNLMATPPDEGQLLGMLLKLINAKNTMEIGVFTGYSLLSTALALPSDGKILAMDVNREYYELGLPVIEKAGVAHKIDFREGPALPLLDVLIKDEKNKGAFDFIYVDADKDNYLNYHKRVIELVKLGGLIGYDNTLWNGSVVAPPDAPLMDYVKYYRDFVMELNKALALDSRVEICQLPVGDGITLCRRII

SEQ ID NO: 116 - DNA, 1155 bp, Zea mays
  misc_feature (1)..(1155): Ceres Clone ID no. 320643
  misc_feature (1)..(1155): Encodes the peptide sequence at SEQ ID NO. 117
aatacccgacgcgcaagccagtgccgcgcccagatctccgcgacagatcagtcgttcgtccagctaactgcactgcacgcaatggccaccacggcgaccaagacgactgcaccggcgcaggagcagcaggccaacggcaacggcaacggcgagcagaagacgcgccactccgaggtcggccacaagagcctgctcaagagcgacgacctctaccagaatgatccgcagtacatcctggacacgagcgtgtacccgcgggagccggagagcatgaaggagctgcgcgagatcaccgccaagcacccatggaacctgatgaccacctccgccgacgagggccagttcctcaacatgctcatcaagctcatcggcgccaagaagaccatggagatcggcgtctacaccggctactcgctcctcgccaccgcgctcgcactcccggaggacggcacgatcttggccatggacatcaaccgcgagaactacgagctaggcctgccctgcatcaacaaggccggcgtgggccacaagatcgacttccgcgagggccccgcgctccccgtcctggacgacctcgtggcggacaaggagcagcacgggtcgttcgacttcgccttcgtggacgccgacaaggacaactacctcagctaccacgagcggctcctgaagctggtgaggcccggcggcctcatcggctacgacaacacgctgtggaacggctccgtcgtgctccccgacgacgcgcccatgcgcaagtacatccgcttctaccgcgacttcgtgctcgccctcaacagcgcgctcgccgccgacgaccgcgtcgagatctgccagctccccgtcggcgacggcgtcacgctctgccgccgcgtcaagtgaaaaaaaaaacacacatactccctccggtgcagtaaaagaagtcatcctgcgcgtgagcgagagtgcacaaaagaagtcgtagcgcacgtgggtctgggatttttgacgtcgctgcccctgagtaattgcatcgggaaaaaaaaaaagctgcgctcaagggaaatcgagcttgagacctccaatctagaatgcctcgggaggtactgcagcaaccaatcgaacttgattgttttggtgatgttaatgcactcatatccctatttaataagggcaagc

SEQ ID NO: 117 - protein, 265 aa, Zea mays
  misc_feature (52)..(264): Pfam Name: Methyltransf_3 Pfam Description: O-methyltransferase
  misc_feature (1)..(265): Ceres Clone ID no. 320643
  misc_feature (1)..(265): Bit score of 614.1 for HMM based on sequences of Figure 13
  misc_feature (1)..(265): Functional Homolog Of SEQ ID NO. 53
MATTATKTTAPAQEQQANGNGNGEQKTRHSEVGHKSLLKSDDLYQNDPQYILDTSVYPREPESMKELREITAKHPWNLMTTSADEGQFLNMLIKLIGAKKTMEIGVYTGYSLLATALALPEDGTILAMDINRENYELGLPCINKAGVGHKIDFREGPALPVLDDLVADKEQHGSFDFAFVDADKDNYLSYHERLLKLVRPGGLIGYDNTLWNGSVVLPDDAPMRKYIRFYRDFVLALNSALAADDRVEICQLPVGDGVTLCRRVK

SEQ ID NO: 118 - DNA, 1041 bp, Triticum aestivum
  misc_feature (1)..(1041): Ceres Clone ID no. 786185
  misc_feature (1)..(1041): Encodes the peptide sequence at SEQ ID NO. 119
gaaaacgattatttctagtcccaaagagctaacaagagattcaagaccggcatggctaatgaagaggaacagaaaaaccacctcttcggcatcaaagatctcggtcacaagactctccttcagagtgatgcactctatcagtatatacttgaaaccagtgtctatccaagagagcacgagtgcttgaaagagatacgcaagatgactgcaaaacacccactgaacatcatggcaacaccagcagacgaaggacaacttctgagcatgcttgttaagctcacgaattcaaagaacgccttggaaattggtgtattcactggttactctctgctctccactgccctggctcttccccctgatggaaagatcttggctttggatgtgaatcgcgaatactatgagttaggattgccaataattcaaaaagctggagtggctcacaagattgatttcagagaaggacctgctcttccgtttcttgacgagatgcttaaagatgaaaataaaaaggggtcgttggatttcgttttcgtggatgctgataaggacaattacttgaactaccacaagagggtactagagcttgtgaagattggaggactgatcggatacgataacaccctatgggctggatctgtggctgcaccacccgatgcaccattgatggattacattaagcctcttcgcggccatgtgatggagctcaacaagtatctggctcaagattcgaggatcgagatttgccagctccccgtgggtgatgggattaccctgtgccgccgcatcatctgatcattttctcttcatctagatttttcatgacagatattcctttcattaaaacaggttgcgtgaatggtggagttctcaaatgttctactgtcttttctagatctttgtgtgtttcttgtcacgctagaaatttagctgaaaggatacaaatcaacatttatcttatttatctacttgctaatcctgtattcagctttggaatagagttgcaaaaaaatgattttaataaaattaagagagaagctatgc

SEQ ID NO: 119 - protein, 246 aa, Triticum aestivum
  misc_feature (33)..(245): Pfam Name: Methyltransf_3 Pfam Description: O-methyltransferase
  misc_feature (1)..(246): Ceres Clone ID no. 786185
  misc_feature (1)..(246): Bit score of 540.1 for HMM based on sequences of Figure 13
  misc_feature (1)..(246): Functional Homolog Of SEQ ID NO. 53
MANEEEQKNHLFGIKDLGHKTLLQSDALYQYILETSVYPREHECLKEIRKMTAKHPLNIMATPADEGQLLSMLVKLTNSKNALEIGVFTGYSLLSTALALPPDGKILALDVNREYYELGLPIIQKAGVAHKIDFREGPALPFLDEMLKDENKKGSLDFVFVDADKDNYLNYHKRVLELVKIGGLIGYDNTLWAGSVAAPPDAPLMDYIKPLRGHVMELNKYLAQDSRIEICQLPVGDGITLCRRII

SEQ ID NO: 120 - protein, 247 aa, Populus trichocarpa
  misc_feature (34)..(246): Pfam Name: Methyltransf_3 Pfam Description: O-methyltransferase
  misc_feature (1)..(247): Bit score of 733.7 for HMM based on sequences of Figure 13
  misc_feature (1)..(247): Functional Homolog Of SEQ ID NO. 53
MATNGEEQQSQAGRHQEVGNKSLLQSDALYQYILETSVYPREPECMKELREVTAKHPWNIMTTSADEGQFLNMLLKLVNAKNTMEIGVYTGYSLLATALAIPEDGKILAMDINRENYELGLPVIQKAGVAHKIDFKEGPALPVLDQMIEDGKCHGSFDFIFVDADKDNYINYHKRLIELVKVGGLIGYDNTLWNGSVVAPPDAPMRKYVRYYRDFVLELNKALAADPRIEICMLPVGDGITLCRRIQ

SEQ ID NO: 121 - protein, 248 aa, Gossypium hirsutum
  misc_feature (34)..(247): Pfam Name: Methyltransf_3 Pfam Description: O-methyltransferase
  misc_feature (1)..(248): Bit score of 722.2 for HMM based on sequences of Figure 13
  misc_feature (1)..(248): Functional Homolog Of SEQ ID NO. 53
  misc_feature (197)..(197): Xaa is any aa, unknown, or other
MATNTQEQQSQAGRHQEVGHKSLLQSDALYQYILETSVYPREPEPMKELRELTAKHPWNLMTTSADEGQFLNMLLKLINAKNTMEIGVYTGYSLLATALAIPDDGKILAMDVNRENYELGLPVIQKAGVAHKIDFKEGPALPVLDQLVEDEKNHGSFDFIFVDADKDNYLNYHKRLIELVKVGGLIGYDNTLWNGSXVVAPPDAPLRKYVRYYRDFVMELNKALAVDPRIEICMLPVGDGITLCRRVK

SEQ ID NO: 122 - protein, 246 aa, Eucalyptus grandis
  misc_feature (34)..(245): Pfam Name: Methyltransf_3 Pfam Description: O-methyltransferase
  misc_feature (1)..(246): Bit score of 720.2 for HMM based on sequences of Figure 13
  misc_feature (1)..(246): Functional Homolog Of SEQ ID NO. 53
MATAGEESQTQAGRHQEVGHKSLLQSDALYQYILETSVYPREPEPMKELRDITAKHPWNIMTTSADEGQFLNMLLKLINAKNTMEIGVFTGYSLLATALALPDDGKILAMDINRENYELGLPVIQKAGVADKIDFREGPALPILDQLIEDGKQGSFDFIFVDADKDNYLNYHKRLIELVKVGGLIGYDNTLWNGSVVAPPDAPLRKYVRYYRDFVLELNKALAADPRIEICMLPVGDGITLCRRIS

SEQ ID NO: 123 - protein, 246 aa, Eucalyptus camaldulensis
  misc_feature (34)..(245): Pfam Name: Methyltransf_3 Pfam Description: O-methyltransferase
  misc_feature (1)..(246): Bit score of 721.0 for HMM based on sequences of Figure 13
  misc_feature (1)..(246): Functional Homolog Of SEQ ID NO. 53
MATAGEESQTQAGRHQEVGHKSLLQSDALYQYILETSVYPREPEPMKELREITAKHPWNIMTTSADEGQFLNMLLKLINAKNTMEIGVFTGYSLLATALALPDDGKILAMDINRENYELGLPVIQKAGVADKIDFREGPALPILDQLIEDGKQGAFDFIFVDADKDNYLNYHKRLIELVKVGGLIGYDNTLWNGSVVAPPDAPLRKYVRYYRDFVLELNKALAADPRIEICMLPVGDGITLCRRIS

SEQ ID NO: 124 - protein, 245 aa, Camellia sinensis
  misc_feature (32)..(244): Pfam Name: Methyltransf_3 Pfam Description: O-methyltransferase
  misc_feature (1)..(245): Bit score of 716.9 for HMM based on sequences of Figure 13
  misc_feature (1)..(245): Functional Homolog Of SEQ ID NO. 53
MATNGEGEQNLRHQEVGHKSLLQSDALYQYILETSVYPREPEAMKELREVTAKHPWNIMTTSADEGQFLNMLLKLINAKNTMEIGVYTGYSLLATALALPDDGKILAMDINRENFEIGLPIIEKAGVAHKIDFREGPALPALDQMIEDGKHHGSFDFIFVDADKDNYINYHKRLIDLVKVGGLIGYDNTLWNGSVVAPPDAPMRKYVRYYRDFVLELNKALAADPRIEICMLPVGDGITLCRRVC

SEQ ID NO: 125 - protein, 247 aa, Betula luminifera
  misc_feature (34)..(246): Pfam Name: Methyltransf_3 Pfam Description: O-methyltransferase
  misc_feature (1)..(247): Bit score of 725.9 for HMM based on sequences of Figure 13
  misc_feature (1)..(247): Functional Homolog Of SEQ ID NO. 53
MATNGEDNQNQASRHQEVGHKSLLQSDALYQYILETSVYPKEPESMKELREVTAKHPWNIMTTSADEGQFLNMLLKLINAKNTMEIGVYTGYSLLATALALPDDGKILAMDINRENYELGLPVIEKAGVAHKIDFREGPALPLLDHLIADEKNHGSYDFIFVDADKDNYINYHKRLIDLVKVGGLIGYDNTLWNGSVVAPPDAPLRKYVRYYRDFVLELNKALAADPRIEICMLPVGDGITLCRRIK

SEQ ID NO: 126 - protein, 245 aa, Camellia sinensis
  misc_feature (32)..(244): Pfam Name: Methyltransf_3 Pfam Description: O-methyltransferase
  misc_feature (1)..(245): Bit score of 713.6 for HMM based on sequences of Figure 13
  misc_feature (1)..(245): Functional Homolog Of SEQ ID NO. 53
MATNGEGEQNLRHQEVGHKSLLQSDALYQYILETSVYPREPEAMKELREVTAKHPWNIMTTSADEGQFLNMLLKLINAKNTMEIGVYTGYSLLATALALPDDGKILAMDINRENFEIGLPIIEKAGVAHKIDFREGPALPALDKMVEDGKHHGSFDFIFVDADKDNYINYHKRLIDLVKVGGLIGYDNTLWNGSVVAPPDAPMRKYVRYYRDFVLELNKALAADPRIEICMLPVGDGITLCRRVC

SEQ ID NO: 127 - protein, 247 aa, Vitis vinifera
  misc_feature (34)..(246): Pfam Name: Methyltransf_3 Pfam Description: O-methyltransferase
  misc_feature (1)..(247): Bit score of 730.2 for HMM based on sequences of Figure 13
  misc_feature (1)..(247): Functional Homolog Of SEQ ID NO. 53
MAGNQEGQQNQAGRHQEVGHKSLLQSDALYQYILETSVYPREPKPMKELRELTAKHPWNIMTTSADEGQFLNMLLKLINAKNTMEIGVYTGYSLLATALALPDDGKILAMDINRENYELGLPIIEKAGLAHKIDFREGPALPVLDQMIEDGKYHGTFDFIFVDADKDNYLNYHKRLIDLVKVGGLIGYDNTLWNGSVVAPPDAPLRKYVRYYKDFVLELNKALAADPRIEICQLPVGDGITLCRRIS

SEQ ID NO: 128 - protein, 247 aa, Vitis vinifera
  misc_feature (34)..(246): Pfam Name: Methyltransf_3 Pfam Description: O-methyltransferase
  misc_feature (1)..(247): Bit score of 731.9 for HMM based on sequences of Figure 13
  misc_feature (1)..(247): Functional Homolog Of SEQ ID NO. 53
MASNQEGQQNQAGRHQEVGHKSLLQSDALYQYILETSVYPREPKPMKELRELTAKHPWNIMTTSADEGQFLNMLLKLINAKNTMEIGVYTGYSLLATALALPDDGKILAMDINRENYELGLPIIEKAGLAHKIDFREGPALPVLDQMIEDGKYHGTFDFIFVDADKDNYLNYHKRLIDLVKVGGLIGYDNTLWNGSVVAPPDAPLRKYVRYYKDFVLELNKALAADPRIEICQLPVGDGITLCRRIS

SEQ ID NO: 129 - protein, 245 aa, Camellia sinensis
  misc_feature (32)..(244): Pfam Name: Methyltransf_3 Pfam Description: O-methyltransferase
  misc_feature (1)..(245): Bit score of 710.7 for HMM based on sequences of Figure 13
  misc_feature (1)..(245): Functional Homolog Of SEQ ID NO. 53
MATNGEGEQNLRHQEVGHKSLLQSDALYQYILETSVYPREPEAMKELREVTAKHPWNIMTTSADEGQFLNMLLKLINAKNTMEIGVYTGYSLLATALALPDDGKILAMDINRDNFEIGLPIIEKAGVAHKIDFREGPALPALDKMVEDGKHHGSFDFIFVDADKDNYINYHKRLIDLVKVGGLIGYDNTLWNGSVVAPPDAPMRKYVRYYRDFVLELNKALAADPRIEICMLPVGDGITLCRRVC

SEQ ID NO: 130 - protein, 248 aa, Ricinus communis
  misc_feature (35)..(247): Pfam Name: Methyltransf_3 Pfam Description: O-methyltransferase
  misc_feature (1)..(248): Bit score of 707.2 for HMM based on sequences of Figure 13
  misc_feature (1)..(248): Functional Homolog Of SEQ ID NO. 53
MASNNEEQQQNQAGRHQEVGHKSLLQSDALYQYILETSVYPNEPEPMKELRELTAKHPWNIMTTSADEGQFLNMLLKLINAKNTMEIGVYTGYSLLATALALPDDGKILAMDINRENYELGLPVIQKAGVAHKIEFREGPAMPVLDEMVADEKYHGSFDFIFVDADKDNYLNYHQRLVELVKVGGVIGYDNTLWNGSVVAPPDAPLRKYVRYYRDFVLELNKALPADPRIEICMLPVGDGITLCRRVK

SEQ ID NO: 131 - protein, 247 aa, Medicago truncatula
  misc_feature (34)..(246): Pfam Name: Methyltransf_3 Pfam Description: O-methyltransferase
  misc_feature (1)..(247): Bit score of 702.2 for HMM based on sequences of Figure 13
  misc_feature (1)..(247): Functional Homolog Of SEQ ID NO. 53
MATNEDQNQTESGRHQEVGHKSLLQSDALYQYILETSVFPREHEAMKELREVTAKHPWNIMTTSADEGQFLSMLLKLINAKNTMEIGVYTGYSLLATALAIPEDGKILAMDINKENYELGLPVIKKAGVDHKIDFREGPALPVLDEMIKDEKNHGSYDFIFVDADKDNYLNYHKRLIDLVKVGGVIGYDNTLWNGSVVTPPDAPLRKYVRYYRDFVLELNKALAVDPRIEICMLPVGDGITICRRIK

SEQ ID NO: 132 - protein, 252 aa, Carthamus tinctorius
  misc_feature (39)..(251): Pfam Name: Methyltransf_3 Pfam Description: O-methyltransferase
  misc_feature (1)..(252): Bit score of 695.6 for HMM based on sequences of Figure 13
  misc_feature (1)..(252): Functional Homolog Of SEQ ID NO. 53
MTINGETKTESNDKEQVSRHQEVGHKSLLQSDALYQYILETSVYPREPEPMKELREITAKHPWNIMTTSADEGQFLNMLLKLVNAKNTMEIGVFTGYSLLATALALPEDGKILAMDINRDNYELGLPIIEKAGVAHKIDFKEGPAMPVLDEMIADGKYHGTYDFIFVDADKDNYINYHKRLIDLVKVGGLIGYDNTLWNGTVVAPPDAPMRKYVRYYRDFVLEFNKVLGADPRIEICMLPVGDGITLCRRIS

SEQ ID NO: 133 - protein, 247 aa, Eucalyptus grandis
  misc_feature (34)..(246): Pfam Name: Methyltransf_3 Pfam Description: O-methyltransferase
  misc_feature (1)..(247): Bit score of 702.7 for HMM based on sequences of Figure 13
  misc_feature (1)..(247): Functional Homolog Of SEQ ID NO. 53
MAANAEPQQTQPAKHSEVGHKSLLQSDALYQYILETSVYPREPEPMKELREITAKHPWNLMTTSADEGQFLNMLLKLINAKNTMEIGVYTGYSLLATALALPDDGKILAMDINRENFEIGLPVIQKAGLAHKIDFREGPALPLLDQLVQDEKNHGTYDFIFVDADKDNYINYHKRLIDLVKVGGLIGYDNTLWNGSVVAPADAPLRKYVRYYRDFVLELNKALAVDPRIEICMLPVGDGITLCRRVS

SEQ ID NO: 134 - protein, 247 aa, Eucalyptus camaldulensis
  misc_feature (34)..(246): Pfam Name: Methyltransf_3 Pfam Description: O-methyltransferase
  misc_feature (1)..(247): Bit score of 703.0 for HMM based on sequences of Figure 13
  misc_feature (1)..(247): Functional Homolog Of SEQ ID NO. 53
MAANAEPQQTQPAKHSEVGHKSLLQSDALYQYILETSVYPREPESMKELREITAKHPWNLMTTSADEGQFLNMLLKLINAKNTMEIGVYTGYSLLATALALPDDGKILAMDINRENFEIGLPVIQKAGLAHKIDFREGPALPLLDQLVQDEKNHGTYDFIFVDADKDNYINYHKRLIDLVKVGGLIGYDNTLWNGSVVAPADAPLRKYVRYYRDFVLELNKALAVDPRIEICMLPVGDGITLCRRVS

SEQ ID NO: 135 - protein, 247 aa, Linum usitatissimum
  misc_feature (34)..(246): Pfam Name: Methyltransf_3 Pfam Description: O-methyltransferase
  misc_feature (1)..(247): Bit score of 693.1 for HMM based on sequences of Figure 13
  misc_feature (1)..(247): Functional Homolog Of SEQ ID NO. 53
MAEEQKSSSENVSRHQEVGHKSLLQSDALYQYILETSVYPREPESMKELREVTAKHPWNIMTTSADEGQFLNMLLKLVNAKNTMEIGVYTGYSLLATALAIPDDGKTLAMDINRENYEIGLPIIEKAGLAHKIEFREGPALPALDLMVENKSLHGTYDFIFVDADKDNYINYHKRLIDLVKIGGVIGYDNTLWNGSVVAPPDAPLRKYVRYYRDFVLELNKALAADPRIEICMLPVGDGITLCRRIS

SEQ ID NO: 136 - protein, 247 aa, Eucalyptus camaldulensis
  misc_feature (34)..(246): Pfam Name: Methyltransf_3 Pfam Description: O-methyltransferase
  misc_feature (1)..(247): Bit score of 702.0 for HMM based on sequences of Figure 13
  misc_feature (1)..(247): Functional Homolog Of SEQ ID NO. 53
MAANAEPQQTQPAKHSEVGHKSLLQSDALYQYILETSVYPREPESMKELREITAKHPWNLMTTSADEGQFLNMLLKLINAKNTMEIGVYTGYSLLATALALPDDGKILAMDINRENFEIGLPVIQKAGLAHKIDFREGPALPLLDQLVQDEKNHGTYDFIFVDADKDNYVNYHKRLIDLVKVGGLIGYDNTLWNGSVVAPADAPLRKYVRYYRDFVLELNKALAVDPRIEICMLPVGDGITLCRRVS

SEQ ID NO: 137 - protein, 244 aa, Carthamus tinctorius
  misc_feature (31)..(243): Pfam Name: Methyltransf_3 Pfam Description: O-methyltransferase
  misc_feature (1)..(244): Bit score of 682.7 for HMM based on sequences of Figure 13
  misc_feature (1)..(244): Functional Homolog Of SEQ ID NO. 53
MAATGETQPAKHQEVGHKSLLQSDALYQYILETSVYPREPESMKELREVTAKHPWNLMTTSADEGQFLNLLLKLINAKNTMEIGVYTGYSLLSTALALPEDGKILALDINRENYEIGLPIIEKAGVAHKIDFREGPALPLLDEMIGDEKFHGSFDFIFVDADKDNYLNYHKRLIDLVKIGGVIGYDNTLWNGSLVAPPDAPLRKYVRYYRDFVLELNKALAADSRVEICQLPVGDGITLCRRIS

SEQ ID NO: 138 - protein, 249 aa, Acacia auriculiformis
  misc_feature (36)..(248): Pfam Name: Methyltransf_3 Pfam Description: O-methyltransferase
  misc_feature (1)..(249): Bit score of 680.6 for HMM based on sequences of Figure 13
  misc_feature (1)..(249): Functional Homolog Of SEQ ID NO. 53
MASSNGEEKKQSEAGRHQEVGHKSLLQSDALYQYILETSVYPREPEPMKELREITAKHPWNIMTTSADEGQFLNMLLKLINAKNTMEIGVYTGYSLLATALALPDDGKILAMDINRENYELGRPTLEKAGVAHKVDFREGPALPFLDELVKDEKNHGSFDFIFVDADKDNYLNYHERLLQLVKVGGVIGYDNTLWNGSVVAPDDAPLRKYVMYYREFVLKLNKALAVDPRIEICMLPVGDGITLCRRIK

SEQ ID NO: 139 - protein, 244 aa, Carthamus tinctorius
  misc_feature (31)..(243): Pfam Name: Methyltransf_3 Pfam Description: O-methyltransferase
  misc_feature (1)..(244): Bit score of 685.2 for HMM based on sequences of Figure 13
  misc_feature (1)..(244): Functional Homolog Of SEQ ID NO. 53
MAATGETQPAKHQEVGHKSLLQSDALYQYILETSVYPREPESMKELREVTAKHPWNLMTTSADEGQFLNLLLKLINAKNTMEIGVYTGYSLLSTALALPEDGKILALDINRENYEIGLPIIEKAGVAHKIDFREGPALPLLDQMVDDEKFHGSFDFIFVDADKDNYLNYHKRLIDLVKIGGVIGYDNTLWNGSLVAPPDAPLRKYVRYYRDFVLELNKALAADSRVEICQLPVGDGITLCRRVS

SEQ ID NO: 140 - protein, 249 aa, Chamaecyparis formosensis
  misc_feature (36)..(248): Pfam Name: Methyltransf_3 Pfam Description: O-methyltransferase
  misc_feature (1)..(249): Bit score of 682.5 for HMM based on sequences of Figure 13
  misc_feature (1)..(249): Functional Homolog Of SEQ ID NO. 53
MATVEATKDSTQQVSRHQEVGHKSLLQSDALYQYILETSVYPREPEPMRELREITAKHPWNLMTTSADEGQFLHLLLKLINAKNTMEIGVYTGYSLLSTALALPDDGKILAMDINRENYELGLPVIQKAGVAHKIDFREGPALPVLDQMLENKEMHGSFDFIFVDADKDNYLNYHKRLIDLVKIGGVIGYDNTLWNGSVVAPPDAPMRKYVRYYRDFVIELNKALAADPRIEISQIPVGDGITLCRRII

SEQ ID NO: 141 - protein, 247 aa, Carthamus tinctorius
  misc_feature (34)..(246): Pfam Name: Methyltransf_3 Pfam Description: O-methyltransferase
  misc_feature (1)..(247): Bit score of 687.6 for HMM based on sequences of Figure 13
  misc_feature (1)..(247): Functional Homolog Of SEQ ID NO. 53
MAAVNGGSESQPAKHQEVGHKSLLQSDALYQYILETSVYPREPAPMKELREVTAKHPWNLMTTSADEGQFLNLLLKLINAKNTMEIGVYTGYSLLSTALALPDDGKILALDINRENYEIGLPIIEKAGVAHKIDFREGPALPLLDSMIEDKKFHGSFDFIFVDADKDNYLNYHKRLIDLVKIGGVIGYDNTLWNGSLVAPPDAPLRKYVRYYRDFVLELNKALAVDPRVEICQLPVGDGITLCRRIS

SEQ ID NO: 142 - protein, 252 aa, Carthamus tinctorius
  misc_feature (39)..(251): Pfam Name: Methyltransf_3 Pfam Description: O-methyltransferase
  misc_feature (1)..(252): Bit score of 659.5 for HMM based on sequences of Figure 13
  misc_feature (1)..(252): Functional Homolog Of SEQ ID NO. 53
MAINEETKIDSNNEEQASGHQEVGHKSLLQSDALYQYILETSVYPREPTPMKELREITAKHPMNVMATSADEGQFLNMLLKLVNAKNTMEIGVFTGYSLLATALALPEDGKILAMDINRDDYELGRPIIEKAGVAHKIDFKEGPAMPVLDEMIVDGKYHGTYDFIFVDADKDNYINYHKRLVDLVKVGGLIGYDNTLWNGPVAAPPDAPMAKYVSYYRDFVLEFNKALAADPRIEICMLPVGDGITLCRRIN

SEQ ID NO: 143 - protein, 249 aa, Taiwania cryptomerioides
  misc_feature (36)..(248): Pfam Name: Methyltransf_3 Pfam Description: O-methyltransferase
  misc_feature (1)..(249): Bit score of 681.6 for HMM based on sequences of Figure 13
  misc_feature (1)..(249): Functional Homolog Of SEQ ID NO. 53
MATVEATKDSTQQVSRHQEVGHKSLLQSDALYQYILETSVYPREPESMRELREITAKHPWNLMTTSADEGQFLHLLLKLINAKNTMEIGVYTGYSLLSTALALPDDGKILAMDINRENYELGLPVIQKAGVAHKIDFREGPALPVLDQMLENKEMHGSFDFIFVDADKDDYLNYHKRLIDLVKIGGVIGYDNTLWNGSVVAPPDAPLRKYVRYYRDFVIELNKALAADPRIEISQIPVGDGITLCRRIS

SEQ ID NO: 144 - protein, 247 aa, Carthamus tinctorius
  misc_feature (34)..(246): Pfam Name: Methyltransf_3 Pfam Description: O-methyltransferase
  misc_feature (1)..(247): Bit score of 679.3 for HMM based on sequences of Figure 13
  misc_feature (1)..(247): Functional Homolog Of SEQ ID NO. 53
MAAVNGGSESQPAKHQEVGHKSFLQSDALYQYILETSVYPREPASMKELREVTAKHPWNLMTTSADEGQFLSLLLKLINAKNTMEIGVYTGYSLLSTALALPDDGKILALDINRENYEIGLPIIEKARVAHKIDFREGPALPLLDQMINDEKFHGSFDFIFVDADKDNYLNYHKRLIDLVKIGGVIGYDNTLWNGSLVAPPDAPLRKYVRYYRDFVLELNKALAIDPRIEICQLPVGDGITLCRRIN

SEQ ID NO: 145 - protein, 259 aa, Bambusa oldhamii
  misc_feature (46)..(258): Pfam Name: Methyltransf_3 Pfam Description: O-methyltransferase
  misc_feature (1)..(259): Bit score of 649.3 for HMM based on sequences of Figure 13
  misc_feature (1)..(259): Functional Homolog Of SEQ ID NO. 53
MATATADATTATKEQTSGGGGEQKTRHSEVGHKSLLQSDALYQYILETSVYPREHECMKELREVTAKHPWNLMTTSADEGQFLNMLLKLIGAKKTMEIGVYTGYSLLATALAIPEDGTILAMDINRENYELGLPCIEKAGVAHKIDFREGPALPVLDQLLEDEANHGSFDFVFVDADKDNYLNYHDRLMKLVKVGGLVGYDNTLWNGSVVLPADAPMRKYIRYYRDFVLELNKALAADERVEICQLPVGDGITLCRRAK

SEQ ID NO: 146 - protein, 232 aa, Eucalyptus camaldulensis
  misc_feature (20)..(231): Pfam Name: Methyltransf_3 Pfam Description: O-methyltransferase
  misc_feature (1)..(232): Bit score of 649.9 for HMM based on sequences of Figure 13
  misc_feature (1)..(232): Functional Homolog Of SEQ ID NO. 53
MATAGEESQTQAGRHQEYILETSVYPREPEPMKELREITAKHPWNIMTTSADEGQFLNMLLKLINAKNTMEIGVFTGYSLLAAALALPDDGKILAMDINRENYELGLPVIQKAGVADKIDFREGPALPILDQLIEDGKQGSFDFIFVDADKDNYLNYHKRLIELVKVGGLIGYDNTLWNGSVVAPPDAPLRKYVRYYRDFVLELNKALAADPRIEICMLPVGDGITLCRRIS

SEQ ID NO: 147 - protein, 232 aa, Eucalyptus camaldulensis
  misc_feature (20)..(231): Pfam Name: Methyltransf_3 Pfam Description: O-methyltransferase
  misc_feature (1)..(232): Bit score of 651.0 for HMM based on sequences of Figure 13
  misc_feature (1)..(232): Functional Homolog Of SEQ ID NO. 53
MATAGEESQTQAGRHQEYILETSVYPREPEPMKELREITAKHPWNIMTTSADEGQFLNMLLKLINAKNTMEIGVFTGYSLLATALALPDDGKILAMDINRENYELGLPVIQKAGVADKIDFREGPALPILDQLIEDGKQGAFDFIFVDADKDNYLNYHKRLIELVKVGGLIGYDNTLWNGSVVAPPDAPLRKYVRYYRDFVLELNKALAADPRIEICMLPVGDGITLCRRIS

SEQ ID NO: 148 - protein, 259 aa, Triticum aestivum
  misc_feature (46)..(258): Pfam Name: Methyltransf_3 Pfam Description: O-methyltransferase
  misc_feature (1)..(259): Bit score of 635.3 for HMM based on sequences of Figure 13
  misc_feature (1)..(259): Functional Homolog Of SEQ ID NO. 53
MATTAADATAAAPKDQPANGSEQVTRHSEVGHKSLLQSDALYQYILETSVYPREHECMKELREITANHPWNLMTTSADEGQFLNMLLKLIGAKKTMEIGVYTGYSLLATALAIPDDGTILAMDINRENYELGLPCIEKAGVAHKIDFREGPALPVLDALLEDEANHGTFDFVFVDADKDNYLNYHERLMKLVKLGGLLGYDNTLWNGSVVLPADAPMRKYIRYYRDFVLDLNKALAADQRVEICQLPVGDGITLCRRAK

SEQ ID NO: 149 - protein, 260 aa, Oryza sativa
  misc_feature (47)..(259): Pfam Name: Methyltransf_3 Pfam Description: O-methyltransferase
  misc_feature (1)..(260): Bit score of 640.0 for HMM based on sequences of Figure 13
  misc_feature (1)..(260): Functional Homolog Of SEQ ID NO. 53
MAEAASAAATATAEQANGSNGGEQKTRHSEVGHKSLLKSDDLYQYILETSVYPREHECMKELREVTANHPWNLMTTSADEGQFLNLLLKLIGAKKTMEIGVYTGYSLLATALAIPDDGTILAMDINRENYELGLPSIEKAGVAHKIDFREGPALPVLDQLVEEEGNHGSFDFVFVDADKDNYLNYHERLMKLVKVGGLVGYDNTLWNGSVVLPADAPMRKYIRYYRDFVLELNKALAADHRVEICQLPVGDGITLCRRVK

SEQ ID NO: 150 - protein, 266 aa, Hordeum spontaneum
  misc_feature (53)..(265): Pfam Name: Methyltransf_3 Pfam Description: O-methyltransferase
  misc_feature (1)..(266): Bit score of 637.8 for HMM based on sequences of Figure 13
  misc_feature (1)..(266): Functional Homolog Of SEQ ID NO. 53
MATTAADATAAVPKDQAANGSAAASTGGEQVTRHSEVGHKSLLQSDALYQYILETSVYPREHECMKELREITANHPWNLMTTSADEGQFLNMLLKLIGAKKTMEIGVYTGYSLLATALAIPDDGTILAMDINRENYELGLPCIEKAGVAHKIDFREGPALPVLDALLEDEANHGTFDFVFVDADKDNYLNYHERLMKLVKVGGLLGYDNTLWNGSVVLPADAPVRKYIRYYRDFVLELNKALAADQRVEICQLPVGDGITLCRRAK

SEQ ID NO: 151 - protein, 261 aa, Oryza sativa
  misc_feature (48)..(260): Pfam Name: Methyltransf_3 Pfam Description: O-methyltransferase
  misc_feature (1)..(261): Bit score of 634.7 for HMM based on sequences of Figure 13
  misc_feature (1)..(261): Functional Homolog Of SEQ ID NO. 53
MAEAASAAAAATTEQANGSSGGEQKTRHSEVGHKSLLKSDDLYQQYILETSVYPREHECMKELREVTANHPWNLMTTSADEGQFLNLLLKLIGAKKTMEIGVYTGYSLLATALAIPDDGRILAMDINRENYELGLPSIEKAGVAHKIDFREGPALPVLDQLVEEEGNHGSFDFVFVDADKDNYLNYHERLMKLVKVGGLVGYDNTLWNGSVVLPADAPMRKYIRYYRDFVLELNKALAADHRVEICQLPVGDGITLCRRVK

SEQ ID NO: 152 - protein, 259 aa, Pinus radiata
  misc_feature (46)..(258): Pfam Name: Methyltransf_3 Pfam Description: O-methyltransferase
  misc_feature (1)..(259): Bit score of 656.5 for HMM based on sequences of Figure 13
  misc_feature (1)..(259): Functional Homolog Of SEQ ID NO. 53
MASRAVQQTEVKAETTQTEEPTKVARHQEVGHKSLLQSDALYQYILETSVYPREPAPLKELREVTAKHPWNLMTTSADEGQFLGLLLKLINAKNTMEIGVYTGYSLLSTALALPDDGKILAMDINRENYDIGLPIIEKAGVAHKIDFREGPALPLLDEMLQKEEMHGSFDFVFVDADKDNYLNYHKRLIDLVKVGGVIAYDNTLWNGSVVAPPDAPLRKYVRYYRDFVVELNKALAADPRIEISQIPVGDGVTLCRRLH

SEQ ID NO: 153 - DNA, 487 bp, Panicum virgatum
  misc_feature (1)..(487): Ceres Clone ID no. 1773290
  misc_feature (1)..(487): Encodes the peptide sequence at SEQ ID NO. 154
cttctcccccacgctgaagacgacgccatccctcaccagctcgcctcctccactcctcccaaacccctcgccgactcagattccgctgccccgcgccgccgccgccgccatgccgttcaccccgggcccctactccggcgtcagcaccctcgctctcgtggcgagggcgtcggccttcggcgtcggcgtcgtctacgggagcatcaagctctccatcctcaaggcgacaaaacctaaaaaggaggaagcacatgcccatcactaaggatggcagggatgcaatgtgttacctgcagttcaaggatgtcataaattggcagtgtaccccttcttcatacgtgcatttgggtttatgatttgtggacctcttgtctgtaacacacctgctgagttaccttagctttgcgtcgtaataagttcttgatcccatgacttgaaatgaggtattaaaggcaaaagctgaaaagaaccctttagttcttgatcc

SEQ ID NO: 154 - protein, 51 aa, Panicum virgatum
  misc_feature (1)..(51): Ceres SEED LINE ID no. CW00761
  misc_feature (1)..(51): Ceres SEED LINE ID no. CW00761
  misc_feature (1)..(51): Ceres Clone ID no. 1773290
  misc_feature (1)..(51): Bit score of 111.4 for HMM based on sequences of Figure 18
  misc_feature (1)..(51): in Figure 18
MPFTPGPYSGVSTLALVARASAFGVGVVYGSIKLSILKATKPKKEEAHAHH

SEQ ID NO: 155 - DNA, 156 bp, Sorghum bicolor
  misc_feature (1)..(156): Ceres Annot ID no. 8701724
  misc_feature (1)..(156): Encodes the peptide sequence at SEQ ID NO. 156
atgcctttcactccgggcccctactccggcgtcagcaccctcgcccttgtggccagggcgtctgccttcagcgtcggtgtcgtctacgggagcatcaagctctcaatcctcaaggcaacaaaacctaaaaaggaggaagcacatgctcatcactaa

SEQ ID NO: 156 - protein, 51 aa, Sorghum bicolor
  misc_feature (1)..(51): Ceres Annot ID no. 8701724
  misc_feature (1)..(51): Bit score of 112.0 for HMM based on sequences of Figure 18
  misc_feature (1)..(51): Functional Homolog Of SEQ ID NO. 154
  misc_feature (1)..(51): in Figure 18
MPFTPGPYSGVSTLALVARASAFSVGVVYGSIKLSILKATKPKKEEAHAHH

SEQ ID NO: 157 - DNA, 379 bp, Zea mays
  misc_feature (1)..(379): Ceres Clone ID no. 1531656
  misc_feature (1)..(379): Encodes the peptide sequence at SEQ ID NO. 158
aaaaaaaactcctaaccctcgcccgactcagatctatctgccccgcgccgccgtcgccatgccgttcactccgggtccctactctggcgtcagcaccctcgcccttgtagcgagggcatcggtcttcggcttcggtgtcgtctacgggagcatcaagctctcaatcctcaaggcaacaaagcctaaaaaggaagaagcgcatgctcatcactaaggacgacagggctgctacatgttaatttctatggaaggatgatataaaaatgtggttgcactctttctccatacgtgcaatttgatttatgatttgtggacatcttgctgtaacacacctgctgagttatcttagttttgtgtcataataaattcttagccaatg

SEQ ID NO: 158 - protein, 51 aa, Zea mays
  misc_feature (1)..(51): Ceres Clone ID no. 1531656
  misc_feature (1)..(51): Bit score of 109.6 for HMM based on sequences of Figure 18
  misc_feature (1)..(51): Functional Homolog Of SEQ ID NO. 154
  misc_feature (1)..(51): in Figure 18
MPFTPGPYSGVSTLALVARASVFGFGVVYGSIKLSILKATKPKKEEAHAHH

SEQ ID NO: 159 - protein, 52 aa, Oryza sativa subsp. japonica
  misc_feature (1)..(52): Public GI ID no. 115456900
  misc_feature (1)..(52): Bit score of 103.8 for HMM based on sequences of Figure 18
  misc_feature (1)..(52): Functional Homolog Of SEQ ID NO. 154
  misc_feature (1)..(52): in Figure 18
MPFTPGPYSGVSTLALVARASALGVGVVYGAVKLSILKATKPNKKEAANAHH

SEQ ID NO: 160 - DNA, 504 bp, Triticum aestivum
  misc_feature (1)..(504): Ceres Clone ID no. 869980
  misc_feature (1)..(504): Encodes the peptide sequence at SEQ ID NO. 161
ctccctttatcaccccagccctcccctctggtcttcttctcacccacgaaacagagagagactccgccgtcgcagcgccagccaaaccctcgtcgtcgtctccgatcccgccgtcgcagccatgccgttcaccccgggaccctactccggcaagagcaccctcgccctcgtggccagggtctccgccgtcggcgtcggcctcgtctacggctccgtcaagctcggcatcctcaagatgaccaagcccaaggaggaagcagctgctgctcatcactgaggacaagtagctccagcgagttgacgccgtagmttcgcaatgtaccttctatacctgcattcggttctgtgatttgtgtctgaaacccaaaaaaacccagacccatgtgggagctgaacctttagcttttttgcttgtggaaaataatatcctcggctgaatcgacttgaaatcaggaagagtgaaacttaaaattctttggtgtggttctgcgatccagacaagtt

SEQ ID NO: 161 - protein, 51 aa, Triticum aestivum
  misc_feature (1)..(51): Ceres Clone ID no. 869980
  misc_feature (1)..(51): Bit score of 104.1 for HMM based on sequences of Figure 18
  misc_feature (1)..(51): Functional Homolog Of SEQ ID NO. 154
  misc_feature (1)..(51): in Figure 18
MPFTPGPYSGKSTLALVARVSAVGVGLVYGSVKLGILKMTKPKEEAAAAHH

SEQ ID NO: 162 - DNA, 519 bp, Musa acuminata
  misc_feature (1)..(519): Ceres Clone ID no. 1739862
  misc_feature (1)..(519): Encodes the peptide sequence at SEQ ID NO. 163
attttccctctaccgctccttccatggcgatacccggcccttactccggcgtcagcaccctcgcgttcgttgctcgtgcttcggcgttcgcgttcggtgtcgtttatggaagcgtcaagctatcgtatctccaggtcaaggcaaagtttcacaagaaggaagaggcaaaaggccaccactgaggaacagaatgcgggcgtgtgatggtgacaaattgacttcacctttgggttatatttaattgaaggattacaaggttggagaagtacggtaaacttcgactcttgagttacacttttacttttgattgcgatagcaacatcagatctcacgtccttactgtcttatcatcaaaaaagtttgaagtggaagctttaaaacatagttggtacgatacgaagttattttaaagcaattttaattattaaatgtagataactcagcttaagagggtgggtagttaacactgtcactggttctccttcagcttaaacgactctaatcgtcaacttatatcac

SEQ ID NO: 163 - protein, 52 aa, Musa acuminata
  misc_feature (1)..(52): Ceres Clone ID no. 1739862
  misc_feature (1)..(52): Bit score of 107.7 for HMM based on sequences of Figure 18
  misc_feature (1)..(52): Functional Homolog Of SEQ ID NO. 154
  misc_feature (1)..(52): in Figure 18
MAIPGPYSGVSTLAFVARASAFAFGVVYGSVKLSYLQVKAKFHKKEEAKGHH

SEQ ID NO: 164 - DNA, 162 bp, Populus balsamifera subsp. trichocarpa
  misc_feature (1)..(162): Ceres Annot ID no. 1452831
  misc_feature (1)..(162): Encodes the peptide sequence at SEQ ID NO. 165
atgacgctacctccaggtccttactccggtgccagcgctctcgctctggtggcgcgtgcatcagcattcagttttggcttggtttatggaagtgtgaagctcaagattctcaagatgaaagcaaattcacataagaaggcggaagctaaggcacatcactga

SEQ ID NO: 165 - protein, 53 aa, Populus balsamifera subsp. trichocarpa
  misc_feature (1)..(53): Ceres Annot ID no. 1452831
  misc_feature (1)..(53): Bit score of 114.1 for HMM based on sequences of Figure 18
  misc_feature (1)..(53): Functional Homolog Of SEQ ID NO. 154
  misc_feature (1)..(53): in Figure 18
MTLPPGPYSGASALALVARASAFSFGLVYGSVKLKILKMKANSHKKAEAKAHH

SEQ ID NO: 166 - DNA, 361 bp, Brassica napus
  misc_feature (1)..(361): Ceres Clone ID no. 1123182
  misc_feature (1)..(361): Encodes the peptide sequence at SEQ ID NO. 167
gatttgggatcatcttagggttttcttctcttctctccaatcaatggcgatacctccaggactatactccggcaccagctcccttgctctcgtggctcgtgcttcggcgtttagcgtgggtctcctctacgggagcatgaagctcaaggtcttgaagatgacaaagaagccacacaaggttgaagctactgctcatcactaaaccattgttctgtctttacaataagaaaccaaacgcttggggcggggatgtcttcccgccctggttagcaattttttttttgtatgattcatctttcatcatgaaaaaggaactaatatacttcataratcattaataaattattttctcaaatgtctc

SEQ ID NO: 167 - protein, 52 aa, Brassica napus
  misc_feature (1)..(52): Ceres Clone ID no. 1123182
  misc_feature (1)..(52): Bit score of 105.8 for HMM based on sequences of Figure 18
  misc_feature (1)..(52): Functional Homolog Of SEQ ID NO. 154
  misc_feature (1)..(52): in Figure 18
MAIPPGLYSGTSSLALVARASAFSVGLLYGSMKLKVLKMTKKPHKVEATAHH

SEQ ID NO: 168 - protein, 53 aa, Vitis vinifera
  misc_feature (1)..(53): Public GI ID no. 225427800
  misc_feature (1)..(53): Bit score of 110.7 for HMM based on sequences of Figure 18
  misc_feature (1)..(53): Functional Homolog Of SEQ ID NO. 154
  misc_feature (1)..(53): in Figure 18
MAPPPGPYSGTSTLALVARVSAFSAGLVYGSIKLKYLKSKAKSQKKAEAKSHH

SEQ ID NO: 169 - DNA, 474 bp, Zea mays
  misc_feature (1)..(474): Ceres Clone ID no. 1649408
  misc_feature (1)..(474): Encodes the peptide sequence at SEQ ID NO. 170
gtcttctcccctgcgtcaaagacgacgcaagcccttgcctctccctactccaaaccctcgccgactcagatccagcttcctcgcaccgccgtcgccatgccgttcactccaggcccctactctggcgtcagcaccctcgcccttgtggcgagggcgtcggcctttggtgtcggtgtcgtctacgggagcatcaagctctcaatcctcaaggtcacaaaacctaaaaaggaggaagtgcatgatcatcactaaggatgacagggctgctacatgttaattcccatatatgcaaggatgttataaaattggcagtgcaccccttatccatacgtgcaatttcgtttatgatttgtggacctgtctgtaacatacctgctgtttttttttgtgttgtaataaattcttatacaatgactgaatgacatgaaatcaggaagtggaaaaagcaatagtaataattgcaagtcgttcgac

SEQ ID NO: 170 - protein, 51 aa, Zea mays
  misc_feature (1)..(51): Ceres Clone ID no. 1649408
  misc_feature (1)..(51): Bit score of 106.1 for HMM based on sequences of Figure 18
  misc_feature (1)..(51): Functional Homolog Of SEQ ID NO. 154
MPFTPGPYSGVSTLALVARASAFGVGVVYGSIKLSILKVTKPKKEEVHDHH

SEQ ID NO: 171 - DNA, 162 bp, Populus balsamifera subsp. trichocarpa
  misc_feature (1)..(162): Ceres Annot ID no. 1442596
  misc_feature (1)..(162): Encodes the peptide sequence at SEQ ID NO. 172
atgactccacctccaggtccttactccggcgccagcactctcgctctggtggcgcgtgcatcggcattcagttttggcttggtttatggaagtgtgaagctcaagattctcaagatgaaagtgaattcgcgtaacaaggcggaagctaaggcacatcactga

SEQ ID NO: 172 - protein, 53 aa, Populus balsamifera subsp. trichocarpa
  misc_feature (1)..(53): Ceres Annot ID no. 1442596
  misc_feature (1)..(53): Bit score of 110.4 for HMM based on sequences of Figure 18
  misc_feature (1)..(53): Functional Homolog Of SEQ ID NO. 154
MTPPPGPYSGASTLALVARASAFSFGLVYGSVKLKILKMKVNSRNKAEAKAHH

SEQ ID NO: 173 - DNA, 671 bp, Gossypium hirsutum
  misc_feature (1)..(671): Ceres Clone ID no. 100011527
  misc_feature (1)..(671): Encodes the peptide sequence at SEQ ID NO. 174
tgattgtttcatctagatctgaaactccgtcgcccacttcccaaacaaagcaaatcgatggcgcctgctcctggaccatactccggcaccagcactcttgctctcgtggcacgtgcatctgctttgtcttttggactcgtttatggtagcattaagctcaagtatctcaaggccaaggcaaggtctcaaaggaaagctgaagcaaaggctcaccactgaagcaggggtggtttttgttcatagttggtttgcatgagtgaatagagtttggtgtaggaataaagcataaaaatagtattgtaccagattttcatttcggcttaaagcttctatggacaatgacatacttgtccccaaattaaattagtattacgaactcggcacttcaagtattagtttatcggttgtcaatggcactaccgatgtttagtgtcttaagttaatgggaaagatgttggatgattatatgcttccatgttcaatgtaataatactcacttattggctcccacaaaaaaaaaaaaaaaaaactcgaggggggtgcctggtaccaattcgccctatagtgagtcgtataacaattcactaggcgtcgtataaaaacgtcgtgactgtgtaaaccttgcgtaaccaattaattgctagaagaaatcaccttttgcaggtgatgta

SEQ ID NO: 174 - protein, 53 aa, Gossypium hirsutum
  misc_feature (1)..(53): Ceres Clone ID no. 100011527
  misc_feature (1)..(53): Bit score of 108.0 for HMM based on sequences of Figure 18
  misc_feature (1)..(53): Functional Homolog Of SEQ ID NO. 154
MAPAPGPYSGTSTLALVARASALSFGLVYGSIKLKYLKAKARSQRKAEAKAHH

SEQ ID NO: 175 - DNA, 549 bp, Arabidopsis thaliana
  misc_feature (1)..(549): Ceres Clone ID no. 1347664
  misc_feature (1)..(549): Encodes the peptide sequence at SEQ ID NO. 176
atcacgaatcgcgatttttttttgagattacggaagcttcgcttgatttgggatttttagggttttctttctccgaagacgactccgagagaccaacagtgatttgacaatgacgctacctccaggtctttactccggcaccagctctcttgctctggtggctcgtgcttcggcttttgggttgggtctcgtctatgggaacatgaagctcaaggtccttaagatcaaatcgatgtcacagaagaaggttgaagccaccgctcatcattaaaccactcttctttctttacaataagatgccaaaagctgggggtgatgtctccccggttagtttgatttcttctttcatgattcatcctttagcataagaaggaacaaatgtgtttttgaaaagcatattatacggttttaagacctttttggagccataattgccattggcttaaaacccgagtcaagaacatcttttccatttgttgtcatccaataacaccgttcacattcacatacacctcacctcttaaccagattatctataacctaagggac

SEQ ID NO: 176 - protein, 53 aa, Arabidopsis thaliana
  misc_feature (1)..(53): Ceres Clone ID no. 1347664
  misc_feature (1)..(53): Bit score of 100.3 for HMM based on sequences of Figure 18
  misc_feature (1)..(53): Functional Homolog Of SEQ ID NO. 154
MTLPPGLYSGTSSLALVARASAFGLGLVYGNMKLKVLKIKSMSQKKVEATAHH

SEQ ID NO: 177 - DNA, 471 bp, Glycine max
  misc_feature (1)..(471): Ceres Clone ID no. 679875
  misc_feature (1)..(471): Encodes the peptide sequence at SEQ ID NO. 178
  misc_feature (112)..(112): n is a, c, t, g, unknown, or other
  misc_feature (455)..(455): n is a, c, t, g, unknown, or other
accctctcactgcggtcccaccttgctggctagggttcgataatcgacaattgtgaagcacaccgttttgttcgtccattttttcctcccttcctctcttcctgcgccgacnactactctcgctcgtaatggcaccaccaccgggaccttattctggtaccagcaccctcgctttggtcgctcgagcttccgctttctcctttggccttgtttatggaaccattaagctcaagtacctcaaggcaaaagccaaatctcatcaaaaagctcaggagaaggctcatcattgaaagcaatgagagatctccggtgttattatctgtccattgatggagtagaatactgaaataattcattacaaggaactgtatcatgttttctcccattttttttttcttctckggtttaagctttggataatcttggagcatcgagtttagtgcgctgaaaatgtncaagattttgccttgt

SEQ ID NO: 178 - protein, 53 aa, Glycine max
  misc_feature (1)..(53): Ceres Clone ID no. 679875
  misc_feature (1)..(53): Bit score of 105.5 for HMM based on sequences of Figure 18
  misc_feature (1)..(53): Functional Homolog Of SEQ ID NO. 154
MAPPPGPYSGTSTLALVARASAFSFGLVYGTIKLKYLKAKAKSHQKAQEKAHH

SEQ ID NO: 179 - DNA, 395 bp, Parthenium argentatum
  misc_feature (1)..(395): Ceres Clone ID no. 1606594
  misc_feature (1)..(395): Encodes the peptide sequence at SEQ ID NO. 180
cgattcgcctaacgacatttctccgatggcaccacctcccggcccttactccggtaccagcaccctcgctctggtggctcgtgtctcggccttctctgctggactagtttatggaaccttgaagctcaaataccttaaggcaaaggctaactcacaaagaaaagctgcagccaaggcacaccattagaaggagaagtgaatgaggtagttatttatgttttgaataattcttgatgatggtccagagtgagtgtccactcgggtcacatgatatcgttcctatcttttgcttgtaactgttcgattttgaccacaagtttttactcctttcaacatgacaaatggttatacatttggttgacatgaagcataattcaaaagtagatttctgcttg

SEQ ID NO: 180 - protein, 53 aa, Parthenium argentatum
  misc_feature (1)..(53): Ceres Clone ID no. 1606594
  misc_feature (1)..(53): Bit score of 104.6 for HMM based on sequences of Figure 18
  misc_feature (1)..(53): Functional Homolog Of SEQ ID NO. 154
MAPPPGPYSGTSTLALVARVSAFSAGLVYGTLKLKYLKAKANSQRKAAAKAHH

SEQ ID NO: 181 - protein, 51 aa, Zea mays
  misc_feature (1)..(51): Bit score of 105.2 for HMM based on sequences of Figure 18
  misc_feature (1)..(51): Functional Homolog Of SEQ ID NO. 154
MPFTPGPYSGVSTLALVARASAFGVGVVYGSIKLSILKLTKPKKEEVHDHH

SEQ ID NO: 182 - protein, 68 aa, Zea mays
  misc_feature (1)..(68): Bit score of 106.4 for HMM based on sequences of Figure 18
  misc_feature (1)..(68): Functional Homolog Of SEQ ID NO. 154
MPFTPGPYSGVNTLALVARASAFGVGVVYGSIKLSILKVTKPKKEEAHDHHQGRQGCYILIPTYGRML

SEQ ID NO: 183 - protein, 51 aa, Zea mays
  misc_feature (1)..(51): Bit score of 101.6 for HMM based on sequences of Figure 18
  misc_feature (1)..(51): Functional Homolog Of SEQ ID NO. 154
MPFTPGPYSGVSTLALVARASAFGVGVVYGSIKLSILKVTKPKKEEVHDHY

SEQ ID NO: 184 - protein, 55 aa, Populus trichocarpa
  misc_feature (1)..(55): Bit score of 102.5 for HMM based on sequences of Figure 18
  misc_feature (1)..(55): Functional Homolog Of SEQ ID NO. 154
MAPPPGPYSGTSTLALVARVSAFSLGLVYGSVKLKYLQAKARSQKKAEAKAKAHH

SEQ ID NO: 185 - protein, 53 aa, Populus trichocarpa
  misc_feature (1)..(53): Bit score of 111.6 for HMM based on sequences of Figure 18
  misc_feature (1)..(53): Functional Homolog Of SEQ ID NO. 154
MAPPPGPYSGTSTLALVARVSAFSLGLVYGSVKLKYLQAKAKSQKKAEAKAHH

SEQ ID NO: 186 - DNA, 1046 bp, Zea mays
  misc_feature (1)..(1046): Ceres Clone ID no. 225681
  misc_feature (1)..(1046): Encodes the peptide sequence at SEQ ID NO. 187
aaaaaacatccagctcaccgcgctaccgtgccccggcatggcgctccacctcaacaccgtcatcgacctcaccgtggacaattactggctgttccgcatcccgcccatcaccatcgacttcctcaacaagctgccgcagcagagcgaggccccgacgccggcatcagccgttaccgcccagcttacccgccgcttcacgtgctccaccggcgacttcgtcctctacagacagccccagcgggtggaggagatggtcacggccgcggggctgcccctggagtgcgcgcccagcgtggcggagttcatcagcctgtcggtccgcagcaactcgtaccgcaagccagtggccatgaccgtggaggtcggcgcgcccgtggacgaggacgaggacgaggacgaggagctgccgcccggcgcggtcttcgaggagtgcgccatatgctacaaggagtacctggtcggcggagcaacgtccgtgaagctggcgtgcagccacacgttccaccgcaagtgcctggaccgctggacggccgtgaaccggacgtgcccctactgccgggcgccggtgccggtggagcaggactactgggacgacgaggatgcttgcgacaacggggagtcggagtctgatgacatccccagcgaggagggcgacgacgaggagtcggagtatgatgacatccccagcgaggggggcgacgacgaggagacggagcatgatgacatccccagtgaggagggcgatgactgggagtcggagtatgaagacgtccccaacgaggaggacgacggctcctcgccggcgcccgacggcagtagccaggaaatcaccgcggcctctccggagtttgttagttctgtcagggatctgtccctgagctgtctaagattagattagattagattagattatattaggaagtgttagtccggttaggatctggatagtttgtttagattcagttgagggtttattgggtatatatatacctacgtacgttagcttcctgtactcagattggaataagaaagcttagttatattcc

SEQ ID NO: 187 - protein, 286 aa, Zea mays
  misc_feature (1)..(286): Ceres SEED LINE ID no. CW00792
  misc_feature (132)..(173): Pfam Name: zf-C3HC4 Pfam Description: Zinc finger, C3HC4 type (RING finger)
  misc_feature (1)..(286): Ceres Clone ID no. 225681
  misc_feature (1)..(286): Bit score of 718.3 for HMM based on sequences of Figure 21
  misc_feature (1)..(286): in Figure 21
MALHLNTVIDLTVDNYWLFRIPPITIDFLNKLPQQSEAPTPASAVTAQLTRRFTCSTGDFVLYRQPQRVEEMVTAAGLPLECAPSVAEFISLSVRSNSYRKPVAMTVEVGAPVDEDEDEDEELPPGAVFEECAICYKEYLVGGATSVKLACSHTFHRKCLDRWTAVNRTCPYCRAPVPVEQDYWDDEDACDNGESESDDIPSEEGDDEESEYDDIPSEGGDDEETEHDDIPSEEGDDWESEYEDVPNEEDDGSSPAPDGSSQEITAASPEFVSSVRDLSLSCLRLD

SEQ ID NO: 188 - protein, 217 aa, Oryza sativa subsp. japonica
  misc_feature (124)..(166): Pfam Name: zf-C3HC4 Pfam Description: Zinc finger, C3HC4 type (RING finger)
  misc_feature (1)..(217): Public GI ID no. 115480375
  misc_feature (1)..(217): Bit score of 445.8 for HMM based on sequences of Figure 21
  misc_feature (1)..(217): Functional Homolog Of SEQ ID NO. 187
  misc_feature (1)..(217): in Figure 21
MQPCGRRLLGAGTASPPPLPGLGSASAHSMDRAQRAHMVRALGVTTTVLFVASVSYIALTALYACFCDGGGRRRREDGGSSSVRPEPSEETKRALDGIPVHVVQMPPRDGGGGGADEEGGSGDCAVCLAEYAAGDEVRVLPACGHGFHRECVDRWLLTRAPTCPVCRAPVVARVEGPDDDAKEDYCGDGESVERHGGGGGDIGFLSVAGESRVLPAI

SEQ ID NO: 189 - DNA, 739 bp, Triticum aestivum
  misc_feature (1)..(739): Ceres Clone ID no. 632248
  misc_feature (1)..(739): Encodes the peptide sequence at SEQ ID NO. 190
ctgttcagtagtcgaatcggaagccgagaccagcatgaatccgaccaggagcggataataaatctgggccaggagcggcagatcgatccagtaatggaggcagcaaggggggatcccgacgaccccctcatcgcctcccgccgcggacgggtcggcgggtggtgggatcgtaaccaggacttcatacggagacgcgcggagacgctgaggcgacccgccgcccaggcggaggccgaggcagagcgtagcagagagccgccggcttccaagaactccatggcggggctgctcgtgccggcggcggcggaggtgcgggatctggagtgcgcggtgtgcctggaggacctggtggccggaggcaggaagctcaggaagatggactgctcccactgcttccaccagcgctgcatcttccgctggctgcacgtcagccggctctgcccgatgtgccgcttcgcgatgccctcccggcccgacggcgagcacgtcggcgacgaggtggagcgggagctcgcggctgaggaggaagacgccgctgacgaagaaaagtctgcagcagctgaagaacgttcgtccggtgagtgagtgaactgaactaatgattcatcggattagcgatgatggtaatgattttagtctgattcgaaatgcctcttctttactgtatactgtatatgaatatttgtttacccgctctttcacaggtagtgtacctctagcaaagatgtcatttttcttt

SEQ ID NO: 190 - protein, 163 aa, Triticum aestivum
  misc_feature (78)..(119): Pfam Name: zf-C3HC4 Pfam Description: Zinc finger, C3HC4 type (RING finger)
  misc_feature (1)..(163): Ceres Clone ID no. 632248
  misc_feature (1)..(163): Bit score of 284.1 for HMM based on sequences of Figure 21
  misc_feature (1)..(163): Functional Homolog Of SEQ ID NO. 187
  misc_feature (1)..(163): in Figure 21
MEAARGDPDDPLIASRRGRVGGWWDRNQDFIRRRAETLRRPAAQAEAEAERSREPPASKNSMAGLLVPAAAEVRDLECAVCLEDLVAGGRKLRKMDCSHCFHQRCIFRWLHVSRLCPMCRFAMPSRPDGEHVGDEVERELAAEEEDAADEEKSAAAEERSSGE

SEQ ID NO: 191 - DNA, 456 bp, Sorghum bicolor
  misc_feature (1)..(456): Ceres Annot ID no. 8657298
  misc_feature (1)..(456): Encodes the peptide sequence at SEQ ID NO. 192
atgggcctgcagagcctcgcggccgccggactcgtcctgctcctgctctacctcaccggccgcttcctctggctctacaataaggacgccgctcaggcagaggcagcagccgcatcagcatcgtccccgtcctcccggcggcggcggccggcaacagcggctggtgcgtcgacgacgtcgctgccagcagcagcctctcctccgccccgccgcgccatgccgctgtcgtcgtcgtcgtctctgctcccggtgttcttcgtcctgaacgtcggcgtgcccgccgggcccggcgcggagactgcggagtgcgcggtgtgtttgacggagttcggggagcgggaggccgggcggctcctgccggggtgcggccacgccttccacgagcagtgcatagcgacgtggctccgggtcagcaccacgtgtccgctctgccgcgcccccgtggctaccaaataa

SEQ ID NO: 192 - protein, 151 aa, Sorghum bicolor
  misc_feature (103)..(144): Pfam Name: zf-C3HC4 Pfam Description: Zinc finger, C3HC4 type (RING finger)
  misc_feature (1)..(151): Ceres Annot ID no. 8657298
  misc_feature (1)..(151): Bit score of 212.9 for HMM based on sequences of Figure 21
  misc_feature (1)..(151): Functional Homolog Of SEQ ID NO. 187
  misc_feature (1)..(151): in Figure 21
MGLQSLAAAGLVLLLLYLTGRFLWLYNKDAAQAEAAAASASSPSSRRRRPATAAGASTTSLPAAASPPPRRAMPLSSSSSLLPVFFVLNVGVPAGPGAETAECAVCLTEFGEREAGRLLPGCGHAFHEQCIATWLRVSTTCPLCRAPVATK

SEQ ID NO: 193 - protein, 315 aa, Zea mays
  misc_feature (185)..(226): Pfam Name: zf-C3HC4 Pfam Description: Zinc finger, C3HC4 type (RING finger)
  misc_feature (1)..(315): Public GI ID no. 194703722
  misc_feature (1)..(315): Bit score of 309.8 for HMM based on sequences of Figure 21
  misc_feature (1)..(315): Functional Homolog Of SEQ ID NO. 187
MSMRASLLQIDRVRLLQLWPAPAVTMPMRPRPRYAYARRPDGNYSFTIQRTALPCPGVELRFNTVIDCTWGKDPMPPITIDFHKNLPRLIEPPMPALSAVPAQMTRRFTCSSGDFVVYRQLQRVGAMVTAAGLPVECVPSVEEFIRLSALCAINLFCKTVAITVEAGADEDEDEELPPGAVAGECAICYKEYLVDGPTSVKLACSHTFHRRCLDRWTAVKSMCPYCRAPVPMEQDCWYEDDCDDSESDYDDVASEEDDDSESDYDDVASEEDDDSESDYDDVASEEGDGSSPAPDGSGQEVTASQPSSTRAQHQC

SEQ ID NO: 194 - protein, 180 aa, Oryza sativa subsp. indica
  misc_feature (87)..(129): Pfam Name: zf-C3HC4 Pfam Description: Zinc finger, C3HC4 type (RING finger)
  misc_feature (1)..(180): Public GI ID no. 125564503
  misc_feature (1)..(180): Bit score of 316.5 for HMM based on sequences of Figure 21
  misc_feature (1)..(180): Functional Homolog Of SEQ ID NO. 187
MARALGVTTTVLFVASVSYIALTALYACFCDGGGRRRREDGGSSSVRPEPSEETKRALDGIPVHVVQMPPRDGGGGGADEEGGSGDCAVCLAEYAAGDEVRVLPACGHGFHRECVDRWLLTRAPTCPVCRAPVVARVEGPDDDAKEDYCGDGESIERHGGGGGDIGFLSVAGESRVLPAI

SEQ ID NO: 195 - DNA, 916 bp, Zea mays
  misc_feature (1)..(916): Ceres Clone ID no. 313499
  misc_feature (1)..(916): Encodes the peptide sequence at SEQ ID NO. 196
gagtgatcgatcgccatgcgcggcgcgcgggtcctcctcgccggggcgccgcagccgctggcgtcggacccgtcgctggacgcgccgcagcgcgcgcagctggagcgggcgatcggggcgaccaccaccgtgctcttcgtcgccaccgtgtcgtacgtcgcgctcagcgccatcttcagctgcctctgcaccggcggcgggtcgtcccagcggcggcagcaaccagacggcagcgataccgggccgcagcggccatctgccgctgccgaggagaccaagcgcgcgctcgaggagatccccgtggtggtggtggcggcgcaggtgacgcgggaccccgctgggagtggcggcggcgccgaggacggctcggaggagccaggggagtgcgcggtgtgcctggcggagtacgcgggcggggaggaggtgcgcgtgctgcccgcttgccgccacggtttccaccgcgcgtgcgtcgaccgctggctgctcacgcgcgcgcccacctgcccggtctgccgcgcccccgtcgccgcgcacgccgagccgcccgacgccaaggaccgctccacgggcgatgtcgatgccgcgcttccctaagtgacgacagcgatctggtaacggcgttgagctcggttttgcctgttagcaakacgatgtttcaggctaaaacaaaaaagacgagaacattggttagattagatcaacgtcacttcttcacattttttttgtttaaatcaatgatgatagttgattaatggggtgtagcatcggaattacttgcccatgtttggaactttgacaggatgtacagcgttgggttgggtgtggctgtatgcagctgacaatttaacccaccacgaacctgaaaaccgacaggatgtatccaatgatgtatttccgaataagggcttgttcggtc

SEQ ID NO: 196 - protein, 192 aa, Zea mays
  misc_feature (124)..(166): Pfam Name: zf-C3HC4 Pfam Description: Zinc finger, C3HC4 type (RING finger)
  misc_feature (1)..(192): Ceres Clone ID no. 313499
  misc_feature (1)..(192): Bit score of 108.0 for HMM based on sequences of Figure 21
  misc_feature (1)..(192): Functional Homolog Of SEQ ID NO. 187
MRGARVLLAGAPQPLASDPSLDAPQRAQLERAIGATTTVLFVATVSYVALSAIFSCLCTGGGSSQRRQQPDGSDTGPQRPSAAAEETKRALEEIPVVVVAAQVTRDPAGSGGGAEDGSEEPGECAVCLAEYAGGEEVRVLPACRHGFHRACVDRWLLTRAPTCPVCRAPVAAHAEPPDAKDRSTGDVDAALP

SEQ ID NO: 197 - DNA, 1268 bp, Panicum virgatum
  misc_feature (1)..(1268): Ceres Clone ID no. 1819917
  misc_feature (1)..(1268): Encodes the peptide sequence at SEQ ID NO. 198
gagcagtgcctccgttgctgcccgctgccccgccgtcgccatgtcctccgccgccgcccgagccctcaagttcgtctcccgcgctgccttgtcctggaagccgacgaggcggccgcagcaaacgctggcggcgaccgtgagcaggtctggcgtgggcctccactcgggcgcgcgcgtcactgcaacgttaatcccggcccacgccggcgagggtaggtatttcctcgtggacggcgaggaggaggcgagggtggcggcggaggtggggaacgccgagccgcggtcgcagctctgcacgacccttcggcggggcgaaggcgggggcccgcgggtccgcacggtggagcaccttctctccgcgatggaggcgctaggcgtcgacaattgccgcgttgaggtcagcggcggcgacgagattcctttgcttgatggatcagcacaagagtgggtagaggcaatacgaagtgcaggtttgtgtgcggccgaggatacaagtgggcaaaacttggagaaactggccccacaaattaatgaacctgtttacttgcagagagatgactgcttcatagctgcattccctagttcgcgaatccgcatcagctatggaattgatttcccgaaggtgccagcaattgggtgtcgatggttttctacatacctggatgctaatatatactcaagcaagattgctccggcaagaactttctgtatatttgaagagatcgaaaaaatgcgtggtgctgggctcatcaaaggagggtcactagaaaatgctatggtttgcagcatgtctggtggttggctaaatccaccagtgcggtttgaggatgaaccttgccgtcacaagattttagatcttataggtgacttctcgcttcttgcacagaatggtaaccagggtttcccaatcgctcatatagttgcctataaggctggtcatgcgctgcacactcatttcctgtgccatctgtctggaaagatcactgtggaccaagaagagcttgctggacaatgctgaaatgcacggctcctattcatcgtagtaagttgttggtagtggttagaaagctacagttcagggtaagcacctgatgaccctcatttcaacacttcagcattctatttggagcatttccctcagacttgtagggtgtgtcagccagctgtttggtgttcgcgttgtagaaaaatcatttttgccgagctgtgtacaaattgttgaaagactgcaacttagtactactgtataaggcattcctttttgtacc

SEQ ID NO: 198 - protein, 325 aa, Panicum virgatum
  misc_feature (24)..(315): Pfam Name: LpxC Pfam Description: UDP-3-O-acyl N-acetylglycosamine deacetyla
  misc_feature (1)..(325): Ceres Clone ID no. 1819917
  misc_feature (1)..(325): Bit score of 793.3 for HMM based on sequences of Figure 4
  misc_feature (1)..(325): in Figure 4
MSSAAARALKFVSRAALSWKPTRRPQQTLAATVSRSGVGLHSGARVTATLIPAHAGEGRYFLVDGEEEARVAAEVGNAEPRSQLCTTLRRGEGGGPRVRTVEHLLSAMEALGVDNCRVEVSGGDEIPLLDGSAQEWVEAIRSAGLCAAEDTSGQNLEKLAPQINEPVYLQRDDCFIAAFPSSRIRISYGIDFPKVPAIGCRWFSTYLDANIYSSKIAPARTFCIFEEIEKMRGAGLIKGGSLENAMVCSMSGGWLNPPVRFEDEPCRHKILDLIGDFSLLAQNGNQGFPIAHIVAYKAGHALHTHFLCHLSGKITVDQEELAGQC

SEQ ID NO: 199 - DNA, 1014 bp, Sorghum bicolor
  misc_feature (1)..(1014): Ceres Annot ID no. 8642356
  misc_feature (1)..(1014): Encodes the peptide sequence at SEQ ID NO. 200
atgtcctccgccgccgcccgagccctcacgtcggtctcccgcgcagccttctcctggaagccgacggggcgcccgcagcaaacgctggcggcggcagtgagcaggtcgggcgtggggctccactcgggagcgcgcgtcaccgccacgctgttcccgacgcaagctggcgagggtaggtatttcctcgtggagggtgaggaggaggcgaaggtggcggcagaggtggggaacgccgagccacggtcgcagctctgcacgacgcttcggcgaggcgaaggcgcccacacgcgggtccggacggtggagcaccttctctcggcgatggaggcgcttggcgtcgacaattgccgtatcgaggttagcggcggtgacgagattcctttgcttgatggatcagcgcaagagtgggtagaagcaatacaaagcgttggcttgtgtgcggcagaggatgccaatgggctaaagttggataaactggcgcctgaaattcatgagcctgtttacctagggaaagatgattgctttatagctgcattccctagctcgcaaatccacatcacctatggcattgatttcccaaaggtgccaacgattgggtgtcaatgggtttctacattcctggatgagaatatatactcaagcaagattgcacctgcaagaactttctgtatatttgaagaggttgaaaaaatgcgtgctgctggactcatcaaaggagggtcactagaaaatgctatggtttgcagcatatctggtggttggctgaatccaccactgcggtttgaggatgaaccttgccgccacaagattttagatcttattggtgacttctcgctgtttgcacagaatggtaaccagggttttccaattgctcatataattgcctataaggctggtcacgcgctgcacactgattttctcagccatctgtctggaaagaacactgtggaccaagaacaacttgctgggcaatgttcaaatatatgcggctcctattcatcgtatgttcggtag

SEQ ID NO: 200 - protein, 337 aa, Sorghum bicolor
  misc_feature (22)..(315): Pfam Name: LpxC Pfam Description: UDP-3-O-acyl N-acetylglycosamine deacetyla
  misc_feature (1)..(337): Ceres Annot ID no. 8642356
  misc_feature (1)..(337): Bit score of 793.7 for HMM based on sequences of Figure 4
  misc_feature (1)..(337): Functional Homolog Of SEQ ID NO. 198
  misc_feature (1)..(337): in Figure 4
MSSAAARALTSVSRAAFSWKPTGRPQQTLAAAVSRSGVGLHSGARVTATLFPTQAGEGRYFLVEGEEEAKVAAEVGNAEPRSQLCTTLRRGEGAHTRVRTVEHLLSAMEALGVDNCRIEVSGGDEIPLLDGSAQEWVEAIQSVGLCAAEDANGLKLDKLAPEIHEPVYLGKDDCFIAAFPSSQIHITYGIDFPKVPTIGCQWVSTFLDENIYSSKIAPARTFCIFEEVEKMRAAGLIKGGSLENAMVCSISGGWLNPPLRFEDEPCRHKILDLIGDFSLFAQNGNQGFPIAHIIAYKAGHALHTDFLSHLSGKNTVDQEQLAGQCSNICGSYSSYVR

SEQ ID NO: 201 - DNA, 1317 bp, Triticum aestivum
  misc_feature (1)..(1317): Ceres Clone ID no. 935672
  misc_feature (1)..(1317): Encodes the peptide sequence at SEQ ID NO. 202
atacttctggctagtcaaactgtgatccctcgctcctccgcaccgccgccgccgctgcgatgtccaccgccgccgccgccgccggccgaggtctcaaatccgtctcccgcgccgccttctcctggaagccgacgggccgggcgcagcagacgctcgcggcggcggtgagcaggtcgggcgtgggactccactcgggcgcgcgcgccaccgccaggttgctccctgcgcgcgccggcgaggggaggtacttcgtcgtggaggaggcgagggtggcggcggaggcggggaatgccgagccacagtctccgctctgcaccacgctgcggagcgggagcggcggcgcgcgggtgcgcacggtggagcacctgctctcggccatggaggcgttcggtgtcgacaactgccgcgtcgaggtcagcggcggcgatgagatccctttgcttgatggatcagcgcaagagtgggtggaggccattcggggtgcaggtctgtgtgcggccgaggatatcggtggacagaagttggagaaactggcacccaagatcgacgagcctgtttacctgcgtaaggacgattgctttgtagctgcattcccttcctcgcaaatccacatcacctatggaattgattttccaaaggcgccagcgattggttgtcaatggttcaatactttcctggatgctgatatatactcaagcaagatagctcctgcaagaactttctgtatttttgaagaggttgaaaaaatgcgtgatgccgggcttataaaaggaggatcactggaaaatgctatggtttgcagtatgtctggtggttggcttaacccaccacttcgttttgatgatgaaccttgccgccacaagattttagatcttataggtgacttctcacttcttgcacggaatggcagccagggttttccaattgctcatgtagttgcctacaaggctggccatgccctgcacaccagtttcctacaccatttatcgggggagaccagtgtggaccaaggaacgcttgcttggtgatcttgaagcgtgtgcatgtggagcgggtactgttcatatgttggtgatagtgatgctcgacaggaagacggcagatttcagcatataccgtactaataaccatctgatggccctcgccctcactctgacagtcggaccggttgtactgtacatctcctccatctttggcaagtgatttctttagttcacgagccatatacagtatcattatcacatgctttggggagattgatccgaagaattatgtttgtacaccatgtgttatagttgtacctgaacacgtttcagt

SEQ ID NO: 202 - protein, 322 aa, Triticum aestivum
  misc_feature (25)..(314): Pfam Name: LpxC Pfam Description: UDP-3-O-acyl N-acetylglycosamine deacetyla
  misc_feature (1)..(322): Ceres Clone ID no. 935672
  misc_feature (1)..(322): Bit score of 775.4 for HMM based on sequences of Figure 4
  misc_feature (1)..(322): Functional Homolog Of SEQ ID NO. 198
  misc_feature (1)..(322): in Figure 4
MSTAAAAAGRGLKSVSRAAFSWKPTGRAQQTLAAAVSRSGVGLHSGARATARLLPARAGEGRYFVVEEARVAAEAGNAEPQSPLCTTLRSGSGGARVRTVEHLLSAMEAFGVDNCRVEVSGGDEIPLLDGSAQEWVEAIRGAGLCAAEDIGGQKLEKLAPKIDEPVYLRKDDCFVAAFPSSQIHITYGIDFPKAPAIGCQWFNTFLDADIYSSKIAPARTFCIFEEVEKMRDAGLIKGGSLENAMVCSMSGGWLNPPLRFDDEPCRHKILDLIGDFSLLARNGSQGFPIAHVVAYKAGHALHTSFLHHLSGETSVDQGTLAW

SEQ ID NO: 203 - protein, 321 aa, Oryza sativa subsp. japonica
  misc_feature (24)..(311): Pfam Name: LpxC Pfam Description: UDP-3-O-acyl N-acetylglycosamine deacetyla
  misc_feature (1)..(321): Public GI ID no. 115451651
  misc_feature (1)..(321): Bit score of 769.4 for HMM based on sequences of Figure 4
  misc_feature (1)..(321): Functional Homolog Of SEQ ID NO. 198
  misc_feature (1)..(321): in Figure 4
MCGSAARALNSVSRAAFSWKPTGLPQQTLAAAVSRSGVGLHSGAKTTATLLPARAGEGRYFVVEGEETRVAAEVANAEAHSPLCTALRRGGARVRTVEHLLSAMEALGVDNCRVEVSGGDEIPLLDGSAQEWVMAIRGAGQCAAKDSSGQKLEKLAPEIHEPVYLQKSDCFIAALPSSRIRITYGIDFPKVPGIGCQRFATVLDANVYSSKIAPARTFCIFEEVEKLRSAGLIRGGSLENATVCSISGGWLNPPLRFEDEPCRHKILDLIGDFSLLAQNGNQGFPLAHVVAYKAGHALHTDFLRHLLGRSAVGQENLAEQC

SEQ ID NO: 204 - DNA, 1382 bp, Glycine max
  misc_feature (1)..(1382): Ceres Clone ID no. 553404
  misc_feature (1)..(1382): Encodes the peptide sequence at SEQ ID NO. 205
agatatatggtatcagatgcaagatttttgccacctgccgctgctctatgttcactattgagtgtcgcgagactcatgcataatgtcttcctccaacgctctcagatcatcaaaactggtctcatggaatagaactgggaggctgcagcaaaccctagcggattgcgtggagcggcaaggcaaggcgttgcattcgggaaaggtttcgacggtgagactgtgtcccgaacgcgcttcccgaggcaggtacttcgattttcgttccaatttcgttcccgcctctgttgaattcgctcaggtctcgcccctctgcaccactctgtacaaaggcgggttccgaattcgaaccgtggagcacttgctttcggctttggaggcttcgggtgtcgataattgcaggatcgagattgaggattcggatactcaaggacacgacgcagagattcctatatttgatgggtctgcaagggaatgggtggctgcagtggaagaagttggtttgacagtggccactgatcttgatggcaaaagtgttgagaaaatggcaccacatgtgaatgaaccagtgtatgcttggagaaatgattcttttgttgctgcatttccttcagaagtggttcgaataacttatggcattaacttttcgcaggcacctgttattggctgccagtggttttctacaccccccttggataatttggtgtattccatgcagatagctttgtcaagaaccttctgcatttatgaagaggttgagcaaatgcgcaatgctggacttatcaaaggaggttctctagaaaatgccattgtgtgcagtgccagtaaaggttggttgaatccacctttgcatttcagtgatgaaccatgtcgtcacaagatcttagaccttattggtgatctgtcactgtttgcccagtttgggaatcaaggactcccagtggctcatatcgttgcgtacaagggtggccatgcattgcatactgatttggcacgccgcctgataggaatgatttgagaggctatcatgttgccagtggtttactaagaagttattggtattttaggtgacttcgttggagtagttgttcaacctgatgcttctgagctcttatttatgtgcagccaaggtggaagaagaaatgctgaaattcctaaacatcttgtattattattctgtctcttcattgtttctatcgtcatcaattttgtaatgaaagcatccaagcaaaccattttgtaaaagaaagccattcaattttccatcatttcagattttatagggaagccgtatagccataatcaagctcaaagatgcttcgacaacatttgatggaattatgatttaattcaatttttatgctaatagtaggaatccatctttc

SEQ ID NO: 205 - protein, 310 aa, Glycine max
  misc_feature (18)..(307): Pfam Name: LpxC Pfam Description: UDP-3-O-acyl N-acetylglycosamine deacetyla
  misc_feature (1)..(310): Ceres Clone ID no. 553404
  misc_feature (1)..(310): Bit score of 775.1 for HMM based on sequences of Figure 4
  misc_feature (1)..(310): Functional Homolog Of SEQ ID NO. 198
  misc_feature (1)..(310): in Figure 4
MSSSNALRSSKLVSWNRTGRLQQTLADCVERQGKALHSGKVSTVRLCPERASRGRYFDFRSNFVPASVEFAQVSPLCTTLYKGGFRIRTVEHLLSALEASGVDNCRIEIEDSDTQGHDAEIPIFDGSAREWVAAVEEVGLTVATDLDGKSVEKMAPHVNEPVYAWRNDSFVAAFPSEVVRITYGINFSQAPVIGCQWFSTPPLDNLVYSMQIALSRTFCIYEEVEQMRNAGLIKGGSLENAIVCSASKGWLNPPLHFSDEPCRHKILDLIGDLSLFAQFGNQGLPVAHIVAYKGGHALHTDLARRLIGMI

SEQ ID NO: 206 - DNA, 972 bp, Populus balsamifera subsp. trichocarpa
  misc_feature (1)..(972): Ceres Annot ID no. 1517043
  misc_feature (1)..(972): Encodes the peptide sequence at SEQ ID NO. 207
atggctatctccggtgcactcaacgctctaaagtcatccgaactcgtctcctggaaaccatgtggcagggttcaacaaacactaaagagatgcgtggaggcaagtgggacgacactccactcaggaaaatcttcaacagtaaggctattgccagagctagcaggcaaagggcgctacttctatttcaactccaaatcaattccagcatccatcgattacgcacaagaatcgtctctttgcacaactctctccaacgacggtgttaaaattcgaaccgtcgagcacttgctttccgctctcgaggctatgagtgtcgataattgccgtattgaaattaccaatcttgactctgatgattccgacttggattccgaggtaggtcagactcagtcagtcatggttcctatattggatggttcggcgagggaatgggtggagagaatagaaaaagatggtttagtggcagccaaagatgagtgtgggaatgactgtgagaaactggctccctatttgaatgagcccatccatgtatcgaagaatgattcgtttgtggcagcgtttccatcaccgaaagttcgagttagttatgggattgattttcctcaggttgccattggctcccagtggttttccttagctcctctggaggattctctttatgccagagaaatagctccatcaaggaccttttgcatatatgaggaggtggagtatatgcgcaatgcaggacttattaaagggggctcactagacaatgccattgtttgtagtgccagcaaaggttggttgaatccaccactgcgtttctctgatgaaccatgtcgtcacaagatcttggatcttgttggtgacctttccctgtttgcacggtttggtaatcaaggactcccagtggcacacatagttgtttacaaggcatgtattatttatttatttatttatttgcatgtttttgctaatatggtccggtag

SEQ ID NO: 207 - protein, 323 aa, Populus balsamifera subsp. trichocarpa
  misc_feature (21)..(323): Pfam Name: LpxC Pfam Description: UDP-3-O-acyl N-acetylglycosamine deacetyla
  misc_feature (1)..(323): Ceres Annot ID no. 1517043
  misc_feature (1)..(323): Bit score of 757.4 for HMM based on sequences of Figure 4
  misc_feature (1)..(323): Functional Homolog Of SEQ ID NO. 198
  misc_feature (1)..(323): in Figure 4
MAISGALNALKSSELVSWKPCGRVQQTLKRCVEASGTTLHSGKSSTVRLLPELAGKGRYFYFNSKSIPASIDYAQESSLCTTLSNDGVKIRTVEHLLSALEAMSVDNCRIEITNLDSDDSDLDSEVGQTQSVMVPILDGSAREWVERIEKDGLVAAKDECGNDCEKLAPYLNEPIHVSKNDSFVAAFPSPKVRVSYGIDFPQVAIGSQWFSLAPLEDSLYAREIAPSRTFCIYEEVEYMRNAGLIKGGSLDNAIVCSASKGWLNPPLRFSDEPCRHKILDLVGDLSLFARFGNQGLPVAHIVVYKACIIYLFIYLHVFANMVR

SEQ ID NO: 208 - protein, 315 aa, Vitis vinifera
  misc_feature (21)..(313): Pfam Name: LpxC Pfam Description: UDP-3-O-acyl N-acetylglycosamine deacetyla
  misc_feature (1)..(315): Public GI ID no. 157339009
  misc_feature (1)..(315): Bit score of 768.3 for HMM based on sequences of Figure 4
  misc_feature (1)..(315): Functional Homolog Of SEQ ID NO. 198
  misc_feature (1)..(315): in Figure 4
MSVSSALNAFKSSALISWKSLGKLQQTIAGCIERSGITLHSGRVARVKIWPECAGVGRYFDFRSNFIHPSVDYVQESPLCTTLCKDGYKVRTVEHLLSALEAMGVDNCRIEVEGLNGEESSVEVPIFDGSAKEWVEAIEQVGLKVATDQGGNSCEKMIPFLIEPVHVHRNDSFIAAFPYPKVQIIYGIDFPQVPAIGCQWFSSASLDDSFYTSEIGPSRTFCVYEEVEKLRNLGLIKGGSTDSAIVCSASKGWLNPPLRFPDEPCRHKVLDLIGDLSLFARHGSQGFPVAQIVGYKACFFHCLFPSKVFLSLLVR

SEQ ID NO: 209 - protein, 339 aa, Physcomitrella patens subsp. patens
  misc_feature (42)..(331): Pfam Name: LpxC Pfam Description: UDP-3-O-acyl N-acetylglycosamine deacetyla
  misc_feature (1)..(339): Public GI ID no. 167997651
  misc_feature (1)..(339): Bit score of 713.9 for HMM based on sequences of Figure 4
  misc_feature (1)..(339): Functional Homolog Of SEQ ID NO. 198
  misc_feature (1)..(339): in Figure 4
MRSLSYLAAIAASSSLSSSSSSSQQIGRASSRVSHVYRASQLQQTIATTATRIGVGLHSGQGATVKLVPARANEGRYFVKLHRKEPAVIVPAIVNNTIDTRLSTCLGRNGSTVRTVEHLMSALEGLGVDNCRIEIEGGNEVPLLDGSAREWVEAIEESGLSIAKDYAGFGSARNAYVLDSPITVHQGDSFVAAFPSPFTRLTYGIDFPHVPAIGLRWFCWTPSGPSSYKHEVAPARTFGIAEQLEQLRAAGLIKGGSLDNALVCSTEEGWLNPPLRFDDEPCRHKLLDLIGDLALCAAPGHPGLPIAHIVAFKASHALHVKFGAALLQHQMKLHNLVQV

SEQ ID NO: 210 - protein, 326 aa, Arabidopsis thaliana
  misc_feature (36)..(326): Pfam Name: LpxC Pfam Description: UDP-3-O-acyl N-acetylglycosamine deacetyla
  misc_feature (1)..(326): Public GI ID no. 186478838
  misc_feature (1)..(326): Bit score of 744.7 for HMM based on sequences of Figure 4
  misc_feature (1)..(326): Functional Homolog Of SEQ ID NO. 198
  misc_feature (1)..(326): in Figure 4
MRLPVTVKATKPSFLVIWIRYSSAASSPTVSLNPSGRLQQTLAGSVEVKGKSLHSGKFSTVKLNPEIAGAGRFFEFRSRFIPASIEFAQESPLCTTLLKDELKIRTVEHLLSALEAKGVDNCRIQIESESSDDREVEVPIFDGSAKEWVDAIQGVGINAAQNHDGESVEKMVAHVNKPVYVCKNDTFVAAFPALETRITCGIDFPQVPAIGCQWFSWRPIHESSFAKDIASSRTFCVYEEVERMREAGLIKGGSLDNAIVCSAEHGWMNPPLRFDDEACRHKILDLIGDLSLVSRGGNGGLPVAHIVAYKAGHALHTDLARHLTMD

SEQ ID NO: 211 - protein, 315 aa, Oryza sativa subsp. japonica
  misc_feature (24)..(305): Pfam Name: LpxC Pfam Description: UDP-3-O-acyl N-acetylglycosamine deacetyla
  misc_feature (1)..(315): Public GI ID no. 24308613
  misc_feature (1)..(315): Bit score of 742.3 for HMM based on sequences of Figure 4
  misc_feature (1)..(315): Functional Homolog Of SEQ ID NO. 198
MCGSAARALNSVSRAAFSWKPTGLPQQTLAAAVSRSGVGLHSGAKTTATLLPARAGEGRYFVVEGEETRVAAEVANAEAHSPLCTALRRGGARVRTVEHLLSAMEALGVDNCRVEIPLLDGSAQEWVMAIRGAGQCAAKDSSGQKLEKLAPEIHEPVYLQKSDCFIAALPSSRIRITYGIDFPKVPGIGCQRFATVLDANVYSSKIAPARTFCIFEEVEKLRSAGLIRGGSLENATVCSISGGWLNPPLRFEDEPCRHKILDLIGDFSLLAQNGNQGFPLAHVVAYKAGHALHTDFLRHLLGRSAVGQENLAEQC

SEQ ID NO: 212 - DNA, 921 bp, Populus balsamifera subsp. trichocarpa
  misc_feature (1)..(921): Ceres Annot ID no. 1463744
  misc_feature (1)..(921): Encodes the peptide sequence at SEQ ID NO. 213
atggctatctccggtgcactcaacgctctaaagtcatccgaactcgtctcctggaaaccatgtggcagggttcaacaaacactaaagagatgcgtggaggcaagtgggacgacactccactcaggaaaatcttcaacagtaaggctattgccagagctagcaggcaaagggcgctacttctatttcaactccaaatcaattccagcatccatcgattacgcacaagaatcgtctctttgcacaactctctccaacgacggtgttaaaattcgaaccgtcgagcacttgctttccgctctcgaggctatgagtgtcgataattgccgtattgaaattaccaatcttgactctgatgattccgacttggattccgaggtaggtcagactcagtcagtcatggttcctatattggatggttcggcgagggaatgggtggagagaatagaaaaagatggtttagtggcagccaaagatgagtgtgggaatgactgtgagaaactggctccctatttgaatgagcccatccatgtatcgaagaatgattcgtttgtggcagcgtttccatcaccgaaagttcgagttagttatgggattgattttcctcaggttgccattggctcccagtggttttccttagctcctctggaggattctctttatgccagagaaatagctccatcaaggaccttttgcatatatgaggaggtggagtatatgcgcaatgcaggacttattaaagggggctcactagacaatgccattgtttgtagtgccagcaaaggttggttgaatccaccactgcgtttctctgatgaaccatgtcgtcacaagatcttggatcttgttggtgacctttccctgtttgcacggtttggagcatgtcatggtaatattgctcctgttttccccttgtgttgttga

SEQ ID NO: 213 - protein, 306 aa, Populus balsamifera subsp. trichocarpa
  misc_feature (21)..(306): Pfam Name: LpxC Pfam Description: UDP-3-O-acyl N-acetylglycosamine deacetyla
  misc_feature (1)..(306): Ceres Annot ID no. 1463744
  misc_feature (1)..(306): Bit score of 670.1 for HMM based on sequences of Figure 4
  misc_feature (1)..(306): Functional Homolog Of SEQ ID NO. 198
MAISGALNALKSSELVSWKPCGRVQQTLKRCVEASGTTLHSGKSSTVRLLPELAGKGRYFYFNSKSIPASIDYAQESSLCTTLSNDGVKIRTVEHLLSALEAMSVDNCRIEITNLDSDDSDLDSEVGQTQSVMVPILDGSAREWVERIEKDGLVAAKDECGNDCEKLAPYLNEPIHVSKNDSFVAAFPSPKVRVSYGIDFPQVAIGSQWFSLAPLEDSLYAREIAPSRTFCIYEEVEYMRNAGLIKGGSLDNAIVCSASKGWLNPPLRFSDEPCRHKILDLVGDLSLFARFGACHGNIAPVFPLCC

SEQ ID NO: 214 - protein, 367 aa, Vitis vinifera
  misc_feature (60)..(350): Pfam Name: LpxC Pfam Description: UDP-3-O-acyl N-acetylglycosamine deacetyla
  misc_feature (1)..(367): Public GI ID no. 147769548
  misc_feature (1)..(367): Bit score of 663.1 for HMM based on sequences of Figure 4
  misc_feature (1)..(367): Functional Homolog Of SEQ ID NO. 198
  misc_feature (43)..(43): Xaa is any aa, unknown, or other
MSVSSALNAFKSSALISWKSVHYTLTFSFSLQTLILLMETSDXRRNLLMCFLIAAWEAPANHSGVVARVKIWPECAGVGRYFDFRSNFIHPSVDYVQDSPLCTTLCKDGYKVRTVEHLLSALEAMGVDNCRIEVEGLNGEESSVEVPIFDGSAKEWVEAIEQVGLKVATDQGGNSCEKMIPFLIEPVHVHTNDSFIAAFPYPKVQIIYGIDFPQVPAIGCQWFSSASLDDSFYTSEIGPSRTFCVYEEVSVPNAGVYLEKSLQVEKLRNLGLIKGGSTDSAIVCSASKGWLNPPLRFPDEPCRHKVLDLIGDLSLFARHGSQGFPVAQIVGYKACFFHCLFPSKVFLSLLGGHALHADFVRRLSGIS

SEQ ID NO: 215 - protein, 280 aa, Nostoc sp. PCC 7120
  misc_feature (1)..(280): Pfam Name: LpxC Pfam Description: UDP-3-O-acyl N-acetylglycosamine deacetyla
  misc_feature (1)..(280): Public GI ID no. 17229762
  misc_feature (1)..(280): Bit score of 352.2 for HMM based on sequences of Figure 4
  misc_feature (1)..(280): Functional Homolog Of SEQ ID NO. 198
MKQHTLAEAIAHTGVGLHSGVSTHVRILPADAGSGRYFVRVDLPDSPTIPAQVAVVSQTVLSTQLGGGETGVRTVEHLLAALAGMGVDNARIEIDGPEIPLLDGSAQEWVTSIAEVGLVAQAVTNNLASFDIQEPIWIHQDDAFVAAIPASETRFSYGIDFDLPAIGNQWYSWSLTTEPDTSFAQEIAPARTFGLLHQIEYLQKSGLIKGGSLDNALICGPDGWVNPPLRFANEPVRHKILDLVGDLSLLGYFPRAHFLAYKASHNLHIQLAQRILALSN

SEQ ID NO: 216 - protein, 280 aa, Anabaena variabilis ATCC 29413
  misc_feature (1)..(280): Pfam Name: LpxC Pfam Description: UDP-3-O-acyl N-acetylglycosamine deacetyla
  misc_feature (1)..(280): Public GI ID no. 75906320
  misc_feature (1)..(280): Bit score of 359.1 for HMM based on sequences of Figure 4
  misc_feature (1)..(280): Functional Homolog Of SEQ ID NO. 198
MKQHTLAEAIAHTGVGLHSGVSTHVRILPADAGSGRYFVRVDLPDSPIIPAQVAAVSQTVLSTQLGKGEAGVRTVEHLLAALAGMGVDNARIEIDGSEVPLLDGSAQEWVKSIAEVGLVTQAVTDNTVSWDIPEPIWIHQDDAFVAAIPASETRFSYGIDFDLPAIGNQWYSWPLTTESDTSFAKEVAPARTFGLLHQIEYLQKSGLIKGGSLDNALVCGPDGWVNPPLRFANEPVRHKILDLVGDLSLLGYFPRAHFLAYKASHNLHIQLAQRILALSN

SEQ ID NO: 217 - protein, 332 aa, Synechococcus sp. PCC 7335
  misc_feature (57)..(331): Pfam Name: LpxC Pfam Description: UDP-3-O-acyl N-acetylglycosamine deacetyla
  misc_feature (1)..(332): Public GI ID no. 225148780
  misc_feature (1)..(332): Bit score of 371.5 for HMM based on sequences of Figure 4
  misc_feature (1)..(332): Functional Homolog Of SEQ ID NO. 198
MSYVDDQVLASRTPVPMPNTNAQKVSQDKVISQNKVISQNLVAQSLAARIEADQDSKQQTLSSSVSIEGVGLHLGQQTTVKLSPAEPNAGRYFVRTDIAEDLPVAATVGNVIQTQLSTELGVNSSTVRTVEHLLSTLAALDIDNVRIEIDGPELPLLDGSAKNWVEAIAAIPIQAQSAQRQVRSPLSQPIFVQSEDAWVAAFPSHELRFTYGIDFELAAIGNQWHSWSKAAGGFASDIAPARTFGLAHQIEYLRQQGLIKGGTLDNALVCGEKGWLNPPLRFENEPARHKLLDLIGDLALLGDIPTAHYVAYKASHSLHVELARQLETSYLL

SEQ ID NO: 218 - protein, 301 aa, Microcoleus chthonoplastes PCC 7420
  misc_feature (1)..(287): Pfam Name: LpxC Pfam Description: UDP-3-O-acyl N-acetylglycosamine deacetyla
  misc_feature (1)..(301): Public GI ID no. 224402519
  misc_feature (1)..(301): Bit score of 340.5 for HMM based on sequences of Figure 4
  misc_feature (1)..(301): Functional Homolog Of SEQ ID NO. 198
MGAAFERSGIGLHSGITTTVRVLPAAAGMGRYFVRVDLPGKPMIPARVEAVSTTMLSTQLRAGKGETSADSEVTVRTVEHLLAALAGSGVDDACIEIDGPEVPLLDGSALAWIKAIQEVGMVESERPQHSSHLSFLASPIVIEEPIWICQDDAFVAALPAPITRFTYGIDFENPAIGNQWHSWTPEQEHFADAIAPARTFGLANQVDQLRDRGLIKGGSLENALVCGDHGWLNPPLRFSNEPVRHKLLDLVGDLSLLGKFPVAHVLAYKASHTLHIQLARLLAQQIGAGDVSRQSSAVIGN

SEQ ID NO: 219 - protein, 275 aa, Synechococcus sp. PCC 7002
  misc_feature (1)..(275): Pfam Name: LpxC Pfam Description: UDP-3-O-acyl N-acetylglycosamine deacetyla
  misc_feature (1)..(275): Public GI ID no. 170076947
  misc_feature (1)..(275): Bit score of 323.7 for HMM based on sequences of Figure 4
  misc_feature (1)..(275): Functional Homolog Of SEQ ID NO. 198
MVKTLKTTVECSGVGLHSGQRVTLRLVPGDRHQGRYFVRTDLPGQPQIPARIEAVDQTLLSTELAVGEAKVRTTEHLLAALVGLGIDVVRLEIDGPELPLLDGSAAQWVEAIAKAGTQTLTDEAIAVPVVAEPVWLREDDAFVVALPSLELRFTYGIDFTYKPIGNQWHSWSPAAEPFAQAIAPARTFGFADQIEQLKKAGLIQGGSLDNALVCDQEKWLNPPLRFDNEPARHKLLDLIGDLSLLGTIPTAHYLAYKASHKLHTQLAKTLQAMLF

SEQ ID NO: 220 - protein, 275 aa, Synechocystis sp. WH 8501
  misc_feature (1)..(273): Pfam Name: LpxC Pfam Description: UDP-3-O-acyl N-acetylglycosamine deacetyla
  misc_feature (1)..(275): Public GI ID no. 67924367
  misc_feature (1)..(275): Bit score of 325.1 for HMM based on sequences of Figure 4
  misc_feature (1)..(275): Functional Homolog Of SEQ ID NO. 198
MTSTIEKGITVSGIGLHSGANTEVRILPNYGNQGRYFVRVDLPEKPIIPATVSAVNQTLLSTELMANGAKIRTVEHLLAALNGCGIENACIEIDGPEVPLLDGSAQNWVEAMLESGLSPSEMVIGSPITEPVWVRDGDAFVAAIPAPEIRFSYGVDYPYQAIGNQWVSWNPKKEPFQELIAPARTFGFADQIEQLKQSGLIKGGSLDNALVCDRSGWLNPPLRFENEPVRHKLLDLIGDLSLLGTIPQAHFLAYKASHKLHVQLAQALSKNTGVQ

SEQ ID NO: 221 - protein, 302 aa, Cyanothece sp. PCC 7822
  misc_feature (20)..(300): Pfam Name: LpxC Pfam Description: UDP-3-O-acyl N-acetylglycosamine deacetyla
  misc_feature (1)..(302): Public GI ID no. 196258900
  misc_feature (1)..(302): Bit score of 362.5 for HMM based on sequences of Figure 4
  misc_feature (1)..(302): Functional Homolog Of SEQ ID NO. 198
MIKEILASILVLGKDFKSYMNTIKEPFERSGVGLHSGVTTTVKVLPASWGEGRYFVRVDLPEKPVIPARIDFVHQTTLSTELANNSHAVRTVEHLLAALGGSGIDDVRIEIDGPEVPLLDGSAKEWVSAIASVGITGSKNEANLPSSLTAIVTSVISVQEGEAFVAAFPSSETRFTYGIDFAYSAIGNQWFSWSPLTETFAEAIAPARTFGLADQIEFLQKAGLIKGGNLENALVCDHQGWLNPPLRFSNEPVRHKLLDLVGDLSLLGKIPQAHFLAYKASHKLHLQLAKAIDGIFSKTPTH

SEQ ID NO: 222 - protein, 292 aa, Nostoc punctiforme
  misc_feature (1)..(282): Pfam Name: LpxC Pfam Description: UDP-3-O-acyl N-acetylglycosamine deacetyla
  misc_feature (1)..(292): Public GI ID no. 186683207
  misc_feature (1)..(292): Bit score of 329.9 for HMM based on sequences of Figure 4
  misc_feature (1)..(292): Functional Homolog Of SEQ ID NO. 198
MQQHTLAAEITQVGVGLHSGVNTQVRILPDETGSGRYFVRVDLPDLPIIPAQVAAVSHTVLSTQLGKGEVYVRTVEHLLAALSGMGVDNARIEIDGSEVPLLDGSASVWVANIAQVGLVSQPVNNQVPLTVTEPIWVYQGDAFVCALPAPETRFSYGIEFDLPAIGNQWYSWSLTTELEKASASFAAEIAPARTFGLLHQIEHLQKTGLIKGGSLDNALVCGPEGWLNPPLRFANEPVRHKILDLVGDLSLLGAFPRAHFLAYKASHNLHIQLAQKILDFGFDFAQSNDFRF

SEQ ID NO: 223 - protein, 276 aa, Synechocystis sp. PCC 6803
  misc_feature (1)..(276): Pfam Name: LpxC Pfam Description: UDP-3-O-acyl N-acetylglycosamine deacetyla
  misc_feature (1)..(276): Public GI ID no. 16329599
  misc_feature (1)..(276): Bit score of 306.1 for HMM based on sequences of Figure 4
  misc_feature (1)..(276): Functional Homolog Of SEQ ID NO. 198
MGHTIKAPLTVQGVGLHSGVETTVTLCPVAAGKGRYFQRVDLPKKPIIPADLTWVREAMLSTELGEPGATIRTVEHLLATLVALDIGDLRIEVNGPEVPLLDGSALSWLTAIAKVGTRPRSKKSQDQPIVITDPLTCQLEDAFVAAFPCATTRFSYGVDYPYLPIGKQWYTWEPDQENFATAIAPARTFGFADQIEKLRQAGLIKGGSLENALVCDKEKWLNPPLRFPDEPVRHKLLDLLGDLSLLGKIPQAHFVAYKASHKLHTQLAQKIADTYR

SEQ ID NO: 224 - protein, 271 aa, Cyanothece sp. PCC 8802
  misc_feature (1)..(271): Pfam Name: LpxC Pfam Description: UDP-3-O-acyl N-acetylglycosamine deacetyla
  misc_feature (1)..(271): Public GI ID no. 196244340
  misc_feature (1)..(271): Bit score of 316.6 for HMM based on sequences of Figure 4
  misc_feature (1)..(271): Functional Homolog Of SEQ ID NO. 198
MSSIIKEVITVSGIGLHSGTTTQVRISSAKPGEGRYFVRVDLPENPIIKAEVASVNQTTLSTELGHTEAKVRTVEHLLAALTGIGVENARIEIDGPEVPLLDGSALEWVKAMVQGGIIPSSLPSGSPVLDPIWIQDGDAFVAALPASETRFTYGIDFPYPAIGNQWYSWNPGLESFEDAIAPARTFGFADQIEQLQKMGLIKGGSLDNALVCDREKWLNPPLRFDNEPARHKLLDLIGDLSLLGTIPQAHFLAYKASHKLHVQLAKVISEQ

SEQ ID NO: 225 - protein, 270 aa, Microcystis aeruginosa NIES-843
  misc_feature (1)..(270): Pfam Name: LpxC Pfam Description: UDP-3-O-acyl N-acetylglycosamine deacetyla
  misc_feature (1)..(270): Public GI ID no. 166366663
  misc_feature (1)..(270): Bit score of 321.6 for HMM based on sequences of Figure 4
  misc_feature (1)..(270): Functional Homolog Of SEQ ID NO. 198
MVSTIAKQFELSGIGLHSGEITRVRVCGANPGEGRYFVRRDLANQPIIPALVSSVYQTTLSTELGQGEAKVRTVEHLLAALTALGVEDARIEVDGAEIPLLDGSAKIWVEAIENAGLNNSFSPSDLTISQPIWLYEGDAFVAAIPSPELRFTYGIDFTYKPIGNQWYSWSPDQESFSQAIASARTFGFADQIEYLQKAGLIKGGSLENALVCDQNQWLNPPLRFENEPVRHKLLDLIGDLSLLGTIPTAHYMAFKASHKLHVQLAKAIQG

SEQ ID NO: 226 - protein, 301 aa, Trichodesmium erythraeum IMS101
  misc_feature (3)..(301): Pfam Name: LpxC Pfam Description: UDP-3-O-acyl N-acetylglycosamine deacetyla
  misc_feature (1)..(301): Public GI ID no. 113476833
  misc_feature (1)..(301): Bit score of 330.9 for HMM based on sequences of Figure 4
  misc_feature (1)..(301): Functional Homolog Of SEQ ID NO. 198
MNMNYQYTLGGEFSRSGVGLHSGIKSHVKIMSAPQNTGRYFVRIDLPNYPVIPAIVSSVISTTLSTELGTRDIRIRTVEHLLAALAGMGIDNARIEIDSPEIPLLDGSAKVWTEAIASIGLVKAKGVDEEVGKWRDETIEINNTHLQQLKAHKLPVISQPVWIYQGDSFVAALPSLETRFTYGIDFDLPAIGNQWYSWSPQTESFTDSIAPARTFGLSYQIDQLREAGLIKGGSLDNALVCSETGWLNPPLRFTNEPVRHKILDLIGDLSLLGSFPQAHYFAYKASHKLHIQLAQKILELN

SEQ ID NO: 227 - protein, 272 aa, Cyanothece sp. ATCC 51142
  misc_feature (1)..(272): Pfam Name: LpxC Pfam Description: UDP-3-O-acyl N-acetylglycosamine deacetyla
  misc_feature (1)..(272): Public GI ID no. 172037292
  misc_feature (1)..(272): Bit score of 316.7 for HMM based on sequences of Figure 4
  misc_feature (1)..(272): Functional Homolog Of SEQ ID NO. 198
MTSIIEKGFTVSGIGLHSGAKTQVHVLPDDRNQGRYFVRVDLPEKPMIPATVSAVNQTLLSTELMADTATVRTVEHLLAALTGCGIENACIEIDGPEVPLLDGSAKNWVDAIIASGLNPSEMAVGSPVIEPVWVREGDAFVAAIPAPDIRFTYGIDFPYPAIGNQWVSWSPKTEPFQDFIAPARTFGFADQIEQLKQAGLIKGGSLENALICDRSGWVNPPLRFDNEPVRHKLLDLIGDLSLLGTIPQAHFLAYKASHKLHIQLADILYQNK

SEQ ID NO: 228 - protein, 285 aa, Thermosynechococcus elongatus BP-1
  misc_feature (11)..(285): Pfam Name: LpxC Pfam Description: UDP-3-O-acyl N-acetylglycosamine deacetyla
  misc_feature (1)..(285): Public GI ID no. 22299333
  misc_feature (1)..(285): Bit score of 333.5 for HMM based on sequences of Figure 4
  misc_feature (1)..(285): Functional Homolog Of SEQ ID NO. 198
MIAASGPTPLVATTQRTLAGTAQWSGVGLHSGQWVALTLQPAAANTGRQFVRLDLEGQPVIPARIEAVKSTQLATELVANGASVRTVEHLLAALAIAGIDNVTIQITGPEVPVLDGSAQPWLEGIQRVGVVPQEAPRPAVILKEPVTIYEGEAFVSAIPAPELRLTYGIDFPYRAIGRQWCSFTPSELATEVAPARTFGFAEQVDYLRSQGLIQGGSLENALVCSASGWVNPPLRFADEPVRHKLLDLWGDLALLGTPPIAHYVAYRASHHLHTQLARAIAQQRV

SEQ ID NO: 229 - protein, 270 aa, Microcystis aeruginosa PCC 7806
  misc_feature (1)..(270): Pfam Name: LpxC Pfam Description: UDP-3-O-acyl N-acetylglycosamine deacetyla
  misc_feature (1)..(270): Public GI ID no. 159027881
  misc_feature (1)..(270): Bit score of 311.2 for HMM based on sequences of Figure 4
  misc_feature (1)..(270): Functional Homolog Of SEQ ID NO. 198
MVSTISKQFELSGIGLHSGEITRVRVCGANPGEGRYFVRRDLANQPIIPALVSSVYQTTLSTELGRGEAKVRTVEHLLAALTALGVEDARIEVDGAEIPLLDGSAKIWVEAIKNAGLNNSFSPSDLTISQPIWLYEGDAFVAAIPSPELRFTYGIDFTYKPIGNQWYSWSPNQESFQNAIADARTFGFADQIEYLQKAGLIKGGSLENALICDQNQWLNPPLRFDNEPARHKLLDLIGDLSLLGTIPTAHYMAFKASHKLHVQLAKAIQG

SEQ ID NO: 230 - protein, 257 aa, Acaryochloris marina MBIC11017
  misc_feature (1)..(256): Pfam Name: LpxC Pfam Description: UDP-3-O-acyl N-acetylglycosamine deacetyla
  misc_feature (1)..(257): Public GI ID no. 158333778
  misc_feature (1)..(257): Bit score of 270.2 for HMM based on sequences of Figure 4
  misc_feature (1)..(257): Functional Homolog Of SEQ ID NO. 198
MGLHTGATATVTVYPAPPHQGRYFGYQDQPDIPAHLSSVHQTQFCTTLKQADTTIATVEHLLAALAGMGIDNARIDLDGPEVPILDGSAQRWTEAILKAGYQVQSELRLRPTLHHPVLVQDADAFVMALPEPHLSFSYGIEFPEPAIGKQWYRLSPNAFLSDIAPARTFGRAKDVESLQAKGFIKGGSLDNALVCRQDEWLNPPLRFANEPVRHKLLDLIGDLSLLGYFPPAHYVAYKASHSLHIRFAKRLQQALLG

SEQ ID NO: 231 - protein, 284 aa, Synechococcus sp. JA-2-3B'a(2-13)
  misc_feature (1)..(278): Pfam Name: LpxC Pfam Description: UDP-3-O-acyl N-acetylglycosamine deacetyla
  misc_feature (1)..(284): Public GI ID no. 86610210
  misc_feature (1)..(284): Bit score of 272.1 for HMM based on sequences of Figure 4
  misc_feature (1)..(284): Functional Homolog Of SEQ ID NO. 198
MRGRQHTLASSIALEGVGLHTGLPIGCSLHPAPAGSGRVFVRVDQPGSPEIPARLGSLAPAHLCTLLQQGSPSVQVQTVEHLLAALYILGIDNCRIEVEGPELPILDGSALPFVEAIAQAGIQAQDQPALLGVIQEPVTVWAGEAFVSALPHPTARFTYGIDFADCPIGEQWLSWRENRPDFVQSIAPARTFARQQDVELARERGLIQGGSLENAIVCSQTEWLGPLRYPDEPVRHKLIDLLGDLSLLGCRLQGHIVAYKAGHALHHRLAEQLLKSGSLLIHEE

SEQ ID NO: 232 - protein, 290 aa, Lyngbya sp. PCC 8106
  misc_feature (2)..(287): Pfam Name: LpxC Pfam Description: UDP-3-O-acyl N-acetylglycosamine deacetyla
  misc_feature (1)..(290): Public GI ID no. 119491435
  misc_feature (1)..(290): Bit score of 289.1 for HMM based on sequences of Figure 4
  misc_feature (1)..(290): Functional Homolog Of SEQ ID NO. 198
MTENTQHTLASEIIQSGIGLHSGLKTTVRILPSSAVGRYFVRVDLPEEPIIPATIKSVVSTTLSTELAIADHINYSNPHLKPSIRTVEHLLSALTLMGVDHARIEIDGPEIPLLDGSAKIWARAIANAGLAITCQTTPIIPISQEIIVRQGDAFVMAIPADETRFSYAIDFEMAAIGQQWHSWVPQQEDFLTAIAPARTFVLDHQVEHLQQAGLIKGGTLDNALVCGDDGWLNPPLRFSNEPVRHKILDLVGDLSLLGVIPQAHYLAYKAGHHLHTQLVQRIQQVALAAH

SEQ ID NO: 233 - protein, 303 aa, Synechococcus sp. JA-3-3Ab
  misc_feature (1)..(278): Pfam Name: LpxC Pfam Description: UDP-3-O-acyl N-acetylglycosamine deacetyla
  misc_feature (1)..(303): Public GI ID no. 86606600
  misc_feature (1)..(303): Bit score of 268.6 for HMM based on sequences of Figure 4
  misc_feature (1)..(303): Functional Homolog Of SEQ ID NO. 198
MREQQHTLASSISLEGVGLHTGLPVRCSLHPAPASSGRVFVRVDQRGSPPIPARLGSLAPAALCTRLQQGSPPVQVQTVEHLLAALYVLGIDNCRIEVEGPELPILDGSALPFVEAVAQAGILAQEQPALLGVIQEPVTVWAGEAFVSAVPYPGFRFTYGIDFADCPIGQQWLSWRENRADFVQSIAPARTFARQQDAELAHQQGLIQGGSLENAIVCSKTEWLGPLRFPDEPVRHKLIDLLGDLSLLGCRLQGHIVAYKAGHALHHRLAEQLLKSGSLQVEPAQEQARDPLCLGGVESRSSF

SEQ ID NO: 234 - protein, 278 aa, Nodularia spumigena CCY9414
  misc_feature (1)..(275): Pfam Name: LpxC Pfam Description: UDP-3-O-acyl N-acetylglycosamine deacetyla
  misc_feature (1)..(278): Public GI ID no. 119511195
  misc_feature (1)..(278): Bit score of 301.2 for HMM based on sequences of Figure 4
  misc_feature (1)..(278): Functional Homolog Of SEQ ID NO. 198
MQQHTIAGEITQAGVGLHSGVITNVRILPSEPDTGRYFVRVDLPDLPIIPAQVAAVNQTLLSTQLGKGEACIRTVEHLLAALAGMSVDNARIEIDGSEVPLLDGSARVWTESIAQVGLVSQPISNPVPWVVKEPIWIYENDAFACALPASTTRFSYEIDFALSAIGNQWHSWSLSGSFAQEIAPARTFGLLHQIEHLQKTGLIKGGSLDNALVFGSEGLVNPPLRFENEPVRHKILDLVGDLSLLGTFPQAHFLAYKASHNLHIQLARKIWELQLAKV

SEQ ID NO: 235 - protein, 285 aa, Synechococcus sp. RS9916
  misc_feature (10)..(282): Pfam Name: LpxC Pfam Description: UDP-3-O-acyl N-acetylglycosamine deacetyla
  misc_feature (1)..(285): Public GI ID no. 116073620
  misc_feature (1)..(285): Bit score of 267.1 for HMM based on sequences of Figure 4
  misc_feature (1)..(285): Functional Homolog Of SEQ ID NO. 198
MQIWPVDYDGAWTLAGAITRSGVGLHSGVDVSVTLLPSERPGYWVSWDDESSGAPVQLAPSQVRDSQLCTTLDFGERRLATVEHLLAALAGTGITHAELRVSGAEVPLLDGSALGWVEAIADVGLVPAASPRVPRPSLEQPLVKHRGSSVITAVPADQFSVVGAIDFPQPAIGRQQFSLTLTPELFVSEIAPARTFGFREQVEQLRAAGLIQGGALDNALVCDGDHWLNPPLRFDDEPVRHKLLDLIGDLALVGLPSAQVLVYRGSHGLHTDLAAALVATPLSSS

SEQ ID NO: 236 - protein, 286 aa, Gloeobacter violaceus PCC 7421
  misc_feature (1)..(275): Pfam Name: LpxC Pfam Description: UDP-3-O-acyl N-acetylglycosamine deacetyla
  misc_feature (1)..(286): Public GI ID no. 37521434
  misc_feature (1)..(286): Bit score of 274.9 for HMM based on sequences of Figure 4
  misc_feature (1)..(286): Functional Homolog Of SEQ ID NO. 198
MQQQTLAATVQLSGISLHKGASVAVRLCPAPPDSGRCFVRADLAGTPAIPALARGFRPSPLCTTLSENGAAIQTVEHVLAALYGLGIDNCRIEVEGPELPILDGSARPYVEAVVRSGTVRQNAPRRFYQIAEPVAVYERDAFVVAMPTDTPALQVSYGIDFPHPIGRHWFSLELTPENFAREVAPARTFTLQSQVEQLLACGLIQGGSLDCALVAGADDWLTPPTWPDEPARHKLLDLLGDLSLAGVALSGHIVAYKAGHALHGRLARALAEKVPVPSVCSQKPSQ

SEQ ID NO: 237 - protein, 296 aa, Synechococcus sp. CC9311
  misc_feature (20)..(293): Pfam Name: LpxC Pfam Description: UDP-3-O-acyl N-acetylglycosamine deacetyla
  misc_feature (1)..(296): Public GI ID no. 113954355
  misc_feature (1)..(296): Bit score of 273.4 for HMM based on sequences of Figure 4
  misc_feature (1)..(296): Functional Homolog Of SEQ ID NO. 198
MAIQFGCWLEVLMMSWPADYNRPWTLASSVSRSGIGLHSGQQCQVTLVPSEQEGFYVRWLDQTSAPVRLDPSQVRDSQLCTTLDFGERQLSTVEHLLAAVAGCGVSHVELQVSGTEIPLLDGSALGWVEAIAEAGLTTASTPRRPPLVLSEPLAFYRGSSAIVATPADRFTLVGVIDFPQEAIGRQQLALELSPQTFIDEIAPARTFGFREQVEQLRSSGLIRGGALDNALVCDGDSWVNPPLRFQDEPVRHKILDLIGDLALVGFPQAQVLVYRGSHGLHTELAAALADQLVPQR

SEQ ID NO: 238 - protein, 284 aa, Synechococcus sp. WH7805
  misc_feature (10)..(281): Pfam Name: LpxC Pfam Description: UDP-3-O-acyl N-acetylglycosamine deacetyla
  misc_feature (1)..(284): Public GI ID no. 88807444
  misc_feature (1)..(284): Bit score of 265.0 for HMM based on sequences of Figure 4
  misc_feature (1)..(284): Functional Homolog Of SEQ ID NO. 198
MVCWPVDYDGAWTLAGTVRRCGIGLHSGKPVSVTLKPSADPGIWVRWSSDDAAPVQLKPSQVRDSQLCTTLELGDRRLATVEHLLAALAGCGLTQALLEVDGEEIPLLDGSAIGWVEAIAEADLVEVSGERSHRPTLEQPIALHRGSSVITATPAEQFSVVGVIDFPQPAIGRQQFALDLTPQRFVEEIAPARTFGFREQVEQLRAAGLIQGGALDNALVCDGDHWLNPPLRYPDEPVRHKLLDLIGDLALVGFPRAQVLVYRGSHGLHTDLAAALADRSPVQP

SEQ ID NO: 239 - protein, 284 aa, Synechococcus elongatus PCC 6301
  misc_feature (5)..(279): Pfam Name: LpxC Pfam Description: UDP-3-O-acyl N-acetylglycosamine deacetyla
  misc_feature (1)..(284): Public GI ID no. 56750622
  misc_feature (1)..(284): Bit score of 285.7 for HMM based on sequences of Figure 4
  misc_feature (1)..(284): Functional Homolog Of SEQ ID NO. 198
MAIAIPRRTLAGPVDCAGVGLHSGAEVNVRLEPAVSGRDRIFVRTDLPGTPEIPVQLDRVRETLLSTELATDQANIRTVEHLLAVLAGLGVTDVQIAIDGPELPLLDGSGAEWLAAIAAVGTVELLGAVSVPVLTEPLTVSEGDAFVTAVPAEETRLSYGIDFDLAPIGNQWFSVRWRPDDWEREVVPARTFGLAPQIEALRQQGLIRGGSLENALVCDRDRWLNPPLRFSNEPVRHKLLDLAGDLSLLGALPQAHILAYKASHRLHVRFARELQARMASLVSR

SEQ ID NO: 240 - protein, 286 aa, Synechococcus sp. RS9917
  misc_feature (10)..(283): Pfam Name: LpxC Pfam Description: UDP-3-O-acyl N-acetylglycosamine deacetyla
  misc_feature (1)..(286): Public GI ID no. 87123666
  misc_feature (1)..(286): Bit score of 265.5 for HMM based on sequences of Figure 4
  misc_feature (1)..(286): Functional Homolog Of SEQ ID NO. 198
MASWPADYNDSWTLASPVRRTGVGLHSGASVSVTLRPSERAGYHVRWAEASASSEPVSLSPAQVRDSQLCTTLDLGERRLATVEHLLAALAGTGLSHVELEVSGPEVPLLDGSALGWVEAIDEAGFAPAATSRRPGPRLTAPITRHRGSSVITATPAERFQLVGVIDFPQVAIGRQQLAITLTPERFVREIAPARTFGFRDQVDQLRAAGLIQGGALDNALVCDGEHWLNPPLRFVDEPVRHKLLDLIGDLALVGFPQAQVLVYRGSHGLHTDLAAALADLSSSPR

SEQ ID NO: 241 - protein, 275 aa, Synechococcus sp. WH8102
  misc_feature (10)..(275): Pfam Name: LpxC Pfam Description: UDP-3-O-acyl N-acetylglycosamine deacetyla
  misc_feature (1)..(275): Public GI ID no. 33865092
  misc_feature (1)..(275): Bit score of 257.2 for HMM based on sequences of Figure 4
  misc_feature (1)..(275): Functional Homolog Of SEQ ID NO. 198
MTNWPQDYSGAWTLAAEVERRGIGLHSGGESTVRLRPCDKPGFHLRVGAAAEAIRLSPDQVRDSQLCTTLDLGAHRVATVEHLLAALAGCGLSHCEIAVQGGEIPLLDGSALGWVEAIADAGLQPAASERPTAPKLEQPLVRHRGSSVITATPSDRFSLVGIIDFPQAAIGRQQLALELTPQRFVDEIAPARTFGFRDQVEQLRAAGLIQGGALDNALVCDGDHWLNPPLRFADEPVRHKLLDLIGDLALVGFPQAQVLVYRGSHGLHTDLAAAL

SEQ ID NO: 242 - protein, 284 aa, Synechococcus sp. WH7803
  misc_feature (10)..(281): Pfam Name: LpxC Pfam Description: UDP-3-O-acyl N-acetylglycosamine deacetyla
  misc_feature (1)..(284): Public GI ID no. 148240294
  misc_feature (1)..(284): Bit score of 246.9 for HMM based on sequences of Figure 4
  misc_feature (1)..(284): Functional Homolog Of SEQ ID NO. 198
MVRWPVDYDGAWTLAGPVHRSGIGLHSGQPVSVTLKPSLEPGVWVQWASDDAAPVRLAPSQVRDSQLCTTLDLGSRRLATVEHLLAALAGCGLTHALLEVDGEEIPLLDGSALGWVEAIAEADLLEVPGWHPQRPELEHPLALHRGSSVITATPAEQFSVVGVIDFPQPAIGRQQFTLELTPQRFVEEIAPARTFGFRDQVEHLRAAGLIQGGALDNALVCDGEHWLNPPLRFPDEPVRHKLLDLIGDLALVGFPRAQVLVYRGSHGLHADLAAALADRSPVQP

SEQ ID NO: 243 - protein, 275 aa, Synechococcus sp. BL107
  misc_feature (10)..(275): Pfam Name: LpxC Pfam Description: UDP-3-O-acyl N-acetylglycosamine deacetyla
  misc_feature (1)..(275): Public GI ID no. 116071234
  misc_feature (1)..(275): Bit score of 240.5 for HMM based on sequences of Figure 4
  misc_feature (1)..(275): Functional Homolog Of SEQ ID NO. 198
MTNWPEDYSGAWTLAGQAERSGVGLHSGRSSVVRLKGSVEPGFYLRVEGHDEAFRLAPHQVRDSQLCTTLELGPCKVATVEHLLAALAGCGLTHAEIQLQGDEIPLMDGSALNWVEAIVEAGIQPAKTPRLPRPSFTQPLVRSRGGSVITAIPATTFRVVGIIDFPQRAIGQQQLSLDLTPERFVKEIAPARTFGFRDQVEQLRSAGLIQGGALDNALVCDGDHWLNPPLRFPDEPVRHKLLDLIGDLALVGFPQAQVLVYRGSHGLHTDLAAAL

SEQ ID NO: 244 - protein, 275 aa, Synechococcus sp. CC9605
  misc_feature (8)..(275): Pfam Name: LpxC Pfam Description: UDP-3-O-acyl N-acetylglycosamine deacetyla
  misc_feature (1)..(275): Public GI ID no. 78213633
  misc_feature (1)..(275): Bit score of 244.3 for HMM based on sequences of Figure 4
  misc_feature (1)..(275): Functional Homolog Of SEQ ID NO. 198
MISWPQDYSAAWTLAAETSLSGIGLHSGAEATVELRPTDHPGFQMRLPGMDQPIQLRPDQVRDSPLCTTLVLGSSKVATVEHLLAALAGCGLSHVEIVLDGHEVPLLDGSALGWVEAIAAAGLVPAATPRPAQPQLEQPLLRTRGNSVITATPADCFGVVGIIDFPQAAIGRQQFALELTPQRFVDEIAPARTFGFREQVEQLRAAGLIQGGALDNALVCDGDKWMNPPLRFEDEPVRHKLLDLIGDLALVGFPQAQVLVYKGSHGLHTDLAAAL

SEQ ID NO: 245 - protein, 295 aa, Synechococcus sp. RCC307
  misc_feature (9)..(280): Pfam Name: LpxC Pfam Description: UDP-3-O-acyl N-acetylglycosamine deacetyla
  misc_feature (1)..(295): Public GI ID no. 148242917
  misc_feature (1)..(295): Bit score of 268.7 for HMM based on sequences of Figure 4
  misc_feature (1)..(295): Functional Homolog Of SEQ ID NO. 198
MIWASDYSRAYTLAAAVERRGVGLHSGKDCLVRLKPGSKPGFWVGFLGQPDQEPVMLAPHQVRDTRLCTALEIGGRPLATVEHLLAALAGVGLTQAEIWLEGHEIPLLDGSALPWVEVIAEAGLEDLGPRAPLPALAAPISCQRGNSFVQALPSEQLLLSAAIEFPQPAIGRQLFSLVLSPESFVREIAPARTFGFKDQVEQLREAGLIQGGALDNALVCDGDQWVNPPLRFADEPVRHKLLDLIGDLALAGLPLAQVMAFRASHNLHTQLAAALAASSAPLSAVTSRGDLPSVA

SEQ ID NO: 246 - protein, 288 aa, Prochlorococcus sp. MIT9211
  misc_feature (10)..(281): Pfam Name: LpxC Pfam Description: UDP-3-O-acyl N-acetylglycosamine deacetyla
  misc_feature (1)..(288): Public GI ID no. 159903932
  misc_feature (1)..(288): Bit score of 247.0 for HMM based on sequences of Figure 4
  misc_feature (1)..(288): Functional Homolog Of SEQ ID NO. 198
MEWLPENYQGAWTLGRSVSREGICLHSGEHSTVTLSPSVAPGINFVWAGEEGLTELINPNKVVSTQLCTTLRLGNKTLSTVEHLFGALIGCGVTHVQIKVSGEEIPLLDGSAIGWVEAIKEAGLESVKSEQRKILELKKPLIIHKGRSVITATPADSFSLIGIIDFPYPAIGQQSFSIDLTPRKFVDQIAPARTFGFKDQIDQLREQGLIKGGSLENSLVCDDNFWVNPPLRFQNEPVRHKLLDLIGDLALVGLPKAQVLVYRGSHALHVELAAAFLKDSFSKQPSFD

SEQ ID NO: 247 - protein, 281 aa, Prochlorococcus sp. NATL2A
  misc_feature (10)..(281): Pfam Name: LpxC Pfam Description: UDP-3-O-acyl N-acetylglycosamine deacetyla
  misc_feature (1)..(281): Public GI ID no. 72382747
  misc_feature (1)..(281): Bit score of 235.8 for HMM based on sequences of Figure 4
  misc_feature (1)..(281): Functional Homolog Of SEQ ID NO. 198
MFSFPDDYEEGWTLQNEIKKDGIGLHTGLKCTVIIKPTELTGFHISFSSEPNKVTPIDISQVRNTPLCTTLDLNGKKVATVEHLLASLLGAGLTHAHIEITGSEIPLLDGSAIGWIEEIQNVGMINSITSPRPRPELKSPIFVSKGESVIFAIPSEKLKLVGLIDFPYKAIGQQMFSIELSPNNFVKEIAPARTFGFLDQLEELKKAGLIKGGALENALVCNGDSWVNPPLRFANEPVRHKLLDLIGDLAFVGLPKAQIFVYKGSHALHAEFAASLKKVLT

SEQ ID NO: 248 - protein, 281 aa, Prochlorococcus marinus str. NATL1A
  misc_feature (10)..(281): Pfam Name: LpxC Pfam Description: UDP-3-O-acyl N-acetylglycosamine deacetyla
  misc_feature (1)..(281): Public GI ID no. 124026469
  misc_feature (1)..(281): Bit score of 236.6 for HMM based on sequences of Figure 4
  misc_feature (1)..(281): Functional Homolog Of SEQ ID NO. 198
MFSFPDDYEEGWTLQNEIKKDGIGLHTGLKCTVIIKPTELTGFHISFSSEPNKVTPIDISQVRNTPLCTTLDLNGKKVATVEHLLASLLGAGLTHAHIEITGSEIPLLDGSAIGWIEEIQNVGMINSLTSPRPRPELKSPIFVSKGESVIFAIPSEKLKLVGLIDFPYKAIGQQMFSIELSPNNFVKEIAPARTFGFLDQLEELKKAGLIKGGALENALVCNGDSWVNPPLRFANEPVRHKLLDLIGDLAFVGLPKAQIFVYKGSHALHAEFAASLQKVLT

SEQ ID NO: 249 - protein, 281 aa, Synechococcus sp. WH5701
  misc_feature (10)..(281): Pfam Name: LpxC Pfam Description: UDP-3-O-acyl N-acetylglycosamine deacetyla
  misc_feature (1)..(281): Public GI ID no. 87301187
  misc_feature (1)..(281): Bit score of 242.3 for HMM based on sequences of Figure 4
  misc_feature (1)..(281): Functional Homolog Of SEQ ID NO. 198
MTVWPEDYSQAWTLATAVERTGVGLHSGNPCRVRLQPTDTAGYRVGWLDAPALEPVALHPSQVSDTQLCTALRLDQRRLATVEHLLAALAGTGLSHLELLVEGEEVPVLDGSALPWVDAIAEAGLRCLGHRVPLQPLSAPITLQQGQSFVTALPSERPRIGAAIEFPQGAIGRQLYSLELTPTAFVEQIAPARTFGFREQIDQLRSAGLIRGGDLENALVCDGDHWLNPPLRFPQEPVRHKLLDLLGDLALSGLPQAQVFAFRGSHGLHTALAAALAAPFR

SEQ ID NO: 250 - protein, 275 aa, Synechococcus sp. CC9902
  misc_feature (10)..(275): Pfam Name: LpxC Pfam Description: UDP-3-O-acyl N-acetylglycosamine deacetyla
  misc_feature (1)..(275): Public GI ID no. 78184132
  misc_feature (1)..(275): Bit score of 229.6 for HMM based on sequences of Figure 4
  misc_feature (1)..(275): Functional Homolog Of SEQ ID NO. 198
MTNWPEDYSGSWTLAGHAERSGVCLHSGHSSVVQLKGSVDPGFYLRVEGHDQAFRLSPHQVRDSQLCTTLDLGPCKVATVEHLLAALAGCGLTHVEIQLQGDEIPLMDGSALNWVEAIVEAGIQPAVTPRLPTPPLTQPLICSRGGSVITATPATTFRVVGIIDFPQQAIGQQQLSLDLTPERFVREIAPARTFGFRDQVEQLRAAGLIQGGALDNALVCDGDHWVNPPLRFPDEPVRHKLLDLIGDLALVGFPQAQVLVYRGSHGLHTDLAAAL

SEQ ID NO: 251 - protein, 321 aa, Oryza sativa
  misc_feature (24)..(311): Pfam Name: LpxC Pfam Description: UDP-3-O-acyl N-acetylglycosamine deacetyla
  misc_feature (1)..(321): Bit score of 732.9 for HMM based on sequences of Figure 4
  misc_feature (1)..(321): Functional Homolog Of SEQ ID NO. 198
  misc_feature (196)..(196): Xaa is any aa, unknown, or other
  misc_feature (219)..(219): Xaa is any aa, unknown, or other
  misc_feature (234)..(234): Xaa is any aa, unknown, or other
MCGSAARALNSVSRAAFSWKPTGLPQQTLAAAVSRSGVGLHSGAKTTATLLPARAGEGRYFVVEGEETRVAAEVANAEAHSPLCTALRRGGARVRTVEHLLSAMEALGVDNCRVEVSGGDEIPLLDGSAQEWVMAIRGAGQCAAKDSSGQKLEKLAPEIHEPVYLQKSDCFIAALPSSRIRITYGIDFPKVPGIGXQRFATVLDANVYSSKIAPARTFXIWKRLKKLGSAGLIXGGSLENATVCSISGGWLNPPLRFEDEPCRHKILDLIGDFSLLAQNGNQGFPLAHVVAYKAGHALHTDFLRHLLGRSAVGQENLAEQC

SEQ ID NO: 252 - DNA, 1637 bp, Panicum virgatum
  misc_feature (1)..(1637): Ceres Clone ID no. 1815762
  misc_feature (1)..(1637): Encodes the peptide sequence at SEQ ID NO. 253
gaacgctcgcccctccgggctcccagcctcccaggcgccgccgcccggcgtagctccaggcggccgggtaccgggaccggcagcgatgagccccaaggaggcggcacagcggccgcacgccgtgctcatcccgcagccggcgcagggccacgtcacgccgatgctgcacctcgccaaggcgctgcacgccagggggttccacatcacctacgtcaactccgagtacaaccaccgccgcctgctccggtcccgcggcccggcgtcgctcgccggcgccgccggcttccgcttcgaggccgtgccggacggcctgccgccgtccgacaacgacgacgtcacgcaggacatcgccgcgctctgcctctccaccaccgagcacagcgccgcgccgttcagggacctgctggcgaggctcaacgccacgccggggggcccgcttgtcagctgcgtcgtagccgacggcgtgatgagcttcgcgcagagggtcgccgaggagatggggatcctggccttggtcttctggaccacgagcgcgtgcggcttcatggggtacctccacttcgccgagctcatcaaacgaggctacgtgccactgaaagacgaaagtgacctgacaaatggttacctggacactgtaatcgactggatccccggcatgccgggcatccgtctgaaggacaaccccagcttcatcagaacgacggaccgggacgacgtgatgctcaacttcgacggcggcgaggcgcagaacgcgcgccgggcccgcggggtcatcctcaacacgtacgacgcgctggagcagggcgtggtggacgcgctgcgccgcgagttcccgcgcgtgtacaccgtcggcccgctcgccgcgttcgcgaacgccgcgcggggaggcgagctggacgcgatcggcgggaacctctggaaggaggacacgagctgcctccggtggctcgacacgcagccgtcgggctccgtcgtgtacgtcaacttcggcagcatcacggtgatgtcccccgctcagctctccgagttcgcgtggggcctggcgggctccggcaggccgttcctgtgggtcatcaggccggacctcgtctccggcgagaacgccatgctgccggaggagttcgtcacggacacaaaggaaaggggtgttctggcgagctggtgcccgcaggagctggtcctctcgcacccctccgtagggctgttcctgactcactgcgggtggaactccacgctggagagcatatgcgccggcgtgccgatgctctgctggcccttcttcgccgagcaaccgacgaactgccagtacgtgtgcgccaagtgggagattgggatggagatcgacagcgacgtgaggagggaggaggtggcgcggcttgtgcgcgaggtcatggacggcgaaaccggcaaggcgatgagagtgaaggcgatgctgtggaaggagaaagctcgagaagcggtggaggacggtggatcctcgaggaaaaacatggaacgcctcgtcgaattcttgctcgcagcgaatgaagatgtttcaacctgaattcgctagtacagataaaatgggctgtgatgatcttaatgtgttaggatctggacctttttgatttgaagtgaaagattttatgactcgactc

SEQ ID NO: 253 - protein, 485 aa, Panicum virgatum
  misc_feature (11)..(480): Pfam Name: UDPGT Pfam Description: UDP-glucoronosyl and UDP-glucosyl transfer
  misc_feature (1)..(485): Ceres Clone ID no. 1815762
  misc_feature (1)..(485): Bit score of 1209.5 for HMM based on sequences of Figure 5
  misc_feature (1)..(485): in Figure 5
MSPKEAAQRPHAVLIPQPAQGHVTPMLHLAKALHARGFHITYVNSEYNHRRLLRSRGPASLAGAAGFRFEAVPDGLPPSDNDDVTQDIAALCLSTTEHSAAPFRDLLARLNATPGGPLVSCVVADGVMSFAQRVAEEMGILALVFWTTSACGFMGYLHFAELIKRGYVPLKDESDLTNGYLDTVIDWIPGMPGIRLKDNPSFIRTTDRDDVMLNFDGGEAQNARRARGVILNTYDALEQGVVDALRREFPRVYTVGPLAAFANAARGGELDAIGGNLWKEDTSCLRWLDTQPSGSVVYVNFGSITVMSPAQLSEFAWGLAGSGRPFLWVIRPDLVSGENAMLPEEFVTDTKERGVLASWCPQELVLSHPSVGLFLTHCGWNSTLESICAGVPMLCWPFFAEQPTNCQYVCAKWEIGMEIDSDVRREEVARLVREVMDGETGKAMRVKAMLWKEKAREAVEDGGSSRKNMERLVEFLLAANEDVST

SEQ ID NO: 254 - DNA, 1455 bp, Sorghum bicolor
  misc_feature (1)..(1455): Ceres Annot ID no. 8680534
  misc_feature (1)..(1455): Encodes the peptide sequence at SEQ ID NO. 255
atgagctccggaaaggcgcagcagcggccacacgccgtgctcatcccgcagccggcgcagggccacgtcacgccgatgctgcacctcgccaaggcgctgcacgccagggggttccgcgtcacctacgtcaactccgagtacaaccaccgccgcctgctccggtcccgcggccaggactcgctcgccggcaccgacggcttccgcttcgaggccgtccccgacggcctgccgcagtccgacaacgacgacgtcacgcaggacatcgccgcgctctgcctgtccaccaccgagcacagcgccgcgccgttcagggacctgctggcgaggctgaacgccacgcccggcagcccgccggtcagctgcgtcatagccgacggcgtgatgagcttcgcgcagcgggtcgccgaggagatggggatcctggccttggttttctggaccaccagtgcgtgcggcttcatggggtacctccacttcgccgagctcatccgacgagcctacgtgccactcaaagacgaaagtgacctgtcgaacgggtacctggacaccgcgatcgactggatccccggcatgcccggcatccgtctgaaggacatccccagcttcatcaggacgacggacccggacgacgtgatgctcaacttcgacggcggcgaggcgcagaacgcgcgcaaggcccgcggggtcatcctcaacacgtacgacgcgctggagcaggacgtggtggacgcgctgcgccgcgagttcccgcgcgtgtacaccgtcggcccgctcgccacgttcgcgaacgccgcggcaggaggcgggctggacgcgatcggcgggaacctctggaaggaggacacgagctgcctccggtggctggacacgcagcgaccgggatcggtggtgtacgtcaacttcggcagcatcacggtgatgaccgccgctcagctcgccgagttcgcctggggcctggcgagctgcggctcgccgttcctgtgggtcatcaggccggacctcgtgtccggcgagaacgccatgctgccggaggggttcgtcacggacaccaaagaaaggggaatcctggcgagctggtgtccgcaagagctggtgctctcgcacccgtccgtcggcctgtttctgacgcactgcgggtggaactcgacgctggagagcatatgtgccggcgtgccgatgctctgctggccgttcttcgctgagcaaccgacgaactgccggtacgtgtgtgacaaatgggggattgggatggagatcgacagtgatgtgaggaggcaggaggtggcgcggctcgtgcgcgaggcgatggacggggagaggggcaaggcgatgagattgaagtcgatggtgtggaaggagaaagctcgacaagcagtggacgaaggtggatcctcgaggaaaaacatggaccggatggtcgagttcctgctcgctgggaatgatgttcctagctga

SEQ ID NO: 255 - protein, 484 aa, Sorghum bicolor
  misc_feature (11)..(480): Pfam Name: UDPGT Pfam Description: UDP-glucoronosyl and UDP-glucosyl transfer
  misc_feature (1)..(484): Ceres Annot ID no. 8680534
  misc_feature (1)..(484): Bit score of 1203.9 for HMM based on sequences of Figure 5
  misc_feature (1)..(484): Functional Homolog Of SEQ ID NO. 253
  misc_feature (1)..(484): in Figure 5
MSSGKAQQRPHAVLIPQPAQGHVTPMLHLAKALHARGFRVTYVNSEYNHRRLLRSRGQDSLAGTDGFRFEAVPDGLPQSDNDDVTQDIAALCLSTTEHSAAPFRDLLARLNATPGSPPVSCVIADGVMSFAQRVAEEMGILALVFWTTSACGFMGYLHFAELIRRAYVPLKDESDLSNGYLDTAIDWIPGMPGIRLKDIPSFIRTTDPDDVMLNFDGGEAQNARKARGVILNTYDALEQDVVDALRREFPRVYTVGPLATFANAAAGGGLDAIGGNLWKEDTSCLRWLDTQRPGSVVYVNFGSITVMTAAQLAEFAWGLASCGSPFLWVIRPDLVSGENAMLPEGFVTDTKERGILASWCPQELVLSHPSVGLFLTHCGWNSTLESICAGVPMLCWPFFAEQPTNCRYVCDKWGIGMEIDSDVRRQEVARLVREAMDGERGKAMRLKSMVWKEKARQAVDEGGSSRKNMDRMVEFLLAGNDVPS

SEQ ID NO: 256 - DNA, 1449 bp, Oryza sativa
  misc_feature (1)..(1449): Ceres Annot ID no. 1694297
  misc_feature (1)..(1449): Encodes the peptide sequence at SEQ ID NO. 257
atgagctcctgcgaggcgaggcgggcgcacgcggtgctcatcccgcagccggcgcagggccacgtcacgcccatgctgcacctcgccaaggcgctgcacgccagggggttcttcgtcacctacgtcaactccgagtacaaccaccgccgcctgctccggtccagcggccctggcgcgctggccggcgccgcgggcttccgtttcgaggccgtgccggacggcatgccggagtccggcaacgacgacgtcacgcaggacatcgccgcgctctgcgtgtccaccaccaggcacagcgccgagccgttcagggagctgttggtgaggctgaacagcacgcccgggacgccgccggtgagctgcgtcatagccgacggcgtgatgagcttcgcgcagagggtcgccgaggagatgggcatcctggccttggtgttctggactacgagcgcttgcggcttcatgggttacctccacttcgccgagctcatcagacgaggctatgtgccactcaaagacgagagtgacctgacgaacggatacctggacactccgatcgactggatccccgggatgcgaggcatccgtctcaaggacgtgccaagtttcatcagaacgaccgatccggacgacgtcatgctcaatttcgacggcggcgaggctcagaacgcgcgcaaggcccgggggctcatcctcaacacgtacgacgcgctggagcaagacgtcgtcgacgcgctgcgccgcgagttcccgcgtgtgtacaccgtcggcccgctcccggcgttcgccaaggccgccgccggcgaggtgggcgcgatcggcggcaacctctggaaggaggacacgggctgcctccggtggctggacgcccagcagcctggctccgtcgtgtacgtcaacttcggcagcatcaccgtcatgtcgccggctcatctggccgagttcgcgtggggcctagcttgctgcggccggccgttcttgtgggtcatcaggccggacctcgtctccggcgagaaggccatgctgccggaggagttcgtcggcgagaccaaagagaggggcgttctggcgagttggtgcccgcaagagctcgtcctctcgcacccgtccgtcggcctgttcctgacgcactgcgggtggaactcgacgctggagagcatatgcgccggcgttccgatgatctgctggccgttcttcgccgagcagccgacgaactgccggtacgtgtgcgacaagtggggggttgggatggagatcgacagcaacgtgagcagaacggaggtggcgcggctcgtgcgcgaggcgatggagggggagagaggcaaggccatgcgagtgaacgccatggtgtggaaggagaaagccaaggaggcgacagaggaaggaggttcgtcgagcagaaatctggaccgtctgatcgaattcttgcattcttctgggagtgacgctcgctga

SEQ ID NO: 257 - protein, 482 aa, Oryza sativa
  misc_feature (10)..(478): Pfam Name: UDPGT Pfam Description: UDP-glucoronosyl and UDP-glucosyl transfer
  misc_feature (1)..(482): Ceres Annot ID no. 1694297
  misc_feature (1)..(482): Bit score of 1189.7 for HMM based on sequences of Figure 5
  misc_feature (1)..(482): Functional Homolog Of SEQ ID NO. 253
  misc_feature (1)..(482): in Figure 5
MSSCEARRAHAVLIPQPAQGHVTPMLHLAKALHARGFFVTYVNSEYNHRRLLRSSGPGALAGAAGFRFEAVPDGMPESGNDDVTQDIAALCVSTTRHSAEPFRELLVRLNSTPGTPPVSCVIADGVMSFAQRVAEEMGILALVFWTTSACGFMGYLHFAELIRRGYVPLKDESDLTNGYLDTPIDWIPGMRGIRLKDVPSFIRTTDPDDVMLNFDGGEAQNARKARGLILNTYDALEQDVVDALRREFPRVYTVGPLPAFAKAAAGEVGAIGGNLWKEDTGCLRWLDAQQPGSVVYVNFGSITVMSPAHLAEFAWGLACCGRPFLWVIRPDLVSGEKAMLPEEFVGETKERGVLASWCPQELVLSHPSVGLFLTHCGWNSTLESICAGVPMICWPFFAEQPTNCRYVCDKWGVGMEIDSNVSRTEVARLVREAMEGERGKAMRVNAMVWKEKAKEATEEGGSSSRNLDRLIEFLHSSGSDAR

SEQ ID NO: 258 - protein, 476 aa, Vitis vinifera
  misc_feature (12)..(475): Pfam Name: UDPGT Pfam Description: UDP-glucoronosyl and UDP-glucosyl transfer
  misc_feature (1)..(476): Public GI ID no. 225459251
  misc_feature (1)..(476): Bit score of 1292.4 for HMM based on sequences of Figure 5
  misc_feature (1)..(476): Functional Homolog Of SEQ ID NO. 253
  misc_feature (1)..(476): in Figure 5
MGSLASAEKPHAVCIPYPAQGHINPMLKLAKFLHFRGFHITFVNTEYNHNRLLKSRGPDSLKGIPSFQFKTIPDGLPPSNVDATQDTPALCVSTTKHCLPPFRDLLSNLNHDGPPVTCIVSDGAMSFTLDAAQELGVPEVLFWTTSACGFMGYVQYRNLIDKGLAPLKDESYLTNGYLDTVIDWIPGMKGIRLRDIPSFIRTTDPNDIMLEFPLREAERARKASALIFNTFDALEHEVLDALSQMFPPIYTIGPLHKLMSQIQDNDLKLMESNLWKEEPECLEWLDSKEPNSVVYVNFGSVTVMTSQQLNEFAWGLVNSNQTFLWIIRPDLVSGDAAILPPEFVAETKERGLLAGWCPQEQVLSHPAVGGFLTHNGWNSTIESVSAGVPMICWPFFAEQQTNCRYCCTEWGIGMEIDSDVKRDEIERLVKELMEGEKGKELKKKALEWKALAEEATRGPNGSSFSNLDKMITQALL

SEQ ID NO: 259 - DNA, 1443 bp, Populus balsamifera subsp. trichocarpa
  misc_feature (1)..(1443): Ceres Annot ID no. 1443484
  misc_feature (1)..(1443): Encodes the peptide sequence at SEQ ID NO. 260
atggcgttccttgaaaatccccatgcagtatgcattccctatccagctcaaggtcacatcaaccccatgttaaaactagccaaactcctccatcacaaaggcttccatatcacttttgtcaacacagagtacaaccacaaacgtatcctaagatctcgaggcctcaactctcttgatggcctcccatcatttcaattcaaagctatccccgatggactccctccaacaagtaacgatgtcacacaagacataccatcactatgtgaatccaccagcaaaacatgcatggttcctttcaaagacctcattaccaatcttaacgacacgtcttcatccaatgttcctcctgtaacttgcattgtttctgatggagtcatgagcttcacgcttgaggcagcacaagagttgggtatacctgaagttctgttttggacaacaagtgcatgcggatttctggcttatgctcactgtcgccagctaatcgagaagggtcttacaccactcaaagatgaaagttacttatctaacggttacctggattccgtgatagactggataccaggcatgaaaggcatccgtctgagggatatcccaagtttcgttagaaccaccgatcctgaagatttcatgctgaaatttataaaggcggagagtgaaagagctaaaaaggcctctgctattgttttgaatacgtatgatgccttggagcatgaaggcttggtttctcttgcttcaatgttacctcctgtatactccattggtccccttcacctgctcctgaatcaggtcacagatagtgatttaaagctgatcggatcaaacctatggatagaagaatccgggtgtcttgagtggcttgactcaaaagaacccaattcagttgtttacgtaaattttggaagcataactgtcatgacaagtgaccaattaacagagtttgcttggggacttgcaaatagtgaccagacatttttgtgggtcattaggcctgaccttgttgcgggtgactccgcgatgttaccaccagagtttgtttcggccactaaagagagaggtcttttcgcaagttggtgctcccaggaacaagtactaagccacccatccattggaggtttcttaacacataacggatggaactccacaattgaaagtatttgtggaggagtgcctatgatttgttggcctttctttgctgaacagcaaaccaattgtcggtattgttgcaccgaatggggcataggcatggaaataaacagtgatgttaagagaggtgaagttgagagccttgttagagagttaatgggaggagaaaagggcagtgaaatgaaaaagaaaaccagggagtggaagaagatggcagaagaggcaattacttccaccggttcatcttgcatgaatttggacgacatgattaacaaggtgctactgtctccaagagattag

SEQ ID NO: 260 - protein, 480 aa, Populus balsamifera subsp. trichocarpa
  misc_feature (9)..(478): Pfam Name: UDPGT Pfam Description: UDP-glucoronosyl and UDP-glucosyl transfer
  misc_feature (1)..(480): Ceres Annot ID no. 1443484
  misc_feature (1)..(480): Bit score of 1294.5 for HMM based on sequences of Figure 5
  misc_feature (1)..(480): Functional Homolog Of SEQ ID NO. 253
  misc_feature (1)..(480): in Figure 5
MAFLENPHAVCIPYPAQGHINPMLKLAKLLHHKGFHITFVNTEYNHKRILRSRGLNSLDGLPSFQFKAIPDGLPPTSNDVTQDIPSLCESTSKTCMVPFKDLITNLNDTSSSNVPPVTCIVSDGVMSFTLEAAQELGIPEVLFWTTSACGFLAYAHCRQLIEKGLTPLKDESYLSNGYLDSVIDWIPGMKGIRLRDIPSFVRTTDPEDFMLKFIKAESERAKKASAIVLNTYDALEHEGLVSLASMLPPVYSIGPLHLLLNQVTDSDLKLIGSNLWIEESGCLEWLDSKEPNSVVYVNFGSITVMTSDQLTEFAWGLANSDQTFLWVIRPDLVAGDSAMLPPEFVSATKERGLFASWCSQEQVLSHPSIGGFLTHNGWNSTIESICGGVPMICWPFFAEQQTNCRYCCTEWGIGMEINSDVKRGEVESLVRELMGGEKGSEMKKKTREWKKMAEEAITSTGSSCMNLDDMINKVLLSPRD

SEQ ID NO: 261 - protein, 483 aa, Vitis vinifera
  misc_feature (12)..(482): Pfam Name: UDPGT Pfam Description: UDP-glucoronosyl and UDP-glucosyl transfer
  misc_feature (1)..(483): Public GI ID no. 225462851
  misc_feature (1)..(483): Bit score of 1251.6 for HMM based on sequences of Figure 5
  misc_feature (1)..(483): Functional Homolog Of SEQ ID NO. 253
  misc_feature (1)..(483): in Figure 5
MASIRASDKPHAVCIPYPSQGHVNPLLQMAKLLHSRGFFITFVNTEHNHKRLLRSKGPNYLDGFPDFRFETIPDGLPPSDADITQPTASVCESTSKNSLAPFCNLISKLNDPSSSAGPPVTCIVSDGVMSFTLDAAEKFGVPEVLFWTTSACGFLGYRHYRDLLQRGLIPLKDESCLTNGYLDTIVDSIPGMMKTIRLRDFPAFFKTTDPNDIMLNFLIAEAERANKASAIILNTFDALEKDVLDALRATLPPVYTIGPLQHLVHQISDDKLKFFGSSLWKEQPECLQWLDSKEPNSVVYVNFGSVIVMTPQQLTELAWGLANSNKPFLWIIRPDLVPGDSAPLPPEFVTETRDRGLLASWCPQEQVLKHPAVGGFVTHSGWNSTSEGICGGVPLICMPFRAEQPTNCRYCCSEWGIGMEIDGNVKRDKVEKLVRELMDGENGKKMKKKAMEWKKLAEEAIMPGGSSYNNFNKLLSDVLLSKK

SEQ ID NO: 262 - protein, 485 aa, Nicotiana tabacum
  misc_feature (13)..(484): Pfam Name: UDPGT Pfam Description: UDP-glucoronosyl and UDP-glucosyl transfer
  misc_feature (1)..(485): Public GI ID no. 62241065
  misc_feature (1)..(485): Bit score of 1287.2 for HMM based on sequences of Figure 5
  misc_feature (1)..(485): Functional Homolog Of SEQ ID NO. 253
  misc_feature (1)..(485): in Figure 5
MGSIGAELTKPHAVCIPYPAQGHINPMLKLAKILHHKGFHITFVNTEFNHRRLLKSRGPDSLKGLSSFRFETIPDGLPPCEADATQDIPSLCESTTNTCLAPFRDLLAKLNDTNTSNVPPVSCIVSDGVMSFTLAAAQELGVPEVLFWTTSACGFLGYMHYCKVIEKGYAPLKDASDLTNGYLETTLDFIPGMKDVRLRDLPSFLRTTNPDEFMIKFVLQETERARKASAIILNTFETLEAEVLESLRNLLPPVYPIGPLHFLVKHVDDENLKGLRSSLWKEEPECIQWLDTKEPNSVVYVNFGSITVMTPNQLIEFAWGLANSQQTFLWIIRPDIVSGDASILPPEFVEETKNRGMLASWCSQEEVLSHPAIVGFLTHSGWNSTLESISSGVPMICWPFFAEQQTNCWFSVTKWDVGMEIDSDVKRDEVESLVRELMVGGKGKKMKKKAMEWKELAEASAKEHSGSSYVNIEKLVNDILLSSKH

SEQ ID NO: 263 - DNA, 1625 bp, Gossypium hirsutum
  misc_feature (1)..(1625): Ceres Clone ID no. 1925472
  misc_feature (1)..(1625): Encodes the peptide sequence at SEQ ID NO. 264
atatatcgttcttttatactcttattttttcaaattgagaaatatcattcaacaatgggttccttgagtcataggcatcatgcagtatgtattcctttccctgctcaaggccatatcaatcctatgctaaagctagctaaaatacttcaccagaagggcttttatatcacttttgtcaacactgaatttaaccataaacgtatacttaaatctcgaggacctgatgctcttaatggtctcccttcttttcgttttgagactattcccgacggccttccgccgaccgacgtcgatgccacccaagacatcccttccctctgcaactccactagcaagacttgcttaccccatttcaaacaactcctccgcaagctaaacgattctgcgtccacatccaaagttccccctgtttcttgcattgtttcggatggtgtcatgagcttcactcttgatgcagctaaagaactaggcgtccctgaagttctgttttggaccacaagcgcttgtggcttccttggttacgttcactatcaccaattaatggaaaagggttatacgcctctcaaagatgaaagctatttaaccaatgggtacttggataccgtcataaattggataccgacaatggaaggtatccgattgagggatctaccttcttttcttagaacaactgattcgaattttgttatgcttgattttattttctctgaaaccaaaagagctcagaaggcgtcagcaattatattgaacacgtttgatgatttggagcacgaatcattggacgcactcaactcaatgctacccccagtttactcagtgggtcctttgcatcttgttttgaatcacaatgtggataatagtgaattgaaacaaataggatcgaatctttggaaagaagagcccgagtgcctccaatggttagactccaaagagcccaactctgttgtttacgtgaattttgggagcatcactgtgatgacagctgatcagctaaacgaatttgcttgggggttagcaaatagcaaacaaccttttctgtgggtcattagacctgatcttgttggtgatgaatcagcagttgtgccaatagagttcgtagcggagaccaaagatagaggcatgttggcaacatggtgcccacaagaacaagtcctgaaccacccttcgattggaggattcttaacacatagcggatggaattccacgattgaaagcatatccggcggcgtgcccatgacatgttggccgtttttcgcggagcaacaaacaaactgttggtattcatgtactaaatggggaatcggcatggaaatcgacaataatgttaagagggataaagtagagagccgtgttagagagctaatcaaaggagaaaagagtaaagatatgaagaagaaagctgtagagtgggagagaaaagcaaaggcggcgactgtcaaggctgatggctcgtcttacatgaatcttgacaaaattatccaacttttatgcacacctagagcttaaaatcaaagcctactttaattatttgattcaaaagatatatcttttaagtattgataaggttatattttgccattacaaaaataatgtaaccttatcactaataaaatttcatttgtatt

SEQ ID NO: 264 - protein, 483 aa, Gossypium hirsutum
  misc_feature (10)..(482): Pfam Name: UDPGT Pfam Description: UDP-glucoronosyl and UDP-glucosyl transfer
  misc_feature (1)..(483): Ceres Clone ID no. 1925472
  misc_feature (1)..(483): Bit score of 1277.2 for HMM based on sequences of Figure 5
  misc_feature (1)..(483): Functional Homolog Of SEQ ID NO. 253
  misc_feature (1)..(483): in Figure 5
MGSLSHRHHAVCIPFPAQGHINPMLKLAKILHQKGFYITFVNTEFNHKRILKSRGPDALNGLPSFRFETIPDGLPPTDVDATQDIPSLCNSTSKTCLPHFKQLLRKLNDSASTSKVPPVSCIVSDGVMSFTLDAAKELGVPEVLFWTTSACGFLGYVHYHQLMEKGYTPLKDESYLTNGYLDTVINWIPTMEGIRLRDLPSFLRTTDSNFVMLDFIFSETKRAQKASAIILNTFDDLEHESLDALNSMLPPVYSVGPLHLVLNHNVDNSELKQIGSNLWKEEPECLQWLDSKEPNSVVYVNFGSITVMTADQLNEFAWGLANSKQPFLWVIRPDLVGDESAVVPIEFVAETKDRGMLATWCPQEQVLNHPSIGGFLTHSGWNSTIESISGGVPMTCWPFFAEQQTNCWYSCTKWGIGMEIDNNVKRDKVESRVRELIKGEKSKDMKKKAVEWERKAKAATVKADGSSYMNLDKIIQLLCTPRA

SEQ ID NO: 265 - protein, 481 aa, Arabidopsis thaliana
  misc_feature (9)..(481): Pfam Name: UDPGT Pfam Description: UDP-glucoronosyl and UDP-glucosyl transfer
  misc_feature (1)..(481): Public GI ID no. 15219870
  misc_feature (1)..(481): Bit score of 1241.0 for HMM based on sequences of Figure 5
  misc_feature (1)..(481): Functional Homolog Of SEQ ID NO. 253
  misc_feature (1)..(481): in Figure 5
MGSHVAQKQHVVCVPYPAQGHINPMMKVAKLLYAKGFHITFVNTVYNHNRLLRSRGPNAVDGLPSFRFESIPDGLPETDVDVTQDIPTLCESTMKHCLAPFKELLRQINARDDVPPVSCIVSDGCMSFTLDAAEELGVPEVLFWTTSACGFLAYLYYYRFIEKGLSPIKDESYLTKEHLDTKIDWIPSMKNLRLKDIPSFIRTTNPDDIMLNFIIREADRAKRASAIILNTFDDLEHDVIQSMKSIVPPVYSIGPLHLLEKQESGEYSEIGRTGSNLWREETECLDWLNTKARNSVVYVNFGSITVLSAKQLVEFAWGLAATGKEFLWVIRPDLVAGDEAMVPPEFLTATADRRMLASWCPQEKVLSHPAIGGFLTHCGWNSTLESLCGGVPMVCWPFFAEQQTNCKFSRDEWEVGIEIGGDVKREEVEAVVRELMDEEKGKNMREKAEEWRRLANEATEHKHGSSKLNFEMLVNKVLLGE

SEQ ID NO: 266 - DNA, 1619 bp, Glycine max
  misc_feature (1)..(1619): Ceres Clone ID no. 514069
  misc_feature (1)..(1619): Encodes the peptide sequence at SEQ ID NO. 267
gtagccagcacttgcatattctttccctttggcaagtgcaatctaagaaagagctaacaaacaaaacatgggttctttgggcacaatcaacaacaagcctcatgctgtgtgcataccgtacccggcacaaggccacattaacccgatgctaaaactagcaaaactccttcacttcaaaggctttcacataacctttgttaacactgagtataaccacaaacgtcttctcaaagcaagaggccctgattcccttaatggtctctcttcttttcgctttgaaaccattcctgatggtctacctgagactgatctggatgccacacaggatattccttccctgtgtgaggccactagaagaacttgctcccctcacttcaagaacctccttactaaaatcaataactctgatgcccctccagtgagttgcatagtctcggatggtgtcatgagcttcactcttgatgctgctgaagaattgggtctccccgaggtgctgttttggaccactagtgcatgtgggttcatgtgttacgtgcaatatgamcaactcattgaaaagggcctaacacccctcaaagactctagttatatcacaaatgggtatttggagactaccatcgattggataccaggaattaaggaaattcggttgaaggatcttcccagcttcattagaaccacaaatccagatgagttcatgcttgatttcatacagtgggagtgtgggaggactcgaagagcttctgcaataattttgaacacctttgatgccttagagcacgacgttttggaagcgttctcgtccattttgcctccggtttattccattggtcctttgaatttactcgtgaaacatgttgatgacaaagacttaaacgcaattgggtccaatctttggaaggaggagtctgagtgcgtggagtggcttgacacaaaagagcccaacagtgtcgtttacgtgaattttggtagcatcgcggttatgacaagtgagcaattgattgagtttgcatggggtcttgctaatagcaacaaaacctttttatgggtcataagaccagatcttgtggcgggcgaaaacgctcttttaccttcagagtttgtgaaacaaactgaaaaaagaggactattgtctagttggtgctcccaggaacaagtgctgactcaccctgcaattgggggatttttgacacacagtggttggaattcaacgttggaaagtgtatgtggaggtgttccaatgatatgttggcctttctttgcagagcaacaaaccaattgttggttttgttgtaaggagtgggggattgggttggagattgaagatgttgagagggacaaaatagagagccttgtgagggagttgatggatggtgaaaagggtaaggagatgaaagaaaaagctttgcaatggaaggaattggcaaaaagtgctgcttttggccctgttggatcttcatttgttaatttggataacatggttcgtgatgttcttctgggcaaaaatgttaaatattcgtattagaagaactcaaatattttaacttactccattgttgtgtgaagacttttttttttaataaccttttcttcatgggaaatgaaatgtaccaagtacc

SEQ ID NO: 267 - protein, 485 aa, Glycine max
  misc_feature (13)..(479): Pfam Name: UDPGT Pfam Description: UDP-glucoronosyl and UDP-glucosyl transfer
  misc_feature (1)..(485): Ceres Clone ID no. 514069
  misc_feature (1)..(485): Bit score of 1272.7 for HMM based on sequences of Figure 5
  misc_feature (1)..(485): Functional Homolog Of SEQ ID NO. 253
  misc_feature (1)..(485): in Figure 5
  misc_feature (159)..(159): Xaa is any aa, unknown, or other
MGSLGTINNKPHAVCIPYPAQGHINPMLKLAKLLHFKGFHITFVNTEYNHKRLLKARGPDSLNGLSSFRFETIPDGLPETDLDATQDIPSLCEATRRTCSPHFKNLLTKINNSDAPPVSCIVSDGVMSFTLDAAEELGLPEVLFWTTSACGFMCYVQYXQLIEKGLTPLKDSSYITNGYLETTIDWIPGIKEIRLKDLPSFIRTTNPDEFMLDFIQWECGRTRRASAIILNTFDALEHDVLEAFSSILPPVYSIGPLNLLVKHVDDKDLNAIGSNLWKEESECVEWLDTKEPNSVVYVNFGSIAVMTSEQLIEFAWGLANSNKTFLWVIRPDLVAGENALLPSEFVKQTEKRGLLSSWCSQEQVLTHPAIGGFLTHSGWNSTLESVCGGVPMICWPFFAEQQTNCWFCCKEWGIGLEIEDVERDKIESLVRELMDGEKGKEMKEKALQWKELAKSAAFGPVGSSFVNLDNMVRDVLLGKNVKYSY

SEQ ID NO: 268 - protein, 479 aa, Stevia rebaudiana
  misc_feature (27)..(479): Pfam Name: UDPGT Pfam Description: UDP-glucoronosyl and UDP-glucosyl transfer
  misc_feature (1)..(479): Public GI ID no. 37993655
  misc_feature (1)..(479): Bit score of 1232.6 for HMM based on sequences of Figure 5
  misc_feature (1)..(479): Functional Homolog Of SEQ ID NO. 253
  misc_feature (1)..(479): in Figure 5
MASIAEMQKPHAICIPYPAQGHINPMMQFAKLLHFKGFHISFVNNHYNHKRLQRSRGLSALEGLPDFHFYSIPDGLPPSNAEATQSIPGLCESIPKHSLEPFCDLIATLNGSDVPPVSCIISDGVMSFTLQAAERFGLPEVLFWTPSACGFLAYTHYRDLVDKEYIPLKDTNDLTNGYLETSLDWIPGMKNIRLKDFPSFIRTTDINDIMLNYFLIETEAIPKGVAIILNTFDALEKDSITPVLALNPQIYTIGPLHMMQQYVDHDERLKHIGSNLWKEDVSCINWLDTKKPNSVVYVNFGSITVMTKEQLIEFGWGLANSKKDFLWITRPDIVGGNEAMIPAEFIEETKERGMVTSWCSQEEVLKHPSIGVFLTHSGWNSTIESISNGVPMICWPFFAEQQTNCRYCCVEWEIGLEIDTDVKREEVEAQVREMMDGSKGKMMKNKALEWKKKAEEAVSIGGSSYLNFEKLVTDVLLRK

SEQ ID NO: 269 - protein, 483 aa, Prunus dulcis
  misc_feature (11)..(481): Pfam Name: UDPGT Pfam Description: UDP-glucoronosyl and UDP-glucosyl transfer
  misc_feature (1)..(483): Public GI ID no. 157734205
  misc_feature (1)..(483): Bit score of 1239.0 for HMM based on sequences of Figure 5
  misc_feature (1)..(483): Functional Homolog Of SEQ ID NO. 253
  misc_feature (1)..(483): in Figure 5
MSPVASKEKPHAVFVPFPAQGHINPMLQLAKLLNYKGFHITFVNTEFNHKRMLESQGSHALDGLPSFRFETIPDGLPPADADARRNLPLVCDSTSKTCLAPFEALLTKLNSSPDSPPVTCIVADGVSSFTLDAAEHFGIPEVLFWTTSACGLMGYVQYYRLIEKGLTPFKDAKDFANGYLDTEIDWIPGMKDVRLKDMPSFIRTTDPNDIMLHYMVSETERSKKASAIILNTFDALEQEVVDALSTLLPPIYSIGPLQLPYSEIPSEYNDLKAIGSNLWAENTECLNWLDTKEPNSVVYVNFGSTTVMTNEQLVEFSWGLANSKKPFLWIIRPGLVAGETAVVPPEFLEETKERGMLASWCPQEQVLLHSAIGGFLTHSGWNSTLEALCGGVPLICWPFFAEQQTNVRYSCTQWGIGIEIDGEVKRDYIDGLVRTLMDGEEGKKMRKKALEWKKLAEDATSPKGSSYLALENVVSKVLLSPRD

SEQ ID NO: 270 - protein, 491 aa, Linum usitatissimum
  misc_feature (14)..(488): Pfam Name: UDPGT Pfam Description: UDP-glucoronosyl and UDP-glucosyl transfer
  misc_feature (1)..(491): Public GI ID no. 159171968
  misc_feature (1)..(491): Bit score of 1242.2 for HMM based on sequences of Figure 5
  misc_feature (1)..(491): Functional Homolog Of SEQ ID NO. 253
  misc_feature (1)..(491): in Figure 5
MGSMGHSEKPKPHAVCIPYPAQGHITPMLKLAKLLHHRGFHVTFVNTEYNHNRLRKSQAVSDLPSFRFATIPDGLPPTDSDVTQDIPSLCESTRRTCLPHFKELLAKLNDVASFEDGVPPVSCVVSDGVMSFTLDAAEELGVPEVLFWTTSACGFLGYMHYRDLIDRGIVPLKDESYLTNGYLDTVIDWIPAMSNIKLKDLPTFLRTTNPDEFMVEFVLGETERSRSPKPAAIILNTFDALEHDVLASLSNMLAKPVYSIGPLQLLANDQTITDPSVKNISSSLWKEESECLDWLETKPKNSVVYVNFGSITVMTNDQLVEFAWGLANSKKDFLWVIRPDLVAGETAVLPPEFVAKTRDRGLLASWCPQEQVLNHESVAGFLTHNGWNSTLESVSAGVPMICWPFFAEQQTNCWFACNEWGVGMEINSDVKRDEVEAQVRELVDGRKGGEMRKKAAEWKRIAAEAVTGGGGSSFAGLDSLIERVLLSSSRK

SEQ ID NO: 271 - protein, 486 aa, Oryza sativa subsp. indica
  misc_feature (9)..(482): Pfam Name: UDPGT Pfam Description: UDP-glucoronosyl and UDP-glucosyl transfer
  misc_feature (1)..(486): Public GI ID no. 125541183
  misc_feature (1)..(486): Bit score of 1098.4 for HMM based on sequences of Figure 5
  misc_feature (1)..(486): Functional Homolog Of SEQ ID NO. 253
MGSNSRLHAVLIPYPAQGHVTPLLHLAKVLHSRGFHVTFVNSEYNHRRLLRSRGTGALAGLDDFRFETIPDGLPPPSESDNDDVTQDIPTVCTSFLTHGPAAFGALLARLNSEPGTPPVSCVIPDGVMSFAQRVASDMGILAPAFWTTSACGFMGYLHYAELIDRGYVPLKDESYLTNGYLDTVLDWVPGMPGIRLRDMPSFIRTTDRDEFMLNFDSGEAQNARHAQGLILNTFDAVEDDVVDALRRIFPRVYTVGPLLTFAGAAAARRPEVGAIGGNLWKEDASCLRWLDAQQPGSVVYVNFGSITVMSPAHLAEFAWGLARCGRPFLWVIRPDLVAGEKAMLPEEFVSETKERGIFLSWCPQEQVLEHPATGLFLTHSGWNSTLESISAGVPMICWPFFAEQMTNCRYACTKWDIGLEIDTDVKREEVARLVQEAMDGEKSKDMRAKAMAWKEKAVAATEEGGTSSAGIDRLVEFLLARGDHAS

SEQ ID NO: 272 - protein, 486 aa, Oryza sativa subsp. japonica
  misc_feature (9)..(482): Pfam Name: UDPGT Pfam Description: UDP-glucoronosyl and UDP-glucosyl transfer
  misc_feature (1)..(486): Public GI ID no. 115448767
  misc_feature (1)..(486): Bit score of 1095.4 for HMM based on sequences of Figure 5
  misc_feature (1)..(486): Functional Homolog Of SEQ ID NO. 253
MGSNSRLHAVLIPYPAQGHVTPLLHLAKVLHSRGFHVTFVNSEYNHHRLLRSRGTGALAGLDDFRFETIPDGLPPPSESDNDDVTQDIPTVCTSFLTHGPAAFGALLARLNSEPGTPPVSCVIPDGVMSFAQRVASDMGILAPAFWTTSACGFMGYLHYAELIDRGYVPLKDESYLTNGYLDTVLDWVPGMPGIRLRDMPSFIRTTDRDEFMLNFDSGEAQNARHAQGLILNTFDAVEHDVVDALRRIFPRVYTVGPLLTFAGAAAARRPEVGAIGGNLWKEDASCLRWLDAQQPGSVVYVNFGSITVMSPAHLAEFAWGLARCGRPFLWVIRPDLVASEKAMLPEEFVSETKERGIFLSWCPQEQVLEHPATGLFLTHSGWNSTLESISAGVPMICWPFFAEQMTNCRYACTKWDIGLEIDTDVKREEVARLVQEAMDGEKSKDMRAKAMAWKEKAVAATEEGGTSSAGIDRLVEFLLARGDHAS

SEQ ID NO: 273 - DNA, 1458 bp, Sorghum bicolor
  misc_feature (1)..(1458): Ceres Annot ID no. 8680541
  misc_feature (1)..(1458): Encodes the peptide sequence at SEQ ID NO. 274
atgggctccaacgcgcgcccccacgcggtgctcatcccgtacccggcgcagggccatgtcacgccgatgctgcagctcgccaaggtgctgcactcgaggggattcttcgtcacctacgtcaacaccgagtacaaccaccgccgcctgctccggtctcgtggcgcggacgcgctggatggcctcgacgacttccggttcgagaccatcccggacggcctgcctccgtccggcaacgacgacgacgacgtcacgcaggacatccccacgctctgcgagtcgcttctccggaacggcgccgcgccgtttagggacctactgacgaggctcaaccgcatgcccggccggccgccggtcacctgcgtcgtgctggacaacttcatgagcttcgcgcagagggtcgccaacgagatgggcatcctcgcagtggtgttctgcaccatgagcgcgtgtggcttcatggggtatctccactacaaggagctcatggacagaggctacgtgccactcaaagatgagagctacctgaccaacgggtacctggacacggtgctcgactgggtgcccgggatgccgggcatccgtctgcgagacattcccagcttcatccgcacgacggacccggacgaattcatggtccatttcgacagcaacgaggcccagaacgcgcaccgcgcgcagggggtcatcttcaacacgttcgacgcgctggagcaggacgtcgtcgacgcgatgcgccgcatcttccctcgcgtgtacaccatcggcccgctcctcacgttcgccggcaccatggcccgccccgacgcggcggcgatcagcggcagcctctggaaggaggacctgagctgcctccggtggctggacgcccggacgggcggctcggtcgtgtacgtcaacttcggcagcatcacggtcatgacgccggctcagctcgccgagttcgcgtggggcctggcgcgctgcggcaggccgttcctgtgggtcatcaggccggacctcgtcaccggcgacaaggctatgctgccggaggagttctacgctgagacgaaagagcgagggctcttcctcagctggtgcccgcaggaacaggtcctgtcgcatccgtcgacggggctgttcctgacgcactctgggtggaactcgacgctggagagcatccgcgccggcgtgccgatgatctgctggccgttcttcgccgagcaggtgaccaactgccgatatgcctgcaacaactggggcattggactggagattgacaacaatgtcacgagggaggaagtggcacggctcataaaagaagccatggacggcgagaaaggcaaagacatgaaagcgaaagcaacgatgtggaaggagaaggccgtggcggcaacagaaggcggcgggacctcgagcgttaacattgaacgtttggtcgaattcatgcttgaaggaaatgttcctacagctgcaagctaa

SEQ ID NO: 274 - protein, 485 aa, Sorghum bicolor
  misc_feature (9)..(479): Pfam Name: UDPGT Pfam Description: UDP-glucoronosyl and UDP-glucosyl transfer
  misc_feature (1)..(485): Ceres Annot ID no. 8680541
  misc_feature (1)..(485): Bit score of 1088.9 for HMM based on sequences of Figure 5
  misc_feature (1)..(485): Functional Homolog Of SEQ ID NO. 253
MGSNARPHAVLIPYPAQGHVTPMLQLAKVLHSRGFFVTYVNTEYNHRRLLRSRGADALDGLDDFRFETIPDGLPPSGNDDDDVTQDIPTLCESLLRNGAAPFRDLLTRLNRMPGRPPVTCVVLDNFMSFAQRVANEMGILAVVFCTMSACGFMGYLHYKELMDRGYVPLKDESYLTNGYLDTVLDWVPGMPGIRLRDIPSFIRTTDPDEFMVHFDSNEAQNAHRAQGVIFNTFDALEQDVVDAMRRIFPRVYTIGPLLTFAGTMARPDAAAISGSLWKEDLSCLRWLDARTGGSVVYVNFGSITVMTPAQLAEFAWGLARCGRPFLWVIRPDLVTGDKAMLPEEFYAETKERGLFLSWCPQEQVLSHPSTGLFLTHSGWNSTLESIRAGVPMICWPFFAEQVTNCRYACNNWGIGLEIDNNVTREEVARLIKEAMDGEKGKDMKAKATMWKEKAVAATEGGGTSSVNIERLVEFMLEGNVPTAAS

SEQ ID NO: 275 - protein, 482 aa, Vitis vinifera
  misc_feature (11)..(482): Pfam Name: UDPGT Pfam Description: UDP-glucoronosyl and UDP-glucosyl transfer
  misc_feature (1)..(482): Public GI ID no. 225465718
  misc_feature (1)..(482): Bit score of 1246.6 for HMM based on sequences of Figure 5
  misc_feature (1)..(482): Functional Homolog Of SEQ ID NO. 253
MGSVTASDKPHVVLIPYPAQGHVNPMLKLAKLLHNKGFFVSFVNTEYNHKRLLRSRGPNSLDGLSDFRFETIPDGLPPSDADATQDIPSLCVSTTKNCLAPFCALITKLNDPSYSPGPPVSCIVSDGVMSFTLDAAEKFGVPEVVFWTTSACGFLGYRHYRNLIRRGLIPLQDESCLSNGYLDTVVDFVPGKKKTIRLRDFPTFLRTTDLNDIMLNFVRVEAERASRASAVILNTFDALEKDVLDALSATLPPVYSIGPLQHLVDQISDDRLKSMGSNLWKEQTDCLQWLDSKEPNSVVYVNFGSITVMTSQQLTEFAWGLANSNKPFLWIIRPDLVVGDSALLPPEFVTETKDRGMLASWCPQEQVLKHPAIGGFLTHSGWNSTSESICGGVPLICWPFFAEQQTNCRYSCSEWGIGMEIDNNVKRVEVEKLVRELMDGEKGKEMKKKVMEWKKLAEEATRPGGSSYDNFNKLLRNVLSKK

SEQ ID NO: 276 - protein, 476 aa, Vitis vinifera
  misc_feature (12)..(475): Pfam Name: UDPGT Pfam Description: UDP-glucoronosyl and UDP-glucosyl transfer
  misc_feature (1)..(476): Public GI ID no. 225459253
  misc_feature (1)..(476): Bit score of 1286.0 for HMM based on sequences of Figure 5
  misc_feature (1)..(476): Functional Homolog Of SEQ ID NO. 253
MGSLASAEKPHAVCIPYPAQGHINPMLKLAKFLHFRGFHITFVNTEYNHNRLLKSRGPDSLKGIPSFQFKTIPDGLLPSNVDATQDIPALCVSTRKHCLPPFRDLLSNLNHDGPPVTCIVSDGAMSFTLDAAQELGVPEVLFWTTSACGFMGYVQYRNLIDKGLAPLKDESYLTNGYLDTVIDWIPGMKGIRLRDIPSFIRTTDPNEIMLEFPLREAERARKASALIFNTFDALEHEVLDALSQMFPPIYTIGPLHQLMSQIQDNDLKLMESNLWKEEPECLEWLDSKEPNSVVYVNFGSITVMTSQQLNEFAWGLVNSNQTFLWIIRPDLVSGDAAILPPEFVAETKERGLLAGWCPQEQVLSHPAVGGFLTHNGWNSTIESVSAGVPMICWPFFAEQQTNCRYCCTEWGIGMEIDSDVKRDEIERLVKELMEGEKGKELKKKALEWKTLAEEATRGPKGSSFSNLDKMITQALL

SEQ ID NO: 277 - protein, 473 aa, Vitis vinifera
  misc_feature (9)..(471): Pfam Name: UDPGT Pfam Description: UDP-glucoronosyl and UDP-glucosyl transfer
  misc_feature (1)..(473): Public GI ID no. 225459257
  misc_feature (1)..(473): Bit score of 1213.8 for HMM based on sequences of Figure 5
  misc_feature (1)..(473): Functional Homolog Of SEQ ID NO. 253
MGSMEKPHAVCIPYPAQGHINPMLKVAKLLHFRGFRITFVNTEFNHTRLLKAQGPNSLNGLPTFQFETIPDGLPPSNVDATQDIPSLCASTKKNCLAPFRRLLAKLNDRGPPVTCIFSDAVMSFTLDAAQELGIPDLLLWTASACGFMAYVQYRSLIDKGFTPLKDESYLTNGYLDTVVDWIPGMKGIRLKDLPSFIRTTDPDDIMLDFAMGELERARKASAIIFNTFDALEQEVLDAIAPMYPPIYTIGPLQLLPDQIHDSELKLIGSNLWKEEPECLKWLDSKEPNSVVYVNYGSITVMTPQQLIEFAWGLANSNQSFLWILRPDLVSGESAILPPEFVAETEDRGLLAGWCPQEQVLTHQAIGGFLTHNGWNSTIEGLCAGVPMICWPFFAEQQTNCRYCCTEWGVGMEIDSDVKRDEVAKLVRELMVGEKGKVMKKKTMEWKHRAEVATTGPDGSSYLNLEKIFEQVLL

SEQ ID NO: 278 - protein, 474 aa, Vitis vinifera
  misc_feature (10)..(470): Pfam Name: UDPGT Pfam Description: UDP-glucoronosyl and UDP-glucosyl transfer
  misc_feature (1)..(474): Public GI ID no. 225459268
  misc_feature (1)..(474): Bit score of 1169.1 for HMM based on sequences of Figure 5
  misc_feature (1)..(474): Functional Homolog Of SEQ ID NO. 253
MGSVEKKPHAVCIPFPAQGHIKPMLNLAKLLHFRGFHITFVNTEFNHRRLLKARGPNSLDGLPSFQFETIPDGLQPSDVNATQDIPSLCVSTKNNLLPPFRCLLSKLNHNGPPVTCIVSDSSLTSTLDAAQELGIPGLLFWTASACGFMGYAHYRTLVNKGFIPLKDASYLTNGYLDTVIDWIPGMKGIRLKDMPSFVRTTDPDDVMLGFAMGEIERARKASAIIFNTFDALEHEVLDAISTMYPPIYTIGPISLLMNQIQDKDLKSIGSNLWKEDEECLQWLDSKGPNTVVYVNFGSITVMKPEHLIEFAWGLSNSKQKFLWIIRPDLVSGASAILPPEFLTETKDRGLLASWCSQEQVLGHPAVGGFLTHNGWNSILESVCCGVAMICWPFFAEQQTNCRYCCTEWGIGMEIDGDVKRDDVERLVRELMEGEKGEEMKKKTMEWKKIAHEATTAPSGSSFFNLDRMIKQLLL

SEQ ID NO: 279 - protein, 472 aa, Vitis vinifera
  misc_feature (8)..(470): Pfam Name: UDPGT Pfam Description: UDP-glucoronosyl and UDP-glucosyl transfer
  misc_feature (1)..(472): Public GI ID no. 225459266
  misc_feature (1)..(472): Bit score of 1190.0 for HMM based on sequences of Figure 5
  misc_feature (1)..(472): Functional Homolog Of SEQ ID NO. 253
MGSEKPHAVCIPYPAQGHINPMLKLAKLLHCRGFRITFVNTEFNHTRLLNAQGPNCLSGLPTFQFETIPDGLPPSDVDATQDIPSLCVSTKKNCLAPFRRLLAKLNHDGPPVTCIFSDAIMSFTLDAAQELGIPDLLLWTASACGFMAYVQYRSLIDKGFTPLKDESYLTNGYLDTVVDWIPGMKGIRLKDLPSFIRTTDPDDVMLDFAMGELERARKASAIIFNTFDALEHEVLDAIAPMYPPIYTIAPLQLLLDQIHDSELQLIESNLWKEEPECLKWLDSKEPNSVVYVNYGSITVMTPQQLIEFAWGLANSNQSFLWILRPDLVSGESAILPPEFVAETEDRGLLAGWCLQEQVLTHQAIGGFLTHNGWNSIIEGLCAGVPMICWPFFAEQQTNCRYCCTEWGVGMEIDSDVKRDEVAKLVRELMEGEKGKEMKKKTMEWKHTAEAATTGPDGSSYLNLEKMFEHVLL

SEQ ID NO: 280 - DNA, 1452 bp, Populus balsamifera subsp. trichocarpa
  misc_feature (1)..(1452): Ceres Annot ID no. 1441002
  misc_feature (1)..(1452): Encodes the peptide sequence at SEQ ID NO. 281
atgggttccttagttccggctgataaacctcatgctgtgtgcgtcccttttccagctcagggtcacataaacccaatgctcaaactagcaaaactactccacttcaaaggctttcacgtaacctttgttaatacagagtataatcacaaacgcttactcaagtctagaggcaccaactcccttgatggcttcccagacttccagtttgagactatccctgacggtcttccatcatcagatattgctgatgccactcaagatgtcccatctctttgcaaatacacctcccaaactgctttagccccactatgcgatcttattgccaaactcaactcctcaggtgcagtgccccaggtgacatgtattgtcgctgatgcttgcatgagtttcagtcttgatgcagctgaagaatttggaattcctgaagcagtgttttggacacctagcgcctgtggtgttttgggctactcgcagtatcgtcctctcatcgaaagaggcttaatacctctgaaagatgcgagggatctaacaaatggctacttagaaacaccagtagattggattccaggaatgaaagatatccgtttgaaagatcttccaacttttatcagaactacagacgtaaacgacgtcatgctgcaattcgtgaaaagagaaattgacagaacttcaagagcttctgctgtcattcttaacacattcgactccttcgaacaagatgttttggatgctctctccccaatgtttcctccaatttacactgttggtcctcttcaattgcttgttgatcagattccaaatggtgatctgaaaaatattggctccaatctttggaaagaacagccagagtgtattgaatggcttgattccaaagaaccaaaatctgtggtgtacgtaaattttggtagcatcactgtaataacaccccagcaaatgatagaatttgcttggggactagccaacagcaaccaaactttcttatggataataagacctgatattgttctaggtgaagccgcaatgttgccacctgaatttttatctgaaacaaaggatagaggcatgcttgtaagctggtgtccccaagaacaagtgttgaagcatccttccataggagggtttctaagtcacatggggtggaattcaacgttggacagtatctgtggtggcgtgccaatggtttgttggccatttttcgctgagcaacagaccaactgtaggcttgcctgtactgatcaatggggcattggcatggagatagataacaatgtgaaaagaaatgaagtggagaaacttgtgagagaattaatggagggagagaagggaaaagcaatgaaaaagaaggcaatggaatggaaaaccaaggcagaggaggcagctttggccggtaatggttctcatcggaacctggatcaattggtaaaagctctttctaacaagaaaataagttag

SEQ ID NO: 281 - protein, 483 aa, Populus balsamifera subsp. trichocarpa
  misc_feature (12)..(481): Pfam Name: UDPGT Pfam Description: UDP-glucoronosyl and UDP-glucosyl transfer
  misc_feature (1)..(483): Ceres Annot ID no. 1441002
  misc_feature (1)..(483): Bit score of 1145.7 for HMM based on sequences of Figure 5
  misc_feature (1)..(483): Functional Homolog Of SEQ ID NO. 253
MGSLVPADKPHAVCVPFPAQGHINPMLKLAKLLHFKGFHVTFVNTEYNHKRLLKSRGTNSLDGFPDFQFETIPDGLPSSDIADATQDVPSLCKYTSQTALAPLCDLIAKLNSSGAVPQVTCIVADACMSFSLDAAEEFGIPEAVFWTPSACGVLGYSQYRPLIERGLIPLKDARDLTNGYLETPVDWIPGMKDIRLKDLPTFIRTTDVNDVMLQFVKREIDRTSRASAVILNTFDSFEQDVLDALSPMFPPIYTVGPLQLLVDQIPNGDLKNIGSNLWKEQPECIEWLDSKEPKSVVYVNFGSITVITPQQMIEFAWGLANSNQTFLWIIRPDIVLGEAAMLPPEFLSETKDRGMLVSWCPQEQVLKHPSIGGFLSHMGWNSTLDSICGGVPMVCWPFFAEQQTNCRLACTDQWGIGMEIDNNVKRNEVEKLVRELMEGEKGKAMKKKAMEWKTKAEEAALAGNGSHRNLDQLVKALSNKKIS

SEQ ID NO: 282 - protein, 480 aa, Vitis vinifera
  misc_feature (11)..(479): Pfam Name: UDPGT Pfam Description: UDP-glucoronosyl and UDP-glucosyl transfer
  misc_feature (1)..(480): Public GI ID no. 225468662
  misc_feature (1)..(480): Bit score of 1068.2 for HMM based on sequences of Figure 5
  misc_feature (1)..(480): Functional Homolog Of SEQ ID NO. 253
MDPKVMGKPHAVCVPFPAQGHVNPMMQVAKLLHSRGFYITFVNTEFNHRRLVRSKGQEDWVKGFDDFRFETIPDGLPPSDRDATQDPSMLCYSIPKHCPAPFQNLLGKLNSLSEVPPVTRIVSDGVMSFAIKAAEELGIPVVQFWTASACGFMGYLHYSQLIQRGIVPFKDETFISDATLDTPIDWIPGMPNIRLKDIPSFIRTTDPNDTMLNYLGDEAQNCLKASAIIINTFDAFEHQVLEAIVSKFPSIYTIGPLSLLTSVAPKSQLTSFRPSLWVDDTTCLEWLDQREPNSVIYVNYGSVTVMSDQHLKEFAWGLANSQYSFLWIIRPDVVMGDSAVLPEEFREETKDRGLLASWCPQEQVLSHPSVAVFLTHSGWNSTLETVCAGVPVICWPFFAEQQTNCRYACTEWGIGMEVNHDVKRHDIEALVKEMMEGEKGKQMKKTAMEWKKKAEEATGVGGSSYNNFDRLVKEVLHHGS

SEQ ID NO: 283 - protein, 484 aa, Vitis vinifera
  misc_feature (11)..(481): Pfam Name: UDPGT Pfam Description: UDP-glucoronosyl and UDP-glucosyl transfer
  misc_feature (1)..(484): Public GI ID no. 225459270
  misc_feature (1)..(484): Bit score of 1220.9 for HMM based on sequences of Figure 5
  misc_feature (1)..(484): Functional Homolog Of SEQ ID NO. 253
MAMAEKPRPHAVCVPFPAQGHINPMMKLAKLLHHKGFHITFVNTEFNHQRLLKSRGPNSLRGLPSFQFETIADGLPPSDIDATQDVPSLCASTHNDCLAPFRDLLAKLNDTSSSKVPPVTCIVSDGIMSFTLKAAEELGIPEVFFWTTSACGFMGYVQYRHLIDRGFFPLKDESCLTNGHLDTVVDWIPAMKGVRLRDLPSFIRTTNPDDIVVNFAMGEVERANDASAILLNTFDELEHEVLQALSTMFPPIYTIGPLQLLLNQMPDNDLKSIESNLWKEEPGCLEWLDAKEPESVVYVNFGSVTVMTPQQLVEFAWGLANANLKFLWIIRPDLVAGDAAILPADFVAQTKERSLLASWCPQERVLTHPAIGGFLTHSGWNSTIEGLCGGVPMICWPFFAEQMTNCRYCCTEWGVGMEIGNDVTRDEVESLVRGLMEGEKGKEMKKKAMEWKRMAEAATTTPAGSSYSNLDKMINQVLLSKSPC

SEQ ID NO: 284 - DNA, 1545 bp, Populus balsamifera subsp. trichocarpa
  misc_feature (1)..(1545): Ceres Annot ID no. 1476414
  misc_feature (1)..(1545): Encodes the peptide sequence at SEQ ID NO. 285
atggtgtccatagaattggcaaataaaccccatgccgtgtgtatcccttttccagcccagggtcacataaacccaatgctaaaactagcaaaactactccacttcaaaggttttcacataacctttgttaatacagagtataaccacagacgcttactcaagtctagaggcagcagctctcttgatggcttgccagacttccagtttaagaccattcctgatggtcttccaccatcagatattgctgatgccactcaagacatcccatctctttgtgactgcacctccacgacttgcttagccccatttcgtgatcttattgtcaaactcaactcctccagtattgtgccccaggtgacatgtattatctctgatgcttgcatgagcttcactcttgacgccgctgaagaattcggaattcctgaagcgctgttttggacacctagcgcctgtggtgttttgggctacgcacaatatcgttctcttatcgaaagaggcttgatacctctgaaagacgcgaccgatctaacaaatgggtacttagaaacatccatagattggattccaggaatgaaaaatatccgtttgagggatcttccaagttttgtcagaactacagacataaacgacttcatgcttcacttcctgataagagaaatagacagaacctcaagagcttctgctgtcattattaacacctttgactccttcgaacaagatgttttggatgctttatccccaatgtttcctccaatttacacacttggtcctctccagttgcttgttgatcagattccaaatggtaatctgaaaaatattggctccaatctttggaaagatcatccagagtgcattgaatggcttgattcaaaaggaccaaactctgtggtgtatgtaaattttggtagcatcactgtaataactgcacagcaaatgattgaatttgcttggggactagccaacagcaacaaacctttcttatggataataaggcctgatcttattgtaggtgaagccgcgatgttgccacctgaatttttatctgtaacaaaggatagaagtttgctagtaagctggtgtcctcaagaacaagtcctgaagcatccttccataggagggtttttaagtcacatggggtggaactcgacattggaaagtatctgtggaggtgtcccaatggtttgttggccgtttttcggtgagcaacagaccaactgttggtttgcttgtactaagtggggtatcggaatggagatagaaaacaacgtgaaaagagatgaagtggaaaaacttgtgagggagttaatggagggagagaagggaaaagatatgaaaaggaaggcaatggaatggaaaaccaaggcagaggaggcagcttggaccggtgatgcttctcataggaatctggatcgattgatgaaaaacatggtcatttttgatgaattgttgtgcaactacaggcattcacgagctcctaaacgacaaagtaatctcacattggaacagccagctgatggcagtgcatacctcagtatatatatatag

SEQ ID NO: 285 - protein, 514 aa, Populus balsamifera subsp. trichocarpa
  misc_feature (12)..(480): Pfam Name: UDPGT Pfam Description: UDP-glucoronosyl and UDP-glucosyl transfer
  misc_feature (1)..(514): Ceres Annot ID no. 1476414
  misc_feature (1)..(514): Bit score of 1158.7 for HMM based on sequences of Figure 5
  misc_feature (1)..(514): Functional Homolog Of SEQ ID NO. 253
MVSIELANKPHAVCIPFPAQGHINPMLKLAKLLHFKGFHITFVNTEYNHRRLLKSRGSSSLDGLPDFQFKTIPDGLPPSDIADATQDIPSLCDCTSTTCLAPFRDLIVKLNSSSIVPQVTCIISDACMSFTLDAAEEFGIPEALFWTPSACGVLGYAQYRSLIERGLIPLKDATDLTNGYLETSIDWIPGMKNIRLRDLPSFVRTTDINDFMLHFLIREIDRTSRASAVIINTFDSFEQDVLDALSPMFPPIYTLGPLQLLVDQIPNGNLKNIGSNLWKDHPECIEWLDSKGPNSVVYVNFGSITVITAQQMIEFAWGLANSNKPFLWIIRPDLIVGEAAMLPPEFLSVTKDRSLLVSWCPQEQVLKHPSIGGFLSHMGWNSTLESICGGVPMVCWPFFGEQQTNCWFACTKWGIGMEIENNVKRDEVEKLVRELMEGEKGKDMKRKAMEWKTKAEEAAWTGDASHRNLDRLMKNMVIFDELLCNYRHSRAPKRQSNLTLEQPADGSAYLSIYI

SEQ ID NO: 286 - DNA, 1665 bp, Populus balsamifera subsp. trichocarpa
  misc_feature (1)..(1665): Ceres Annot ID no. 1529873
  misc_feature (1)..(1665): Encodes the peptide sequence at SEQ ID NO. 287
atggtgtccatagaattggcaaataaaccccatgccgtgtgtatcccttttccagcccagggtcacataaacccaatgctaaaactagcaaaactacgccacttcaaaggttttcacataacctttgttaatacagagtataaccacagacgcttactcaagtctagaggcagcagctctcttgatggcttgccagacttccagtttatgaccattcctgatggtcttccaccatcagatattgctgatgccactcaagacatcccatctctttgtgactgcacctccacgacttgcttagccccatttcgtgatcttattgccaaactcaactcctccagtattgtgccccaggtgacatgtattatctctgatgcttgcatgagcttcactcttgacgcagctgaagaattcggaattcctgaagcgctgttttggacacctagcgcctgtggtgttttgggctacgcacaatatcgttctcttatcgaaagaggcttgacacctctgaaagacgcgaccgatctaacaaatgggtacttggaaacatccatagattggattccaggaatgaaaaatatccgtttgagggatcttccaagttttgtcagaactacagacataaacgacttcatgcttcacttccagataagagaaatagacagaacctcaagagcttctgctgtcattattaacacctttgactccttcgaacaagatgttttggatgctttatccccaatgtttcctccaatttacacacttggtcctctccagttgcttgttgatcagattccaaatggtaatctgaaaaatattggctccaatctttggaaagatcatccagagtgcattgaatggcttgattcaaaaggaccaaactctgtggtgtatgtaaattttggtagcatcactgtaataactgcacagcaaatgattgaattttcttggggactagccaacagcaacaaacctttcttatggataataaggcctgatcttattgtaggtgaagccgcgatgttgccacctgaatttttatctgtaacaaaggatagaagtttgctagtaagctggtgtcctcaagaacaagtcctgaagcatccttccataggagggtttgtaagtcacatggggtggaactcgacattggaaagtatctgtggcggtgtcccaatggtttgttggccatttttcggtgaacaacagaccaactgttggtttgcttgtactaagtgggatatcggaatggagatagaaaacaacgtgaaaagagatgaagtggaaaaacttgtgagggagttaatggagggagagaaaggaaaagatatgaaaaggaaggcaatggaatggaaaaccaaggcagaagaggcagcttggaccggtgatgcttctcatcggaatctggatcgattgcttgcgtgcacctcgactaatcccacgggccctgaagttaacgaccatctactcactgctctcctaaacgtcaaagtaagctcacctcaaaatttggaacttcctgccaggacgttcctgctggctagttttgtcgctagctactacatgacgtctataatttccaaagaattaaattctagtcgtatgtaccctgacatggattccattaacaaatctaaaactcacgctggtattgttgtgctttaa

SEQ ID NO: 287 - protein, 554 aa, Populus balsamifera subsp. trichocarpa
  misc_feature (12)..(480): Pfam Name: UDPGT Pfam Description: UDP-glucoronosyl and UDP-glucosyl transfer
  misc_feature (1)..(554): Ceres Annot ID no. 1529873
  misc_feature (1)..(554): Bit score of 1144.4 for HMM based on sequences of Figure 5
  misc_feature (1)..(554): Functional Homolog Of SEQ ID NO. 253
MVSIELANKPHAVCIPFPAQGHINPMLKLAKLRHFKGFHITFVNTEYNHRRLLKSRGSSSLDGLPDFQFMTIPDGLPPSDIADATQDIPSLCDCTSTTCLAPFRDLIAKLNSSSIVPQVTCIISDACMSFTLDAAEEFGIPEALFWTPSACGVLGYAQYRSLIERGLTPLKDATDLTNGYLETSIDWIPGMKNIRLRDLPSFVRTTDINDFMLHFQIREIDRTSRASAVIINTFDSFEQDVLDALSPMFPPIYTLGPLQLLVDQIPNGNLKNIGSNLWKDHPECIEWLDSKGPNSVVYVNFGSITVITAQQMIEFSWGLANSNKPFLWIIRPDLIVGEAAMLPPEFLSVTKDRSLLVSWCPQEQVLKHPSIGGFVSHMGWNSTLESICGGVPMVCWPFFGEQQTNCWFACTKWDIGMEIENNVKRDEVEKLVRELMEGEKGKDMKRKAMEWKTKAEEAAWTGDASHRNLDRLLACTSTNPTGPEVNDHLLTALLNVKVSSPQNLELPARTFLLASFVASYYMTSIISKELNSSRMYPDMDSINKSKTHAGIVVL

SEQ ID NO: 288 - protein, 485 aa, Nicotiana tabacum
  misc_feature (13)..(484): Pfam Name: UDPGT Pfam Description: UDP-glucoronosyl and UDP-glucosyl transfer
  misc_feature (1)..(485): Public GI ID no. 62241067
  misc_feature (1)..(485): Bit score of 1277.5 for HMM based on sequences of Figure 5
  misc_feature (1)..(485): Functional Homolog Of SEQ ID NO. 253
MGSIGAEFTKPHAVCIPYPAQGHINPMLKLAKILHHKGFHITFVNTEFNHRRLLKSRGPDSLKGLSSFRFETIPDGLPPCDADATQDIPSLCESTTNTCLGPFRDLLAKLNDTNTSNVPPVSCIISDGVMSFTLAAAQELGVPEVLFWTTSACGFLGYMHYYKVIEKGYAPLKDASDLTNGYLETTLDFIPCMKDVRLRDLPSFLRTTNPDEFMIKFVLQETERARKASAIILNTYETLEAEVLESLRNLLPPVYPIGPLHFLVKHVDDENLKGLRSSLWKEEPECIQWLDTKEPNSVVYVNFGSITVMTPNQLIEFAWGLANSQQSFLWIIRPDIVSGDASILPPEFVEETKKRGMLASWCSQEEVLSHPAIGGFLTHSGWNSTLESISSGVPMICWPFFAEQQTNCWFSVTKWDVGMEIDCDVKRDEVESLVRELMVGGKGKKMKKKAMEWKELAEASAKEHSGSSYVNIEKVVNDILLSSKH

SEQ ID NO: 289 - protein, 483 aa, Vitis vinifera
  misc_feature (12)..(479): Pfam Name: UDPGT Pfam Description: UDP-glucoronosyl and UDP-glucosyl transf
  misc_feature (1)..(483): Public GI ID no. 225468664
  misc_feature (1)..(483): Bit score of 1049.4 for HMM based on sequences of Figure 5
  misc_feature (1)..(483): Functional Homolog Of SEQ ID NO. 253
MDSINGARKPHAVCVPYPTQGHVTPMLQLTKLLHTRGFHITFVNTEYNHRRLLRSRGPNAVKGLPDFRFETIPDGLPQSDRDASQDIPSLCDSTRKNCLPPFKDLLAKIGSSSEVPPVTCIISDGVMSFAIKAAKELGIPGFQLWTASACGFMGYLSYRELIRRGIVPFKDESYATDGTLDAPIDWIPGMPNMLLKDIPTFLRTTDLNDIMFDFLGEEAQNCLKATAVIINTFDELEHEVLEALKSKCPRLYTAGPLSLHARHLPESPFKHHSSSLWKEDHNCIEWLDKREPNSVVYVNYGSITTMTDQHLIEFAWGLANSRHPFLWILRSDVVGRDTAILPEEFLEETKDRGLVASWCSQDKVLYHPSVGVFLSHCGWNSTTESICGGVPLMCWPFFAEQVTNARYACTKWGMAVEVNQDVNRHEIEALVKEVMEGEKGKEIKKNAMEWKRKAFEATDVGGSSYNNFERFIKEVLQNHSDYQ

SEQ ID NO: 290 - protein, 487 aa, Vitis vinifera
  misc_feature (11)..(482): Pfam Name: UDPGT Pfam Description: UDP-glucoronosyl and UDP-glucosyl transfer
  misc_feature (1)..(487): Public GI ID no. 225467440
  misc_feature (1)..(487): Bit score of 1036.0 for HMM based on sequences of Figure 5
  misc_feature (1)..(487): Functional Homolog Of SEQ ID NO. 253
MATATVEKPHAVCIPYPTQGHISPMLNLAKLLHHRGFHITFVHSHFNYARLLKSRGPSSLRGLPDFRFESIPDGLPPPDNPDATQDIIALSISTANNCFIPFRNLLAKLNGGAPEIPPVTCVIYDGLMSFALEAAQQVGVPGVAFWTVSACSFICLLHFPHLLERGFTPFKDVSCKTKGNLDTIIDWIPGIPKIRLRDIPSSTRTTDPNDAFLEFIKGEISRAYKASASILNTFDALERDVLDSLSSMLNRLYTMGPMHLLLNQIQYEDTKLIGSNLWKEEPGCFQWLDSKKPGSVVYVNFGSITVLSPKQLIEFAWGLANSMQTFLWIIRPDLVMGETAFLPPEFLTEIKDRGMLAGWCAQEQVLIHSSVGGFLTHSGWNSTLESVCGGVPMICWPFFSDQHTNCYYSCEHWGFGTEIAYDVKREEVERVVRELMEGEKGKGMKKKVMKWKRKAEEATSPCGGSSYSNLNKLIQEILLPNKSITFN

SEQ ID NO: 291 - protein, 487 aa, Vitis vinifera
  misc_feature (11)..(482): Pfam Name: UDPGT Pfam Description: UDP-glucoronosyl and UDP-glucosyl transfer
  misc_feature (1)..(487): Public GI ID no. 225468668
  misc_feature (1)..(487): Bit score of 1034.7 for HMM based on sequences of Figure 5
  misc_feature (1)..(487): Functional Homolog Of SEQ ID NO. 253
MATATVEKPHAVCIPYPTQGHISPMLNLAKLLHHRGFHITFVHSHFNYARLIKSRGPSSLCGLPDFRFESIPDGLPPPDNPDATQDIIALSISTANNCFIPFRNLLAKLNSGAPEIPPVTCVIYDGLMSFALEAAQQVGVPGVAFWTVSACSFICLLHFPHLLERGFTPFKDVSCKTKGNLDTIIDWIPGIPKIRLRDIPSSTRTTDPNDAFLEFIKGEISRAYKASASILNTFDALERDVLDSLSSMLNRLYTMGPMHLLLNQIQYEDTKLIGSNLWKEEPGCFQWLDSKKPGSVVYVNFGSITVLSPKQLIEFAWGLANSMQTFLWIIRPDLVMGETAFLPPEFLTEIKDRGMLAGWCAQEQVLIHSSVGGFLTHSGWNSTLESVCGGVPMICWPFFSDQHTNCYYSCEHWGFGTEIAYDVKREEVERVVRELMEGEKGKEMKKKVMKWKRKAEEATSPCGGSSYSNLNKLIQEILLPNKSITFN

SEQ ID NO: 292 - protein, 481 aa, Arabidopsis thaliana
  misc_feature (9)..(481): Pfam Name: UDPGT Pfam Description: UDP-glucoronosyl and UDP-glucosyl transfer
  misc_feature (1)..(481): Public GI ID no. 17065006
  misc_feature (1)..(481): Bit score of 1239.9 for HMM based on sequences of Figure 5
  misc_feature (1)..(481): Functional Homolog Of SEQ ID NO. 253
MGSHVAQKQHVVCVPYPAQGHINPMMKVAKLLYAKGFHITFVNTVYNHNRLLRSRGPNAVDGLPSFRFESIPDGLPETDVDVTQDIPTLCESTMKHCLAPFKELLRQINARDDVPPVSCIVSDGCMSFTLDAAEELGVPEVLFWTTSACGFLAYLYYYRFIEKGLSPIKDESYLTKEHLDTKIDWIPSMKDLRLKDIPSFIRTTNPDDIMLNFIIREANRAKRASAIILNTFDDLEHDVIQSMKSIVPPVYSIGPLHLLEKQESGEYSEIGRTGSNLWREETECLDWLNTKARNSVVYVNFGSITVLSAKQLVEFAWGLAATGKEFLWVIRPDLVAGDEAMVPPEFLTATADRRMLASWCPQEKVLSHPAIGGFLTHCGWNSTLESLCGGVPMVCWPFFAEQQTNCKFSRDEWEVGIEIGGDVKREEVEAVVRELMDEEKGKNMREKAEEWRRLANEATEHKHGSSKLNFEMLVNKVLLGE

SEQ ID NO: 293 - DNA, 1605 bp, Arabidopsis thaliana
  misc_feature (1)..(1605): Ceres Annot ID no. 865380
  misc_feature (1)..(1605): Encodes the peptide sequence at SEQ ID NO. 294
aaaactcacatttgttcattacaaaaagaggaaactgacaactgatttcgcgcaagagaaagaaaaatgggatctcagatcattcataactcacaaaaaccacatgtagtttgtgttccatatccggctcaaggccacatcaaccctatgatgagagtggctaaactcctccacgccagaggcttctacgtcaccttcgtcaacaccgtctacaaccacaatcgtttccttcgttctcgtgggtccaatgccctagatggacttccttcgttccgatttgagtccattgctgacggtctaccagagacagacatggatgccacgcaggacatcacagctctttgcgagtccaccatgaagaactgtctcgctccgttcagagagcttctccagcggatcaacgctggagataatgttcctccggtaagctgtattgtatctgacggttgtatgagctttactcttgatgttgcggaggagcttggagtcccggaggttcttttttggacaaccagtggctgtgcgttcctggcttatctacacttttatctcttcatcgagaagggcttatgtccgctaaaagatgagagttacttgacgaaggagtacttagaagacacggttatagattttataccaaccatgaagaatgtgaaactaaaggatattcctagcttcatacgtaccactaatcctgatgatgttatgattagtttcgccctccgcgagaccgagcgagccaaacgtgcttctgctatcattctaaacacatttgatgaccttgagcatgatgttgttcatgctatgcaatctatcttacctccggtttattcagttggaccgcttcatctcttagcaaaccgggagattgaagaaggtagtgagattggaatgatgagttcgaatttatggaaagaggagatggagtgtttggattggcttgatactaagactcaaaatagtgtcatttatatcaactttgggagcataacggttttgagtgtgaagcagcttgtggagtttgcttggggtttggcgggaagtgggaaagagtttttatgggtgatccggccagatttagtagcgggagaggaggctatggttccgccggactttttaatggagactaaagaccgcagtatgctagcgagttggtgtcctcaagagaaagtactttctcatcctgctattggagggtttttgacgcattgcgggtggaactcgatattggaaagtctttcgtgtggagttccgatggtgtgttggccattttttgctgaccagcaaatgaattgtaagttttgttgtgacgagtgggatgttgggattgagataggtggagatgtgaagagagaggaagttgaggcggtggttagagagctcatggatggagagaagggaaagaaaatgagagaaaaggcggtagagtggcagcgcttagccgagaaagcgacggaacataaacttggttcttccgttatgaattttgagacggttgttagcaagtttcttttgggacaaaaatcacaggattaactaaaatataagatgatcatcgaaatgtattattttttctataatgattactaagtaagtgtttatttt

SEQ ID NO: 294 - protein, 489 aa, Arabidopsis thaliana
  misc_feature (13)..(485): Pfam Name: UDPGT Pfam Description: UDP-glucoronosyl and UDP-glucosyl transfer
  misc_feature (1)..(489): Ceres Annot ID no. 865380
  misc_feature (1)..(489): Bit score of 1156.2 for HMM based on sequences of Figure 5
  misc_feature (1)..(489): Functional Homolog Of SEQ ID NO. 253
MGSQIIHNSQKPHVVCVPYPAQGHINPMMRVAKLLHARGFYVTFVNTVYNHNRFLRSRGSNALDGLPSFRFESIADGLPETDMDATQDITALCESTMKNCLAPFRELLQRINAGDNVPPVSCIVSDGCMSFTLDVAEELGVPEVLFWTTSGCAFLAYLHFYLFIEKGLCPLKDESYLTKEYLEDTVIDFIPTMKNVKLKDIPSFIRTTNPDDVMISFALRETERAKRASAIILNTFDDLEHDVVHAMQSILPPVYSVGPLHLLANREIEEGSEIGMMSSNLWKEEMECLDWLDTKTQNSVIYINFGSITVLSVKQLVEFAWGLAGSGKEFLWVIRPDLVAGEEAMVPPDFLMETKDRSMLASWCPQEKVLSHPAIGGFLTHCGWNSILESLSCGVPMVCWPFFADQQMNCKFCCDEWDVGIEIGGDVKREEVEAVVRELMDGEKGKKMREKAVEWQRLAEKATEHKLGSSVMNFETVVSKFLLGQKSQD

SEQ ID NO: 295 - protein, 482 aa, Vitis vinifera
  misc_feature (10)..(479): Pfam Name: UDPGT Pfam Description: UDP-glucoronosyl and UDP-glucosyl transfer
  misc_feature (1)..(482): Public GI ID no. 225468660
  misc_feature (1)..(482): Bit score of 1033.5 for HMM based on sequences of Figure 5
  misc_feature (1)..(482): Functional Homolog Of SEQ ID NO. 253
MDPKNTTRKPHIVCVPFPAQGHVIPMMQLAKLLHSKGFCITFVNTEFNHRRLVRSKGEDWAKGFDDFWFETISDGLPPSNPDATQNPTMLCYHVPKHCLAPFRHLLAKLNSSPEVPPVTCIISDGIMSFALKAAEELGIPEVQFWTASACGFMAYLHHAELIQKGIFPFKDENFMSDGTLDTRVDWIPGMRNIRLKDLPSFIRTTDPNHIMFHFARTETQNCLKASAIIFNTFDAFEHEVLEAIASKFPHIYTIGPLSLLSSFTPKSQLTSFRPSLWADDSACLEWLDQRAPNSVIYANYGSVTVMSDQHLKEFAWGLANSKYSFLWIVRPDVVMGDSAVLPEEFLEETKGRGLLASWCPQEQVLSHPSVAVFLTHCGWNSMMETICAGVPVICWPFFAEQQTNCRYACTEWGIGMEVNHDVKRHDIEALVKEMMEGERGKEMKKNAMEWKKKAEEATAVGSSPCNNFDRFIKRLSTMDAKK

SEQ ID NO: 296 - protein, 485 aa, Vigna angularis
  misc_feature (12)..(479): Pfam Name: UDPGT Pfam Description: UDP-glucoronosyl and UDP-glucosyl transfer
  misc_feature (1)..(485): Public GI ID no. 19911203
  misc_feature (1)..(485): Bit score of 1169.7 for HMM based on sequences of Figure 5
  misc_feature (1)..(485): Functional Homolog Of SEQ ID NO. 253
MSSPDAKEKQHAVCVPFPAQGHINPMLKLAKLLHFNGFYITFVNTHYNHKRLLKSRGLNSLNGLPSFRFETIPDGLPEPEVEGTHHVPSLCDSTSTTCLPHFRNLLSKLNNESGVPAVSCIISDGVMSFTLDASQELGLPNVLFWTSSACGFMCYVHYHQLIQRGIVPFKDASDLTNGYLDTTIDWVAGIKEIRLKDIPSFIRTTDPEDIMLNFARDECIRAEKASAIILNTFDALEHDVLEAFSSILPPVYSIGPLSFLLNNVTDKRLNAIGSNLWREEPGCLEWLDTKEANTVVYVNFGSVTVMTNEQMIEFAWGLANSKKSFVWVIRPDLVVGERAVLPQEFVTQTKNRGMLSGWCPQEQVLGHPAIGVFLTHSGWNSTLESLCAGVPMICWPFFAEQQTNCRFCCKEWGIGVEIEDVERDHIERLVRAMMDGEKGKDMKRKAVNWKILAEKAASAPTGSSFVQFQKLIREVLKGRNGMTII

SEQ ID NO: 297 - protein, 479 aa, Arabidopsis thaliana
  misc_feature (12)..(479): Pfam Name: UDPGT Pfam Description: UDP-glucoronosyl and UDP-glucosyl transfer
  misc_feature (1)..(479): Public GI ID no. 42571589
  misc_feature (1)..(479): Bit score of 1146.1 for HMM based on sequences of Figure 5
  misc_feature (1)..(479): Functional Homolog Of SEQ ID NO. 253
MASHAVTSGQKPHVVCIPFPAQGHINPMLKVAKLLYARGFHVTFVNTNYNHNRLIRSRGPNSLDGLPSFRFESIPDGLPEENKDVMQDVPTLCESTMKNCLAPFKELLRRINTTKDVPPVSCIVSDGVMSFTLDAAEELGVPDVLFWTPSACGFLAYLHFYRFIEKGLSPIKDESSLDTKINWIPSMKNLGLKDIPSFIRATNTEDIMLNFFVHEADRAKRASAIILNTFDSLEHDVVRSIQSIIPQVYTIGPLHLFVNRDIDEESDIGQIGTNMWREEMECLDWLDTKSPNSVVYVNFGSITVMSAKQLVEFAWGLAATKKDFLWVIRPDLVAGDVPMLPPDFLIETANRRMLASWCPQEKVLSHPAVGGFLTHSGWNSTLESLSGGVPMVCWPFFAEQQTNCKYCCDEWEVGMEIGGDVRREEVEELVRELMDGDKGKKMRQKAEEWQRLAEEATKPIYGSSELNFQMVVDKVLLGE

SEQ ID NO: 298 - DNA, 1440 bp, Populus balsamifera subsp. trichocarpa
  misc_feature (1)..(1440): Ceres Annot ID no. 1503910
  misc_feature (1)..(1440): Encodes the peptide sequence at SEQ ID NO. 299
atgaggtcgactggagccagaaaaccacatgcagtatgtgttccctttccagcacagggccatgttacccctatgatgcatctagccaagcttttgcactcaagaggctttcacataaccttcgttaacactgagttcaaccacaggcgattaatccggtccagaggaccagactctgttgaaggcctgcctgatttccggtttgagaccataccggatggtttgcctttgccaccatctgattttgatgcaacacaagacgttccgtccttgtgtgattcaacaaggacaaattgtttggccccatttaaagagctccttacaaagttgaattcatcttctgaagtgcctcctgttacttgcgtaatctcagatggagccatgagctttggcataaaagctgcagaagagtttagcattccccaggttcagttttggacagcgtcagcttgtagcttcatgggatatttgcatttcagtgaactcaccagaagaggcttcgttccatacaaagaagaaaatttacttcgagatggcgatacacctattgattggatccctggtttgagtaacatccgactaaaagacatgccaacctttatcagaaccacaaacgatgaaataatgtttgattttatgggatcagaagcagagaactgcttgaactctcctgcaattatcttcaacacattcaacgaattcgaaaatgaggtgttggagtctataattgctaccaagttccctaacatttatacaataggtcctcttcccttgcttgcaaagcatatcgcagctgaaagcgaatccaggtcacttggttcaagtttatggaaagaagactcaaactgtcttgattggcttgataaaagaggactaaattctgtcgtgtacattaattatggaagtgtgaccgtaatgacagacacacacttgagagaatttgcttggggcctggcaaatagtaaactaccgtttttatggataattaggcctgatgtagtgatgggtgattctgcaatcttgccggaagagtttcttgagcaaattgatggtagaggattattagcaagttggtgtccacaggatcaagttcttgcacatccatcagttggggttttcctgacacattgtgggtggaattctatgatggaaactatatcctgtggcgttccagtaatctgctggcctttttttgctgatcaacaaccgaactgccggtatgcatgcaccaaatgggggattggagtggaggtcaatcatgatgttaagagaaacgagattgaaagtcttgttaaggaaatgatagaaggggacagtgggaagcaaatgaggcaaaaggctttggagtggaaagatatagcagaagcagctaccaatattggaggatcatcttacaatgacttcgaaaaattcatcaaggaggctcttttctgtgtgtag

SEQ ID NO: 299 - protein, 479 aa, Populus balsamifera subsp. trichocarpa
  misc_feature (11)..(479): Pfam Name: UDPGT Pfam Description: UDP-glucoronosyl and UDP-glucosyl transfer
  misc_feature (1)..(479): Ceres Annot ID no. 1503910
  misc_feature (1)..(479): Bit score of 987.2 for HMM based on sequences of Figure 5
  misc_feature (1)..(479): Functional Homolog Of SEQ ID NO. 253
MRSTGARKPHAVCVPFPAQGHVTPMMHLAKLLHSRGFHITFVNTEFNHRRLIRSRGPDSVEGLPDFRFETIPDGLPLPPSDFDATQDVPSLCDSTRTNCLAPFKELLTKLNSSSEVPPVTCVISDGAMSFGIKAAEEFSIPQVQFWTASACSFMGYLHFSELTRRGFVPYKEENLLRDGDTPIDWIPGLSNIRLKDMPTFIRTTNDEIMFDFMGSEAENCLNSPAIIFNTFNEFENEVLESIIATKFPNIYTIGPLPLLAKHIAAESESRSLGSSLWKEDSNCLDWLDKRGLNSVVYINYGSVTVMTDTHLREFAWGLANSKLPFLWIIRPDVVMGDSAILPEEFLEQIDGRGLLASWCPQDQVLAHPSVGVFLTHCGWNSMMETISCGVPVICWPFFADQQPNCRYACTKWGIGVEVNHDVKRNEIESLVKEMIEGDSGKQMRQKALEWKDIAEAATNIGGSSYNDFEKFIKEALFCV

SEQ ID NO: 300 - DNA, 1854 bp, Panicum virgatum
  misc_feature (1)..(1854): Ceres Clone ID no. 1747545
  misc_feature (1)..(1854): Encodes the peptide sequence at SEQ ID NO. 301
agtacctctccaacacgcctctctccctacatacagcaatggcggcaggagctcatcaagtggattcgatcgagcaaattaacaaagcggccactcccggcaccttctagccactacctacccagcagctagctagccagccatggggtcgctgccgccagcggagcagccgccgccgcacgcggtgatgatcccgtacccggcgcagggccacgtgacgcccatgctgcagctggccaagctcctccacgcgcggggcttccacgtcaccttcgtcaacaacgagttcaaccaccgccgccacctccgcgcgcgggggcccgccgcgctcgacggcgcccccgggttccgcttcgccgccatcgacgacggcctcccgcgctgcgacgccgacgccacccaggacgtcccggcgctctgctactccaccatgaccacctgcctgccccgcttcaaggacctcgtcgccaggctcgacgccgaggccgaccgcccgcgcgtcacctgcgtcgtcgccgacagcaccatgacgttcgcgctccgcgccgcgcgggagctcggcctccgcgccgccacgctctggaccgccagcgcgtgcggcttcatcacctactaccactaccgccacctcgtcgaccgcggcctcgtcccgctcagggacgaggcgcagctcgctgacggctacctcgacaccgtcgtcgactgggtccccggcgcgcccgcggacctgcgcctccgcgacttccccagcttcgtgcgcaccacggaccccgacgacgtcatgctcaacttcttcatccacgagacggccggcatgtcgcaggcgtcggcggtcgtgatcaacaccttcgacgagctcgacgccacgctgctcgacgccatggccaatatcctaccgcccctctacaccgtgggcccgctcccgctgacggtgcggaacaacgtgccggcggggagccccgtcgccgccatcgcgtccaacctgtggaaggagcaggacgcgccgctccggtggctggacggccgcccgccgcgctccgtcgtgtacgtcaacttcgggagcatcacggtgatgtcgagcgagcagctggccgagttcgcgtggggcctcgccaacaccggctacgcctttctctggaacgtgcgcccggacctcgtcaagggcgactccgccgggctgccgccggagttcgcggcggccacggagggccggagcatgctgtcgacgtggtgcccgcaggcggcggtgctggagcacgaggccgtgggggtgttcctcacgcactccggctggaactcaacgctggagagcatctgcggcggcgtgcccatggtgtgctggcccttcttcgccgagcagcagaccaactgccgctacaagtgcaccgagtggggcatcgggatggagatcggcggcgacgtggagcgcgccgaggtggaggcgctcatccgggaggccatggagggggacaaggggagggagatgcgccgccgcgcggccgagctcagggagagcgccgtggcggcggcgagccccggcggacggtccatgcgcaacgtcgaccggctcatcgacgaggtgctcctagcttgaacacacgttgccctgtgttcgttggcctcttgttggttggcggctgccacagcttgaaatcctatctttgttatctgaatgcgatagccttctgatatcagtttgagatgatatatagtgatgcaaaataacttcagttattaagttcgggttctttttggggaaagctatcacgttttagctcgatcgaatttatacggaattttatgtgatttccgctccacttcatacaaatatatctagtttcttgtataattatt

SEQ ID NO: 301 - protein, 483 aa, Panicum virgatum
  misc_feature (14)..(480): Pfam Name: UDPGT Pfam Description: UDP-glucoronosyl and UDP-glucosyl transfer
  misc_feature (1)..(483): Ceres Clone ID no. 1747545
  misc_feature (1)..(483): Bit score of 965.3 for HMM based on sequences of Figure 5
  misc_feature (1)..(483): Functional Homolog Of SEQ ID NO. 253
MGSLPPAEQPPPHAVMIPYPAQGHVTPMLQLAKLLHARGFHVTFVNNEFNHRRHLRARGPAALDGAPGFRFAAIDDGLPRCDADATQDVPALCYSTMTTCLPRFKDLVARLDAEADRPRVTCVVADSTMTFALRAARELGLRAATLWTASACGFITYYHYRHLVDRGLVPLRDEAQLADGYLDTVVDWVPGAPADLRLRDFPSFVRTTDPDDVMLNFFIHETAGMSQASAVVINTFDELDATLLDAMANILPPLYTVGPLPLTVRNNVPAGSPVAAIASNLWKEQDAPLRWLDGRPPRSVVYVNFGSITVMSSEQLAEFAWGLANTGYAFLWNVRPDLVKGDSAGLPPEFAAATEGRSMLSTWCPQAAVLEHEAVGVFLTHSGWNSTLESICGGVPMVCWPFFAEQQTNCRYKCTEWGIGMEIGGDVERAEVEALIREAMEGDKGREMRRRAAELRESAVAAASPGGRSMRNVDRLIDEVLLA

SEQ ID NO: 302 - DNA, 1449 bp, Populus balsamifera subsp. trichocarpa
  misc_feature (1)..(1449): Ceres Annot ID no. 1476416
  misc_feature (1)..(1449): Encodes the peptide sequence at SEQ ID NO. 303
atgagatctcttccaaaaaccaccaaggctcatgccgtgtgcgtcccatatccagctcaaggtcacataactcctatgctcaaagtagcaaaactactccatcacaaaggttttcacatcacctttgtcaactctgaatacaatcacagacgtttgctcaagtctagaggccgtaactcccttgatgtcttgcctgatttccagtttgaaaccattccagatggtctaggcgatcagatcgatgttgatgttacccaagacacttcatttctctgtgactctacctcaaaggcttgcttagacccatttcgccaacttcttgccaaactcaattcatcaagtgttgtcccgcctgtaacttgcatagtagcagacagtggcatgtccttcgctctcgatgttaaggaggaacttcaaatcccagtcatcactttctggacttcaagtgcatgtggcacattggcctacgcgcattacaaacatcttgttgaaagaggttacacaccactcaaagaagaaagcgatttgacaaatggatatttggagacaaaaatagactggattcctggaatgaaagatattcgtctgaaggaccttccgaccttcattcgcacaacagatcgaaacgacgttatgctaaactttgtgataagagtaattgatagagcttcaaaagcttcagcagctcttgtgaatacttttgatgacttagatcatgatgttctggttgctctctcatctatgtttcctccaatttattctgttggtcctcttaatctgcttcttgatcaaacacagaatgattatctagcatcaattggatccggtctgtggaaagaagagactgaatgcctgcactggctcgactccaaggatcccaattctgttgtctacgtgaattttggaagcataactgtgatgaatccacagcaacttgtggagttttcttggggactagctaacagcaagaagaattttttatggataatcaggcctgatcttgtcaggggcgactcagctgttttgcctccagagtttcttgaagagactagagaaagaggcctgatggcgagctggtgtgcgcaggaaaaagtcctgaagcattcatcgataggagggtttttaagtcacatggggtggaattccaccattgaaagcttgtccaacggcgtgccaatgctatgctggccttttttctccgaacaacaaactaactgtaagtttgcttgcgttgattggggtgttggcatggaaattgaaagtgatgcaaatagagatgaagtagagaagcttgtgatagagttaattgatggggagaaaggtaaggaaatgaaaaggaaggcaatggaatggaagtcaaaggctgaagcgacaactggtattaatggttcatcatccatgaattttgacaaacttgtcaacgacgtgctccgcttccaaaaaccttga

SEQ ID NO: 303 - protein, 482 aa, Populus balsamifera subsp. trichocarpa
  misc_feature (12)..(480): Pfam Name: UDPGT Pfam Description: UDP-glucoronosyl and UDP-glucosyl transfer
  misc_feature (1)..(482): Ceres Annot ID no. 1476416
  misc_feature (1)..(482): Bit score of 1095.6 for HMM based on sequences of Figure 5
  misc_feature (1)..(482): Functional Homolog Of SEQ ID NO. 253
MRSLPKTTKAHAVCVPYPAQGHITPMLKVAKLLHHKGFHITFVNSEYNHRRLLKSRGRNSLDVLPDFQFETIPDGLGDQIDVDVTQDTSFLCDSTSKACLDPFRQLLAKLNSSSVVPPVTCIVADSGMSFALDVKEELQIPVITFWTSSACGTLAYAHYKHLVERGYTPLKEESDLTNGYLETKIDWIPGMKDIRLKDLPTFIRTTDRNDVMLNFVIRVIDRASKASAALVNTFDDLDHDVLVALSSMFPPIYSVGPLNLLLDQTQNDYLASIGSGLWKEETECLHWLDSKDPNSVVYVNFGSITVMNPQQLVEFSWGLANSKKNFLWIIRPDLVRGDSAVLPPEFLEETRERGLMASWCAQEKVLKHSSIGGFLSHMGWNSTIESLSNGVPMLCWPFFSEQQTNCKFACVDWGVGMEIESDANRDEVEKLVIELIDGEKGKEMKRKAMEWKSKAEATTGINGSSSMNFDKLVNDVLRFQKP

SEQ ID NO: 304 - protein, 483 aa, Arabidopsis thaliana
  misc_feature (12)..(483): Pfam Name: UDPGT Pfam Description: UDP-glucoronosyl and UDP-glucosyl transfer
  misc_feature (1)..(483): Public GI ID no. 54292902
  misc_feature (1)..(483): Bit score of 1134.1 for HMM based on sequences of Figure 5
  misc_feature (1)..(483): Functional Homolog Of SEQ ID NO. 253
MASHAVTSGQKPHVVCIPFPAQGHINPMLKVAKLLYARGFHVTFVNTNYNHNRLIRSRGPNSLDGLPSFRFESIPDGLPEENKDVMQDVPTLCESTMKNCLAPFKELLRRINTTKDVPPVSCIVSDGVMSFTLDAAEELGVPDVLFWTPSACGFLAYLHFYRFIEKGLSPIKGIMADESSLDTKINWIPSMKNLGLKDIPSFIRATNTEDIMLNFFVHEADRAKRASAIILNTFDSLEHDVVRSIQSIIPQVYTIGPLHLFVNRDIDEESDIGQIGTNMWREEMECLDWLDTKSPNSVVYVNFGSITVMSAKQLVEFAWGLAATKKDFLWVIRPDLVAGDVPMLPPDFLIETANRRMLASWCPQEKVLSHPAVGGFLTHSGWNSTLESLSGGVPMVCWPFFAEQQTNCKYCCDEWEVGMEIGGDVRREEVEELVRELMDGDKGKKMRQKAEEWQRLAEEATKPIYGSSELNFQMVVDKVLLGE

SEQ ID NO: 305 - protein, 489 aa, Vitis vinifera
  misc_feature (9)..(476): Pfam Name: UDPGT Pfam Description: UDP-glucoronosyl and UDP-glucosyl transfer
  misc_feature (1)..(489): Public GI ID no. 225465732
  misc_feature (1)..(489): Bit score of 970.1 for HMM based on sequences of Figure 5
  misc_feature (1)..(489): Functional Homolog Of SEQ ID NO. 253
MESVKKPHAVCLPLPAQGHMNPMLKIAKLLHSQGFYVTFVLTEFNYQLLVKSRGANSLKVFDDFRFETISDGLPPTNQRGILDLPALCLSMPVYSLVSFRELILKLKASSDVPPITCIVSDGVMSFTLEVAQEFGIPEMLFFTPSACGMLGYLHFEELIQRGYFPLKDESCLNNGYLDTSIDWIPGLNGVRLKDLPTFIRTTDPNDTMFNYNLLSVNNALKAKSIILNTFEDLEKEVLDSIRTKFPPVYTIGPLWMLQQQLSEAKLDSIELNLWKEDTRCLDWLDKRERGSVVYVNYGSLVTLTPSQLSEFAWGLANSKCPFLWVIRSNLVVSEAEIISKDFMEEISGRGLLSGWCPQEKVLQHPAIGCFLTHCGWNSILESICEGVPMICWPFFAEQQTNCFFSCGKWGLGVEIDSNVRREKVEGLVRELMGGEKGKEMKETAMQWKKRAEKATRSGGSSYVNFDNLVKQLKGKPIIETNTISPENVT

SEQ ID NO: 306 - DNA, 1446 bp, Populus balsamifera subsp. trichocarpa
  misc_feature (1)..(1446): Ceres Annot ID no. 1456348
  misc_feature (1)..(1446): Encodes the peptide sequence at SEQ ID NO. 307
atgggttctctcaacaacaaaccccatgcagtcctgcttccctacccagcacaaggccatgttaatcccttgatgcaattagccagacttctgcattcaaaaggtttccacgtaacttttgtcaacactgagttcaaccatagacgcttagtccggtctaatgggccagagttttttaagggcttgctggattttaggttcgaaaccatacctgatggattgcccccttccgaccgtgatgctacccaagatatttgggccctgagtgattctgtcaggaaaaattgcttggatccattcagagagctattagctaagttgaattcatcacctgagttgcctcctgttacttgcattatctctgacgggctaatgagctttgcaattgaagctgcagaagaactggacatccctgagattcaattctggactgcctcagctattggtctgatgggatttttgcagtttgaagaacttgtgaagagaggcattgttccgtttaaagatgaaaacttcattaatgatggaacccttgacatgcctcttggttggatccctggtgtaaaaaacattcgcctcaaggatatgccaagcttgatccgaaccactgaccctgatgacataatgttgaagttcatgagtgatgaagcacaaaattgtttgaaagcttctgctattatcttcaacacatttgatgagatcgaacatgtggtgctagaagcaattgttaccaagtttcctcgcatttatactataggcccactttctttgctcggaaggaacatgcctccaacacaagcaaagtcacttaggtctaacttatggaaggaagacttgaaatgctttgaatggcttgataaacaagagccaaaatcagtgctttatgtgaattatggtagcataacagtcatgactgaccaacagttcgaagaatttgcgtgggggctggcaaacagcaatcatccatttttatggatagttaggcctgatgtggtgatgggaagttctggatttttaccaaaagaatatcacgaggagatcaagaatagagggttcctagcaccctggtgtcctcaggatgaagtactttctcatccatcaattggagctttcttgacacacggtggatggaattctaccttggagagtatatctagtggtatacctatgctttgttggcctttcttcgacgaacaaccgatgaattgccggtacttgtgcaccatttggggcattggtatggagattaaccattatgtaaagcgtgaggaagttgaagccattgttaagcaaatgatggaaggggagaaagggaagcggatgaaaaacaatgctttgcaatggaagaagaaagctgaagctgcagccagtattggaggctcatcctacaataatttcaataaattcataagtgaggtgctgcattttaaaggaaatattcactga

SEQ ID NO: 307 - protein, 481 aa, Populus balsamifera subsp. trichocarpa
  misc_feature (10)..(477): Pfam Name: UDPGT Pfam Description: UDP-glucoronosyl and UDP-glucosyl transfer
  misc_feature (1)..(481): Ceres Annot ID no. 1456348
  misc_feature (1)..(481): Bit score of 982.7 for HMM based on sequences of Figure 5
  misc_feature (1)..(481): Functional Homolog Of SEQ ID NO. 253
MGSLNNKPHAVLLPYPAQGHVNPLMQLARLLHSKGFHVTFVNTEFNHRRLVRSNGPEFFKGLLDFRFETIPDGLPPSDRDATQDIWALSDSVRKNCLDPFRELLAKLNSSPELPPVTCIISDGLMSFAIEAAEELDIPEIQFWTASAIGLMGFLQFEELVKRGIVPFKDENFINDGTLDMPLGWIPGVKNIRLKDMPSLIRTTDPDDIMLKFMSDEAQNCLKASAIIFNTFDEIEHVVLEAIVTKFPRIYTIGPLSLLGRNMPPTQAKSLRSNLWKEDLKCFEWLDKQEPKSVLYVNYGSITVMTDQQFEEFAWGLANSNHPFLWIVRPDVVMGSSGFLPKEYHEEIKNRGFLAPWCPQDEVLSHPSIGAFLTHGGWNSTLESISSGIPMLCWPFFDEQPMNCRYLCTIWGIGMEINHYVKREEVEAIVKQMMEGEKGKRMKNNALQWKKKAEAAASIGGSSYNNFNKFISEVLHFKGNIH

SEQ ID NO: 308 - DNA, 1740 bp, Panicum virgatum
  misc_feature (1)..(1740): Ceres Clone ID no. 1768985
  misc_feature (1)..(1740): Encodes the peptide sequence at SEQ ID NO. 309
acctacccagcagctagccatggggtcgctgccgccggcggagcagccgccgccgcacgcggtgatgatcccgtacccggcgcagggccacgtcacgcccatgctgcagctggccaagctcctccacgcgcggggcttccacgtcaccttcgtcaacaacgagttcaaccaccgccgccacctccgcgcgcgggggcccgccgcgctcgacggcgcccccgggttccgcttcgccgccatcgacgacggcctcccgccctgcgaagccgacgccacccaggacgtcccggcgctctgccgctccaccatgaccacctgcctgccccgcttcagggacctcgtcgccgggctcgacgccgaggccgcccgcgacggccgcccgcgcgtcacctgcgtcgtcgccgacagcaccatgacgttcgcgctccgcgccgcgcgggagctcggcctccgcgccgccacgctctggaccgccagcgcctgcggcttcctcacctactaccactaccgccacctcgtcgaccgcggcctcgtcccgctcagggacgaggcgcagctcgccgacggctacctcgacaccgtcgtcgactgggtccccggcgcgcccgcggacctgcgcctccgcgacttccccagcttcgtgcgcaccacggaccccgacgacgtcatgctcaacttcttcatccacgagaccgccggcatgtcgcaggcgtcggccgtcgtcatcaacaccttcgacgagctcgacgccacgctgctcgacgccatggccaagctcctgccggcgcccgtctacaccgtgggcccgctcccgctgacggtgcggaacaacgttccggcggggagcccggtcgccgccatcgggtccaacctgtggaaggagcaggacgcgccgctccggtggctggacggccgcccgccgcgctccgtcgtgtacgtcaacttcgggagcatcacggtgatgtccaaggaggagctggccgagttcgcgtggggcctcgccggcaccggctacgccttcctctggaacgtgcgcccggacctcgtcaagggcgtcggcgactcagccgggctgccgccggagttcgcggcggccacggagggccggagcatgctgtcgacgtggtgcccgcaggcggcggtgctggagcacgacgccgtgggggtgttcctcacgcactccggctggaactccacgctggagagcatctgcggcggcgtgcccatggtgtgctggcccttcttcgccgagcagcagaccaactgccgcttcaagtgcacagagtggggcatcgggatggagatcggcggcgacgtcaagcgcgtcgaggtggaggcgctcatccgggaggccatggaggggaagaaggggagggagatgcgccgccgcgtggccgagctcagggacagcgccgtggcggcggcgagccccggcggccggtccatgcgcaacgtcgacaggctcatcgacgaggtgctcctagcttgaacgctcatcaacacgctactgaacgttgccccgtgttcgttattggcctcttgttgattggcggctgccgcgctagcttgatatccactatctctgtgagctgaatgcgattgcgatatatcagtttgaggtgatagtgatataagtttgggttctttttggctcgaatttatacggagtttatgtgcttgtgctccacctcatgcaaatatatctagtttcttgtataattattaaagaaagtgttttgc

SEQ ID NO: 309 - protein, 489 aa, Panicum virgatum
  misc_feature (14)..(486): Pfam Name: UDPGT Pfam Description: UDP-glucoronosyl and UDP-glucosyl transfer
  misc_feature (1)..(489): Ceres Clone ID no. 1768985
  misc_feature (1)..(489): Bit score of 943.0 for HMM based on sequences of Figure 5
  misc_feature (1)..(489): Functional Homolog Of SEQ ID NO. 253
MGSLPPAEQPPPHAVMIPYPAQGHVTPMLQLAKLLHARGFHVTFVNNEFNHRRHLRARGPAALDGAPGFRFAAIDDGLPPCEADATQDVPALCRSTMTTCLPRFRDLVAGLDAEAARDGRPRVTCVVADSTMTFALRAARELGLRAATLWTASACGFLTYYHYRHLVDRGLVPLRDEAQLADGYLDTVVDWVPGAPADLRLRDFPSFVRTTDPDDVMLNFFIHETAGMSQASAVVINTFDELDATLLDAMAKLLPAPVYTVGPLPLTVRNNVPAGSPVAAIGSNLWKEQDAPLRWLDGRPPRSVVYVNFGSITVMSKEELAEFAWGLAGTGYAFLWNVRPDLVKGVGDSAGLPPEFAAATEGRSMLSTWCPQAAVLEHDAVGVFLTHSGWNSTLESICGGVPMVCWPFFAEQQTNCRFKCTEWGIGMEIGGDVKRVEVEALIREAMEGKKGREMRRRVAELRDSAVAAASPGGRSMRNVDRLIDEVLLA

SEQ ID NO: 310 - protein, 488 aa, Arabidopsis thaliana
  misc_feature (13)..(484): Pfam Name: UDPGT Pfam Description: UDP-glucoronosyl and UDP-glucosyl transfer
  misc_feature (1)..(488): Public GI ID no. 79349376
  misc_feature (1)..(488): Bit score of 1157.1 for HMM based on sequences of Figure 5
  misc_feature (1)..(488): Functional Homolog Of SEQ ID NO. 253
MGSRFVSNEQKPHVVCVPYPAQGHINPMMKVAKLLHVKGFHVTFVNTVYNHNRLLRSRGANALDGLPSFQFESIPDGLPETGVDATQDIPALSESTTKNCLVPFKKLLQRIVTREDVPPVSCIVSDGSMSFTLDVAEELGVPEIHFWTTSACGFMAYLHFYLFIEKGLCPVKDASCLTKEYLDTVIDWIPSMNNVKLKDIPSFIRTTNPNDIMLNFVVREACRTKRASAIILNTFDDLEHDIIQSMQSILPPVYPIGPLHLLVNREIEEDSEIGRMGSNLWKEETECLGWLNTKSRNSVVYVNFGSITIMTTAQLLEFAWGLAATGKEFLWVMRPDSVAGEEAVIPKEFLAETADRRMLTSWCPQEKVLSHPAVGGFLTHCGWNSTLESLSCGVPMVCWPFFAEQQTNCKFSCDEWEVGIEIGGDVKRGEVEAVVRELMDGEKGKKMREKAVEWRRLAEKATKLPCGSSVINFETIVNKVLLGKIPNT

SEQ ID NO: 311 - DNA, 1449 bp, Populus balsamifera subsp. trichocarpa
  misc_feature (1)..(1449): Ceres Annot ID no. 1476405
  misc_feature (1)..(1449): Encodes the peptide sequence at SEQ ID NO. 312
atgggatctcttccaaagagcaccaaggctcatgctgtgtgcgtcccatatccagctcaaggtcacataactcctatgctcaaagtagcaaaactactccatcacaaaggctttcacatcacctttgtcaactctgaatacaatcacagacgtttgctcaagtccagaggccgtaactcccttgatgtcttgcctgatttccagtttgaaaccattccagatggtctaggcgatcagatcgatgctgatgttacccaagacacttcatttctctgtgactctatctcaaaggcttgcttagtcccatttcgcaaccttcttgccaaactcaattcatcaaatgttgtcccgcctgtaacttgcatagtagcagatagtggcatgtccttcgctctcgatgttaaggaggaacttcaaatccctgtcgtcactttctggacttcaagtgcatgtggcacattggcctatgcacattacaaacatcttgttgaaagaggttacacaccactcaaagaagaaagcgatttgacaaatggatatttggagacaaaaatagactggattcctggaatgaaagatattcgtctgaaggaccttccgaccttcattcgcacaacagatcgaaacgacgttatcctaaactatgtgataagaataattgatagagcttcaaaagcttcagcagctcttgtgaatacttttgatgacttagatcatgatgttctggttgctctctcatctatgtttcctccgatttattctgttggtcctcttaatttgcttcttgatcaaacacagaatgattatctagcatcaattggatccagtctgtggaaagaagagactgaatgcctgcaatggctcgactccaaggatcccaattctgttgtctacgtgaattttggaagcatcactgtcatgaatccacagcaactagtggagttttcttggggactagctaacagcaagaagaattttttatggataatcaggcctgatcttgtcaggggcgaatcagcggttttgcctccagagtttcttgaagagactagagagagaggcctgatggcgagctggtgtgcgcaggaaaaagtcctgaagcattcatcgataggagggtttttaagtcacatggggtggaattccaccattgaaagcttgtccaacggcgtggcaatgctatgctggccttttttctccgaacaacaaactaactgtaagtttgcttgcgttgattggggtgttggcatggaaattgaaagtgatgcaaatagagatgatgtagagaagcttgtgatagagttaattgatggggagaaaggtaaggaaatgaaaaggaaggcaatggaatggaagtcaaaggctgaagcgacaactggtattaatggttcatcatccatgaattttgacaaacttgtcaacgacgtgctccgcttccaaaaaccttga

SEQ ID NO: 312 - protein, 482 aa, Populus balsamifera subsp. trichocarpa
  misc_feature (12)..(480): Pfam Name: UDPGT Pfam Description: UDP-glucoronosyl and UDP-glucosyl transfer
  misc_feature (1)..(482): Ceres Annot ID no. 1476405
  misc_feature (1)..(482): Bit score of 1088.5 for HMM based on sequences of Figure 5
  misc_feature (1)..(482): Functional Homolog Of SEQ ID NO. 253
MGSLPKSTKAHAVCVPYPAQGHITPMLKVAKLLHHKGFHITFVNSEYNHRRLLKSRGRNSLDVLPDFQFETIPDGLGDQIDADVTQDTSFLCDSISKACLVPFRNLLAKLNSSNVVPPVTCIVADSGMSFALDVKEELQIPVVTFWTSSACGTLAYAHYKHLVERGYTPLKEESDLTNGYLETKIDWIPGMKDIRLKDLPTFIRTTDRNDVILNYVIRIIDRASKASAALVNTFDDLDHDVLVALSSMFPPIYSVGPLNLLLDQTQNDYLASIGSSLWKEETECLQWLDSKDPNSVVYVNFGSITVMNPQQLVEFSWGLANSKKNFLWIIRPDLVRGESAVLPPEFLEETRERGLMASWCAQEKVLKHSSIGGFLSHMGWNSTIESLSNGVAMLCWPFFSEQQTNCKFACVDWGVGMEIESDANRDDVEKLVIELIDGEKGKEMKRKAMEWKSKAEATTGINGSSSMNFDKLVNDVLRFQKP

SEQ ID NO: 313 - DNA, 2187 bp, Zea mays
  misc_feature (1)..(2187): Ceres Clone ID no. 1597737
  misc_feature (1)..(2187): Encodes the peptide sequence at SEQ ID NO. 314
agtctcgtgcctcatctaacaagtaatcgtcacagtggtagatttgcgctgttacacatcactgcactgcacaggcacagttccacatgggctccatcgttgccgacgccgatcgccggccacacgccgtgtgcgtgccgttcccagcgcagggccacgtgacgccgatgctgaagctagccaaggttctccacagccgaggcttccacatcaccttcgtcaactcggagttcaaccaccgccgcttgctccgctcccgcggcgccagcgcgcttgacggcctcccggacttccgcttcgccgccatcccggagggtctgcccccgtccgacgccgacgccacccaggacgtgccgtcgctctgccgcgccaccatggagaactgcctcccgcatttcaggagcctcctcgccgagctcaactccaacccggacgtgccgccggtcacttgcgtcgtcggagacgacgtcatgagcttcaccctggaagcagccagagaggtcggcgtgccgtgtgcgctgttctggacggccagcgcctgcggctacctgggctaccgctattaccgcgacctcatggagaagggcatcttcccgctcaaagacgccgagcagctgacgaacgggttcttggacacgccgacggactgggcgctggggatgagcaagcacacgcggctcaaggacttcccaagtttcgtgcgctcgacggaccccgacgagttcatgttccacttcgccctgaaggtgacagagcagatagtcggcgcggacgccgtcatcctcaacactttcgacgagctcgagcaggaggcgctcgacgccatgcgcgccatgatcccgtcgtccgcgtccatccacaccatcgggccgctcgcgttcctcgccgaggagatagtgccccgcggaggcccgaccgacgcgctaggctccaacctctggaaggaggacgtgtcctgcttcgagtggctccacggcagggcgcccaggtcggtggtgtacgtgaactacggcagcatcacggtgatgacgaacgaggagctggtggaattcgcgtggggcctggccaacagcggccacgacttcctgtggatcatccggccggacctggtcaacggcgacgccgccgtgctgccgccggagttcctggaagccatcaggggccgcggccacctggcgagctggtgcccgcaagaggtggtgctgaggcacgaggcggtgggcgtgttcctgacgcactgcgggtggaactccaccatggagagcctgtgcgccggggtgccgatgctgtgctggcccttcttcgcggagcagcagaccaactgccggtacacgtgcgtggagtggggcgtggccatggagatcggccaggacgttcggcgggaggcggtggaggagaagatccgagaggcgatgggcggggagaagggaatggagatgcagcgccgcgcgggggagtggcagcagattggtctccgcgcgacgcggccccgagggcgctcatacgccaacctcgacaagctggtcgccgacgtgctcctctcgggtactagcggcaagagttcttaaaatctcaggagggtttcacttcgcacaccgccaccgtccaatgattcggactgaacatggatggtatggtagtacaccaaaagagaagtttgtgtgaatgttgaggcaaacccgtaaatcatggagcatgtgatggaatggaaggaccgaaggagccagtagcggaagaagttacttctcgtagcaggcaaaaattggaatatgaaaacctggaagccaagagggttaatccctaattactatattttctatctgctagctgtattcgttgcaaatgcacmcggtctgctgtttgtacgagtgtctggtagacacatctacgcttaattaggttttgtccaatttttatttagtaattacataaaaaatcaaagatcaaagttaatactaggtgtaatttatgggggtcttaatatgatctaaccgatggtttgataagggttaggtacacaatgatactatagtgtgttgtttggttggtccattttactttgtaaaccgttaacagtatccaataacggtagtttatgtttgtttttggttcactgtaatcaaatcacgatgggatttgttaccggcatatgtaaatttgataccgcctatttcctagagttaggct

SEQ ID NO: 314 - protein, 493 aa, Zea mays
  misc_feature (14)..(487): Pfam Name: UDPGT Pfam Description: UDP-glucoronosyl and UDP-glucosyl transfer
  misc_feature (1)..(493): Ceres Clone ID no. 1597737
  misc_feature (1)..(493): Bit score of 1021.0 for HMM based on sequences of Figure 5
  misc_feature (1)..(493): Functional Homolog Of SEQ ID NO. 253
MGSIVADADRRPHAVCVPFPAQGHVTPMLKLAKVLHSRGFHITFVNSEFNHRRLLRSRGASALDGLPDFRFAAIPEGLPPSDADATQDVPSLCRATMENCLPHFRSLLAELNSNPDVPPVTCVVGDDVMSFTLEAAREVGVPCALFWTASACGYLGYRYYRDLMEKGIFPLKDAEQLTNGFLDTPTDWALGMSKHTRLKDFPSFVRSTDPDEFMFHFALKVTEQIVGADAVILNTFDELEQEALDAMRAMIPSSASIHTIGPLAFLAEEIVPRGGPTDALGSNLWKEDVSCFEWLHGRAPRSVVYVNYGSITVMTNEELVEFAWGLANSGHDFLWIIRPDLVNGDAAVLPPEFLEAIRGRGHLASWCPQEVVLRHEAVGVFLTHCGWNSTMESLCAGVPMLCWPFFAEQQTNCRYTCVEWGVAMEIGQDVRREAVEEKIREAMGGEKGMEMQRRAGEWQQIGLRATRPRGRSYANLDKLVADVLLSGTSGKSS

SEQ ID NO: 315 - DNA, 1762 bp, Panicum virgatum
  misc_feature (1)..(1762): Ceres Clone ID no. 1862526
  misc_feature (1)..(1762): Encodes the peptide sequence at SEQ ID NO. 316
ccagcaaaatcatcagcaagaacccaagctccagtgtgccgggcaaagccgcagctctagctagctaagctagagcggatccaagcccgagccagcacccgcaccgcagatcaccgatcaccatgggctccctcggcggcggcgcgcagggcgacagcaggccgcacgccgtgtgcctgccgtacccggcgcagggccacatcaccccgatgctcaacgtggccaagctgctccacgcccggggcttccacgtcaccttcgtcaacaccgagtacaaccacgcccgcctcgtccggacccgcggcgccgccgccgtggccggcgtcccgggcttccgcttcgccaccatcccggacggcctgcccccctcggaggacgacgacgtcacgcaggacatcccctcgctctgcaagtccaccactgagacctgcctcggccccttccgccgcctcctcgcggagctcaacgacgaccccgcccacccgcccgtcacctgcgtcgtctccgacgtcgtcatgggcttctccatcgacgccgccaaggagctcggcctcccctacgtccagctctggacggccagcaccatcagcttcctcggctaccaacactaccgcctcctcatgagccggggcctcgccccactcaaagatgccgagcagctgacgaacgggttcctggacacggcggtggacgacgtcccggggctgcggagcatgaggttccgggacttcccgagcttcatccgcacgacggacccggacgagttcatggtgcactacgtcctcaaggagacggggcgctcggcgggcgcgtcggcggtgatcgtcaacaccttcggcgagctcgagggcgaggcggtggcggccatggagtcgctgggcctggcgcgcaaggtctacacgctgggcccgctcccgctgctggcgcgcgaggacccgcccaccccgcgctcctccatcagcctcagcctctggaaggagcaggcggagtgcctgcggtggctcgacggcagggagcccggcgccgtcgtctacgtcaacttcggcagcatcaccgtcatgaccaacgagcagctggtggagttcgcgtgggggctggccaacagcggccgccagttcctgtggatcatccgccgcgacctcgtcaagggcgacagcgccgtgctgccgccggagttcctcgccgccacggccgaccgcgggctcatggcgagctggtgcccgcagcaggaggtgctggaccacccggccgtcggcgcgttcctcacgcacagcggctggaactccaccctagaggccatgtgcggcggcgtccccgtcatcagctggcccttcttcgccgaccagcagaccaactgccggtaccagtgcaacgagtggggcgtcggcatggagatcgacgccaacgtccgccgcgacgccgtggcgggcctcatcacggagctcatggagggggagcaggggaaggagatgaggaggaaggcccgggagtggcgggacaaagcgatcgaggcggccaagcccgggggggcgtctcaccgcaacttggacgagctggtccgcgacgtgctcctgcccaagaactagacagcagcaggctccccacatctgctgcctactctcacccgtgttcggctggtgtgccagggtctagtagttatgttcattttaatttgttcgggggtaacagacaaatcactgttagcgtggtagtgtaaaccaataatgtacaagcctctccgttttgtactggtatattgctg

SEQ ID NO: 316 - protein, 487 aa, Panicum virgatum
  misc_feature (16)..(486): Pfam Name: UDPGT Pfam Description: UDP-glucoronosyl and UDP-glucosyl transfer
  misc_feature (1)..(487): Ceres Clone ID no. 1862526
  misc_feature (1)..(487): Bit score of 989.8 for HMM based on sequences of Figure 5
  misc_feature (1)..(487): Functional Homolog Of SEQ ID NO. 253
MGSLGGGAQGDSRPHAVCLPYPAQGHITPMLNVAKLLHARGFHVTFVNTEYNHARLVRTRGAAAVAGVPGFRFATIPDGLPPSEDDDVTQDIPSLCKSTTETCLGPFRRLLAELNDDPAHPPVTCVVSDVVMGFSIDAAKELGLPYVQLWTASTISFLGYQHYRLLMSRGLAPLKDAEQLTNGFLDTAVDDVPGLRSMRFRDFPSFIRTTDPDEFMVHYVLKETGRSAGASAVIVNTFGELEGEAVAAMESLGLARKVYTLGPLPLLAREDPPTPRSSISLSLWKEQAECLRWLDGREPGAVVYVNFGSITVMTNEQLVEFAWGLANSGRQFLWIIRRDLVKGDSAVLPPEFLAATADRGLMASWCPQQEVLDHPAVGAFLTHSGWNSTLEAMCGGVPVISWPFFADQQTNCRYQCNEWGVGMEIDANVRRDAVAGLITELMEGEQGKEMRRKAREWRDKAIEAAKPGGASHRNLDELVRDVLLPKN

SEQ ID NO: 317 - protein, 469 aa, Arabidopsis thaliana
  misc_feature (9)..(469): Pfam Name: UDPGT Pfam Description: UDP-glucoronosyl and UDP-glucosyl transfer
  misc_feature (1)..(469): Public GI ID no. 79318336
  misc_feature (1)..(469): Bit score of 1187.7 for HMM based on sequences of Figure 5
  misc_feature (1)..(469): Functional Homolog Of SEQ ID NO. 253
MGSHVAQKQHVVCVPYPAQGHINPMMKVAKLLYAKGFHITFVNTVYNHNRLLRSRGPNAVDGLPSFRFESIPDGLPETDVDVTQDIPTLCESTMKHCLAPFKELLRQINARDDVPPVSCIVSDGCMSFTLDAAEELGVPEVLFWTTSACGFLAYLYYYRFIEKGLSPIKDESYLTKEHLDTKIDWIPSMKNLRLKDIPSFIRTTNPDDIMLNFIIREADRAKRASAIILNTFDDLEHDVIQSMKSIVPPVYSIGPLHLLEKQESGEYSEIGRTGSNLWREETECLDWLNTKARNSVVYVNFGSITVLSAKQLVEFAWGLAATGKEFLWVIRPDLVAGDEAMVPPEFLTATADRRMLASWCPQEKVLSHPAIGGFLTHCGWNSTLESLCGGVPMVCWPFFAEQQTNCKFSRDEWEVGIEIGGDLMDEEKGKNMREKAEEWRRLANEATEHKHGSSKLNFEMLVNKVLLGE

SEQ ID NO: 318 - protein, 485 aa, Oryza sativa subsp. indica
  misc_feature (12)..(483): Pfam Name: UDPGT Pfam Description: UDP-glucoronosyl and UDP-glucosyl transfer
  misc_feature (1)..(485): Public GI ID no. 125541186
  misc_feature (1)..(485): Bit score of 996.0 for HMM based on sequences of Figure 5
  misc_feature (1)..(485): Functional Homolog Of SEQ ID NO. 253
MGSLGAAGKPHAVCMPYPAQGHITPMLNVAKLLHARGFDVTFVNTEYNHARLVRTRGEAAVAGAPGFRFATIPDGLPPSDDDDVTQDIPSLCRSTKETCLAPFRRLLAQLNDPATGHPPVTCVVSDVVMGFSMAAAKELGLPYVQLWTASSISYLGYRHYRLLMERGLAPLKDVDQLTNGYLDTPVEDVPGLRNMRIKDFPSFIHTTNPEEYMVGYVIEETERCKDASAIIVNSFGDLEGEAVAAMEALGLPKVYTLGPLPLVARKDPPSPRRSSIRLSLWKEQEECLQWLDGKEAGSVVYVNFGSITVMTNEQLVEFAWGLANSGREFLWIVRRDLVKGDTAVLPPEFLAETAERGLMASWCPQQDVLNHPAVGAFLTHSGWNSTLESLAAGVPVISWPFFADQQTNCRYQCNEWGVGMEIDSNVKRGAVAGLIAELMEGQKGKEMRRKAEEWREKAIRAAKPGGSSHRNFEELVRHVLLAKES

SEQ ID NO: 319 - DNA, 1654 bp, Glycine max
  misc_feature (1)..(1654): Ceres Clone ID no. 624581
  misc_feature (1)..(1654): Encodes the peptide sequence at SEQ ID NO. 320
atcgatgattcaagatgagttacacagcagagacaaagcctcacgctgtgttcactccatatccacttcaaggccatattaacccattgttcaaactcgcaaagctgcttcatctgaaaggctttcatataacctttgtccacactgagtacaactacagacgcttcctcaaatcaaagggtcccgacgcccttgatgagcttcctgattttcgcttcgaaaccatcccagatggccttcctccctcggatggtgatgtcagtcaagacataccctctctttgtgactctctcagaaagaacttccttcaaccctttcgtgaccttcttgccagacttaaccattctgccactactcccccagttacttgcttagtctctgattgcttcgtcacttttcctatacaagctgctcatgaacttggaatccctgtccttctcctttctcctctcagtgcagctgcattctggggttttatgcactatcgcactctggttgatagaggaatcatacccctcaaagaagagagttatctgacaaatggatatttggacaccaaagttgactgtattccaggtttgcaaaattatcgcctcaaggatctgcctgactttttaaggaccacagatccaaatgatttcatgctacactttttcattgaagtggccgaaaaagttcctagtgcctctgctgttgcttttaatacttttcatgagcttgagagagatgcactcaatgctctcccctctatgttcccttctctttattccattggtcctttcccttcatttttagatcaaagtccacataaacaggtcccgtctttaggatccaatctttggaaggaagatactggctgtcttgattggcttgaatccaaggaacccagatccgttgtttatgtgaattttggcagcatcacagttatgtctgcagaacaactcttggagtttgcttggggtttggccaacagcaagaaaccctttttgtggatcattaggcctgaccttgtcattggtggctctgtgattttgtcatctgagtttgtcaatgaaactagagacagaagcctaatagcaagctggtgtccacaggagcaagtgctgaaccatccttcaattggtgtattcctgactcattgtggatggaactcaactactgaaagtatttgtgcaggagtgccaatgttgtgttggccattctttgcagatcagccaacaaactgtagatatatttgcaatgagtgggaaattgggatggaaattgataccaatgccaagagagaggagttggaaaagctggtgaatgagtttatggtgggagagaaaggaaagaagatgggacaaaagaccatggagttgaagaagaaggcagaagaggaaaccaggcccggtggtggttcatacatgaacttggacaaattaatcaaggaggtgttgcttaagcagacaacattggaataatgaagggattttcactttttctcttttttttttaatgctttactgtgataattacttgattttatcctctagaatttgttgccatgtagaactaatgcactggttataggtgctagtttgtgtcttctttgtaaagatacataatgtatcttgacatttcaaactgtgattcatagcatcacaattaagac

SEQ ID NO: 320 - protein, 482 aa, Glycine max
  misc_feature (11)..(478): Pfam Name: UDPGT Pfam Description: UDP-glucoronosyl and UDP-glucosyl transfer
  misc_feature (1)..(482): Ceres Clone ID no. 624581
  misc_feature (1)..(482): Bit score of 986.7 for HMM based on sequences of Figure 5
  misc_feature (1)..(482): Functional Homolog Of SEQ ID NO. 253
MSYTAETKPHAVFTPYPLQGHINPLFKLAKLLHLKGFHITFVHTEYNYRRFLKSKGPDALDELPDFRFETIPDGLPPSDGDVSQDIPSLCDSLRKNFLQPFRDLLARLNHSATTPPVTCLVSDCFVTFPIQAAHELGIPVLLLSPLSAAAFWGFMHYRTLVDRGIIPLKEESYLTNGYLDTKVDCIPGLQNYRLKDLPDFLRTTDPNDFMLHFFIEVAEKVPSASAVAFNTFHELERDALNALPSMFPSLYSIGPFPSFLDQSPHKQVPSLGSNLWKEDTGCLDWLESKEPRSVVYVNFGSITVMSAEQLLEFAWGLANSKKPFLWIIRPDLVIGGSVILSSEFVNETRDRSLIASWCPQEQVLNHPSIGVFLTHCGWNSTTESICAGVPMLCWPFFADQPTNCRYICNEWEIGMEIDTNAKREELEKLVNEFMVGEKGKKMGQKTMELKKKAEEETRPGGGSYMNLDKLIKEVLLKQTTLE

SEQ ID NO: 321 - protein, 487 aa, Arabidopsis thaliana
  misc_feature (13)..(485): Pfam Name: UDPGT Pfam Description: UDP-glucoronosyl and UDP-glucosyl transfer
  misc_feature (1)..(487): Public GI ID no. 15219867
  misc_feature (1)..(487): Bit score of 1124.2 for HMM based on sequences of Figure 5
  misc_feature (1)..(487): Functional Homolog Of SEQ ID NO. 253
MESHVVHNAQKPHVVCVPYPAQGHINPMLKVAKLLYAKGFHVTFVNTLYNHNRLLRSRGPNALDGFPSFRFESIPDGLPETDGDRTQHTPTVCMSIEKNCLAPFKEILRRINDKDDVPPVSCIVSDGVMSFTLDAAEELGVPEVIFWTNSACGFMTILHFYLFIEKGLSPFKDESYMSKEHLDTVIDWIPSMKNLRLKDIPSYIRTTNPDNIMLNFLIREVERSKRASAIILNTFDELEHDVIQSMQSILPPVYSIGPLHLLVKEEINEASEIGQMGLNLWREEMECLDWLDTKTPNSVLFVNFGCITVMSAKQLEEFAWGLAASRKEFLWVIRPNLVVGEAMVVLPQEFLAETIDRRMLASWCPQEKVLSHPAIGGFLTHCGWNSTLESLAGGVPMICWPCFSEQPTNCKFCCDEWGVGIEIGKDVKREEVETVVRELMDGEKGKKLREKAEEWRRLAEEATRYKHGSSVMNLETLIHKVFLENLR

SEQ ID NO: 322 - DNA, 1779 bp, Panicum virgatum
  misc_feature (1)..(1779): Ceres Clone ID no. 1797125
  misc_feature (1)..(1779): Encodes the peptide sequence at SEQ ID NO. 323
atatacagccatacaagcacacagcaaccagaacaagttagtgccgtttacacttgcacaataagcgcccgacgagatgggctccatcgccgccgatgccggcaagccacacgccgtgctggtgccgttcgcggcgcagggccacgtcacgccgatgctgaagctgggcaagatcctccacttctggggcttccacgtcaccttcgtgaacacggattacaaccaccgccgcctccaccgctcccgcggcgccggcgcgctcggcggcctcccgggcttccgtttcgccaccatcccggatggcctgccgcagtccgaggcggacgtcacccaggacctgccctcgctctgccgctccacggcggagacctgcctcccgcacttcaggagcctcctcgcggagctcaacgcctccccggacgcaccgccggtcacctgcgtcgtcggcgacaacgtcatgagcttcaccctggatgccgccagggagatcggcgtgccgtgcgcgctgctctggacgtccagcacctgcggctacgtgggctaccggtactcccgcaccctcatcgacgagggcgtcttccctctcaaagaggagcagctgacgaacgggttcttggacacgccggtggacaacgcgcctgggttgagcaagtacacccggttcaaggacctcccaagtttcatccgctcgacggaccccgacgagttcatgctccacttcgctctcaaggtaacagagcagatagccggcgcggacgctgtcatcctcaacaccttgtacgagctcgagcaggaggcggtggacggcatgcgcgccatgatcccgcctgccgcgtccatccacgccgtcggcccgctcgccttgctcgccgagcagatcgtgccccatggaggccagctcgacgcgctgggctccaacctctggaaggaggacgtctcctgcctcgcctggctggagggccggagcgccgggtccgtggtgttcgtcaactacggcagcaccacggttatgaccaacgcggagctgctgaagttcgcgtgggggctggccaacagcggccacgactttgtgtgggtcatccggcctgacctcgtgagcggcgacgccgccgtgctgccgccggagttcctggaggcgatcgaggggcgcggcctgctggcgggctggtgcccgcaggatgccgtgctgcggcacgaggcggtgggcgtgttcctgacgcactgtgggtggaactcgacgctggagagcctgtgcgccggggtgccgatgctgtgctggcccttcttcgcggagcagcagaccaactgccggtacacgtgcgcggagtggggcgtgggcatggagatcggccaggacgttcggcgggaggccgtggaggggaagatacgggaggccatggacggggagaaagggaaggagatgcggcgccgcgcggcggagtggcgggaggccgccgtgcgcgcgacgcggcccggcgggggctcgtacgccagcctcgagaagctggtgaacgacgtgctcctgtcgggcggcaagggctcttgattgcaacctgctactattaggatcggatgcgtgtatgctgctgtgtcctcttggcggtactgctgtatcttcagtgcccgtactgtaataagctaagatggagacgagttgataaatacgtatgtatgggagtaggtgggtggcctggatccttacatagctattgattcccatcactctctcgatcaaaaccataagcacaaaaactaaatgaaaagttgatcgttccatgt

SEQ ID NO: 323 - protein, 489 aa, Panicum virgatum
  misc_feature (12)..(485): Pfam Name: UDPGT Pfam Description: UDP-glucoronosyl and UDP-glucosyl transfer
  misc_feature (1)..(489): Ceres Clone ID no. 1797125
  misc_feature (1)..(489): Bit score of 974.3 for HMM based on sequences of Figure 5
  misc_feature (1)..(489): Functional Homolog Of SEQ ID NO. 253
MGSIAADAGKPHAVLVPFAAQGHVTPMLKLGKILHFWGFHVTFVNTDYNHRRLHRSRGAGALGGLPGFRFATIPDGLPQSEADVTQDLPSLCRSTAETCLPHFRSLLAELNASPDAPPVTCVVGDNVMSFTLDAAREIGVPCALLWTSSTCGYVGYRYSRTLIDEGVFPLKEEQLTNGFLDTPVDNAPGLSKYTRFKDLPSFIRSTDPDEFMLHFALKVTEQIAGADAVILNTLYELEQEAVDGMRAMIPPAASIHAVGPLALLAEQIVPHGGQLDALGSNLWKEDVSCLAWLEGRSAGSVVFVNYGSTTVMTNAELLKFAWGLANSGHDFVWVIRPDLVSGDAAVLPPEFLEAIEGRGLLAGWCPQDAVLRHEAVGVFLTHCGWNSTLESLCAGVPMLCWPFFAEQQTNCRYTCAEWGVGMEIGQDVRREAVEGKIREAMDGEKGKEMRRRAAEWREAAVRATRPGGGSYASLEKLVNDVLLSGGKGS

SEQ ID NO: 324 - DNA, 1506 bp, Sorghum bicolor
  misc_feature (1)..(1506): Ceres Annot ID no. 8701197
  misc_feature (1)..(1506): Encodes the peptide sequence at SEQ ID NO. 325
atgggcttcgccgctgctgccgccgacgacgccggcaagccgcacgccgtgctggtgccgttcccggcgcagggccacgtcacgccgatgctgaagctgggaaagatcctccactgctggggcttccacgtcaccttcgtgaacagcgagtacaaccaccgccgcctgctccggtcccgcggcgcgggcgcgctcgacggcctcccgggcttccgcttcgccaccatcccggacggcctgccgccgtccgacgcggacgccacccaggacgttccctccctctgccgctccacggaggagacctgcctcccgcatttcagggccctgctccaagctctcaacgccgcctcatcatcccctgacgacgacgtgccgccgccggtcacctgcgtcgtcggcgacggcaccatgagctttaccttggaggccgccagggagatcggcgtcccgtgcgctctcctctggactgccagcgcctgcggttacatgggctaccgttactaccgcaccctcatcgacaagggcatcttcccgttgaaagaggagcagctgacgaacgggttcttggacacgccggtggacgggatgagcaagcacatgaggctcaaggacttcccaagcttcatccgctccacggaccccgacgagttcatggtccactacgccattagggtgacgggtcagacagccggcgcggacgccgtcgtcctcaacaccttcgacgagctcgagcaggaggcgctcgacgccatgcgcgccgagacgatcccacctgcagcgacgtccatcaacaccatcggcccgctcgccctcctcgccgagcagatcgtgcccaagggcggccaccaccagctcgacgcgctgggctccaacctctggaaggaggacgtgtcctgcttccgctggctcgacggcagggcgcccaggtcggtggtgtacgtgaactacggcagcatcacggtgatgaccgacgaggagctggtggagttcgcgtggggtctggccaacagcggccacgacttcctgtggatcatccggccggacctcgtcagtggcgacgccgccgtgctgccgccggagttccgggaggcgaccaaagggcgcggcctgctggcgagctggtgcccgcaggacgcggtgctgcggcacgaggcggtgggcgtgttcctgacgcactccgggtggaactcgacgctggagagcctctgcgccggggtgccaatgctgtgctggccgttcttcgcggagcagcagaccaactgccggtacaagtgcacggagtggggcgtgggcgtggagatcggccacgacgtgcggcgggaggccgtggaggcgaagatacgggaggccatggacggggaggaaggaaaggagatgcgtcgccgcgcgttggagtggcgggacaccgccgtgcgcgcgacgcagcccggcgggcgctcgtacgccaatctgcagaagctggtgactgacgtgctcctctcgggtggcaatggcaagagttcttaa

SEQ ID NO: 325 - protein, 501 aa, Sorghum bicolor
  misc_feature (16)..(495): Pfam Name: UDPGT Pfam Description: UDP-glucoronosyl and UDP-glucosyl transfer
  misc_feature (1)..(501): Ceres Annot ID no. 8701197
  misc_feature (1)..(501): Bit score of 1004.3 for HMM based on sequences of Figure 5
  misc_feature (1)..(501): Functional Homolog Of SEQ ID NO. 253
MGFAAAAADDAGKPHAVLVPFPAQGHVTPMLKLGKILHCWGFHVTFVNSEYNHRRLLRSRGAGALDGLPGFRFATIPDGLPPSDADATQDVPSLCRSTEETCLPHFRALLQALNAASSSPDDDVPPPVTCVVGDGTMSFTLEAAREIGVPCALLWTASACGYMGYRYYRTLIDKGIFPLKEEQLTNGFLDTPVDGMSKHMRLKDFPSFIRSTDPDEFMVHYAIRVTGQTAGADAVVLNTFDELEQEALDAMRAETIPPAATSINTIGPLALLAEQIVPKGGHHQLDALGSNLWKEDVSCFRWLDGRAPRSVVYVNYGSITVMTDEELVEFAWGLANSGHDFLWIIRPDLVSGDAAVLPPEFREATKGRGLLASWCPQDAVLRHEAVGVFLTHSGWNSTLESLCAGVPMLCWPFFAEQQTNCRYKCTEWGVGVEIGHDVRREAVEAKIREAMDGEEGKEMRRRALEWRDTAVRATQPGGRSYANLQKLVTDVLLSGGNGKSS

SEQ ID NO: 326 - DNA, 1443 bp, Populus balsamifera subsp. trichocarpa
  misc_feature (1)..(1443): Ceres Annot ID no. 1453378
  misc_feature (1)..(1443): Encodes the peptide sequence at SEQ ID NO. 327
atgtttcgcaaaatcttagctgacaagcctcatgtaatctgtattccctgtccagctcaaagccatgtaaaggcaatgcttaaactagcaaaactactgcattaccgaggttttcgcataacctttgtgaacacagagttcaaccacagacggttgcttaaatctagaggtcctgattccctgaatggcttgcccgactttcggttcgaatctatcccagatgggctccctccttcagatgagaaagctacccaagatgtacaagcaatttttgaggcttgcaagaagaacttgctagctccatttaatgaactgcttgccaagctcaatgatacagcatcttctgatggtcctcaagtgacttgcattgtatctgatggatttgtgccagctgccatcactgctgctcagaggcatggaattcctgttgccttgttcttttctatctctgcttgcactttcatggggtttaagcaatataaagagctcaaagaaagaggactgtttccattaaaagacgagagctttttaacaaatggctatttggatcaagtactagactggattccaggaatgaaagatatacgattgagggatcttccaagttttcttcgcacaacagatccagatgattatggtttcaacttctgcatggaatgtgctgagagagcatctgaaggttctgcagtgattttccatacttttgatgctttggagaaagaagtcttgagtgctctttactcaatgtttcctcgtgtctacacgatcggtccacttcaattacttctcaatcaaatgaaagaagatgatctagattctattggatataatctatggaaagaagaggttgagtgtctccaatggcttgattccaagaaaccaaactcagtaatttatgtgaactttggtagcatagccgtcgctacaaagcagcagctgattgaattgggaatgggacttgcaaaaagtggtcacccatttttatggatattaaggcctgacatggtcataggcgactccgccatattgccaccagaatttactgacgagactaaagacagaggatttatttctagctggtgtccacaagaggaagttctcaaccacccatcaataggaggtttcctaacacatagtggatggaattcaacagctgagagcatttcttctggggtgcccatgctttgtttgccgttctttggtgatcaacaaacaaactgtaggtacacttgcaatgagtggggcgttggaatggagattgatagcaatgcggaaagagataaagtggagaagcttgtgcgagagttgatggaaggagagaaaggcagggaggtaaagaaaaaagtcatggagtggagaaaattagcagaggaagctgcgggtccaagtggctcatcatccatgaatttagacgagttggtgaaggcagtgcttttgccatga

SEQ ID NO: 327 - protein, 480 aa, Populus balsamifera subsp. trichocarpa
  misc_feature (10)..(477): Pfam Name: UDPGT Pfam Description: UDP-glucoronosyl and UDP-glucosyl transfer
  misc_feature (1)..(480): Ceres Annot ID no. 1453378
  misc_feature (1)..(480): Bit score of 1003.5 for HMM based on sequences of Figure 5
  misc_feature (1)..(480): Functional Homolog Of SEQ ID NO. 253
MFRKILADKPHVICIPCPAQSHVKAMLKLAKLLHYRGFRITFVNTEFNHRRLLKSRGPDSLNGLPDFRFESIPDGLPPSDEKATQDVQAIFEACKKNLLAPFNELLAKLNDTASSDGPQVTCIVSDGFVPAAITAAQRHGIPVALFFSISACTFMGFKQYKELKERGLFPLKDESFLTNGYLDQVLDWIPGMKDIRLRDLPSFLRTTDPDDYGFNFCMECAERASEGSAVIFHTFDALEKEVLSALYSMFPRVYTIGPLQLLLNQMKEDDLDSIGYNLWKEEVECLQWLDSKKPNSVIYVNFGSIAVATKQQLIELGMGLAKSGHPFLWILRPDMVIGDSAILPPEFTDETKDRGFISSWCPQEEVLNHPSIGGFLTHSGWNSTAESISSGVPMLCLPFFGDQQTNCRYTCNEWGVGMEIDSNAERDKVEKLVRELMEGEKGREVKKKVMEWRKLAEEAAGPSGSSSMNLDELVKAVLLP

SEQ ID NO: 328 - protein, 496 aa, Oryza sativa subsp. japonica
  misc_feature (13)..(487): Pfam Name: UDPGT Pfam Description: UDP-glucoronosyl and UDP-glucosyl transfer
  misc_feature (1)..(496): Public GI ID no. 115457712
  misc_feature (1)..(496): Bit score of 957.6 for HMM based on sequences of Figure 5
  misc_feature (1)..(496): Functional Homolog Of SEQ ID NO. 253
MGSTATARRQHHAVMVPYPAQGHVTPMLKLAKLLHARGFHVTFVNTEFNHRRLLASRGAAALDGVVPGFRFAAIPDGLPPSDPDATQDIPALCYSTMTTCLPHLDALLATINADAAAAPPVTCVVCDGVMSFAYDAARRIGVPCAALWTASACGLMGYRHYRHLVERGLVPLRDAAQLTDGYLDTVVDGARGMCDGVRLRDLPSFIRTTDRGDTMLNFLMRECERLSLPDAVIVNTFDDLERQALDEMRRVLPPPVYAVGPLLLQVRRAVPAGSQLDVAVGSNLWKEQGGLLEWLDGRPPRSVVYVNYGSIAVMTNEQLLEFAWGLAHSGYPFLWNVRPDLVKGDAAVLPPEFLAAVEGRGLLTTWCPQEQVIEHPAVGVFLTHSGWNSTLESLAAGVPMLSWPFFAEQQTNCRYKRTEWGVGMEIGGEARRGEVAALIREAMEGEKGAEMRRRAAGWKEAAARAARPGGPAECGLDRLIHEVLLAGGNKGGQRLS

SEQ ID NO: 329 - protein, 496 aa, Oryza sativa subsp. indica
  misc_feature (13)..(487): Pfam Name: UDPGT Pfam Description: UDP-glucoronosyl and UDP-glucosyl transfer
  misc_feature (1)..(496): Public GI ID no. 125547765
  misc_feature (1)..(496): Bit score of 956.1 for HMM based on sequences of Figure 5
  misc_feature (1)..(496): Functional Homolog Of SEQ ID NO. 253
MGSTATARRQHHAVMVPYPAQGHVTPMLKLAKLLHARGFHVTFVNTEFNHRRLLASRGAAALDGVVPGFRFAAIPDGLPPSDPDATQDIPALCYSTMTTCLPHLDALLATINADAAAAPPVTCVVCDGVMSFAYDAARRIGVPCAALWTASACGLMGYRHYRHLVERGLVPLRDAAQLTDGYLDTVVDGARGMCDGVRLRDLPSFIRTTDRGDTMLNFLMRECERLSLPDAVIVNTFDDLERQALDEMPRVLPPPVYAVGPLLLQVRRAVPAGSQLDVAVGSNLWKEQGGLLEWLDGRPPRSVVYVNYGSIAVMTNEQLLEFAWGLAHSGYPFLWNVRPDLVKGDAAMLPPEFLAAVEGRGLLTTWCPQEQVIEHPAVGVFLTHSGWNSTLESLAAGVPMLSWPFFAEQQTNCRYKRTEWGVGMEIGGEARRGEVAALIREAMEGEKGAEMRRRAAGWKEAAARAARPGGPAECGLDRLIHEVLLAGGNKGGQRLS

SEQ ID NO: 330 - DNA, 1443 bp, Populus balsamifera subsp. trichocarpa
  misc_feature (1)..(1443): Ceres Annot ID no. 1453373
  misc_feature (1)..(1443): Encodes the peptide sequence at SEQ ID NO. 331
atgtttcgcaaaatcttagctgacaagcctcatgtaatctgtattccctgtccagctcaaagccatgtaaaggcaatgcttaaactagcaaaactactgcattaccgaggttttcgcataacctttgtgaacacagagttcaaccatagacgcttgcttaaatctagaggtccttattccctgaatggcttgcccgactttcggttcgaatctatcccagatggcctccctccttcagatgagaatgctacccaagatggacaagcaattttggaggcttgcaagaagaacttgctagctccatttaatgaattgcttgccaagctcaatgatacagcatcttctgatgttcctcaagtgacttgcattgtatctgatggatttgtgccagctgccatcactgctgctcagaggcatggaattcctgttgctttgttcttttctatctctgcttgcagtttcatggggcttaagcaatataaagagctcaaagaaagaggactgtttccattaaaagacgagagctttttaacaaatggctatttggatcaagtactagactggattccaggaatgaaagatatacgattgagggatcttccaagttttcttcgcacaacagatccagatgattaccgtttcaacttctgcatggaatgtgctgagagagcatctgaaggttctgcagtgattttccatacttttgatgctttggagaaagaagtcttgagtgctctttactcaatgtttcctcgtgtctacacgatcggtccacttcaattacttctcaatcaaatgaaagaagatgatctagattctattggatataatctatggaaagaagaggttgagtgtctccaatggcttgattccaagaaaccaaactcagtaatttatgtgaactttggtagcatagcggtcgctacaaagcagcagctgattgaattgggaatgggacttgctaaaagtggccacccatttttatggataataaggcctgacatggtcacaggcgactccgccatattgccaccggaatttactgacgagactaaagacagaggatttatttctaactggtgtccacaagaggaagttctcaaccacccatcaataggaggtttcctaacacatagtggatggaattcaacagctgagagcatttcttctggggtgcccatgctttgtttgccgttctttggtgatcaacaaacaaactgtaggtacacttgcaatgagtggggcgttggaatggagattgatagcagtgcggaaagagataaagtggagaagcttgtgcgagagttgatggaaggagagaaaggcagggaggtaaagaaaaaagtcatgcagtggaaaatattagcagaggaagccgctggtccaagtggctcatcatccatgaatttagacgagatggtgaaggcagtgcttttgccatga

SEQ ID NO: 331 - protein, 480 aa, Populus balsamifera subsp. trichocarpa
  misc_feature (10)..(477): Pfam Name: UDPGT Pfam Description: UDP-glucoronosyl and UDP-glucosyl transfer
  misc_feature (1)..(480): Ceres Annot ID no. 1453373
  misc_feature (1)..(480): Bit score of 992.3 for HMM based on sequences of Figure 5
  misc_feature (1)..(480): Functional Homolog Of SEQ ID NO. 253
MFRKILADKPHVICIPCPAQSHVKAMLKLAKLLHYRGFRITFVNTEFNHRRLLKSRGPYSLNGLPDFRFESIPDGLPPSDENATQDGQAILEACKKNLLAPFNELLAKLNDTASSDVPQVTCIVSDGFVPAAITAAQRHGIPVALFFSISACSFMGLKQYKELKERGLFPLKDESFLTNGYLDQVLDWIPGMKDIRLRDLPSFLRTTDPDDYRFNFCMECAERASEGSAVIFHTFDALEKEVLSALYSMFPRVYTIGPLQLLLNQMKEDDLDSIGYNLWKEEVECLQWLDSKKPNSVIYVNFGSIAVATKQQLIELGMGLAKSGHPFLWIIRPDMVTGDSAILPPEFTDETKDRGFISNWCPQEEVLNHPSIGGFLTHSGWNSTAESISSGVPMLCLPFFGDQQTNCRYTCNEWGVGMEIDSSAERDKVEKLVRELMEGEKGREVKKKVMQWKILAEEAAGPSGSSSMNLDEMVKAVLLP

SEQ ID NO: 332 - protein, 519 aa, Oryza sativa subsp. japonica
  misc_feature (43)..(517): Pfam Name: UDPGT Pfam Description: UDP-glucoronosyl and UDP-glucosyl transfer
  misc_feature (1)..(519): Public GI ID no. 115446887
  misc_feature (1)..(519): Bit score of 984.5 for HMM based on sequences of Figure 5
  misc_feature (1)..(519): Functional Homolog Of SEQ ID NO. 253
MCSACNRRGCISYTAASRFHQPIDRRTTTYDDMVAADEIKPHAVCLPFPAQGHVTPMMKLAKVLHCRGFHVTFVNTEYNHRRLIRSRGAAAVAGVPGFRFATIPDGLPPSDADATQDPASICYSTMTTCLPHFTKLLVDLDGSRAAGIPPVTCVVADGVMSFAVDAAKELGVPCALFWTASACGYMGYRHHRFFLDEGLSPLKDEEQLTNGFLDTVARPARGMSKHMRYRDYPSFIWTTDRGDILLNFLLHEVERADRADAVILNTFDELEQQALDAMRAILPPVYTIGPLGSLADRVVAPDAPAAAIRPSLWKEDTACLAWLDGREPRSVVFVNYGSITTMSNDELVEFAWGLANCGHGFLWIVRPDLVRGDAAVLPREFLEAVAGRGLLASWCEQEAVLRHGAVGAFLTHCGWNSTMESLSAGVPMLCWPFFAEQQTNARYSCAEWGVGMEVGGGVRREAVEATIREAMGGEKGKEMRRRAAEWKELGARATQPGGRSLVNLDNLIKEVLLPSKKCG

SEQ ID NO: 333 - DNA, 1851 bp, Zea mays
  misc_feature (1)..(1851): Ceres Clone ID no. 1492154
  misc_feature (1)..(1851): Encodes the peptide sequence at SEQ ID NO. 334
agataattctttcccgtacgcacccacccaatcccggaaatatattcataccgacagcacagctcgccaacactccgatacgcggggatgcatagacgtcggcaggaggagctcatgtcgaacaccaatagcgttagccaccaccagtagccacagcagtcatggggtcggtgccgccggcagagggggacaggcgccagccccagcagcagccacacgtggtgatgatcccgtacccggcgcagggccatgtcacgccgatgctgcagctggccaagctactccacacacgcggattccacgtcaccttcgtcaacaacgagttcaaccaccgtcgccacctgcgcgcgcgggggccgggcgcgctccacggcgcgccggggttccgcttcaccgccattgacgacggccttccgccctccgacgccgacgccacccaggacgtccccaagctctgctactccaccatgaccacctgcctaccccggttcagggacctaattgtcaggaccaatgccgaggccgaggccgagggacgccccgccgtgacgtgcgtcgtcgccgacagcatcatgagcttcggcctccgcgccgcgcgggagctcggtctccgctgcgccacgttctggaccgccagcgcctgcggcttcattggctactactactaccgccacctcgtcgcacggggtatcgtcccgcttaagaatgaagcgcagctcaccgacggttacctggacaccgtcgtcgactggatcccttgcgcgcccaaggacctgcagctccgggacttcccgagctttgtgcgcaccacggacccggacgacatcatgctcaacttcttcatccacgaggtagaggcgatgtcgcaggcgtcggcggtggtcatcaacaccttcgatgatctcgacgcgacgctgcttcacgccatggcgaagctcctgtcccggcccatctacaccgtgggcccgctcctgctgacggtgcgaaacaacgtccccgcggacagccccgtcgcggccatcgggtccaacctatggaaggaacaagaggcgccgctccggtggctcgacggccgcgcgccgcgctcggtcgtgtacatcaacttcgggagcgtcacggtgatgtccaacgagcagctggtcgagttcgcgtgggggctggccaacaccggctacaccttcctctggaacgtgcgcccggacctcgtcaagggcggcgactccgccggcgcggggctgccaccggagtttctggccgcgacggagggccggagcatgctgtcgacgtggtgcccgcaggcagaggtgctggagcacgaggccgtggggttgttcttgacgcactccgggtggaactccacgattgagagcatctgtggcggcgtgcccatggtgtgctggcccttcttcgctgagcagcagaccaactgccggtacaagcgcaccgagtggggcatcgggatggagatcggtaatgacgtccggcggggcgaggtgaaggcgctcatacgggaggccatggagggggagaaagggcgggacatgcgccgccgcgtcacggagcttaaggggagcgccgtggccgcggcgaagctcaacggacgctctatgcgcaacgtggacaggttcatcgatgaggtgctcctagcttgagcattaaggtttttttacaatggtggccttagttttgcctctgtactcaagtctactcttatttttgcttcttcctcggttttacccaccatccagccgtccactgccttggcttagatcaaggctcgcacgccgtgtcccccactgttatgttatgaaaacaaaaacggtaattttcagataccggaaatcgttttcg

SEQ ID NO: 334 - protein, 496 aa, Zea mays
  misc_feature (19)..(493): Pfam Name: UDPGT Pfam Description: UDP-glucoronosyl and UDP-glucosyl transfer
  misc_feature (1)..(496): Ceres Clone ID no. 1492154
  misc_feature (1)..(496): Bit score of 935.5 for HMM based on sequences of Figure 5
  misc_feature (1)..(496): Functional Homolog Of SEQ ID NO. 253
MGSVPPAEGDRRQPQQQPHVVMIPYPAQGHVTPMLQLAKLLHTRGFHVTFVNNEFNHRRHLRARGPGALHGAPGFRFTAIDDGLPPSDADATQDVPKLCYSTMTTCLPRFRDLIVRTNAEAEAEGRPAVTCVVADSIMSFGLRAARELGLRCATFWTASACGFIGYYYYRHLVARGIVPLKNEAQLTDGYLDTVVDWIPCAPKDLQLRDFPSFVRTTDPDDIMLNFFIHEVEAMSQASAVVINTFDDLDATLLHAMAKLLSRPIYTVGPLLLTVRNNVPADSPVAAIGSNLWKEQEAPLRWLDGRAPRSVVYINFGSVTVMSNEQLVEFAWGLANTGYTFLWNVRPDLVKGGDSAGAGLPPEFLAATEGRSMLSTWCPQAEVLEHEAVGLFLTHSGWNSTIESICGGVPMVCWPFFAEQQTNCRYKRTEWGIGMEIGNDVRRGEVKALIREAMEGEKGRDMRRRVTELKGSAVAAAKLNGRSMRNVDRFIDEVLLA

SEQ ID NO: 335 - protein, 492 aa, Oryza sativa subsp. indica
  misc_feature (8)..(485): Pfam Name: UDPGT Pfam Description: UDP-glucoronosyl and UDP-glucosyl transfer
  misc_feature (1)..(492): Public GI ID no. 125525771
  misc_feature (1)..(492): Bit score of 963.9 for HMM based on sequences of Figure 5
  misc_feature (1)..(492): Functional Homolog Of SEQ ID NO. 253
MARRQRHAVMIPYPAQGHITPMMKLAKLLHARGFHVTFVNTEFNHPRMLASRGAAALDGGVPGFRFAAIPDGLPPSDADATQDIPALCRSTMTTCLPHVVALLAELNDPTSGVPPVTCVVADAIMSFAYDAARRIGVPCTALCTPSACGFVGYSHYRQLVERGLVPLKDAAQLADGYLDTVVDGARGMCDGVQLRDFPSFIRTTDRGDIMLNFIMREAERLTLPDAVILNTFDDLERPALDAMRAILPPVYTVGPLHLHVRHVVPKGSPLDTAIGSNLWKEQDGLLEWLDGRPPRSVVYVNYGSITVMTNEQLLEFAWGLAHSGYPFLWNVRPDLVKGDAAVLSPEFLTAVEGRSMLTTWCPQEQVIEHPAVGVFLTHSGWNSTLESLCAGVPMLSWPFFAEQQTNCRYKRTEWGVGMEIGGEVERSDVAATIREAMEGEKGREMRRRAAEWKEMATRVTLPGGTADINLTRLIDEVLLSGGKKRQALDARD

SEQ ID NO: 336 - DNA, 1817 bp, Zea mays
  misc_feature (1)..(1817): Ceres Clone ID no. 1571410
  misc_feature (1)..(1817): Encodes the peptide sequence at SEQ ID NO. 337
ctccgatacgcggggatgcataggcgtcggcaggaggagctcatgtcgaacaccaatagcgttagccgttagccaccaccagtaggcagtagccacagcagtcatggggtcggtgccgccggcagagggggacaggcgccagccccagcagcagccgcacgtgatgatgatcccgtacccggcgcagggccatgtcacgccgatgctgcagctggccaagctactccacacacgcggattccacgtcaccttcgtcaacaacgagttcaaccaccgtcgccacctgcgcgcgcgggggccgggcgcgctccacggcgccccggggttccgcttcaccgccattgacgacggccttccgccctccgacgccgacgccacccaggacgtccccaagctctgctactccaccatgaccacctgcctaccccggttcagggacctaattgtcaggaccaatgccgaggccgaggccgagggacgccccgccgtgacgtgcgtcgtcgccgacagcatcatgagcttcggcctccgcgccgcgcgggagctcggtctccgctgcgccacgttctggaccgccagcgcctgcggcttcattggctactactactaccgccacctcgtcgcacggggtatcgtcccgcttaagaatgaagcgcagctcaccgacgggtacctggacaccgtcgtcgactggatcccttgcgcgcccaaggacctgcagctccgggacttcccgagctttgtgcgcaccacggacccggacgacatcatgctcaacttcttcatccacgaggtagaggcgatgtcgcaggcgtcggcggtggtcatcaacacattcgatgatctcgacgcgacgctgcttcacgccatggcgaagctcctgtcccggcccatctacaccgtgggcccgctcctgctgacggtgcgaaacaacgtccccgcggacagccccgtcgcggccatcgggtccaacctatggaaggaacaagaggcgccgctccggtggctcgacggccgcgcgccgcgctcggtcgtgtacatcaacttcgggagcgtcacggtgatgtccaacgagcagctggtcgagttcgcgtgggggctggccaacaccggctacacattcctctggaacgtgcgcccggacctcgtcaagggcggcgactccgccggcgcggggctgccaccggagtttctggccgcgacggagggccggagcatgctgtcgacgtggtgcccgcaggcagaggtgctggagcacgaggccgtggggttgttcttgacgcactccgggtggaactccacgattgagagcatctgtggcggcgtgcccatggtgtgctggcccttcttcgctgagcagcagaccaactgccggtacaagcgcaccgagtggggcatcgggatggagatcggtaatgacgtccggcggggcgaggtgacggcgctcatacgggaggccatggagggggagaaagggcgggacatgcgccgccgcgtcacggagcttaaggggagcgccgtggccgcggcgaagctcaacggacgctctatgcgcaacgtggacaggttcatcgacgaggtgctcctagcttgagcattaagggttttttttacaatggtggccttagttttgcctctgtactcaagtctactcttatttttgcttcttcctcggttttacccaccatccagccgtccactgccttgcttagatcaaggctcgcacgccgtgtcccccactgttatgttatgaaaacaaaaacggtaattttcagataccgaaaatcgttttcgaaattttatcaagatttaggtct

SEQ ID NO: 337 - protein, 496 aa, Zea mays
  misc_feature (18)..(493): Pfam Name: UDPGT Pfam Description: UDP-glucoronosyl and UDP-glucosyl transfer
  misc_feature (1)..(496): Ceres Clone ID no. 1571410
  misc_feature (1)..(496): Bit score of 931.6 for HMM based on sequences of Figure 5
  misc_feature (1)..(496): Functional Homolog Of SEQ ID NO. 253
MGSVPPAEGDRRQPQQQPHVMMIPYPAQGHVTPMLQLAKLLHTRGFHVTFVNNEFNHRRHLRARGPGALHGAPGFRFTAIDDGLPPSDADATQDVPKLCYSTMTTCLPRFRDLIVRTNAEAEAEGRPAVTCVVADSIMSFGLRAARELGLRCATFWTASACGFIGYYYYRHLVARGIVPLKNEAQLTDGYLDTVVDWIPCAPKDLQLRDFPSFVRTTDPDDIMLNFFIHEVEAMSQASAVVINTFDDLDATLLHAMAKLLSRPIYTVGPLLLTVRNNVPADSPVAAIGSNLWKEQEAPLRWLDGRAPRSVVYINFGSVTVMSNEQLVEFAWGLANTGYTFLWNVRPDLVKGGDSAGAGLPPEFLAATEGRSMLSTWCPQAEVLEHEAVGLFLTHSGWNSTIESICGGVPMVCWPFFAEQQTNCRYKRTEWGIGMEIGNDVRRGEVTALIREAMEGEKGRDMRRRVTELKGSAVAAAKLNGRSMRNVDRFIDEVLLA

SEQ ID NO: 338 - protein, 482 aa, Medicago truncatula
  misc_feature (11)..(481): Pfam Name: UDPGT Pfam Description: UDP-glucoronosyl and UDP-glucosyl transfer
  misc_feature (1)..(482): Public GI ID no. 115334817
  misc_feature (1)..(482): Bit score of 986.3 for HMM based on sequences of Figure 5
  misc_feature (1)..(482): Functional Homolog Of SEQ ID NO. 253
MGNFANRKPHVVMIPYPVQGHINPLFKLAKLLHLRGFHITFVNTEYNHKRLLKSRGPKAFDGFTDFNFESIPDGLTPMEGDGDVSQDVPTLCQSVRKNFLKPYCELLTRLNHSTNVPPVTCLVSDCCMSFTIQAAEEFELPNVLYFSSSACSLLNVMHFRSFVERGIIPFKDESYLTNGCLETKVDWIPGLKNFRLKDIVDFIRTTNPNDIMLEFFIEVADRVNKDTTILLNTFNELESDVINALSSTIPSIYPIGPLPSLLKQTPQIHQLDSLDSNLWKEDTECLDWLESKEPGSVVYVNFGSITVMTPEQLLEFAWGLANCKKSFLWIIRPDLVIGGSVIFSSEFTNEIADRGLIASWCPQDKVLNHPSIGGFLTHCGWNSTTESICAGVPMLCWPFFADQPTDCRFICNEWEIGMEIDTNVKREELAKLINEVIAGDKGKKMKQKAMELKKKAEENTRPGGCSYMNLNKVIKDVLLKQN

SEQ ID NO: 339 - protein, 482 aa, Clitoria ternatea
  misc_feature (11)..(478): Pfam Name: UDPGT Pfam Description: UDP-glucoronosyl and UDP-glucosyl transfer
  misc_feature (1)..(482): Public GI ID no. 133874192
  misc_feature (1)..(482): Bit score of 958.0 for HMM based on sequences of Figure 5
  misc_feature (1)..(482): Functional Homolog Of SEQ ID NO. 253
MSYTKERKPHAVLTPFPCQGHINPMFNLAKLLHLKGFYITFVNTEYNHKRLLKSMGPNSLQNIHLETIPDGLPLMEDEADVTQDIVSLCESITKNFLVPFRDLVFRLNDSGLVPSVTCLVSDVCMAFTLQVAQQLELPNVILFPASASMLLSVSQFPALLNKGLIPLKDESYLTNGYLDTKVDWIPCMKNFRLKDLPDFIRTTDPNNFMVKFLIQVVAEVAHKATAILFNTFDELESDVIEALSSVFPPIYPIGPFPSFLNQSPQNHLSSLSSSLWKEDTECIHWLESKEPNSVVYVNFGSITVMSPDQLLEFAWGLANSKRPFLWIIRPDLVIGGSVILSSEFVNETSDRGLIASWCPQEQVLNHPSVGGFLTHCGWNSTIESICAGVPMLCWPFFADQPTNCRSICNEWNIGMELDTNVKREEVEKLVNELMEGEKGNKMKEKVMELKKKAEEDTRPGGLSHTNLDKVTNEMLLKKIRLI

SEQ ID NO: 340 - DNA, 1443 bp, Populus balsamifera subsp. trichocarpa
  misc_feature (1)..(1443): Ceres Annot ID no. 1453383
  misc_feature (1)..(1443): Encodes the peptide sequence at SEQ ID NO. 341
  misc_feature (60)..(60): n is a, c, t, g, unknown, or other
atgtttcgcaaaatcttagctgacaagcctcatgtaatatgtattccctgtccagctcanagccatgtaaaggcaatgcttaaactagcaaaactactgcattaccgaggttttcgcataacctttgtgaacacagagttcaaccacagacggttgcttaaatctagaggtcctgattccctgaatggcttacccgactttcggttcgaatctatcccagatggcctccctccttcagatgagaaagctacccaagatgtacaagcaatttttgaggcttgcaagaagaacttgctagctccatttaatgaactgcttgccaagctcaatgatacagcatcttctgatgttcctcaagtgacttgcattgtatctgatggatttgtgccagctgccatcactgctgctcagaggcatggaattcctgttgccttgttcgtttctatctctgcttgcactttcatggggcttaagcaatataaagagctcaaagaaagaggactgtttccattaaaagacgagagctttttaacaaatggctatttggatcaagtactagactggattccaggaatgaaagatatacggttaagggatcttccaagttttcttcgtacaacagatccagatgatcattctttcaacttctccatggaatgtgctgagagagcatctgaaggttctgcagtgattttccctacttttgatgctttggagaaagaagtcttgagtgctctttactcaatgtttcctcgtgtctacacgaccggtccacttcaattacttctcaatcaaatgaaagaagatgatctagattctattggatataatctatggaaagaagaggttgagtgtctccaatggcttgattccaagaaaccaaactcagtaatttatgtgaactttggtagcatagccgtcgctacaaagcagcagctgattgaattgggaatgggacttgcaaaaagtggtcacccatttttatggatattaaggcctgacatggtcataggcgactccgccatattgccaccagaatttactgacgagactaaagacagaggatttatttctagctggtgtccacaagaggaagttctcaaccacccatcaataggaggtttcctaacacatagtggatggaattcaacagctgagagcatttcttctggggtgcccatgctttgtttgccgttctttggtgatcaacaaacaaactgtaggtacacttgcaatgagtggggcattggaatggagattgatagcaatgcggaaagagataaagtggagaagcttgtgcgagagttgatggaaggagagaaaggcagggaggtaaagaaaaaagtcatggagtggagaaaattagcagaggaagccgctggtccaagtggctcgtcatccatgaatttagacgagttggtgaaggcagtgcttttgccatga

SEQ ID NO: 341 - protein, 480 aa, Populus balsamifera subsp. trichocarpa
  misc_feature (10)..(477): Pfam Name: UDPGT Pfam Description: UDP-glucoronosyl and UDP-glucosyl transfer
  misc_feature (1)..(480): Ceres Annot ID no. 1453383
  misc_feature (1)..(480): Bit score of 988.6 for HMM based on sequences of Figure 5
  misc_feature (1)..(480): Functional Homolog Of SEQ ID NO. 253
  misc_feature (20)..(20): Xaa is any aa, unknown, or other
MFRKILADKPHVICIPCPAXSHVKAMLKLAKLLHYRGFRITFVNTEFNHRRLLKSRGPDSLNGLPDFRFESIPDGLPPSDEKATQDVQAIFEACKKNLLAPFNELLAKLNDTASSDVPQVTCIVSDGFVPAAITAAQRHGIPVALFVSISACTFMGLKQYKELKERGLFPLKDESFLTNGYLDQVLDWIPGMKDIRLRDLPSFLRTTDPDDHSFNFSMECAERASEGSAVIFPTFDALEKEVLSALYSMFPRVYTTGPLQLLLNQMKEDDLDSIGYNLWKEEVECLQWLDSKKPNSVIYVNFGSIAVATKQQLIELGMGLAKSGHPFLWILRPDMVIGDSAILPPEFTDETKDRGFISSWCPQEEVLNHPSIGGFLTHSGWNSTAESISSGVPMLCLPFFGDQQTNCRYTCNEWGIGMEIDSNAERDKVEKLVRELMEGEKGREVKKKVMEWRKLAEEAAGPSGSSSMNLDELVKAVLLP

SEQ ID NO: 342 - protein, 482 aa, Medicago truncatula
  misc_feature (11)..(481): Pfam Name: UDPGT Pfam Description: UDP-glucoronosyl and UDP-glucosyl transfer
  misc_feature (1)..(482): Public GI ID no. 152149367
  misc_feature (1)..(482): Bit score of 983.5 for HMM based on sequences of Figure 5
  misc_feature (1)..(482): Functional Homolog Of SEQ ID NO. 253
MGNFANRKPHVVMIPYPVQGHINPLFKLAKLLHLRGFHITFVNTEYNHKRLLKSRGPKAFDGFTDFNFESIPDGLTPMEGDGDVSQDVPTLCQSVRKNFLKPYCELLTRLNHSTNVPPVTCLVSDCCMSFTIQAAEEFELPNVLYFSSSACSLLNVMHFRSFVERGIIPFKDESYLTNGCLETKVDWIPGLKNFRLKDIVDFIRTTNPNDIMLEFFIEVADRVNKDTTILLNTFNELESDVINALSSTIPSIYPIGPLPSLLKQTPQIHQLDSLDSNLWKEDTECLDWLESKEPGSVVYVNFGSTTVMTPEQLLEFAWGLANCKKSFLWIIRPDLVIGGSVIFSSEFTNEIADRGLIASWCPQDKVLNHPSIGGFLTHCGWNSTTESICAGVPMLCWPFFADQPTDCRFICNEWEIGMEIDTNVKREELAKLINEVIAGDKGKKMKQKAMELKKKAEENTRPGGCSYMNLNKVIKDVLLKQN

SEQ ID NO: 343 - DNA, 1657 bp, Triticum aestivum
  misc_feature (1)..(1657): Ceres Clone ID no. 791790
  misc_feature (1)..(1657): Encodes the peptide sequence at SEQ ID NO. 344
aggagtatatatatataagcagtaaggggtcctcaagagcgcacgatctgtcgaggtcgagaacatggagatgaagaagcctcacgcggtgatcgtgccgttgccgacgcaggggcacgtcacgcccatgctgaagctggccaagcttcttcactgcaagggcttccacatcaccttcgtcaacaccgagtacaaccaccggcgcctggtccgctcccgcggcgacgcagccgtggagggcctcccggacttccgcttcgccaccatccccgacggcctgccgccatcggacgcggatgccacgcaggacataccctccctgtgctactccacgatgaccacctgccttccccccttgaagaggctgctcggggagcttaacagggttgggccgccggtgacgtgcgtggtggcggacaacgtgatgagcttcagcgtggacgcggcggcggagatcggggtgccgtgcgtcctcttctggaccgccagcgcctgcggctacattggctaccgcaacttccggttcctcatgcaagagggcatcgctcccctcaaagatgaagcgcagctgagcaacgggtacctggacacgccggtggcgcaggctcccgggatgagccggcacatgcgcctccgggacttcccttccttcatctgcaccaccgaccgcgacgacgtgatgctcaacttcctgctgcaccactcggagcaggcgggccgcgcggccgccgtcatcgtcaacaccctggacgagcttgagcagccggcgctggacgccatgcgcgccatgctcccgcgcgtctacaccattggcccgctcaacctcctcgcggacaagggcgaagccggcccgctcgcccggatacgcgccagcctctggagggaggaccgctcctgcctagagtggctcgacggcagggagccccggtcggtggtgtacgtcaacttcgggagcatcaccaccatgtccagcgaggagctggtggagttcgcgtggggcctggccaactgcggccaccccttcctgtggatcgtgaggaatgacctgctggccaagggcgccgccgtgcggctgcctcccgagttcctggaggccaccaaggggaggtgcctcctggcgagctggtgcgagcaggaggcggtgttgcggcaccaggccgtcggcgtcttcctcacccacagcgggtggaactcggccctggtgtccatcagcgccggggtgcccatgctctgctggcccttcttcgccgagcagcagaccaacgcccgctacgcgtgtgtcgagtggggcgtcggcatggaggtcggcgacgacgtgcgctgcgatgaggtggaggccaggataagggaggtgatgggaggcgagggagctgggagggagatgaagcgcagggcggccgagtgggaggagatgtgtgtccgtgcaaccgcgcagccgggtggcaggtccatggccaaccttgacagcctcatcaaggatgtgctgctcaccgcaacaccaacaaactaaaacactttgattcatgagtagtatccaagtgtttgttttcagaataaataaccatgtttgaattttagttcatccatgaattaatgcgctttcctatgcctgtaatccataattttaattaataaataaaaattccagtttcatcct

SEQ ID NO: 344 - protein, 481 aa, Triticum aestivum
  misc_feature (8)..(477): Pfam Name: UDPGT Pfam Description: UDP-glucoronosyl and UDP-glucosyl transfer
  misc_feature (1)..(481): Ceres Clone ID no. 791790
  misc_feature (1)..(481): Bit score of 954.0 for HMM based on sequences of Figure 5
  misc_feature (1)..(481): Functional Homolog Of SEQ ID NO. 253
MEMKKPHAVIVPLPTQGHVTPMLKLAKLLHCKGFHITFVNTEYNHRRLVRSRGDAAVEGLPDFRFATIPDGLPPSDADATQDIPSLCYSTMTTCLPPLKRLLGELNRVGPPVTCVVADNVMSFSVDAAAEIGVPCVLFWTASACGYIGYRNFRFLMQEGIAPLKDEAQLSNGYLDTPVAQAPGMSRHMRLRDFPSFICTTDRDDVMLNFLLHHSEQAGRAAAVIVNTLDELEQPALDAMRAMLPRVYTIGPLNLLADKGEAGPLARIRASLWREDRSCLEWLDGREPRSVVYVNFGSITTMSSEELVEFAWGLANCGHPFLWIVRNDLLAKGAAVRLPPEFLEATKGRCLLASWCEQEAVLRHQAVGVFLTHSGWNSALVSISAGVPMLCWPFFAEQQTNARYACVEWGVGMEVGDDVRCDEVEARIREVMGGEGAGREMKRRAAEWEEMCVRATAQPGGRSMANLDSLIKDVLLTATPTN

SEQ ID NO: 345 - protein, 498 aa, Oryza sativa subsp. indica
  misc_feature (20)..(495): Pfam Name: UDPGT Pfam Description: UDP-glucoronosyl and UDP-glucosyl transfer
  misc_feature (1)..(498): Public GI ID no. 125561485
  misc_feature (1)..(498): Bit score of 913.8 for HMM based on sequences of Figure 5
  misc_feature (1)..(498): Functional Homolog Of SEQ ID NO. 253
MGSFSAAEETTATAAARPHAVMVPYPAQGHVTPMLKLAVLLHARGFHVTFVNNEFNHRRLLRARGAGTLDGAPGFRFAAIDDGLPPSDADATQDVPALCHSVRTTCLPRFKALLAKLDEEADADAGAGAGDARRVTCVVADSTMAFAILAARELGLRCATLWTASACGFMGYYHYKHLLDRGLFPLKSEADLSNGHLDTKMDWIPGMPADLRLRDLPSFVRSTDRDDIMFNFFIDVTATMPLASAVILNTFDELDAPLMVAMSALLPPIYTVGPLHLTARNNLPADSPVAGVGSNLWKEQGEALRWLDGRPPRSVVYVNFGSITVMSAEHLLEFAWGLAGSGYAFLWNVRPDLVKGDAAALPPEFAAATGERSMLTTWCPQAEVLEHEAVGVFLTHSGWNSTLESIVGGVPMVCWPFFAEQQTNCRYKRTEWGIGAEIPDDVRRGEVEALIREAMDGEKGREMRRRVAELRESAVASGQQGDRSMQNLDRLIDEVLLA

SEQ ID NO: 346 - DNA, 1767 bp, Glycine max
  misc_feature (1)..(1767): Ceres Clone ID no. 474849
  misc_feature (1)..(1767): Encodes the peptide sequence at SEQ ID NO. 347
acacccaaatccttcttcaccttcacaattagaaaaaaaaaaaaacaaaaaatgggcgtttctcgttctcaaaagcctcatgttgtttgtgtgccattcccagcacaaggccacgtgaacccttttatgcaactaagcaaactccttctttgcaccggtttccacataacctttgtgaacaccgagttcaaccacaagcgtttggtgaagtctcttggacaagaatttgtcaagggacaacctcattttcgatttgagaccataccagatgggttgcctccatctgacaaagatgcaacacaaagcattgcagcattgtgtgatgcaactagaaaacattgttatgagccactcaaagagcttgtgaagaagctcaatgcttcacatgaagtgcctttggttacctctatcatctatgatgggctaatgggctttgcagggaaagtggcaagggatttggacatttctgaacaacaattttggacagcctcagcttgtggtttaatgggatacttgcaatttgatgagcttgtcgaaagaggcattattcccttccaagatgaaagtttcactactgatgggtcattggatacaaatctagactggatatctggaatgaaaaatatgcgaatcagagattgtccaagtttcgtgagaactaccactctagatgaaaccagttttatttgctttggtatagaagcaaaaacctgcatgaaatcatcttcaatcataattaacaccatccaagaattggaaagtgaagttctcaatgcccttatggctcagaacccaaatatatataacattggtccacttcaattgttaggaaggcattttcctgataaagacaagggcttcaaggtgagtgggtcaaatctttggaaaaatgactcaaaatgtatccaatggctagaccaatgggaaccttcctcagtcatatatgtgaattatggaagtattactgtgatgtccgaggatcatttgaaagaatttgcttggggactagcaaatagcaatttaccatttttgtggataaaaaggccagatttggtaatgggtgagtccacacaattgccacaagacttcttagatgaggttaaagatagaggatacataacaagttggtgcccccaagagcaagtgctgtctcatccatcagttggggttttcctaactcattgtggctggaattctacactagaaggtataagtgggggtgtccctatgataggttggcctttctttgctgaacaacaaacaaattgcaggtacatatgcacaacttgggggataggaatggatattaaagatgatgtaaaaagggaggaggtgacaacacttgtgaaagaaatgataaccggagaaagggggaaggaaatgagacaaaagtgtctggagtggaaaaagaaagcaatagaagccactgatatgggaggatcatcatataatgatttccatcgattagtgaaggaggttcttcacaatgatgttgtttgagtctttcaatatattgggggtccgaaggtagggtattaggtgtttcaatattggagatcctagtgttgggctgggctatcaaacaaaatattatgaagaaactagcatgacttgatggctgaaaatcaagtctattaaataaagatttgtgtggatgtaattcatcatatattgtattgatttgaagtgtatgtcggtttacaatatacatgtaaactttcaattcgatgtaattgaggttaaattataattttgatcctctaattc

SEQ ID NO: 347 - protein, 482 aa, Glycine max
  misc_feature (20)..(480): Pfam Name: UDPGT Pfam Description: UDP-glucoronosyl and UDP-glucosyl transfer
  misc_feature (1)..(482): Ceres Clone ID no. 474849
  misc_feature (1)..(482): Bit score of 916.8 for HMM based on sequences of Figure 5
  misc_feature (1)..(482): Functional Homolog Of SEQ ID NO. 253
MGVSRSQKPHVVCVPFPAQGHVNPFMQLSKLLLCTGFHITFVNTEFNHKRLVKSLGQEFVKGQPHFRFETIPDGLPPSDKDATQSIAALCDATRKHCYEPLKELVKKLNASHEVPLVTSIIYDGLMGFAGKVARDLDISEQQFWTASACGLMGYLQFDELVERGIIPFQDESFTTDGSLDTNLDWISGMKNMRIRDCPSFVRTTTLDETSFICFGIEAKTCMKSSSIIINTIQELESEVLNALMAQNPNIYNIGPLQLLGRHFPDKDKGFKVSGSNLWKNDSKCIQWLDQWEPSSVIYVNYGSITVMSEDHLKEFAWGLANSNLPFLWIKRPDLVMGESTQLPQDFLDEVKDRGYITSWCPQEQVLSHPSVGVFLTHCGWNSTLEGISGGVPMIGWPFFAEQQTNCRYICTTWGIGMDIKDDVKREEVTTLVKEMITGERGKEMRQKCLEWKKKAIEATDMGGSSYNDFHRLVKEVLHNDVV

SEQ ID NO: 348 - DNA, 1467 bp, Populus balsamifera subsp. trichocarpa
  misc_feature (1)..(1467): Ceres Annot ID no. 1474602
  misc_feature (1)..(1467): Encodes the peptide sequence at SEQ ID NO. 349
atggtttatagtgttttagctgatcataagcctcatgcagtctgtctccctagcccatttcaaagccatataaagtcaatgcttaaactagcaaaactactacatcacaaaggttttcacatcacctttgtcaacacagagtttaaccataagcgtttacttaaatctagaggtcctgattccctgaatgggttgcccgactttcggttcgagtccattcctgatggccttcctccttcagatgagaatgtcatcccagatatctctgtagctgttgcggctgcctcgaagaatttgctggatccgtttaatgaagttcttgacaagctcaatgacacagcagcttctgattcgcccccagtgacctgcatcctttctgatggtttcatgccagtagctatcacttctgccgagatgcaccaaattccgattgcgctgttatttaccatctccgcttgcagcttcatgggctttaaacaatacaaggcgctcaaagaaagaggtcttacaccactgaaagatgagagctttttaacaaatggcttcctggaaaaggtagtagactggattccaggaatgaaagatatacggataagagatcttccaagttttgttcgtacaacagatgcaactgattttatgttcaacttctgcctaggatgcgctgagagagctccttcagcttctgcggtcattttccatactttcgatgctttagagcaagaagtcctgactgccctttatcctatcttccctcgtgtctacacaatcggtccacttcaattacttctcaatcaaatccaagaagatgatctaaattctattgattgtaacctatggaaagaagaagttgagtgtctccaatggcttgattccaagaaacccaactcggtaatttatgtgaattttggtagcatagcagtggctacaaaagagcagctcgttgaattgggaatgggactttctaaaagtggtcacccatttttatggataatacgaccagacatgatcaccggcgactccgcgatatcgccaccagaattcactgaagaaactaaagaaaggggctttatttgtagttggtgtccacaagaggaagtcctcaaccacccatcagttggaggttttctaacacattgtggatggacttccataatcgagagcatttcttctggtgtgcctatgctttgttggccattcgctggtgatcaacaaacaaattgtaggtatacatgcactgagtggggaattggaatggagattgatagcaatgtgaaaagagataatgtggagaagcttgtgagagagttgatggagggggagagaggtaagaaaatgaaggagaaatccacagaatggaaaaaactagcagaggaggccagtggccccagaggttcatcaaccatgaatttagacatgttggtgaaagaagtgctcttgtcacgaaaccaaacttatgacgtataa

SEQ ID NO: 349 - protein, 488 aa, Populus balsamifera subsp. trichocarpa
  misc_feature (13)..(482): Pfam Name: UDPGT Pfam Description: UDP-glucoronosyl and UDP-glucosyl transfer
  misc_feature (1)..(488): Ceres Annot ID no. 1474602
  misc_feature (1)..(488): Bit score of 985.7 for HMM based on sequences of Figure 5
  misc_feature (1)..(488): Functional Homolog Of SEQ ID NO. 253
MVYSVLADHKPHAVCLPSPFQSHIKSMLKLAKLLHHKGFHITFVNTEFNHKRLLKSRGPDSLNGLPDFRFESIPDGLPPSDENVIPDISVAVAAASKNLLDPFNEVLDKLNDTAASDSPPVTCILSDGFMPVAITSAEMHQIPIALLFTISACSFMGFKQYKALKERGLTPLKDESFLTNGFLEKVVDWIPGMKDIRIRDLPSFVRTTDATDFMFNFCLGCAERAPSASAVIFHTFDALEQEVLTALYPIFPRVYTIGPLQLLLNQIQEDDLNSIDCNLWKEEVECLQWLDSKKPNSVIYVNFGSIAVATKEQLVELGMGLSKSGHPFLWIIRPDMITGDSAISPPEFTEETKERGFICSWCPQEEVLNHPSVGGFLTHCGWTSIIESISSGVPMLCWPFAGDQQTNCRYTCTEWGIGMEIDSNVKRDNVEKLVRELMEGERGKKMKEKSTEWKKLAEEASGPRGSSTMNLDMLVKEVLLSRNQTYDV

SEQ ID NO: 350 - DNA, 1494 bp, Sorghum bicolor
  misc_feature (1)..(1494): Ceres Annot ID no. 8713073
  misc_feature (1)..(1494): Encodes the peptide sequence at SEQ ID NO. 351
atggggtcgctgccgacggaggagcgggagaggcgccagcagcagccgccgcacgtggtgatggtcccgtacccggcgcagggccatgtcacgccgatgctgcagctggccaagctactccacacgcgcggcttccacgtcaccttcgtcaacaacgagttcaaccaccgccgccacctgcgcgcgcgcgggcctggagcgctcgacggcgcgccggggttccgcttcgtcgccatcgacgacggccttccacgctccgacgccgacgccacgcaggacgtccccgcgctctgctactccaccatgaccacctgcctgccccggtttaaggacctcgtcgcccggaccaatgccgaggccgaggcccagggacggcccgccgtgacgtgcgtcgtcgccgacagcgtcatgaccttcgctctccgcggcgcgcgggagctcggcctccgctgcgccacgctctggaccgccagcgcctgcggcttcatcggctactactactaccgccacctcgtggagcggggcatcgtcccgctccagaacgaggcgcagctcaccgacgggtacctggacgacaccgtcgtcgactggatccccgacggcgcggcgcccaaggacctgcggctccgggacttcccgagcttcgtacgcaccacggacccggacgacatcatgctcaactacttcatccacgaggtggccgggatgtcgcaggcgtcggcggtggtcatcaacaccttcgacgagctcgacgcgacaccgctccacgccatggcgaagctcctgtcgcggccggtctacaccgtcggcccgctcccgctgacggtgcgaaacaacgtccccgcggacagccccgtcgcggccatcgcgtccaacctgtggaaggaggaggacgcgccgctccggtggctccacggccgcgcgccgcgctcggtcgtgtacgttaacttcgggagcatcacggtgatgtccaacgagcagctggccgagttcgcgtgggggctggccaacaccggctacgccttcctgtggaacgtgcgtccggacctcgtcaagggcggcggcggcggcggcgggctgccgtcggagttcgcggccgcgacggagggccggagcatgctgtcgacgtggtgcccgcaggcggcggtgctggagcacgatgccgtgggggtgttcttgacgcactccgggtggaactccacgctggagagcatctgcggcggcgtgcccatggtgtgctggcccttcttcgccgagcagcagaccaactgccggtacaagcgcaccgagtggggcatcgggatggagatcggcagcgacgtccggcggggcgaggtggaggcgctcatacgggaggccatggagggggagaaagggcgggagatgcgccggcgagtgacggagctcaaggaaagcgccgtggccgcggcgaggcccgacggacgatccatgcgcaacgtggacaggctcatcgacgaggtgctcctagcctga

SEQ ID NO: 351 - protein, 497 aa, Sorghum bicolor
  misc_feature (18)..(494): Pfam Name: UDPGT Pfam Description: UDP-glucoronosyl and UDP-glucosyl transfer
  misc_feature (1)..(497): Ceres Annot ID no. 8713073
  misc_feature (1)..(497): Bit score of 907.2 for HMM based on sequences of Figure 5
  misc_feature (1)..(497): Functional Homolog Of SEQ ID NO. 253
MGSLPTEERERRQQQPPHVVMVPYPAQGHVTPMLQLAKLLHTRGFHVTFVNNEFNHRRHLRARGPGALDGAPGFRFVAIDDGLPRSDADATQDVPALCYSTMTTCLPRFKDLVARTNAEAEAQGRPAVTCVVADSVMTFALRGARELGLRCATLWTASACGFIGYYYYRHLVERGIVPLQNEAQLTDGYLDDTVVDWIPDGAAPKDLRLRDFPSFVRTTDPDDIMLNYFIHEVAGMSQASAVVINTFDELDATPLHAMAKLLSRPVYTVGPLPLTVRNNVPADSPVAAIASNLWKEEDAPLRWLHGRAPRSVVYVNFGSITVMSNEQLAEFAWGLANTGYAFLWNVRPDLVKGGGGGGGLPSEFAAATEGRSMLSTWCPQAAVLEHDAVGVFLTHSGWNSTLESICGGVPMVCWPFFAEQQTNCRYKRTEWGIGMEIGSDVRRGEVEALIREAMEGEKGREMRRRVTELKESAVAAARPDGRSMRNVDRLIDEVLLA

SEQ ID NO: 352 - DNA, 1696 bp, Triticum aestivum
  misc_feature (1)..(1696): Ceres Clone ID no. 795726
  misc_feature (1)..(1696): Encodes the peptide sequence at SEQ ID NO. 353
ggatctattctccttctcatactgtatgtttccaacgtactcaaacatacaagagccagctgagcatggcgatggcgccgtcctcgaagccggccaagacgacgccgcacatcctgctgctcccctacccggcgcagggccacgtcaacccgtttcttcgtctggccaaggccctgcacgcgcgggggctccacgtcaccttcgtccacacggagcacaaccacggccgcctcctccgctctcgcggtctcggcgccgtcacgggcgccgccgacggcttccggtttgagacgatccccgacgggctcccccgctccgaccacgacgccacgcaggacatctgggcgctctgtgaggccacgcgccgggcgtgtcctggccacctcagggagctcgttgagaggctcgggaggacggagggagtcccgccggtcacctgcgtcgtcaccgacggcgccatgggattcgcggtgcacgcggccaaggagatggggctgccggcatacctcttcttcacccccagcgcctgcggcttcttgtgctacctcaacttcgatcagcttgtcaagcggggatacgtgccattcaaagatgagagctgcttcaccaatgggtacctggacacccccgtggactggatcactggcatgatcagtaacctccgcctacgtgacttcccgacgttcatccgcaccactgacgctgacgatgtgatgctgaccatcaacatcaagcaatgcgagctcgacgcccccgccgctgacggtatcctcctcaacacctacgacgacctcgagcgcgccgcgctggacgccatccgcgagcgcctgcccaacaccttcgtcgtcgggcccctcggcccagaggtctcgccgccatcgtacctccccttcctcacctcgagcttgtggaaggaggacggccggtgcatcgcgtggctagacgcgcaggcggcggacggctccgtgatgtacgtcaacttcgggagcatcacggtcatgacgagggaccagatggtggagttcgctcgggggctggccgacgccggcagcccgttcctgtgggttgtccggcccgacatggtgcgcgacggcggcgatgatgatggcaaggtgccggtgccggatgggttcgcggaggaggtcgcgggacgagggctgatggtggggtggtgcgaccaggaggcggtgctgggccaccgcgcgaccgggggtttcctgagccactgcggttggaactcgacgttggagagcctgtgcgctggcgtgccgatgttgtgttggcccttcttctcagagcaggtgaccaactgccggtacgcgtgcgaggagtggggtgtgggcgtccagatgccgcgcgaggccgggcggggaaaggttgaggctgccgtgagggagctaatgggcgatggggataaggcggtggcaatgaggaggaaggcagcggagtggaaggagaaggccgtgagggcggtcgcggcgggtgggtcctcgcaacgggaccttgaaaggttcgtcgacgaaattgcgcacgtcaagggctagaggactcatgtcatgcatctggtgtgttcttgcttcgatttgacctttggtgaatggtttatgtgaagatattgtttcaacttgtcttgtaaactgcaaataaacttttggattcacattgaacttggggcaatatataagttttgttcggc

SEQ ID NO: 353 - protein, 490 aa, Triticum aestivum
  misc_feature (23)..(489): Pfam Name: UDPGT Pfam Description: UDP-glucoronosyl and UDP-glucosyl transfer
  misc_feature (1)..(490): Ceres Clone ID no. 795726
  misc_feature (1)..(490): Bit score of 825.2 for HMM based on sequences of Figure 5
  misc_feature (1)..(490): Functional Homolog Of SEQ ID NO. 253
MAPSSKPAKTTPHILLLPYPAQGHVNPFLRLAKALHARGLHVTFVHTEHNHGRLLRSRGLGAVTGAADGFRFETIPDGLPRSDHDATQDIWALCEATRRACPGHLRELVERLGRTEGVPPVTCVVTDGAMGFAVHAAKEMGLPAYLFFTPSACGFLCYLNFDQLVKRGYVPFKDESCFTNGYLDTPVDWITGMISNLRLRDFPTFIRTTDADDVMLTINIKQCELDAPAADGILLNTYDDLERAALDAIRERLPNTFVVGPLGPEVSPPSYLPFLTSSLWKEDGRCIAWLDAQAADGSVMYVNFGSITVMTRDQMVEFARGLADAGSPFLWVVRPDMVRDGGDDDGKVPVPDGFAEEVAGRGLMVGWCDQEAVLGHRATGGFLSHCGWNSTLESLCAGVPMLCWPFFSEQVTNCRYACEEWGVGVQMPREAGRGKVEAAVRELMGDGDKAVAMRRKAAEWKEKAVRAVAAGGSSQRDLERFVDEIAHVKG

SEQ ID NO: 354 - DNA, 1470 bp, Sorghum bicolor
  misc_feature (1)..(1470): Ceres Annot ID no. 8656770
  misc_feature (1)..(1470): Encodes the peptide sequence at SEQ ID NO. 355
atggcgtcgtcggaggcccagccaaccaataagccgccgcacgtcgtgctcatcccctacccggcgcagggccacgtgaacccgttcctgaagctagccaaggcgctgcacgcgcgcggcttccacgtcaccttggtccacacggagtacaaccacgggcgcctcctccgcgcgcggggcgcgggggccttcgacgccggcgacgagggcttccggttcgagaccatcccggacggcctgccgccctccgacctcgacgccacgcaggacatctgggcgctctgcgaggccacgcgccggacgggccccgccgccgtcagagggctcgtcgagcggttgaaccgcacggatggggtcccgcctgtcagctgcgtcgtcgccgacggcgccatgggttacgtggtgcacgtcgccaaggagatgggcctgccggcgtacctcttcttcacgcccagcggctgcggcttcttggcctacctcaactttgatcagctcgtcaagaggggctacgtgcctttcaaagatgagacgtgcttcaccaacgggtacctggacaccccggtggactggatcgccggcatgctgccgagcgcccgcctccgcgacctcccgacgttcatccgcaccacggaccccgatgacaccatgctgaccatcaacatcaagcagtgcgagctcgactccccggccgccgacggcatcctcctcaacaccttcgacgacctggagcgccgtgccctcgacgccatccgggcccgcctccccaacaccttcaccgtcggcccgctcggcccggaggtctccccgccgtcgtacctgccctctctaacctcgagcctgtggagggacgacgaccggtgcgcggcgtggctggacggacacgccggcggcgaggagggctccgtggtgtacgtgaacttcgggagcatcacggtggtgacgggcgagcagatggacgagttcgcgtgggggctggccgccgcgggatgcccgttcctgtgggtggtccggccggacacggtgcgcgacgccggcgggtgggcgctcccggaggggttcgcggaggcggtggccgggcgcgggctcacggtggggtggtgcgaccaggaggccgtgctggagcaccgcgccacgggcgggttcctcagccactgcgggtggaactccacgctggagagcctccgcgccggggtgccgctgctgtgctggcccttcttctcggagcaggtgaccaactgccggtacgcgtgcgacgagtggggggtgggactggagatgccgcgcgaggcggggcgtcgcgaggtggaggccgccgtcagggagctgatggacgcccagggaaggggcgccgcggccaggcggagggccgccgagtggaaggagaaggccagggcggccgtcgcgccgggcgggtcgtcgcgcgtcaacctcgacaggttcatccaagagatcgcgcgagccaagtgctaa

SEQ ID NO: 355 - protein, 489 aa, Sorghum bicolor
  misc_feature (14)..(488): Pfam Name: UDPGT Pfam Description: UDP-glucoronosyl and UDP-glucosyl transf
  misc_feature (1)..(489): Ceres Annot ID no. 8656770
  misc_feature (1)..(489): Bit score of 807.5 for HMM based on sequences of Figure 5
  misc_feature (1)..(489): Functional Homolog Of SEQ ID NO. 253
MASSEAQPTNKPPHVVLIPYPAQGHVNPFLKLAKALHARGFHVTLVHTEYNHGRLLRARGAGAFDAGDEGFRFETIPDGLPPSDLDATQDIWALCEATRRTGPAAVRGLVERLNRTDGVPPVSCVVADGAMGYVVHVAKEMGLPAYLFFTPSGCGFLAYLNFDQLVKRGYVPFKDETCFTNGYLDTPVDWIAGMLPSARLRDLPTFIRTTDPDDTMLTINIKQCELDSPAADGILLNTFDDLERRALDAIRARLPNTFTVGPLGPEVSPPSYLPSLTSSLWRDDDRCAAWLDGHAGGEEGSVVYVNFGSITVVTGEQMDEFAWGLAAAGCPFLWVVRPDTVRDAGGWALPEGFAEAVAGRGLTVGWCDQEAVLEHRATGGFLSHCGWNSTLESLRAGVPLLCWPFFSEQVTNCRYACDEWGVGLEMPREAGRREVEAAVRELMDAQGRGAAARRRAAEWKEKARAAVAPGGSSRVNLDRFIQEIARAKC

SEQ ID NO: 356 - DNA, 1533 bp, Sorghum bicolor
  misc_feature (1)..(1533): Ceres Annot ID no. 8679871
  misc_feature (1)..(1533): Encodes the peptide sequence at SEQ ID NO. 357
atggcagccggcgacaacaccaagccgcacgcggtgtgcgtcccgttcccggcgcagggccacgtgacgccgatgatgaagctggccaaggtcctctactgcaagggcttccacatcaccttcgtcaacaccgagtacaaccaccgccgcctgatccggtcccggggcccccaggccgtcgcgggcctcccgggcttccgcttcgccaccatccctgacggcctgccgcactcggacgccgacgccacgcaggaccccgccgcgatctgcgactccaccatgaagacctgcctcccgcacctcaagcgcctgctcgaccgcctcaaccacgacgccgccggcgatggcgagcaggtgccgccgccgccgccgccggtgacgtgcgtcgtggccgacaacgtcaccagcttctgcctggacgctgccaaggacatcggcgtgccttgcctgctcttctggacggccagcgcctgcggctacctgggctaccgccacttccagttcctcatggacgaaggccttgcgcctctcaaagacgaggcgcagctgacgaacgggtacctggacacgccggtggggtgggcgcgcgggatgagcaagcacatgcggctcagggacttcccgagcttcatctacacgatgcagcgcggcgacatcctgctggacttcatgatgcacgaggtgtcgcggacgaacgccgccgccgccgtcatcctcaacaccttcgacgagctcgagccagaggcgctggacgccatgcgcgccatcctgccgccgcccgtctacaccatcggcccgctcagtctcctcctcgagcggctggtggccaccgccgccgccgccgtccctgaacctggcgacgacgtcgtcgtcgtcgacgccgccgcgctcggcacggtccgcgccagcctctggaaggaagaccacacctgcctgcggtggctggacggcagggcggcccgccggtccgtggtgtacgtgaactacgggtgcgtcaccaccatgtcgaaccaggacctggtggagttcgcgtgggggctggcgagcagcggctacgacttcctgtggatcatccggccggacctggtgaagggcgagacggcggtgctgccgccggagttcgtggagtccaccaagggcaggtgcctcctggcgagctggtgcgagcaggaggcggtgctgcggcacgaggcggtgggggtgttcctgacgcacagcgggtggaactccatgacggagagcctcagcgcgggcgtgcccatgctgtgctggcccttcttcgcggagcagcagaccaaccgtcggtacgcgtgcaccgagtggggcgtggggatggaggtcgacggcgacgtgcggcgggaggctctggcggcaacgatacgggaggcaatggccggcgacaaggggaaggagatgaagcggagggcggacgagtggaaggaggccgccattcgggccacgcagcctggcggcacggcgttgaccaacctggacgacctaatcaagaatcacgtcctgctacctaagtgctga

SEQ ID NO: 357 - protein, 510 aa, Sorghum bicolor
  misc_feature (11)..(508): Pfam Name: UDPGT Pfam Description: UDP-glucoronosyl and UDP-glucosyl transfer
  misc_feature (1)..(510): Ceres Annot ID no. 8679871
  misc_feature (1)..(510): Bit score of 932.7 for HMM based on sequences of Figure 5
  misc_feature (1)..(510): Functional Homolog Of SEQ ID NO. 253
MAAGDNTKPHAVCVPFPAQGHVTPMMKLAKVLYCKGFHITFVNTEYNHRRLIRSRGPQAVAGLPGFRFATIPDGLPHSDADATQDPAAICDSTMKTCLPHLKRLLDRLNHDAAGDGEQVPPPPPPVTCVVADNVTSFCLDAAKDIGVPCLLFWTASACGYLGYRHFQFLMDEGLAPLKDEAQLTNGYLDTPVGWARGMSKHMRLRDFPSFIYTMQRGDILLDFMMHEVSRTNAAAAVILNTFDELEPEALDAMRAILPPPVYTIGPLSLLLERLVATAAAAVPEPGDDVVVVDAAALGTVRASLWKEDHTCLRWLDGRAARRSVVYVNYGCVTTMSNQDLVEFAWGLASSGYDFLWIIRPDLVKGETAVLPPEFVESTKGRCLLASWCEQEAVLRHEAVGVFLTHSGWNSMTESLSAGVPMLCWPFFAEQQTNRRYACTEWGVGMEVDGDVRREALAATIREAMAGDKGKEMKRRADEWKEAAIRATQPGGTALTNLDDLIKNHVLLPKC

SEQ ID NO: 358 - DNA, 1404 bp, Arabidopsis thaliana
  misc_feature (1)..(1404): Ceres Annot ID no. 833488
  misc_feature (1)..(1404): Encodes the peptide sequence at SEQ ID NO. 359
atgggatcccgttttgtttctaacgaacaaaaaccacacgtagtttgcgtgccttacccagctcaaggccacattaaccctatgatgaaagtggctaaactcctccacgtcaaaggcttccacgtcaccttcgtcaacaccgtctacaaccacaaccgtctactccgatcccgtggggccaacgcactcgatggacttccttccttccagttcgagtcaatacctgacggtcttccggagactggcgtggacgccacgcaggacatccctgccctttccgagtccacaacgaaaaactgtctcgttccgttcaagaagcttctccagcggattgtcacgagagaggatgtccctccggtgagctgtattgtatcagatggttcgatgagctttactcttgacgtagcggaagagcttggtgttccggagattcatttttggaccactagtgcttgtggcttcatggcttatctacacttttatctcttcatcgagaagggtttatgtccagtaaaagatgcgagttgcttgacgaaggaatacttggacacagttatagattggataccgtcaatgaacaatgtaaaactaaaagacattcctagttttatacgtaccactaatcctaacgacataatgctcaacttcgttgtccgtgaggcatgtcgaaccaaacgtgcctctgctatcattctgaacacgtttgatgaccttgaacatgacataatccagtctatgcaatccattttaccaccggtttatccaatcggaccgcttcatctcttagtaaacagggagattgaagaagatagtgagattggaaggatgggatcaaatctatggaaagaggagactgagtgcttgggatggcttaatactaagtctcgaaatagcgttgtttatgttaactttgggagcataacaataatgaccacggcacagcttttggagtttgcttggggtttggcggcaacgggaaaggagtttctatgggtgatgcggccggattcagtagccggagaggaggcagtgattccaaaagagtttttagcggagacagctgatcgaagaatgctgacaagttggtgtcctcaggagaaagttctttctcatccggcggtcggagggttcttgacccattgcgggtggaattcgacgttagaaagtctttcatgcggagttccaatggttggtattgagatcggtggagatgtcaagaggggagaggttgaggcggtggttagagagctcatggatggagagaaaggaaagaaaatgagagagaaggctgtagagtggcggcgcttggccgagaaagctacaaagcttccgtgtggttcgtcggtgataaattttgagacgattgtcaacaaggttctcttgggaaagatccctaacacgtaa

SEQ ID NO: 359 - protein, 467 aa, Arabidopsis thaliana
  misc_feature (13)..(463): Pfam Name: UDPGT Pfam Description: UDP-glucoronosyl and UDP-glucosyl transfer
  misc_feature (1)..(467): Ceres Annot ID no. 833488
  misc_feature (1)..(467): Bit score of 1051.4 for HMM based on sequences of Figure 5
  misc_feature (1)..(467): Functional Homolog Of SEQ ID NO. 253
MGSRFVSNEQKPHVVCVPYPAQGHINPMMKVAKLLHVKGFHVTFVNTVYNHNRLLRSRGANALDGLPSFQFESIPDGLPETGVDATQDIPALSESTTKNCLVPFKKLLQRIVTREDVPPVSCIVSDGSMSFTLDVAEELGVPEIHFWTTSACGFMAYLHFYLFIEKGLCPVKDASCLTKEYLDTVIDWIPSMNNVKLKDIPSFIRTTNPNDIMLNFVVREACRTKRASAIILNTFDDLEHDIIQSMQSILPPVYPIGPLHLLVNREIEEDSEIGRMGSNLWKEETECLGWLNTKSRNSVVYVNFGSITIMTTAQLLEFAWGLAATGKEFLWVMRPDSVAGEEAVIPKEFLAETADRRMLTSWCPQEKVLSHPAVGGFLTHCGWNSTLESLSCGVPMVGIEIGGDVKRGEVEAVVRELMDGEKGKKMREKAVEWRRLAEKATKLPCGSSVINFETIVNKVLLGKIPNT

SEQ ID NO: 360 - DNA, 1770 bp, Panicum virgatum
  misc_feature (1)..(1770): Ceres Clone ID no. 1769061
  misc_feature (1)..(1770): Encodes the peptide sequence at SEQ ID NO. 361
aaagttagcccgggagcatctttcaatggcgtaggcgctcttgtctgcagtctgccgtctgcacctgaacggccatttcctcctcggtttcattatccgcatctttcgatttttatatcctggggagtggggaagatcagacccgatccgatctctatcgaggccaactttgtcttcgagcgtgcaagatcctttgcggccatggcgaggccgcacgtcatggttgtgccgtacccgggcgccggcaacatcaacccggcgctgcaggtcgccaagctgctgcaccgccacggcgtctacgtcaccttcgtcaacaccgagcacaaccaccggcgcgtgcaggccacggagggcgccggcgccgtgcggggccgcgaggggttccgcttcgaggccatcccggacgggctctccgaggccgaccgcggcaagcaggactacggccgcggcctcgccgtgtccacgagcacgcgctgcgcggcgccgctcagggacctcatcgcgctgctcaacgccacacccggcgtgccgccggtcacctgcgtgctgcccacgatgctgatgagcttcgcgctgggcgtggcgcgggagctcgggatcccgaccatggcgttctggaccggcagcgccgccgcgctcatgacgcacatgaggctccgggagctcgaggagcgaggatacgtgccactcaaggatgagagctacttgaccaacggctacctcgagaagacggtcatcgactggatccccggcatgccgccgatccgcctcggcgacttctccagcttcctccgcaccaccgacccgaacgacttcggcctccgcttcaacgagtcggaggccaacaaatgcgccaaggccggcgctctcatcctcaacaccttcgacggcctcgaggccgacgtcctcgccgctctccgagccgagtacccgcgcatctacaccgtcggccctctgggctccctcctccgacagaacctcgacagcgccgccgccgccgacgactcgaccggcctaagcctgtggaagcaggacgccgagtgcctggcgtggctggacgcgcaggagcagcagcgctccgtcgtctacgtcaacttcggcagccacacggtgctgacgccggagcagctggccgagttcgcctggggcctcgcggcgagcggccacctgatcctatggtgcatcagggacaacctcgtccgcggcggcggcggcggcccggccgtgctgcccccggacttctgggctgcagcggcggggaggtgccacgtgacggcgtggtgcccgcaggagcaggtgctgcgccacccggccgtgggctgcttcctgacgcacagcgggtggaactcgacgtgcgagggcgtggccgccggcgtgccgatggtgtgctggccggggttctcggaccagtacaccaactgcaagtacgcctgcgaggtgtggggcgtcggcgtccggctggacccggaggtgtggagggagcaggtcgccgcgcacgtcagggaggccatggagagcgaggagatgaggaggagggcggccaagtggaaggaggaggcggagacggccaccagccccggcggctcgtcgtttgagaacctgctgaccatggtgagagcgctcagcggcacacacgagagctgaaggatcagttgttggacttggactgatacacaatgcaaaagtgtctgtttagttagcgtcaataaaaaaaagtattggattttcagcaattttaatcgccttaaataaaattggcttgtttctgtc

SEQ ID NO: 361 - protein, 480 aa, Panicum virgatum
  misc_feature (4)..(478): Pfam Name: UDPGT Pfam Description: UDP-glucoronosyl and UDP-glucosyl transfer
  misc_feature (1)..(480): Ceres Clone ID no. 1769061
  misc_feature (1)..(480): Bit score of 748.4 for HMM based on sequences of Figure 5
  misc_feature (1)..(480): Functional Homolog Of SEQ ID NO. 253
MARPHVMVVPYPGAGNINPALQVAKLLHRHGVYVTFVNTEHNHRRVQATEGAGAVRGREGFRFEAIPDGLSEADRGKQDYGRGLAVSTSTRCAAPLRDLIALLNATPGVPPVTCVLPTMLMSFALGVARELGIPTMAFWTGSAAALMTHMRLRELEERGYVPLKDESYLTNGYLEKTVIDWIPGMPPIRLGDFSSFLRTTDPNDFGLRFNESEANKCAKAGALILNTFDGLEADVLAALRAEYPRIYTVGPLGSLLRQNLDSAAAADDSTGLSLWKQDAECLAWLDAQEQQRSVVYVNFGSHTVLTPEQLAEFAWGLAASGHLILWCIRDNLVRGGGGGPAVLPPDFWAAAAGRCHVTAWCPQEQVLRHPAVGCFLTHSGWNSTCEGVAAGVPMVCWPGFSDQYTNCKYACEVWGVGVRLDPEVWREQVAAHVREAMESEEMRRRAAKWKEEAETATSPGGSSFENLLTMVRALSGTHES

SEQ ID NO: 362 - protein, 484 aa, Zea mays
  misc_feature (11)..(480): Pfam Name: UDPGT Pfam Description: UDP-glucoronosyl and UDP-glucosyl transfer
  misc_feature (1)..(484): Bit score of 1186.0 for HMM based on sequences of Figure 5
  misc_feature (1)..(484): Functional Homolog Of SEQ ID NO. 253
MSSGKAQRRPHAVLIPQPAQGHVTPMLHLAKALHARGFRVTYVNSEYNHRRLLRSRGQDSLAGTDGFHFEAVPDGLPQSDNDDVTQDIAALCLSTTAHSAAPFRDLLERLNAMPGSPPVSCVIADGVMSFAQRVAEEMGILALVFWTTSACGFMGYLHFAELIRRGYVPLKDESDLTNGYLDTAIDWIPGMPDIRLKDIPSFIRTTDRDDVMLNFDGGEAQNARRARGVILNTYDALEQDVVDALRREFPRVYTVGPLAAFANAAAGGELDAIGGNLWKEDTSCLRWLDTQRPGSVVYVNFGSITVMTAAQLAEFAWGLAGCGRPFLWVVRPDLVSGETAMLPEGFVTDTKGRGILASWCPQELVLSHPSVGLFLTHCGWNSTLESVCAGVPMLCWPFFAEQPTNCRYVCDKWGIGMEIDNDVRREEVARLVREAIDGEGGKAMRVKSIVWKEKARQAVEDGGSSRKNLDRLVDFLLAGKDVPC

SEQ ID NO: 363 - protein, 482 aa, Oryza sativa
  misc_feature (10)..(478): Pfam Name: UDPGT Pfam Description: UDP-glucoronosyl and UDP-glucosyl transfer
  misc_feature (1)..(482): Bit score of 1183.7 for HMM based on sequences of Figure 5
  misc_feature (1)..(482): Functional Homolog Of SEQ ID NO. 253
MSSCEARRAHAVLIPQPAQGHVTPMLHLAKALHARGFFVTYVNSEYNHRRLLRSSGPGALAGAAGFRFEAVPDGMPESGNDDVTQDIAALCVSTTRHSAEPFRELLVRLNSTPGTPPVSCVIADGVMSFAQRVAEEMGILALVFWTTSACGFMGYLHFAELIRRGYVPLKDESDLTNGYLDTPIDWIPGMRGIRLKDVPSFIRTTDPDDVMLNFDGGEAQNARKARGLILNTYDALEQDVVDALRREFPRVYTVGPLPAFAKAAAGEVGAIGGNLWKEDTGCLRWLDAQQPGSVVYVNFGSITVMSPAHLAEFAWGLACCGRPFLWVIRPDPVSGEKAMLPEEFVGETKERGVLASWCPQELVLSHPSVGLFLTHCGWNSTLESICAGVPMICWPFFAEQPTNCRYVCDKWGVGMEIDSNVSRTEVARLVREAMEGERGKAMRVNAMVWKEKAKEATEEGGSSSRNLDRLIEFLHSSGSDAR

SEQ ID NO: 364 - protein, 482 aa, Oryza sativa
  misc_feature (10)..(478): Pfam Name: UDPGT Pfam Description: UDP-glucoronosyl and UDP-glucosyl transfer
  misc_feature (1)..(482): Bit score of 1187.5 for HMM based on sequences of Figure 5
  misc_feature (1)..(482): Functional Homolog Of SEQ ID NO. 253
MSSCEARRAHAVLIPQPAQGHVTPMLHLAKALHARGFFVTYVNSEYNHRRLLRSSGPGALAGAAGFRFEAVPDGMPESGNDDVTQDIAALCVSTTRHSAEPFRELLVRLNSTPGTPPVSCVIADGVMSFVQRVAEEMGILALVFWTTSACGFMGYLHFAELIRRGYVPLKDESDLTNGYLDTPIDWIPGMRGIRLKDVPSFIRTTDPDDVMLNFDGGEAQNARKARGLILNTYDALEQDVVDALRREFPRVYTVGPLPAFAKAAAGEVGAIGGNLWKEDTGCLRWLDAQQPGSVVYVNFGSITVMSPAHLAEFAWGLACCGRPFLWVIRPDLVSGEKAMLPEEFVGETKERGVLASWCPQELVLSHPSVGLFLTHCGWNSTLESICAGVPMICWPFFAEQPTNCRYVCDKWGVGMEIDSNVSRTEVARLVREAMEGERGKAMRVNAMVWKEKAKEATEEGGSSSRNLDRLIEFLHSSGSDAR

SEQ ID NO: 365 - protein, 581 aa, Oryza sativa
  misc_feature (109)..(577): Pfam Name: UDPGT Pfam Description: UDP-glucoronosyl and UDP-glucosyl transfer
  misc_feature (1)..(581): Bit score of 1187.2 for HMM based on sequences of Figure 5
  misc_feature (1)..(581): Functional Homolog Of SEQ ID NO. 253
MEFPGNPWYSPDRVIYLRPLSAFTLTSLVKKPNSKTPAVNLLHASRHHYAGIRAVRHCSVYTALSQDQICTNPPDSNTFGLTAAPSVRPSARRRRRHTAMSSCEARRAHAVLIPQPAQGHVTPMLHLAKALHARGFFVTYINSEYNHRRLLRSSGPGALAGAAGFRFEAVPDGMPESGNDDVTQDIAALCVSTTRHSAEPFRELLVRLNSTPGTPPVSCVIADGVMSFAQRVAEEMGILALVFWTTSACGFMGYLHFAELIRRGYVPLKDESDLTNGYLDTPIDWIPGMRGIRLKDVPSFIRTTDPDDVMLNFDGGEAQNARKARGLILNTYDALEQDVVDALRREFPRVYTVGPLPAFAKAAAGEVGAIGGNLWKEDTGCLRWLDAQQPGSVVYVNFGSITVMSPAHLAEFAWGLACCGRPFLWVIRPDLVSGEKAMLPEEFVGETKERGVLASWCPQELVLSHPSVGLFLTHCGWNSTLESICAGVPMICWPFFAEQPTNCRYVCDKWGVGMEIDSNVSRTEVARLVREAMEGERGKAMRVNAMVWKEKAKEATEEGGSSSRNLDRLIEFLHSSGSDAR

SEQ ID NO: 366 - protein, 491 aa, Zea mays
  misc_feature (16)..(485): Pfam Name: UDPGT Pfam Description: UDP-glucoronosyl and UDP-glucosyl transfer
  misc_feature (1)..(491): Bit score of 1083.4 for HMM based on sequences of Figure 5
  misc_feature (1)..(491): Functional Homolog Of SEQ ID NO. 253
  misc_feature (54)..(54): Xaa is any aa, unknown, or other
MQGKTSMMGSNARPHAVLIPYPAQGHVTPLLQLAKVLHSRGFFVTYVNSEYNHXRLLRSRGADSLAGLDDFRFETIPDGLPPSGSDDDVTQDIPALCESLSRSGAAPFRDLLARLNGMPGRPPVTCVVLDNFMSFAQRVASEMGILAVVFCTMSACGFMGYLHFKELMDRGYVPLKDESYLTNGYLDTVLDWVPGMRGIRLRDMPSFIRTTDPDEFMVHFDSGEAQNARRAQGIIVNTFDALEQDVVGALRGVFPRVYTIGPLLTFARAMARPDASAICGNLWKEDLSCLGWLDAQGPGSVVYVNFGSITVMTPAQLAEFAWGLANCGRPFLWVIRPDLVTGEKAMLPEEFYAETRERGLFLSWCPQEQVLSHPSTGLFLTHSGWNSTLESIRAGVPMICWPFFAEQTTNCRYACANWGIGLEIDNNVTRDEVARLIEEAMDGEKGKDMKAKATVWKEKAVAATESGGTSSVSIDRLVEFLLEGNVPTAAG

SEQ ID NO: 367 - DNA, 1677 bp, Panicum virgatum
  misc_feature (1)..(1677): Ceres Clone ID no. 1790897
  misc_feature (1)..(1677): Encodes the peptide sequence at SEQ ID NO. 368
atgttaatccttgattgattcctcgcatagccgccggccccgcaccgccgagcccagtttcataaacaatcgaccagcggtgagattggatcgagaaacacgttctccattgggtgggtgctcgaggctcaagccgatggggcggaccggcggcggactggtggcggtggtggtcggtgctcgtcgtcgtgtactaggtcgtaaaaaaaaaagctcgtcgggattcgcggtccacatggcggcttctgctcgcgttcggcgccatttccgcgagcacccgctccgctccgccaataaatccttgcccctcgtcggcgaaattcctcgacggatcgatcttgatttctcgccgccgtccccgcatctctgccaccaccttcctgtttgggaggactccaggccgcgctcccatggccgtcacggtgtgcgtcaccggcgccggcggcttcatcgggtcgtggatcgtcaagctcctcctcgaccgcgggtacgccgtccggggcacctcccgccgcgcagatgaccccaagaacgcgcacctctgggcgctcgacggcgcggcggagggcctcacgatgctgcaggtggacctgctcgacagggccagcctccgcgccgccttcgacggctgcgacggcgtcatccacaccgcctcgccgatgcacgacatccccgaggagatcatcgacccaattatcgccgggacgcggaacgtcgtcgaggccgcggccgacgccggcgtgcggcgcctggtgttctcctccaccatcggcaccatgtacatgaacccgcaccgcgaccccgacgatcccctggacgagtggagctggagcgacctcgagtactgcaagaggaccgcgcactggtactgctacgcgaagacgatcgcggagcagagcgcgtggcaggcggcgcgggcgcgggagctggacctggcggtggtcatcccggtggtggtgctcggcgagctgatgcagccaagcatgaacaccagcaccctgcacatactcaagtacctcaccggcgaggccaagaattacgtcaacgagtcgcaggcgtacgtgcacgtcaaggacgctgcagaggcgcacgtcagggtgctcgaggcgcccggcgccggcgggcatcgctacgtctgcgccgagcggactctgcaccgcggcgagctgtgccgaatgctcgctgaactcttcccggagtaccctgttccgacgaggtgcaaggatgaggtgaatccaccaaagaagggctacaagtttacaaaccagcctctgaaggacctaggcatcaggttcacacctgcgcatgagtacctctatgaagcagtaaaatccctgcaacaaaagggttttctccccaaggccaaagcttctgtcacagaggtgactgaaagtcgcagttccccgcctcaaaagttgcaactggggatgttgatttcaaatctttgacagatttgcacacgaagtgaccatgtaacacgccgacgtgttaatttgatttcaaacctcagaataagtgtagtgcagtggttaatttgattggttaaatttttggtggcctgctcttatagggtcataggactgtgcaacttaattttgtacgctatactactctctgccatgcatcaaatcattcctcaaatttactttttttttacaataaaatgccaggagttat

SEQ ID NO: 368 - protein, 345 aa, Panicum virgatum
  misc_feature (5)..(244): Pfam Name: Epimerase Pfam Description: NAD dependent epimerase/dehydratase fam
  misc_feature (1)..(345): Ceres SEED LINE ID no. CW00778
  misc_feature (1)..(345): Ceres SEED LINE ID no. CW00776
  misc_feature (1)..(345): Ceres Clone ID no. 1790897
  misc_feature (1)..(345): Bit score of 802.7 for HMM based on sequences of Figure 16
  misc_feature (1)..(345): in Figure 16
MAVTVCVTGAGGFIGSWIVKLLLDRGYAVRGTSRRADDPKNAHLWALDGAAEGLTMLQVDLLDRASLRAAFDGCDGVIHTASPMHDIPEEIIDPIIAGTRNVVEAAADAGVRRLVFSSTIGTMYMNPHRDPDDPLDEWSWSDLEYCKRTAHWYCYAKTIAEQSAWQAARARELDLAVVIPVVVLGELMQPSMNTSTLHILKYLTGEAKNYVNESQAYVHVKDAAEAHVRVLEAPGAGGHRYVCAERTLHRGELCRMLAELFPEYPVPTRCKDEVNPPKKGYKFTNQPLKDLGIRFTPAHEYLYEAVKSLQQKGFLPKAKASVTEVTESRSSPPQKLQLGMLISNL

SEQ ID NO: 369 - DNA, 1329 bp, Zea mays
  misc_feature (1)..(1329): Ceres Clone ID no. 1583304
  misc_feature (1)..(1329): Encodes the peptide sequence at SEQ ID NO. 370
gattccgcggataaatgcttgcccctatttgctcagcccgctctcggacgaacccattcacccgtccggccgtccgtgcgcggcgcacccacccggcaccggcaccagcaccaccgcccgcccggcgcccgtcacgctcgagaggaggaggaagaagaagggactgggcgacagcgcgcgatggccgccgtcgtgtgcgtcaccggcgccggcggcttcatcggctcgtggatcgtcaagatcctcctcgcccgcgggtacgccgtccggggcacctcccgccgcgaagctgctgaccccaagaacgcgcacctgtgggcgctcgacggcgcggcggagcgcctcaccatgctgcaggtggacctgctcgaccgcgccagcctccgcgccgccttccgcggctgcgacggcgtcatccacaccgcctcgccgatgcacgacaaccccgaggagatcatcgagccgattatcgccgggacgcggaacgtcgtggaggcggcggcggacgccggcgtgcggcgcctggtgctgtcctccaccatcggcaccatgtacatggacccgcgccgcgaccccgacgccccgctcggcgactccagctggagcgacctcgagtactgcaagagcaccgagaactggtactgctacgcaaagacggtggcggagcagggcgcgtgggaggcggcgcgggcgcgggggctggacctggcggtggtcatcccggtggtggtgctcggcgagctgctgcagcccagcatgaacaccagcaccctgcacatcctcaagtacctcacgggacagacaaaggagtacgtcaacgagtcgcacgcctacgtgcacgtcagggacgccgccgaggcgcacgtaagggtgctggaggcgcccggcgccggcggccggcggtacgtctgcgccgagcgcaccctgcaccgcggcgagctctgccgcatcctcgccggactcttcccggagtaccctattccgacaaggtgcaaggatcaggtgaacccaccgaagaagggctacaagtttacgaaccaacctctgaaggaccttggcgtcaagttcactccagtgcatgggtacctgtacgaagcagtgaagtccctgcaagacaagggcttcctcccgaagacctctggcgccaagcaggtgcctgaacgacgcagctacctgcctcaaacgacatcacagccaccacccgaaatcgtttcgaaactttgaggtggatctgcacacgtgctcaaactggccatgtttttttttgtcagaacaagccgttcatttgattggttattaaaagattttgggcagtctgttcttacatag

SEQ ID NO: 370 - protein, 347 aa, Zea mays
  misc_feature (5)..(245): Pfam Name: Epimerase Pfam Description: NAD dependent epimerase/dehydratase f
  misc_feature (1)..(347): Ceres Clone ID no. 1583304
  misc_feature (1)..(347): Bit score of 797.3 for HMM based on sequences of Figure 16
  misc_feature (1)..(347): Functional Homolog Of SEQ ID NO. 368
  misc_feature (1)..(347): in Figure 16
MAAVVCVTGAGGFIGSWIVKILLARGYAVRGTSRREAADPKNAHLWALDGAAERLTMLQVDLLDRASLRAAFRGCDGVIHTASPMHDNPEEIIEPIIAGTRNVVEAAADAGVRRLVLSSTIGTMYMDPRRDPDAPLGDSSWSDLEYCKSTENWYCYAKTVAEQGAWEAARARGLDLAVVIPVVVLGELLQPSMNTSTLHILKYLTGQTKEYVNESHAYVHVRDAAEAHVRVLEAPGAGGRRYVCAERTLHRGELCRILAGLFPEYPIPTRCKDQVNPPKKGYKFTNQPLKDLGVKFTPVHGYLYEAVKSLQDKGFLPKTSGAKQVPERRSYLPQTTSQPPPEIVSKL

SEQ ID NO: 371 - DNA, 1545 bp, Triticum aestivum
  misc_feature (1)..(1545): Ceres Clone ID no. 703342
  misc_feature (1)..(1545): Encodes the peptide sequence at SEQ ID NO. 372
acacgttgctcgctgctcggagagaggttcacacggctgcggttgtctcgtcgccgtcttggtctccccgtcccggtccgcgcgtcgcggttctcacatgaccaccgggccgcgctagttttcacggcgtggccatggccgtcgtcgtctgcgtcaccggcgccggcggcttcatcggctcctggatcgtcaagctcctcctcgcccgcggctacgccgtccgcggcacctcccgccgcgccgatgaccccaagaacgcgcacctgtgggcgctcgacggcgcggcggagcggctgacgatggtgcaggtcgacctgctcgaccgggccagcctccgcgccgccttccacggctgcgacggcgttatccacaccgcatcaccgatgcacgacacccccgaggagatcatcgagccggtgatcaccgggacgctcaacgtggtggagatggccgcggacgccggcgtccggcgcgtggtgctgtcctccaccatcggcaccatgtacatgaacccccaccgcgacccggacgcgccgctcgacgagtcgtgctggagcgacctcgactactgcaaacaaaccaagaactggtactgctacgccaagacgatcgcggagcggggcgcgtgggaggcggcgcgggcgctggggctggacctggcggtggtgatcccggtggtgacgctgggcgagctgctgcagccgagcatgaacaccagcaccaggcacatactcaagtacctcaccggcgaggccaaggcgtacgtcaacgagtcgcacgcctacgtgcatgtcaaggacgccgccgaggcgcacgtcagggtgctcgaggcgcccaacgccgggggacggcgctacgtctgcgccgagaggacgctgcaccgcggcgagctctgccggatcctcgccgggctcttcccggagtacccgattcccacaagatgtaaggacgaggtaaatccgccaaagaagggttacaagtacaccaaccagcctctgaaggaccttggcatgaagttcacccctgtgcaagaatacctctatgaagcggtgaaatccctgcaagagaagggattcattcagaaggcttctggcaacaaggggcttgctagtagagggagttcgccgcctcaaaattcaacggcgcccgtgtttatgtcgaaactttgatgggcttctgcacaaagtaacaatgcagttcgccgtcatgtgaattgtaattcatttgattaagtgatatgttgctggacagttcttgtatgtggcaaactgccaactttgtgtagtagcgccgtgttgcctggaacagtacaccgctacagagcaacttcagtgatgcatgccaaatattttccctggtcgatgttcttctaccaccacctagttgttcaccttgtctgactcagcgggtacaaaaacccgatcaagttggcacttggcagcagagcatacaagcgtgccctctttggagtctcgttcggagagtgatgctgttttggccaacttctgcttgttgttggtcgtgatcttgtttatgcgctttctc

SEQ ID NO: 372 - protein, 344 aa, Triticum aestivum
  misc_feature (5)..(244): Pfam Name: Epimerase Pfam Description: NAD dependent epimerase/dehydratase f
  misc_feature (1)..(344): Ceres Clone ID no. 703342
  misc_feature (1)..(344): Bit score of 809.1 for HMM based on sequences of Figure 16
  misc_feature (1)..(344): Functional Homolog Of SEQ ID NO. 368
  misc_feature (1)..(344): in Figure 16
MAVVVCVTGAGGFIGSWIVKLLLARGYAVRGTSRRADDPKNAHLWALDGAAERLTMVQVDLLDRASLRAAFHGCDGVIHTASPMHDTPEEIIEPVITGTLNVVEMAADAGVRRVVLSSTIGTMYMNPHRDPDAPLDESCWSDLDYCKQTKNWYCYAKTIAERGAWEAARALGLDLAVVIPVVTLGELLQPSMNTSTRHILKYLTGEAKAYVNESHAYVHVKDAAEAHVRVLEAPNAGGRRYVCAERTLHRGELCRILAGLFPEYPIPTRCKDEVNPPKKGYKYTNQPLKDLGMKFTPVQEYLYEAVKSLQEKGFIQKASGNKGLASRGSSPPQNSTAPVFMSKL

SEQ ID NO: 373 - protein, 344 aa, Oryza sativa subsp. japonica
  misc_feature (6)..(245): Pfam Name: Epimerase Pfam Description: NAD dependent epimerase/dehydratase f
  misc_feature (1)..(344): Public GI ID no. 115444625
  misc_feature (1)..(344): Bit score of 808.4 for HMM based on sequences of Figure 16
  misc_feature (1)..(344): Functional Homolog Of SEQ ID NO. 368
  misc_feature (1)..(344): in Figure 16
MAAAVVCVTGAGGFIGSWIVKLLLARGYAVRGTSRRADDPKNAHLWALDGAAERLTMVSVDLLDRGSLRAAFAGCHGVIHTASPMHDDPEEIIEPVITGTLNVVEVAADAGVRRVVLSSTIGTMYMDPRRDPDSPLDDSFWSDLDYCKNTKNWYCYAKTIAERKAWEVARGRGVDMAVVIPVVVLGELLQPGMNTSTKHILKYLTGEAKTYVNESHAYVHVVDAAEAHVRVLEAPGAGGRRYICAERTLHRGELCRILAGLFPEYPIPTRCRDEINPPKKGYKFTNQPLKDLGIKFTPVHEYLYEAVKSLEDKGFIKKTSNTKELHRQSSPPQNSPASMLMSKL

SEQ ID NO: 374 - DNA, 1029 bp, Populus balsamifera subsp. trichocarpa
  misc_feature (1)..(1029): Ceres Annot ID no. 1490808
  misc_feature (1)..(1029): Encodes the peptide sequence at SEQ ID NO. 375
atgcctgtcgatacttcatcacttccatgccaaggccaaactgtctgtgtcaccggggctggtggcttcattgcttcatggattgttaaacttcttctagagaaaggttactctgttaaaggaactgtgagaaacccagctgatcccaagaattcccatttgagggagcttgaaggagctcaagaaagattaactttatgcaaggctgatctccttgattatgagtctcttaaagaggctattcaagggtgtgatggagttttccatactgcttctcctgtcacagacgatccagagcaaatgctggagccagcagtgaatggaaccaagaatgtgatcatggcagcagctgaggccaaagtccgacgagtggttttcacgtcttcaattgggactgtgtacatggaccccaataggagccctgatgttgtcgttgatgaatcttgctggagtgatcttgagttctgcaagaacaccaagaattggtattgctatggaaagactgtggcggaacaggatgcatgggatgtggctaagaagaatggagttgacctagtggtggtgaacccagtgctggtgcttggaccattgttgcaacccactgtcaatgctagcatcgttcacatcctcaagtacctaaccggctcagccaagacatatgctaactctgttcaagcttatgtgcatgttaaggatgtggcactagcccacattttagtcttcgagacaccttccgcctccggccgttacatttgcgctgagagaatgctccaccgtggagaggtggtggaaatccttgcaaagttcttcccggagtatcccatccccaccaagtgttcagatgagaagaatccaagaaaacaaccctacaagttcacaaaccagaagatcaaggatctgggcatcgaattcaccccagtgaaacagtgcctgtatgaatctgttaagagcttgcaggaaaagggtcaccttccaatcccaaaacaagctgaagactctgtgaaaattcaacaagggctcatttattag

SEQ ID NO: 375 - protein, 342 aa, Populus balsamifera subsp. trichocarpa
  misc_feature (15)..(253): Pfam Name: Epimerase Pfam Description: NAD dependent epimerase/dehydratase fam
  misc_feature (1)..(342): Ceres Annot ID no. 1490808
  misc_feature (1)..(342): Bit score of 829.7 for HMM based on sequences of Figure 16
  misc_feature (1)..(342): Functional Homolog Of SEQ ID NO. 368
  misc_feature (1)..(342): in Figure 16
MPVDTSSLPCQGQTVCVTGAGGFIASWIVKLLLEKGYSVKGTVRNPADPKNSHLRELEGAQERLTLCKADLLDYESLKEAIQGCDGVFHTASPVTDDPEQMLEPAVNGTKNVIMAAAEAKVRRVVFTSSIGTVYMDPNRSPDVVVDESCWSDLEFCKNTKNWYCYGKTVAEQDAWDVAKKNGVDLVVVNPVLVLGPLLQPTVNASIVHILKYLTGSAKTYANSVQAYVHVKDVALAHILVFETPSASGRYICAERMLHRGEVVEILAKFFPEYPIPTKCSDEKNPRKQPYKFTNQKIKDLGIEFTPVKQCLYESVKSLQEKGHLPIPKQAEDSVKIQQGLIY

SEQ ID NO: 376 - protein, 341 aa, Linum album
  misc_feature (15)..(253): Pfam Name: Epimerase Pfam Description: NAD dependent epimerase/dehydratase fam
  misc_feature (1)..(341): Public GI ID no. 57282092
  misc_feature (1)..(341): Bit score of 819.1 for HMM based on sequences of Figure 16
  misc_feature (1)..(341): Functional Homolog Of SEQ ID NO. 368
  misc_feature (1)..(341): in Figure 16
MPADSSSLPGHGQTVCVTGAGGFIASWIVKLLLDRGYSVKGTVRNPDDPKNAHLRALEGADERLTLCKADLLDYQSLREAISGCQGVFHTASPVTDDPEQMVEPAVEGTKNVINAAAEAKVRRVVFTSSIGAVYMDPNRSPDTVVDESCWSDLEFCKNTKNWYCYGKTVAEQAAWEMAKEKEVDVVVVNPVLVLGPLLQSTINASIIHILKYLTGSAKTYANSVQAYIHVKDVALSHILVFENPSAAGRYLCAESVLHRGEVVEILAKLFPDYPVPTKCSDEKNPRAKAYKFSCQKLKDLGLEFTPAKQCLYETVTSLQEKGHLALPASKQQEEPIKIQSS

SEQ ID NO: 377 - protein, 336 aa, Leucaena leucocephala
  misc_feature (22)..(260): Pfam Name: Epimerase Pfam Description: NAD dependent epimerase/dehydratase fam
  misc_feature (1)..(336): Public GI ID no. 115501961
  misc_feature (1)..(336): Bit score of 791.7 for HMM based on sequences of Figure 16
  misc_feature (1)..(336): Functional Homolog Of SEQ ID NO. 368
  misc_feature (1)..(336): in Figure 16
MPAAAPAPTAANTTSSGSGQTVCVTGAGGFIASWIVKLLLERGYTVRGTVRNPDDSKNSHLKELEGAEERLTLHKVDLLDLESVKAVINGCDGIIHTASPVTDNPEEMVEPAVNGAKNVIIAAAEAKVRRVVFTSSIGAVYMDPSRNIDEVVDESCWSNLEYCKNTKNWYCYGKAVAEQAAWDEAKARGVDLVVVNPVLVLGPLLQSTMNASTIHILKYLTGSAKTYANATQAYVHVKDVALAHVLVYEIPSASGRYLCSESSLHRGELVEILAKYFPEYPIPTKCSDEKNPRAKAYTFSNKRLKDLGLEFTPVHQCLYDTVKSLQDKGHLPLPTK

SEQ ID NO: 378 - protein, 332 aa, Solanum tuberosum
  misc_feature (9)..(247): Pfam Name: Epimerase Pfam Description: NAD dependent epimerase/dehydratase f
  misc_feature (1)..(332): Public GI ID no. 25140434
  misc_feature (1)..(332): Bit score of 813.6 for HMM based on sequences of Figure 16
  misc_feature (1)..(332): Functional Homolog Of SEQ ID NO. 368
  misc_feature (1)..(332): in Figure 16
MPSESGKVVCVTGAGGFIASWLVKLLLEKGYTVRGTVRNPDDPKNGHLKELEGAKERLILLRADLLDYQSLREAIYGCDGVFHTASPVTDDPEQMVEPAVIGTKNVITAAAEAKVGRVVFTSSIGTVYMDPNRAPDKVVDETCWSDLGFCKNTKNWYCYGKTVAEKTAWDEAREKGVDLVVINPVLVLGPLLQPTVNASVLHILKYLTGSAKTYANSIQAYVHVKDVALAHILLYEAPSASGRYICAESVLHRGDVVEILAKFFPEYPIPTKCSDETRPRAKPYKFTNQKLKDLGLGFTPVKQCLYETVKSLQEKGHLPIPTQNDEPIKIHS

SEQ ID NO: 379 - DNA, 1318 bp, Gossypium hirsutum
  misc_feature (1)..(1318): Ceres Clone ID no. 1895447
  misc_feature (1)..(1318): Encodes the peptide sequence at SEQ ID NO. 380
aaaacaaagcatcaaaaccccagaagacaagagtttcacctcaacaaaacacctacagagcaaatatgccaattgagagctcttccactaatgccccaaccgtctgtgtcaccggtgccggtggcttcatcgcctcctggattgtcaagcttcttcttgaaaaaggttacactgtcaagggcactgtaaggaacccagacgatcccaagaattgtcatttgagagagcttgaaggagcaaaggagaggctatctcttcacaaagctgaccttcttgattaccagtctcttaaggaagccattagcggttgcgatggagttttccatactgcttcacctgtgactgatgatcctgaacaaatggtggagccggccgtgattgggactaagaatgtgataatggcagcggcagaggccaaagttcgacgtgtggtgttcacatcttccataggtgccgtgtacatggaccccaacaggagccctgatgtggtggtcgatgagtcttgctggagcgacctcgagttttgcaaaaataccaagaattggtattgttatgggaaggcagtggcagaacaagcagcctgggaaacagccaaggaaaaaggggtggaccttgtggcgataaccccagttttggtgctgggtccattgctgcaaccaactgtgaatgccagcattgttcacatcctcaagtacttaaccggctcggcaaagacctatgccaattcagttcaagcctatgttcacgtcagagatgtcgcattagcacaccttctcgtgtatgagaatccctctgcctccggccgctacctctgcgctgagagcgtcctccaccgtggtgaagtggtggagattttagccaagttcttccccgagtatcccatccctaccaagtgctcagatgagaagaacccaagagcaaaaccctacaagttcacgaaccagaagctgagggatttggggttggagttcaccccggtgaagcagtgcctatacgagacggtgaaaagcttgcaagagaaaggtcacctgcctataccagcgcaacaccaggaagattctggccttcgtattcaatcttaagccttattctcatacacttaatactcctgcttagcttacctactattaagggaaccgagacatgcaccctggatggctagcattactgaatgccaatgtgttgtgtgcccattttgtgttgtcgtatctaattaatagcaaaaatagcttattggacccaataatctgttgaacttttccatcttctaattaatcaattatttaaaatgaaatgtgtggaaaatattatattttcg

SEQ ID NO: 380 - protein, 338 aa, Gossypium hirsutum
  misc_feature (13)..(251): Pfam Name: Epimerase Pfam Description: NAD dependent epimerase/dehydratase fam
  misc_feature (1)..(338): Ceres Clone ID no. 1895447
  misc_feature (1)..(338): Bit score of 822.5 for HMM based on sequences of Figure 16
  misc_feature (1)..(338): Functional Homolog Of SEQ ID NO. 368
  misc_feature (1)..(338): in Figure 16
MPIESSSTNAPTVCVTGAGGFIASWIVKLLLEKGYTVKGTVRNPDDPKNCHLRELEGAKERLSLHKADLLDYQSLKEAISGCDGVFHTASPVTDDPEQMVEPAVIGTKNVIMAAAEAKVRRVVFTSSIGAVYMDPNRSPDVVVDESCWSDLEFCKNTKNWYCYGKAVAEQAAWETAKEKGVDLVAITPVLVLGPLLQPTVNASIVHILKYLTGSAKTYANSVQAYVHVRDVALAHLLVYENPSASGRYLCAESVLHRGEVVEILAKFFPEYPIPTKCSDEKNPRAKPYKFTNQKLRDLGLEFTPVKQCLYETVKSLQEKGHLPIPAQHQEDSGLRIQS

SEQ ID NO: 381 - DNA, 1543 bp, Panicum virgatum
  misc_feature (1)..(1543): Ceres Clone ID no. 2023103
  misc_feature (1)..(1543): Encodes the peptide sequence at SEQ ID NO. 382
gcatacatatcccagcactgtaatcgcctttctcttctagagcatacctggagaacagtttttcaccaagagtacctgtctcaggctaactggtaggcaccatttcacatcacacaaacacacaccttccttttgacttggaggccgggatactacaccatgccgattgagacgcccatgccggccctctccggccacggcctgacggtctgcgtgaccggcgccggaggattcatcgcctcctggctcgtcaagcgcctcctggagaagggctacactgtccgcggcacggtccggaaccctgttgatcccaagaacgaccacctgagggcgcttgaaggtgccgccgaccgccttactctcgtccgcgccgacttgctggatcccgacagccttctcgcggccttctccggctgcgagggtgtcttccatactgcctccccggtcaccgatgatcccgagaagatgatcgagccggcgatccgcggcacaaggcacgtgatgacggtggccgcggacaccggcgtgaagcgcgtcgtgttcacgtcctccatcggcacggtgtacatgaacccataccgcgaccccaacgagcccgtcgacgacacctgctggagcgacctcgagtactgcaagaagaccgagaactggtactgctacgcgaagacggtggcggagcagggcgcgtgggaggtggcgcggaagcgcgggctggacctggtagttgtgaacccggtgctggtgctgggtccgctgctgcagccgacggtgaacgcgagcacggaccacgtgatgaagtacctgacggggtcggccaagacgtacgtgaacgcggcgcaggcctacgtgcacgtcaaggacgtcgccgaggcgcacgtccgggtgtacgaggccgcccacgcgcacggccgctacatctgcgccgagagcaccctccaccgcggcgagctctgccgtatcctcgccaagctcttcccggagtaccccatacccaccaagtgtaaggacgaggtgaatcctccggtggccggatacaagttcagcaaccagcggctcaaggatctagggatcgagttcgtgccggtgctgcagtgcctgtacgagacggtgaagagcctccaggagaaagggatgctgcccgtcctcccgccaaacgacgaccaccacctcgaccaactgatgacatcatgatcatcccaaggttcactactgatggtctacggcatgctgccacgcatatcatgagctagctgattaatatattataagcaaacctttttatcaacataatatatggcaactttcatggttgcatgcatgtacgcgtggcagccactgcaccgaccgacccaaatgttagtgctgtatgacgtacacatgcaacacatctttgtggaatatatatgattgtaatttatataactgctgtgagcaataactgggctcctttttagctgccctatgccacacacttggcccttggccctttgcttgtcctcgagtagagattgaaggaccaaataaagtggatgcaactcctttg

SEQ ID NO: 382 - protein, 343 aa, Panicum virgatum
  misc_feature (17)..(255): Pfam Name: Epimerase Pfam Description: NAD dependent epimerase/dehydratase fam
  misc_feature (1)..(343): Ceres Clone ID no. 2023103
  misc_feature (1)..(343): Bit score of 731.5 for HMM based on sequences of Figure 16
  misc_feature (1)..(343): Functional Homolog Of SEQ ID NO. 368
MPIETPMPALSGHGLTVCVTGAGGFIASWLVKRLLEKGYTVRGTVRNPVDPKNDHLRALEGAADRLTLVRADLLDPDSLLAAFSGCEGVFHTASPVTDDPEKMIEPAIRGTRHVMTVAADTGVKRVVFTSSIGTVYMNPYRDPNEPVDDTCWSDLEYCKKTENWYCYAKTVAEQGAWEVARKRGLDLVVVNPVLVLGPLLQPTVNASTDHVMKYLTGSAKTYVNAAQAYVHVKDVAEAHVRVYEAAHAHGRYICAESTLHRGELCRILAKLFPEYPIPTKCKDEVNPPVAGYKFSNQRLKDLGIEFVPVLQCLYETVKSLQEKGMLPVLPPNDDHHLDQLMTS

SEQ ID NO: 383 - protein, 346 aa, Zea mays
  misc_feature (22)..(260): Pfam Name: Epimerase Pfam Description: NAD dependent epimerase/dehydratase fam
  misc_feature (1)..(346): Public GI ID no. 28544965
  misc_feature (1)..(346): Bit score of 720.0 for HMM based on sequences of Figure 16
  misc_feature (1)..(346): Functional Homolog Of SEQ ID NO. 368
MPTAEATTPVPPELSSGQGRTVCVTGAGGFIASWLVKRLLEKGYTVRGTVRNPVDPKNDHLRALDGAVDRLVLLRADLLDPQSLAEAFSGCDGVFHAASPVTDDPEMMIEPAIRGTRYVMAAAADAGVKRVVFTSSIGTVYMNPYRDPSKPVDDTCWSDLEYCKNTQNWYCYAKTVAEQGAWEVARKRGLDLVVVNPVLVLGPLLQPTVNASTDHVMKYLTGSATTYVNAAQAYVHVRDVAEAHVRVYEAPHAHGRYICAESTLHRGDLCRVLAKLFPEYPVPTKCKDQVNPPVVGYKFTNQRLKDLGMDFVPVLQCLYETVTSLQEKGMLPVLPTKQDHDQLGKS

SEQ ID NO: 384 - protein, 357 aa, Triticum aestivum
  misc_feature (20)..(258): Pfam Name: Epimerase Pfam Description: NAD dependent epimerase/dehydratase fam
  misc_feature (1)..(357): Public GI ID no. 59805044
  misc_feature (1)..(357): Bit score of 690.9 for HMM based on sequences of Figure 16
  misc_feature (1)..(357): Functional Homolog Of SEQ ID NO. 368
MPIEAADNVPAELPGHGRTVCVTGAGGFIASWLVKRLLQKGYNVRGTVRNPVDPKNDHLRAFDGAADRLVLLRADLMEPETLVEAFTGCEGIFHAASPVTDDPEKMIEPAIRGTKYVITAAADMGIKRVVFTSTIGTVYMNPNRDPSKPVDDTCWSDLEYCKKTANWYCYAKTVAEQDALETARQRGIELIVVNPVLVLGPLLQPTVNASTEHVMKYLTGSAKTYVNAAQAYVHVKDVAEAHVRVYEAPGAHGRYICAEGTTLHRGELCRVLCKLFPEYPVPTKCKDEVNPPVKGYKFTNQRLKDLGMEFVPVLQSIYETVKSLQEKGMLPVLPPGDDVRDNLHEQLMMKPAQLLRN

SEQ ID NO: 385 - protein, 341 aa, Zea mays
  misc_feature (22)..(260): Pfam Name: Epimerase Pfam Description: NAD dependent epimerase/dehydratase fam
  misc_feature (1)..(341): Public GI ID no. 28544959
  misc_feature (1)..(341): Bit score of 709.4 for HMM based on sequences of Figure 16
  misc_feature (1)..(341): Functional Homolog Of SEQ ID NO. 368
MPTAEATTPVPPELSSGQGRTVCVTGAGGFIASWLVKRLLEKGYTVRGTVRNPVDPKNDHLRSLDGADDRLVLLRADLLDPESLAEAFSGCDGVFHAASPVTDDPEMMIEPAIRGTRYVMAAADDAGVKRVVFTSSIGTVYMNPYRDPSKPVDDTCWSDLEYCKNTQNWYCYAKTVAEQGAWEVARKRGLDLVVVNPVLVLGPLLQPTVNASTDHVMKYLTGSATTYVNAAQAYVHVRDVAEAHVRVYEAPHAHGRYICAESTLHRGDLCRVLAKLFPEYPVPTKCKDQVNPPVVGYKFTNQRLKDLGMDFVPVLQCLYETVTSLQEKGMLPVLPTKHDHA

SEQ ID NO: 386 - protein, 347 aa, Oryza sativa subsp. indica
  misc_feature (23)..(261): Pfam Name: Epimerase Pfam Description: NAD dependent epimerase/dehydratase fam
  misc_feature (1)..(347): Public GI ID no. 125562805
  misc_feature (1)..(347): Bit score of 701.9 for HMM based on sequences of Figure 16
  misc_feature (1)..(347): Functional Homolog Of SEQ ID NO. 368
MPTDETTAAAPATTALSGHGRTVCVTGAGGFIASWLVKRLLEKGYTVRGTVRNPMDPKNDHLRALDGAGERLVLLRADLLEPDSLVAAFTGCEGVFHAASPVTDDPEKMIEPAIRGTRYVITAAADTGIKRVVFTSSIGTVYMNPYRDPNKPVDDTCWSDLEYCKRTENWYCYAKTVAEQGAWEVARRRGVDLVVVNPVLVLGPLLQATVNASTEHVMKYLTGSAKTYVNAAQAYVHVRDVAEAHVRVYECGGARGRYICAESTLHRGDLCRALAKLFPEYPVPTRCKDEAAPPVKGYLFSNQRLRDLGMDFVPVRQCLYETVRSLQDKGLLPVLPPTADDHHHPSS

SEQ ID NO: 387 - protein, 347 aa, Oryza sativa subsp. japonica
  misc_feature (23)..(261): Pfam Name: Epimerase Pfam Description: NAD dependent epimerase/dehydratase fam
  misc_feature (1)..(347): Public GI ID no. 115478030
  misc_feature (1)..(347): Bit score of 697.2 for HMM based on sequences of Figure 16
  misc_feature (1)..(347): Functional Homolog Of SEQ ID NO. 368
MPTDETAAAAPATTALSGHGCTVCVTGAGGFIASWLVKRLLEKGYTVRGTVRNPMDPKNDHLRALDGAGERLVLLRADLLDPDSLVAAFTGCEGVFHAASPVTDDPEKMIEPAIRGTRYVITAAADTGIKRVVFTSSIGTVYMNPYRDPNKPVDDTCWSDLEYCKRTENWYCYAKTVAEQGAWEVARRRGVDLVVVNPVLVLGPLLQATVNASTEHVMKYLTGSAKTYVNAAQAYVHVRDVAEAHVRVYDCGGARGRYICAESTLHRGDLCRALAKLFPEYPVPSRCKDEAAPPVKGYLFSNQRLRDLGMDFVPVRQCLYETVRSLQDKGLLPVLPPTADDHHHPSS

SEQ ID NO: 388 - DNA, 736 bp, Panicum virgatum
  misc_feature (1)..(736): Ceres Clone ID no. 1821848
  misc_feature (1)..(736): Encodes the peptide sequence at SEQ ID NO. 389
gaaattcctcgacggatcgatcgcatctctgccaccgccgccaccacctgcctatttgggaggttgcctggccgcgcgcccatggccgtcaccgtgtgcgtcaccggcgccggcggcttcatcgggtcttggatagtcaagctcctcctcgaccgcgggtacgccgtccggggcacctcccgccgcgcagatgaccccaagaacgcgcacctctgggcgctcgacggcgcggcggagcgcctcacgatgctgcaggtggacctgctcgatcgggccagcctccgcgccgccttcgacggctgcgacggcgtcatccacaccgcctcgccgatgcacgacaaccccgaggagatcatcgagccaattatcgccgggacacggaacgtcgtggaggccgcggccgacgccggcgtgcggcgcctggtgatctcctccaccatcggcaccatgtacatgaacccgcaccgcgaccccgacgcgcccctggacgagtggagctggagcgacctcgagcactgcaagaagaccgcgaactggtactgctacgccaagacgatcgcggagcagagcgcgtggcaggcggcgcgggcgcggggcctggacctggcggtggtcatcccggtggtggtgctcggcgaactgatgcagccaagcatgaacaccagcaccctgcacatactcaagtacctcaccggccaggccaaggactatgtcaacgagtcgcacgcgtacgtgc

SEQ ID NO: 389 - protein, 218 aa, Panicum virgatum
  misc_feature (5)..(218): Pfam Name: Epimerase Pfam Description: NAD dependent epimerase/dehydratase f
  misc_feature (1)..(218): Ceres Clone ID no. 1821848
  misc_feature (1)..(218): Bit score of 383.1 for HMM based on sequences of Figure 16
  misc_feature (1)..(218): Functional Homolog Of SEQ ID NO. 368
MAVTVCVTGAGGFIGSWIVKLLLDRGYAVRGTSRRADDPKNAHLWALDGAAERLTMLQVDLLDRASLRAAFDGCDGVIHTASPMHDNPEEIIEPIIAGTRNVVEAAADAGVRRLVISSTIGTMYMNPHRDPDAPLDEWSWSDLEHCKKTANWYCYAKTIAEQSAWQAARARGLDLAVVIPVVVLGELMQPSMNTSTLHILKYLTGQAKDYVNESHAYV

SEQ ID NO: 390 - DNA, 1026 bp, Populus balsamifera subsp. trichocarpa
  misc_feature (1)..(1026): Ceres Annot ID no. 1483675
  misc_feature (1)..(1026): Encodes the peptide sequence at SEQ ID NO. 391
atgcctgtcgatacttcatcacttccatgccaaggccaaactgtctgtgtcaccggggctggtggcttcattgcttcatggattgttaaacttcttctagagaaaggttactctgttaaaggaactgtgaggaacccagctgatcccaagaattcccatttgagggagcttgaaggagctcaagaaagattaactttatgcaaggctgatctccttgattatgagtctcttaaagaggctattcaagggtgtgatggagttttccatactgcttctcctctcacagacgatccagagcaaatggtggagccagcagtgaatggatccaagaatgtgatcatggcagcatctgaggccaaagtccgacgagtggttttcacgtcttcaattggtactgtgtacatggaccccaataggagccctgatgttgtcgttgatgaatcttgctggagtgatcttgagtattgcaagaacaccaagaattggtattgctatggaaagactgtggcagaacaggttgcatgggatgtggctaagaagaaaggagttgacctagtggtggtgaacccagtggtggtgcttggaccattgttgcaacccactgtcaatgctagcatccttcacatcctcaagtacctaaccggctcagccaagacatatgctaacgctgttcaagcttatgtgcatgttagggatgtggcggtagcccacattttagtcttcgagacaccttctgcctccggccgttacatttgctttgagaaaatgcttcaccgtggagaggttgtggaaatccttgcaaagttcttcccggagtatcccatccccaccaagtgttcagatgagaagaacccaagaaaacaaccctacaagttcacaaaccagaagatcaaggatctgggcatcgaattcaccccagtgaaacagtgtctgtatgaaactgttaagagcttgcaggaaaagggtcaccttccaatcccaaaacaagctaaagatgggtccgttgtcagaatctccaaatattaa

SEQ ID NO: 391 - protein, 341 aa, Populus balsamifera subsp. trichocarpa
  misc_feature (15)..(253): Pfam Name: Epimerase Pfam Description: NAD dependent epimerase/dehydratase fam
  misc_feature (1)..(341): Ceres Annot ID no. 1483675
  misc_feature (1)..(341): Bit score of 812.7 for HMM based on sequences of Figure 16
  misc_feature (1)..(341): Functional Homolog Of SEQ ID NO. 368
MPVDTSSLPCQGQTVCVTGAGGFIASWIVKLLLEKGYSVKGTVRNPADPKNSHLRELEGAQERLTLCKADLLDYESLKEAIQGCDGVFHTASPLTDDPEQMVEPAVNGSKNVIMAASEAKVRRVVFTSSIGTVYMDPNRSPDVVVDESCWSDLEYCKNTKNWYCYGKTVAEQVAWDVAKKKGVDLVVVNPVVVLGPLLQPTVNASILHILKYLTGSAKTYANAVQAYVHVRDVAVAHILVFETPSASGRYICFEKMLHRGEVVEILAKFFPEYPIPTKCSDEKNPRKQPYKFTNQKIKDLGIEFTPVKQCLYETVKSLQEKGHLPIPKQAKDGSVVRISKY

SEQ ID NO: 392 - DNA, 1014 bp, Populus balsamifera subsp. trichocarpa
  misc_feature (1)..(1014): Ceres Annot ID no. 1483663
  misc_feature (1)..(1014): Encodes the peptide sequence at SEQ ID NO. 393
atgcctgtcgatacttcatcacttccatgccaaggccaaactgtctgtgtcaccggggctggtggcttcattgcttcatggattgttaaacttcttctagagaaaggttactctgttaaaggaactgtgaggaacccagctgatcccaagaattcccatttgagggagcttgaaggagctcaagaaagattaactttatgcaaggctgatattcttgattatgagtctcttaaagaggctattcaagggtgtgatggagttttccatactgcttgtcctgtcacagacgatccagacaaggtgatggagccagcagtgaatggaaccaagaatgtgatcatggcagcagctgaggccaaagtccgacgagtggttttcacgtcctcaattggtactgtgtacatggaccccaataggagccctgatgttgtcgttgatgaatcttgctggagtgatcttgagtattgcaagaacaccaagaattggtattgctatggaaagactgtggcagaacaggttgcatgggatgtggctaagaagaaaggagttgacctagtggtggtgaacccagtggtggtgcttggaccattgttgcaacccactgtcaatgctagcatccttcacatcctcaagtacctaaccggctcagccaagacatatgctaacgctgttcaagcttatgtgcatgttagggatgtggccgtagcccacattttagtcttcgagacaccttctgcctccggccgttacatttgctttgagaaaatgcttcaccgtggagaggtggtggaaatccttgcaaagttcttcccggagtatcccatccccaccaagtgttctgatgagaagaacccaagaaaacaaaactacaagctcacaaaccagaagatcaaggatctgggcatcgaattcgtcccagtaaaacagtgcttgtatgaaactgttaagagcttgcaggaaaagggtatccttccaatcctaaaacatgctgaagactctgtgaaaattcaataa

SEQ ID NO: 393 - protein, 337 aa, Populus balsamifera subsp. trichocarpa
  misc_feature (15)..(253): Pfam Name: Epimerase Pfam Description: NAD dependent epimerase/dehydratase fam
  misc_feature (1)..(337): Ceres Annot ID no. 1483663
  misc_feature (1)..(337): Bit score of 782.3 for HMM based on sequences of Figure 16
  misc_feature (1)..(337): Functional Homolog Of SEQ ID NO. 368
MPVDTSSLPCQGQTVCVTGAGGFIASWIVKLLLEKGYSVKGTVRNPADPKNSHLRELEGAQERLTLCKADILDYESLKEAIQGCDGVFHTACPVTDDPDKVMEPAVNGTKNVIMAAAEAKVRRVVFTSSIGTVYMDPNRSPDVVVDESCWSDLEYCKNTKNWYCYGKTVAEQVAWDVAKKKGVDLVVVNPVVVLGPLLQPTVNASILHILKYLTGSAKTYANAVQAYVHVRDVAVAHILVFETPSASGRYICFEKMLHRGEVVEILAKFFPEYPIPTKCSDEKNPRKQNYKLTNQKIKDLGIEFVPVKQCLYETVKSLQEKGILPILKHAEDSVKIQ

SEQ ID NO: 394 - DNA, 1017 bp, Populus balsamifera subsp. trichocarpa
  misc_feature (1)..(1017): Ceres Annot ID no. 1448084
  misc_feature (1)..(1017): Encodes the peptide sequence at SEQ ID NO. 395
atgcctgttgatgcttcatcactttcaggccaaggccaaactatctgtgtcaccggggctggtggtttcattgcttcttggatggttaaacttcttttagataaaggttacactgttagaggaactgcgaggaacccagctgatcccaagaattctcatttgagggggcttgaaggagctgaagaaagattaactttatgcaaagctgatcttcttgattatgagtctcttaaagaggctattcaagggtgtgatggtgttttccacactgcttctcctgtcacagatgatccggaagaaatggtggagccagcagtgaacgggaccaaaaatgtgataattgcggcggctgaggccaaagtccgacgagtggtgttcacgtcatcaattggcgctgtgtacatggatcccaataagggcccagatgttgtcattgatgagtcttgctggagtgatcttgaattctgcaagaacaccaagaattggtattgctatggaaaggctgtggcagaacaagctgcatgggatatggctaaggagaaaggggtggacctagtggtggttaacccagtgctggtgcttggaccattgttgcagcccactgtcaatgctagcatcactcacatcctcaagtacctcaccggctcagccaagacatatgctaactctgttcaagcttatgtgcatgttagggatgtggcactagcccacattttagtctttgagacgccttccgcctccggccgttacctttgctctgagagcgttctccaccgtggagaggtggtggaaatccttgcaaagttcttccctgagtaccccatccctaccaagtgctcagatgagaagaacccaagaaaacaaccttacaagttctcaaaccagaagctaagggatctgggtttcgaattcaccccagtaaagcagtgtctgtatgaaactgttaagagtttgcaggaaaagggtcaccttccaatcccaaaacaagctgcagaagagtctttgaaaattcaataa

SEQ ID NO: 395 - protein, 338 aa, Populus balsamifera subsp. trichocarpa
  misc_feature (15)..(253): Pfam Name: Epimerase Pfam Description: NAD dependent epimerase/dehydratase fam
  misc_feature (1)..(338): Ceres Annot ID no. 1448084
  misc_feature (1)..(338): Bit score of 806.2 for HMM based on sequences of Figure 16
  misc_feature (1)..(338): Functional Homolog Of SEQ ID NO. 368
MPVDASSLSGQGQTICVTGAGGFIASWMVKLLLDKGYTVRGTARNPADPKNSHLRGLEGAEERLTLCKADLLDYESLKEAIQGCDGVFHTASPVTDDPEEMVEPAVNGTKNVIIAAAEAKVRRVVFTSSIGAVYMDPNKGPDVVIDESCWSDLEFCKNTKNWYCYGKAVAEQAAWDMAKEKGVDLVVVNPVLVLGPLLQPTVNASITHILKYLTGSAKTYANSVQAYVHVRDVALAHILVFETPSASGRYLCSESVLHRGEVVEILAKFFPEYPIPTKCSDEKNPRKQPYKFSNQKLRDLGFEFTPVKQCLYETVKSLQEKGHLPIPKQAAEESLKIQ

SEQ ID NO: 396 - protein, 338 aa, Populus tomentosa
  misc_feature (15)..(253): Pfam Name: Epimerase Pfam Description: NAD dependent epimerase/dehydratase fam
  misc_feature (1)..(338): Public GI ID no. 190710713
  misc_feature (1)..(338): Bit score of 807.9 for HMM based on sequences of Figure 16
  misc_feature (1)..(338): Functional Homolog Of SEQ ID NO. 368
MPVDASSLSGQGQTICVTGAGGFIASWMVKLLLDKGYTVRGTARNPADPKNSHLRELEGAQERLTLCKADLLDYESLKEAIQGCDGVFHTASPVTDDPEEMVEPAVNGTKNVIIAAAEAKVRRVVFTSSIGAVYMDPNKGPDVVIDESCWSDLEFCKNTKNWYCYGKAVAEQAAWDMAKEKGVDLVVVNPVLVLGPLLQPTVNASIVHILKYLTGSAKTYANSVQAYVHVRDVALAHILVFETPSASGRYLCSESVLHRGEVVEILAKFFPEYPIPTKCSDEKNPRKQPYKFSNQKLRDLGFEFTPVKQCLYETVKSLQERGHLPIPKQAAEESVKIQ

SEQ ID NO: 397 - DNA, 1221 bp, Parthenium argentatum
  misc_feature (1)..(1221): Ceres Clone ID no. 1602920
  misc_feature (1)..(1221): Encodes the peptide sequence at SEQ ID NO. 398
aataacctccctcaaccaatctctcacaagtcacaaaccacaaccatgtctccggcatccaaccaagtcatctgtgtcaccggagccggcggattcatcgcctcgtggatggtcaaattgctcttagagaaaggctatattgttagaggaaccgttaggaatccagacgatcagaagaataatcatttaagagagctcgaaggagcgaaagagcgattaactctatacaaagctgatcttctagatttcgaaagcttgcgtgaagccatcaagggttgtgacggcgtattccacactgcttctcctgtcacagatgatcctgaacaaatggtggagccagcggttatcggaacaaggaatgtaatagtagctgcagctgaagctaaagtccgacgagtggttttcacttcttcgattggagcggtttacatggacccgaaccgtagtcctgatgatgttgttgatgagagctgctggagtgatcttgaattctgcaagaacaccaagaactggtattgctatggaaaagctgtggcagaacaagctgcatgggacgaggctaaggcaagaggggttgacctggttgtagtgaacccggtgttggtgatgggaccacttttgcaacccgcggtcaatgcgagcattattcatatcttaaagtatctaacagggtcggcaaagacctatgctaattcagtccaagcatacgttgatgtacgagatgtggcattagcgcacattttactcttcgagactccttcagcttccggtcgatatctctgtgctgagagtgtgctacatcgtggagaagtggttgagattttagctaaatattttccggaataccctattcccaccaagtgtaaagatgagacaaatccacgagcaaagccatacaaattctcaaaccaaaaactgaaagatgtgggtattgaatttataccagtaaaccagagtttatatgacacggtcaagagtttacaagagaagggtcatcttccggtgcagccaacccaacccgatgaccagctccatattcaatcctagtagttcgattttaatttggttatgtagtgaatgtatctctctatatttattataagagaatgatcattgtttatgttttgtttgtaacaaatattctctcaaccgtcattgtcatgcagaaagttgtgaataatggagtattgtccataaattcaaaagaatattttcgaagtc

SEQ ID NO: 398 - protein, 333 aa, Parthenium argentatum
  misc_feature (9)..(247): Pfam Name: Epimerase Pfam Description: NAD dependent epimerase/dehydratase fam
  misc_feature (1)..(333): Ceres Clone ID no. 1602920
  misc_feature (1)..(333): Bit score of 778.3 for HMM based on sequences of Figure 16
  misc_feature (1)..(333): Functional Homolog Of SEQ ID NO. 368
MSPASNQVICVTGAGGFIASWMVKLLLEKGYIVRGTVRNPDDQKNNHLRELEGAKERLTLYKADLLDFESLREAIKGCDGVFHTASPVTDDPEQMVEPAVIGTRNVIVAAAEAKVRRVVFTSSIGAVYMDPNRSPDDVVDESCWSDLEFCKNTKNWYCYGKAVAEQAAWDEAKARGVDLVVVNPVLVMGPLLQPAVNASIIHILKYLTGSAKTYANSVQAYVDVRDVALAHILLFETPSASGRYLCAESVLHRGEVVEILAKYFPEYPIPTKCKDETNPRAKPYKFSNQKLKDVGIEFIPVNQSLYDTVKSLQEKGHLPVQPTQPDDQLHIQS

SEQ ID NO: 399 - protein, 338 aa, Populus tomentosa
  misc_feature (15)..(253): Pfam Name: Epimerase Pfam Description: NAD dependent epimerase/dehydratase fam
  misc_feature (1)..(338): Public GI ID no. 40233135
  misc_feature (1)..(338): Bit score of 803.7 for HMM based on sequences of Figure 16
  misc_feature (1)..(338): Functional Homolog Of SEQ ID NO. 368
MPVDASSLSGQGQTICVTGAGGFIASWMVKLLLDKGYTVRGTARNPADPKNSHLRELEGAQERLTLCKADLLDYESLKEAIQGCDGVFHTASPVTDDPEEMVEPAVNGTKNVIIAAAEAKVRRVVFTSSIGAVYMDPNKGPDVVIDESCWSDLEFCKNTKNWYCHGKAVAEQAAWDMAKEKGVDLVVVNPVLVLGPLLQPTVNASIVHILKYLTGSAKTYANSVQAYVHVRDVALAHILVFETPSASGRYLCSESVLHRGEVVEILAKFFPEYPIPTKCSDEKNPRKQPYKFSNQKLRDLGFEFTPVKQCLYETVKSLQERGHLPIPKQAAEESVKIQ

SEQ ID NO: 400 - protein, 338 aa, Populus balsamifera subsp. trichocarpa
  misc_feature (15)..(253): Pfam Name: Epimerase Pfam Description: NAD dependent epimerase/dehydratase fam
  misc_feature (1)..(338): Public GI ID no. 2960364
  misc_feature (1)..(338): Bit score of 802.2 for HMM based on sequences of Figure 16
  misc_feature (1)..(338): Functional Homolog Of SEQ ID NO. 368
MPVDASSLSGQGQTICVTGGGGFIASWMVKLLLDKGYTVRGTARNPADPKNSHLRELEGAEERLTLCKADLLDYESLKEGIQGCDGVFHTASPVTDDPEEMVEPAVNGTKNVIIAAAEAKVRRVVFTSSIGAVYMDPNKGPDVVIDESCWSDLEFCKNTKNWYCYGKAVAEQAAWDMAKEKGVDLVVVNPVLVLGPLLQPTVNASITHILKYLTGSAKTYANSVQAYVHVRDVALAHILVFETPSASGRYLCSESVLHRGEVVEILAKFFPEYPIPTKCSDEKNPRKQPYKFSNQKLRDLGFEFTPVKQCLYETVKSLQEKGHLPIPKQAAEESLKIQ

SEQ ID NO: 401 - protein, 348 aa, Hordeum vulgare
  misc_feature (21)..(260): Pfam Name: Epimerase Pfam Description: NAD dependent epimerase/dehydratase fam
  misc_feature (1)..(348): Public GI ID no. 25140432
  misc_feature (1)..(348): Bit score of 717.2 for HMM based on sequences of Figure 16
  misc_feature (1)..(348): Functional Homolog Of SEQ ID NO. 368
MTVVDAAAAVAQELPGHGQTVCVTGAAGYIASWLVKLLLERGYTVKGTVRNPDDPKNAHLKALDGAAERLVLCKADLLDYDAICAAVEGCHGVFHTASPVTDDPEQMVEPAVRGTEYVIDAAADAGTVRRVVFTSSIGAVTMDPNRGPDVVVDESCWSDLEFCKKTKNWYCYGKAVAEQAAWEKARARGVDLVVVNPVLVVGPLLQPTVNASAAHILKYLDGSARKYANAVQAYVDVRDVAGAHLRVFEAPQASGRYLCAERVLHRQDVVHILAKLFPEYPVPTRCSDEVNPRKQPYKMSNQKLQDLGLKFTPVNDSLYETVKSLQEKGHLPVPRKDILAPQLDGATA

SEQ ID NO: 402 - protein, 332 aa, Solanum lycopersicum
  misc_feature (9)..(247): Pfam Name: Epimerase Pfam Description: NAD dependent epimerase/dehydratase f
  misc_feature (1)..(332): Public GI ID no. 65306614
  misc_feature (1)..(332): Bit score of 804.0 for HMM based on sequences of Figure 16
  misc_feature (1)..(332): Functional Homolog Of SEQ ID NO. 368
MPSESGKVVCVTGAGGFIASWLVKLLLEKGYTVRGTVRNPDDSKNGHLKELEGAKERLILLRADLLDYQSLREAIYGCDGVFHTASPVTDDPEQMVEPAVIGTKNVITAAAETKVRRVVFTSSIGTVYMDPNRAPDKVVDETCWSDLDYCKNTKNWYCYGKTVAEKTARDEAREKGVDLVVINPVLVLGPLLQPTVNASVLHILKYLTGSAKTYANSIQAYVHVKDVALAHILLYEAPSASGRYICAERVLHRGDVVEILAKFFPEYPIPTKCSDETRPRAKPYIFTNQKLKDLGLEFTPVKQCLYETVKSLQEKGHLPVPTQNDEPIKIHS

SEQ ID NO: 403 - protein, 344 aa, Lolium perenne
  misc_feature (18)..(257): Pfam Name: Epimerase Pfam Description: NAD dependent epimerase/dehydratase fam
  misc_feature (1)..(344): Public GI ID no. 9964087
  misc_feature (1)..(344): Bit score of 718.9 for HMM based on sequences of Figure 16
  misc_feature (1)..(344): Functional Homolog Of SEQ ID NO. 368
MTVVNTVAQQLPGHGQTVCVTGAAGYIASWLVKLLLERGYTVKGTVRNPDDPKNAHLKALDGAVERLILCKADLLDYDAICAAAEGCHGVFHTASPVTDDPEQMVEPAVRGTEYVINAAADAGTVRRVVFTSSIGAVTMDPNRGPDVVVDESCWSDLEFCKKTKNWYCYGKAVAEQAAWEAARKRGIDLVVVNPVLVVGPLLQPTVNASAAHILKYLDGSAKKYANAVQSYVDVRDVADAHIRVFEAPEASGRYLCAERVLHRGDVVQILSKLFPEYPVPTRCSDEVNPRKQPYKMSNQKLQDLGLQFTPVNDSLYETVKSLQEKGHLLVPSKNIPEGLNGVTA

SEQ ID NO: 404 - protein, 336 aa, Eucalyptus gunnii
  misc_feature (13)..(251): Pfam Name: Epimerase Pfam Description: NAD dependent epimerase/dehydratase fam
  misc_feature (1)..(336): Public GI ID no. 2058311
  misc_feature (1)..(336): Bit score of 784.9 for HMM based on sequences of Figure 16
  misc_feature (1)..(336): Functional Homolog Of SEQ ID NO. 368
MPVDALPGSGQTVCVTGAGGFIASWIVKLLLERGYTVRGTVRNPDDPKNGHLRELEGASERLTLYKGDLMDYGSLEEAIKGCDGVVHTASPVTDDPEQMVEPAVIGTKNVIVAAAEAKVRRVVFTSSIGAVTMDPNRGPDVVVDESCWSDLEFCKSTKNWYCYGKAVAEKAAWPEAKERGVDLVVINPVLVLGPLLQSTINASIIHILKYLTGSAKTYANSVQAYVHVKDVALAHVLVLETPSASGRYLCAESVLHRGDVVEILAKFFPEYNVPTKCSDEVNPRVKPYKFSNQKLRDLGLEFTPVKQCLYETVKSLQEKGHLPVPSPPEDSVRIQG

SEQ ID NO: 405 - DNA, 1274 bp, Glycine max
  misc_feature (1)..(1274): Ceres Clone ID no. 1243741
  misc_feature (1)..(1274): Encodes the peptide sequence at SEQ ID NO. 406
attagcatctatctcactaaccaacttctttctttgttccgttctactttcccttcccaacaacaacaagaagatgccttctgcagaagcttcctccgaaaccatttgtgtcaccggcgctggtggcttcatcgcctcttggatggtcaaactcctcttggaaaaaggctacactgtccgaggaaccctcagaaatccagatgatcccaagaacgggcacttgaaggagtttgaaggagcctccgagaggttaactctgcataaggttgacctccttcatcttgactccgttagatcagttattaacggttgccatggtgtctttcacactgcttctcccgtcaccgataaccccgaagaaatggtggagccagcggtgagtggagctaagaatgtgatcatagctgctgcagaggctaaagttagacgtgtggtgttcacctcatccattggtgccgtctatatggaccccagtaggagcatcgatttggtggttgacgagtcctgttggagtgatttggaatattgcaagaacaccaagaattggtattgctatgggaaggctgtggctgaacaagcagcatgggacacagcaaaagagaatggggtggacttggttgtagtgaacccagttttggttcttggaccattactgcaacccacaatcaatgctagtacaattcacatcctcaagtacctcactggctctgctaagacctatgcaaatgccacacaggcttatgtgcatgttagggatgtggcattggcccacatacttgtttatgagaagccttctgcctctggtagatacctatgtgccgaaagctccctccaccgtggagaattagttgaaattctcgccaagtatttcccggagtacccagttcccaccaagtgttcagatgaaaagaatccgagagcaaaaccctacactttttcaaatcaaaagctgaaagatttgggattggaattcactccagtgagtcagtgtctatatgaaacagtgaagagcctgcaggagaaaggccaccttccagttcctgcaaagcagcaggaagaagattcaactaccgtgaaatcctaaatgagcagctagttgtccactaaggcaagaagctgcagcttgtggcaatctgtgctcatcttatatattataatagagaatcctacattagaagactgctgtatttggattttgttaaaaagacatcaactaaattgttgccgtgtatgaacttataatattaatgaaatttattcccctcgttgagttg

SEQ ID NO: 406 - protein, 336 aa, Glycine max
  misc_feature (11)..(249): Pfam Name: Epimerase Pfam Description: NAD dependent epimerase/dehydratase fam
  misc_feature (1)..(336): Ceres Clone ID no. 1243741
  misc_feature (1)..(336): Bit score of 782.1 for HMM based on sequences of Figure 16
  misc_feature (1)..(336): Functional Homolog Of SEQ ID NO. 368
MPSAEASSETICVTGAGGFIASWMVKLLLEKGYTVRGTLRNPDDPKNGHLKEFEGASERLTLHKVDLLHLDSVRSVINGCHGVFHTASPVTDNPEEMVEPAVSGAKNVIIAAAEAKVRRVVFTSSIGAVYMDPSRSIDLVVDESCWSDLEYCKNTKNWYCYGKAVAEQAAWDTAKENGVDLVVVNPVLVLGPLLQPTINASTIHILKYLTGSAKTYANATQAYVHVRDVALAHILVYEKPSASGRYLCAESSLHRGELVEILAKYFPEYPVPTKCSDEKNPRAKPYTFSNQKLKDLGLEFTPVSQCLYETVKSLQEKGHLPVPAKQQEEDSTTVKS

SEQ ID NO: 407 - protein, 336 aa, Eucalyptus globulus
  misc_feature (13)..(251): Pfam Name: Epimerase Pfam Description: NAD dependent epimerase/dehydratase fam
  misc_feature (1)..(336): Public GI ID no. 50345916
  misc_feature (1)..(336): Bit score of 779.3 for HMM based on sequences of Figure 16
  misc_feature (1)..(336): Functional Homolog Of SEQ ID NO. 368
  misc_feature (175)..(175): Xaa is any aa, unknown, or other
MPVDALPGSGQTVCVTGAGGFIASWIVKLLLERGYTVRGTVRNPDDPKNGHLRELDGASERLTLYKGDLMDYESLREAIMGCDGVVHTASPVTDDPEQMVEPAVIGTKNVIVAAAEAKVRRVVFTSSIGAVTMDPNRGPDVVVDESCWSDLEFCKSTKNWYCYGKAVAEKAACAXAKERGVDLVVINPVLVLGPLLQSTINASIIHILKYLTGSAKTYANSVQAYVHVKDVALAHVLVLETPSASGRYLCAESVLHRGDVVEILAKFFPEYNVPTKCSDEVNPRVKPYKFSNQKLKDLGLEFTPVKQCLYETVKSLQEKGHLPVPPPPEDSVRIQG

SEQ ID NO: 408 - protein, 334 aa, Leucaena leucocephala
  misc_feature (20)..(258): Pfam Name: Epimerase Pfam Description: NAD dependent epimerase/dehydratase fam
  misc_feature (1)..(334): Public GI ID no. 170285663
  misc_feature (1)..(334): Bit score of 776.1 for HMM based on sequences of Figure 16
  misc_feature (1)..(334): Functional Homolog Of SEQ ID NO. 368
MPAAAPAAANTTSSGSGQTVCVTGAGGFIASWIVKLLLERDYTVRGTVRNPDDSKNSHLKELEGAEERLTLHKVDLLDLESVKAAINGCDGVLHTASPVTDNPEEMVEPAVNGAKNVIIAAAEAKVRRVVFTSSIGAVYMDPSRNIDEVVDESCWSNLEYCKNTKNWYCYGKAVAEQAAWDEAKARGVDLVVVNPVLVLGPLLQSTINASTIHILKYLAGSAKTLCNATQAYVHVKDVALAHVLVYETPSASGRYLCSESSLHRGELVEILAKYFPEYPIPTKCSDEKNPRAKPYTFSNKRLKDLGLEFTPVHQCLYDTVKSLQDKGHLPLPTK

SEQ ID NO: 409 - protein, 337 aa, Populus tremuloides
  misc_feature (14)..(252): Pfam Name: Epimerase Pfam Description: NAD dependent epimerase/dehydratase fam
  misc_feature (1)..(337): Public GI ID no. 7239228
  misc_feature (1)..(337): Bit score of 793.3 for HMM based on sequences of Figure 16
  misc_feature (1)..(337): Functional Homolog Of SEQ ID NO. 368
MPVDASSLSGQGQTCVTGAGGFIASWMVKLLLDKGYTVRGTARNPADPNNSHLRELEGAQERLTLCKADLLDYESLKEAIQGCDGVFHTASPVTDDPEEMVEPAVNGTKNVIIAAAEAKVRRVVFTSSIGAVYMDPNKGPDVVIDESCWSDLEFCKNTKNWYCYGKAVAEQAAWDMAKEKGVDLVVVNPVLVLGPLFQPTVNASIVHILKYLTGSAKTYANSVQAYVHVRDVALAHILVFETPSASGRYLCSESVLHRGEVVEILAKFFPEYPIPTKCSDEKNPRKQPYKFSNQKLRDLGFEFTPVKQCLYETVKSLQERGHLPIPKQAAEESVKIQ

SEQ ID NO: 410 - protein, 338 aa, Vitis vinifera
  misc_feature (15)..(253): Pfam Name: Epimerase Pfam Description: NAD dependent epimerase/dehydratase fam
  misc_feature (1)..(338): Public GI ID no. 225465530
  misc_feature (1)..(338): Bit score of 806.0 for HMM based on sequences of Figure 16
  misc_feature (1)..(338): Functional Homolog Of SEQ ID NO. 368
MPIDASSPSSSGQIVCVTGAGGFIASWIVKLLLERGYTVKGTVRNPDDPKNSHLRELEGAKERLILCKADLMDYESLKEAINGCHGVFHTASPVTDDPEEMVEPAVNGTKNVIIAAAEAKVRRVVFTSSIGAVYMDPNRSPDQVVDESCWSDLEFCKNTKNWYCYGKAVAEQAAWEVAKEKEVDLVVVNPVLVLGPLLQSTVNASIIHILKYLTGSAKTYANSVQAYVHVKDVALAHILVFEAPSASGRYLCAESVLHRGDVVEILAKFFPEYPIPTKCSDEVKPRAKPYKFSNQKLRELGLEFIPVKQCLYETVKTLQEKGHVPVPPQHDDSLRIQS

SEQ ID NO: 411 - protein, 336 aa, Eucalyptus globulus
  misc_feature (13)..(251): Pfam Name: Epimerase Pfam Description: NAD dependent epimerase/dehydratase fam
  misc_feature (1)..(336): Public GI ID no. 25989515
  misc_feature (1)..(336): Bit score of 779.1 for HMM based on sequences of Figure 16
  misc_feature (1)..(336): Functional Homolog Of SEQ ID NO. 368
MPVDALPGSGQTVCVTGAGGFIASWIVKLLLERGYTVRGTVRNPDDPKNGHLRELDGASERLTLYKGDLMDYESLREAIMGCDGVVHTASPVTDDPEQMVEPAVIGTKNVIVAAAEAKVRRVVFTSSIGAVTMDPNRGPDVVVDESCWSDLEFCKSTKNWYCYGKAVAEKAACAEAKERGVDLVVINPVLVLGPLLQSTINASIIHILKYLTGSAKTYANSVQAYVHVKDVALAHVLVLETPSASGRYLCAESVLHRGDVVEILAKFFPEYNVPTKCSDEVNPRVKPYKFSNQKLRDLGLEFTPVKQCLYETVKSLQEKGHLPVPPPPEDSVRIQG

SEQ ID NO: 412 - protein, 349 aa, Triticum aestivum
  misc_feature (22)..(261): Pfam Name: Epimerase Pfam Description: NAD dependent epimerase/dehydratase fam
  misc_feature (1)..(349): Public GI ID no. 90902167
  misc_feature (1)..(349): Bit score of 702.7 for HMM based on sequences of Figure 16
  misc_feature (1)..(349): Functional Homolog Of SEQ ID NO. 368
MTVVAAAAAAAAQELPGHGQTVCVTGAAGYIASWLVKLLLERGYTVKGTVRNPDDPKNAHLKALDGAAERLVLCKADLLDYDAICAAVEGCHGVFHTASPVTDDPEQMVEPAVRGTEYVINAAADAGTVRRVGVTSSIGAVTMDPNRGPDVVVDESCWSDLEFCKKTKNWYCYGKAVAEQAAWEKAAARGVDLVVVNPVLVVGPLLQPTVNASAAHILKYLDGSAKKYANAVQAYVNVRDVAAAHVRVFEAPGASGRHLCAERVLHREDVVHILGKLFPEYPVPTRCSDEVNPRKQPYKMSNQKLQDLGLQFTPVNDSLYETVKSLQEKGHLPAPRKDILPAELDGATA

SEQ ID NO: 413 - protein, 372 aa, Saccharum officinarum
  misc_feature (31)..(270): Pfam Name: Epimerase Pfam Description: NAD dependent epimerase/dehydratase fam
  misc_feature (1)..(372): Public GI ID no. 3341511
  misc_feature (1)..(372): Bit score of 709.1 for HMM based on sequences of Figure 16
  misc_feature (1)..(372): Functional Homolog Of SEQ ID NO. 368
MTVVDAVSTDAAGAPAAAAAPVQQPGNGQTVCVTGAAGYIASWLVKLLLEKGYTVKGTVRNPDDPKNAHLKALDGAAERLILCKADLLDYDAICRAVQGCHGVFHTASPVTDDPEQMVEPAVRGTEYVINAAAEAGTVRRVVFTSSIGAVTMDPSRGPDVVVDESCWSDLEFCKKTRNWYCYGKAVAEQAAWDAARQRGVDLVVVNPVLVVGPLLQPTVNASIAHVVKYLDGSARTFANAVQAYVDVRDVADAHLRVFESPRASGRYLCAERVLHREDVVRILAKLFPEYPVPTRCSDEVNPRKQPYKFSNQKLRDLGLEFRPVSQSLYDTVKNLQEKGHLPVLGEQTTEADDKEAAPAAAELQQGGIAIRA

SEQ ID NO: 414 - protein, 336 aa, Eucalyptus globulus
  misc_feature (13)..(251): Pfam Name: Epimerase Pfam Description: NAD dependent epimerase/dehydratase fam
  misc_feature (1)..(336): Public GI ID no. 50345922
  misc_feature (1)..(336): Bit score of 774.4 for HMM based on sequences of Figure 16
  misc_feature (1)..(336): Functional Homolog Of SEQ ID NO. 368
MPVDALPGSGQTVCVTGAGGFIASWIVKLLLERGYTVRGTVRNPDDPKNGHLRDLEGASERLTLYKGDLMDYGSLEEAIKGCDGVVHTASPVTDDPEQMVEPAVIGTKNVIVAAAEAKVRRVVFTSSIGAVTMDPNRGPDVVVDESCWSDLEFCKSTKNWYCYGKAVAEKAACAEAKERGVDLVVINPVLVLGPLLQSTINASIIHILKYLTGSAKTYANSVQAYVHVKDVALAHVLVLETPSASGRYLCAESVLHRGDVVEILAKFFPEYNVPTKCSDEVNPRVKPYKFSNQKLRDLGLEFTPVKQCLYETVKSLQEKGHLPVPPPPEDSVRIQG

SEQ ID NO: 415 - DNA, 1343 bp, Glycine max
  misc_feature (1)..(1343): Ceres Clone ID no. 475958
  misc_feature (1)..(1343): Encodes the peptide sequence at SEQ ID NO. 416
gagcattagcatccatctctgatctcactcaccattcaccaacctgcttctctgttctcttctttcccttcccaagaagaagaagaagaagatgccttcttcagaatcatcaacaggcttctccgaaaccatttgtgtgaccggcgctggtggcttcatcgcctcttggatggtcaaactcctcttggagaaaggctacactgtccgaggaaccctcagaaacccagatgatcccaagaacgggcacttaaaagagtttgaaggagcttcccagagactaactctgcataaggttgacctccttcatcttgactccgttagatctgttattaacggctgtcatggtgtctttcacactgcttctcccgtcaccgataaccccgaagaaatggtggagcctgcggtgaatggagctaagaatgtgatcatagcagctgcagaggctaaagttagacgcgtggtgttcacctcatccattggtgccgtttacatggaccccaaaaggagcatcgatttggtggttgacgagtcctgttggagtgatttagaattttgcaagaacaccaagaattggtattgctatgggaaggctgtggctgaagaagcggcatgggacacagcaaaagagaaaggggtggacatggttgtagtgaacccagttttggtacttggaccattactgcaacccagcataaatgctagtacaattcacatcctcaagtacctcactggctctgctaagacctatgcaaatgccacacaggcgtatgttcatgttagggacgtggcattggcccacatacttgtttatgagaagccttctgcctctggtagatacatatgtgccgaaagctctctccaccgtggagaattagttgaaattctcgccaagtatttccccgactacccagttcccaccaagtgttcagatgaaaagaatccgagagcaaaaccctacactttttcaaatcaaaaactgaaagatttgggattggaattcaccccagtgagtcagtgtttatatgaagccgtcaagaacctgcaggagaaagggcaccttcctgttcctgcaaggcagcaggaagattcaactactgtgaaaccttaaacgagctatccctttttatctaatttgtcaacaaacaagaagctgcagcttttggcaatctgggctcatcttatattattatagagaatcctacattagaagatttctgtatttggatttcgtaaaaaaaaaaaagacatcgaccaaattgttgccatgtatgaacttgataatattagtggaatttattcctcttgttgagttgaattattctgctcctcaagctcttttatcc

SEQ ID NO: 416 - protein, 338 aa, Glycine max
  misc_feature (14)..(252): Pfam Name: Epimerase Pfam Description: NAD dependent epimerase/dehydratase fam
  misc_feature (1)..(338): Ceres Clone ID no. 475958
  misc_feature (1)..(338): Bit score of 770.2 for HMM based on sequences of Figure 16
  misc_feature (1)..(338): Functional Homolog Of SEQ ID NO. 368
MPSSESSTGFSETICVTGAGGFIASWMVKLLLEKGYTVRGTLRNPDDPKNGHLKEFEGASQRLTLHKVDLLHLDSVRSVINGCHGVFHTASPVTDNPEEMVEPAVNGAKNVIIAAAEAKVRRVVFTSSIGAVYMDPKRSIDLVVDESCWSDLEFCKNTKNWYCYGKAVAEEAAWDTAKEKGVDMVVVNPVLVLGPLLQPSINASTIHILKYLTGSAKTYANATQAYVHVRDVALAHILVYEKPSASGRYICAESSLHRGELVEILAKYFPDYPVPTKCSDEKNPRAKPYTFSNQKLKDLGLEFTPVSQCLYEAVKNLQEKGHLPVPARQQEDSTTVKP

SEQ ID NO: 417 - DNA, 1095 bp, Populus balsamifera subsp. trichocarpa
  misc_feature (1)..(1095): Ceres Annot ID no. 1437997
  misc_feature (1)..(1095): Encodes the peptide sequence at SEQ ID NO. 418
atgcctgtcgatacttcatcacttccatgccaaggccaaactgtctgtgtcaccggggctggtggcttcattgcttcatggattgttaaacttcttctagagaaaggttactctgttaaaggaactgtgagaaacccagctgatcccaagaattcccatttgagggagcttgaaggagctcaagaaagattaactttatgcaaggctgatctccttgattatgagtctcttaaagaggctattcaagggtgtgatggagttttccatactgcttctcctgtcacagacgatccagagcaaatgctggagccagcagtgaatggaaccaagaatgtgatcatggcagcagctgaggccaaagtccgacgagtggttttcacgtcttcaattgggactgtgtacatggaccccaataggagccctgatgttgtcgttgatgaatcttgctggagtgatcttgagttctgcaagaacaccaagaattggtattgctatggaaagactgtggcggaacaggatgcatgggatgtggctaagaagaatggagttgacctagtggtggtgaacccagtgctggtgcttggaccattgttgcaacccactgtcaatgctagcatcgttcacatcctcaagtacctaaccggctcagccaagacatatgctaactctgttcaagcttatgtgcatgttaaggatgtggcactagcccacattttagtcttcgagacaccttccgcctccggccgttacatttgcgctgagagaatgctccaccgtggagaggtggtggaaatccttgcaaagttcttcccggagtatcccatccccaccaacaaaagggtcctcaccaaccccatcgtctttgtcatatttggaccaaaatgggttctctacgattggtgttcagatgagaagaatccaagaaaacaaccctacaagttcacaaaccagaagatcaaggatctgggcatcgaattcaccccagtgaaacagtgcctgtatgaatctgttaagagcttgcaggaaaagggtcaccttccaatcccaaaacaagctgaagactctgtgaaaattcaacaagggctcatttattag

SEQ ID NO: 418 - protein, 364 aa, Populus balsamifera subsp. trichocarpa
  misc_feature (15)..(253): Pfam Name: Epimerase Pfam Description: NAD dependent epimerase/dehydratase fam
  misc_feature (1)..(364): Ceres Annot ID no. 1437997
  misc_feature (1)..(364): Bit score of 793.8 for HMM based on sequences of Figure 16
  misc_feature (1)..(364): Functional Homolog Of SEQ ID NO. 368
MPVDTSSLPCQGQTVCVTGAGGFIASWIVKLLLEKGYSVKGTVRNPADPKNSHLRELEGAQERLTLCKADLLDYESLKEAIQGCDGVFHTASPVTDDPEQMLEPAVNGTKNVIMAAAEAKVRRVVFTSSIGTVYMDPNRSPDVVVDESCWSDLEFCKNTKNWYCYGKTVAEQDAWDVAKKNGVDLVVVNPVLVLGPLLQPTVNASIVHILKYLTGSAKTYANSVQAYVHVKDVALAHILVFETPSASGRYICAERMLHRGEVVEILAKFFPEYPIPTNKRVLTNPIVFVIFGPKWVLYDWCSDEKNPRKQPYKFTNQKIKDLGIEFTPVKQCLYESVKSLQEKGHLPIPKQAEDSVKIQQGLIY

SEQ ID NO: 419 - DNA, 1480 bp, Panicum virgatum
  misc_feature (1)..(1480): Ceres Clone ID no. 1724312
  misc_feature (1)..(1480): Encodes the peptide sequence at SEQ ID NO. 420
tcaggaaggatcctaccaaacctaccaactcctcctccatcgatcgcccgcgcaaaggggaaacctaaaaactaactctcgccattcgccaactagctagctttctctctccgcttcggcgccgctgcggctccaccgcgttcgagcgagaggtttcgtgaagaaaccagagagtagcgtcgaggaactgatcgtcgatcgtgaagacgatgaccgtggtcgacgccgtgtccgcgggcgccggcgacgccgccgccgcggtgccgcagccggcggggaacgggcagaccgtgtgcgtcaccggcgcggccgggtacatcgcgtcgtggctcgtcaagctgctgctcgagaaggggtacactgtcaagggcaccgtcaggaacccagatgacccgaagaacgcgcacctcaaggcgctggacggcgccgccgagcggctcatcctctgcaaggccgacctcctggactacgacgccatctgccgcgccgtggagggctgccacggcgtcttccacaccgcctcccccgtcaccgacgaccccgagcaaatggtggagccggcggtgcgcggcacggagtacgtgatcagcgcggcggcggaggccggcacggtacggcgggtggtgttcacgtcctccatcggcgccgtgaccatggaccccaaccgcgggcccgacgtggtggtcgacgagtcctgctggagcgacctcgacttctgcaagaaaaccaggaactggtactgctacggcaaggcggtggcggagcaggcggcgtgggaggcggcgcggcagcgcggcgtggacctggtggtggtgaacccggtgctggtggtgggcccgctgctgcagccgacggtgaacgccagcatcgcgcacatcctcaagtacctggacggctccgcccgcaccttcgccaacgccgtgcaggcctacgtcgacgtccgcgacgtcgccgccgcgcacctccgcgtcttcgagagccccgccgcctccggccgccacctctgcgccgagcgcgtcctccaccgcgaggacgtcgtccgcatcctcgccaagctcttccccgagtaccccgtccccaccaggtgctccgacgaggtgaacccgcggaagcaggcgtacaagtttacgaaccagaagctccgggacctggggctggagttccggccggtgagccagtcgctgtacgacacggtgaagagcctccaggagaagggccacctgccggtgctcgccgacgagcaggcgccggaggccgcccccggcgccgaggcgcagcagggcgggatcgccatccgtgcgtgaggtccaggccgatggcgccacgaatgaacagaatgcaagcgatgttcatatactgcccctgatgtgtaacccaagtagtgtttgttgcctgtctgatgtccctagcaagacttgaaacgtcgtgctcgtccttgtgaactacatggtgggtgaataaatatggttaatgttcgttc

SEQ ID NO: 420 - protein, 364 aa, Panicum virgatum
  misc_feature (28)..(267): Pfam Name: Epimerase Pfam Description: NAD dependent epimerase/dehydratase fam
  misc_feature (1)..(364): Ceres Clone ID no. 1724312
  misc_feature (1)..(364): Bit score of 714.2 for HMM based on sequences of Figure 16
  misc_feature (1)..(364): Functional Homolog Of SEQ ID NO. 368
MTVVDAVSAGAGDAAAAVPQPAGNGQTVCVTGAAGYIASWLVKLLLEKGYTVKGTVRNPDDPKNAHLKALDGAAERLILCKADLLDYDAICRAVEGCHGVFHTASPVTDDPEQMVEPAVRGTEYVISAAAEAGTVRRVVFTSSIGAVTMDPNRGPDVVVDESCWSDLDFCKKTRNWYCYGKAVAEQAAWEAARQRGVDLVVVNPVLVVGPLLQPTVNASIAHILKYLDGSARTFANAVQAYVDVRDVAAAHLRVFESPAASGRHLCAERVLHREDVVRILAKLFPEYPVPTRCSDEVNPRKQAYKFTNQKLRDLGLEFRPVSQSLYDTVKSLQEKGHLPVLADEQAPEAAPGAEAQQGGIAIRA

SEQ ID NO: 421 - protein, 336 aa, Eucalyptus saligna
  misc_feature (13)..(251): Pfam Name: Epimerase Pfam Description: NAD dependent epimerase/dehydratase fam
  misc_feature (1)..(336): Public GI ID no. 10304406
  misc_feature (1)..(336): Bit score of 768.2 for HMM based on sequences of Figure 16
  misc_feature (1)..(336): Functional Homolog Of SEQ ID NO. 368
MPVDALPGSGQTVCVTGAGGFIASWIVKLLLERGYTVRGTVRNPDDPKNGHLRDLEGASERLTLYKGDLMDYGSLEEAIKGCDGVVHTASPVTDDPEQMVEPAVIGTKNVIVAAAEAKVRRVVFTSSIGAVTMDPNRGPDVVVDESCWSDLEFCKSTKNWYCYGKAVAEKARCAEAKERGVDLVVINPVLVLGPLLQSTINASIIHILKYLTGSAKTYANSVQAYVHVKDVALAHVLVLETPSASGRYLCDESVLHRGDVVEILAKFFPEYNVPTKCSDEVNPRVKPYKFSNQKLKDLGLEFTPVKQCLYETVKSLQEKGHLPVPPPPEDSVRIQG

SEQ ID NO: 422 - DNA, 1873 bp, Panicum virgatum
  misc_feature (1)..(1873): Ceres Clone ID no. 1993306
  misc_feature (1)..(1873): Encodes the peptide sequence at SEQ ID NO. 423
gccccccaggcagggtgaagaggaagaaccagaagaaggcaagtggtggtggcggcgacggcggtgatgaggatgaggagtgaggatgaaccagtagccgttacctgatataatattatctagttgtcataaacatgttggtatcttgagctcttagctgtgtggcctgatgctcagccccttgtgctgactgggcatcacggatggttatcgttttatcttgcagtgttattagcctatacctagctgctatgttttgagatgtttattcaagttgcgtttcgacttctgttgtcatcaaagctgtacctgttttctctgcaaaaaaaaggaaggatcctaccaaacctaccaactcctcctcctcgaccgatcgcccgcgcaaaggggaaacctaaaaaaaaaactaactcgccattcgccaactagctagcttaactttctctccgcttcgggcgccaccgcgatcgtgcgaggtttcgtgaagacaccagagagtagtagcgggggtgttgaggaactgatctgatcgtcgatcgtgaagacgatgaccgtggtcgacgccgtgtcgtccgcgggcgccggcgacgccgtcgcgcccgccgccgacgccgcggggcagccgccggctgcggggaacgggcagacggtgtgcgtcaccggcgcggccgggtacatcgcgtcgtggctcgtcaagctgctgctcgagaaggggtacactgtcaagggcaccgtcaggaacccagatgacccgaagaacgcgcacctcaaggcgctggacggcgccgccgagcggctcttcctctgcaaggccgacctcctggacttcgacgccatctgccgcgccgtggagggctgccagggcgtcttccacaccgcctcccccgtcaccgacgaccccgagcaaatggtggagccggcggtgcgcggcacggagtacgtgatcagggcggcggcggaggccggcacggtgcggcgggtggtgttcacgtcctccatcggcgccgtcaccatggaccccaaccgcgggcccgacgtggtggtcgacgaatcctgctggagcgacctcgacttctgcaagaaaaccaggaactggtactgctacggcaaggcggtggcggagcaggcggcgtgggatgcggcgcggcagcgcggcgtggacctggtggtggtgaacccggtgctggtggtgggcccgctgctgcagccgacggtgaacgccagcatcgcgcacatcctcaagtacctggacggctccgcccgcaccttcgccaacgccgtgcaggcctacgtcgacgtccgcgacgtcgccgccgcgcacctcctcgtcttcgaggcccccgccgcctccggccgccacctctgcgccgaccgcgtcctccaccgcgaggacgtcgtccgcatcctcgccaagctcttccccgagtaccccgtccccaccaggtgctccgacgaggtgaacccgcggaagcaggcgtacaagttctcgaaccagaagctccgggacctggggctggagttccggccggtgagccagtcgctgtacgacacggtgaagagcctccaggagaagggccacctgccggtgctcgccgagcaggcgcccgagctggaggccgagaaggaggccgccgcccccgccgccgaggtgcagcagggcgggacgatcgccatccgtgcgtgaggtccaggcagatggcgccacgaatgaacagaatgcaagccatgttcatatgctgccccggccggtgcccctgatgtgtaacccaagtagtagtgtttgttgcctgtctgatgcccctaccaagacttgtaacgtcgtgctgctcgtccttgtgaactatagtgggtgaataaatatggttaattcccc

SEQ ID NO: 423 - protein, 378 aa, Panicum virgatum
  misc_feature (35)..(275): Pfam Name: Epimerase Pfam Description: NAD dependent epimerase/dehydratase fam
  misc_feature (1)..(378): Ceres Clone ID no. 1993306
  misc_feature (1)..(378): Bit score of 713.0 for HMM based on sequences of Figure 16
  misc_feature (1)..(378): Functional Homolog Of SEQ ID NO. 368
MTVVDAVSSAGAGDAVAPAADAAGQPPAAGNGQTVCVTGAAGYIASWLVKLLLEKGYTVKGTVRNPDDPKNAHLKALDGAAERLFLCKADLLDFDAICRAVEGCQGVFHTASPVTDDPEQMVEPAVRGTEYVIRAAAEAGTVRRVVFTSSIGAVTMDPNRGPDVVVDESCWSDLDFCKKTRNWYCYGKAVAEQAAWDAARQRGVDLVVVNPVLVVGPLLQPTVNASIAHILKYLDGSARTFANAVQAYVDVRDVAAAHLLVFEAPAASGRHLCADRVLHREDVVRILAKLFPEYPVPTRCSDEVNPRKQAYKFSNQKLRDLGLEFRPVSQSLYDTVKSLQEKGHLPVLAEQAPELEAEKEAAAPAAEVQQGGTIAIRA

SEQ ID NO: 424 - DNA, 1245 bp, Oryza sativa
  misc_feature (1)..(1245): Ceres Annot ID no. 1255335
  misc_feature (1)..(1245): Encodes the peptide sequence at SEQ ID NO. 425
atccaacaaattgcctaacactaacaagcaacgatgaccgtcgtcgtcgttgccgatgacgccgccgccgccgcagcggcggcgcagcagcaggaggagctgccgccggggcacggccaaacggtgtgtgtcaccggcgccgccgggtacatcgcgtcgtggctcgtcaagctgctgctggagaggggctacaccgtgaagggcacagtgagaaacccagatgacccgaagaacgcccacctgaaggcgctggacggcgccgacgagaggctggtcctctgcaaggccgacctcctcgactacgactccatccgcgccgccgtcgacggctgccacggcgtgttccacaccgcctcccccgtcaccgatgaccctgagcagatggtggagccggcggtgcgggggacggagtacgtgataaaggcggcggcggaggccggcacggtgcgccgggtggtgttcacgtcgtccatcggcgccgtcaccatggaccccaaccgcggccccgacgtggtcgtcgacgagtcctgctggagcgacctcgagttctgcaagaaaaccaagaactggtactgctacggtaaggcggtggcagagcaggaggcgtgcaaggcggccgaagagcgcggcgtcgacctcgtcgtcgtcagccccgtgctggtggtcggcccgctgctgcagccgacggtgaacgccagcgccgtgcacatcctcaagtacctcgacggctcggccaagaagtacgccaatgccgtgcaggcgtacgtggacgtgcgcgacgtcgcggctgcgcacgtccgcgtcttcgaggcgccggaggcctccggccggcacctctgcgccgagcgcgtcctgcaccgtgaggacgtcgtccacatcctcggcaagctcttccccgagtatcctgtgcccacaaggtgctctgacgaggtgaacccacggaagcagccgtacaagatgtccaacaagaagctgcaggatcttggcctccacttcatacctgtgagcgactcgctctacgagacggtgaagagcctccaggagaaggggcaccttccagttctgagcaaagagatcccagaagagttgaatggtgtgccagcatgatactgttgaagaaacagagcatttaacgttctcctgtaacagtgttaggcatctgttgttatgtatgtaaactaagtggataacgaaaaaacatggagactatcattgaatataaacagacgtgaattctgccccttc

SEQ ID NO: 425 - protein, 357 aa, Oryza sativa
  misc_feature (31)..(270): Pfam Name: Epimerase Pfam Description: NAD dependent epimerase/dehydratase fam
  misc_feature (1)..(357): Ceres Annot ID no. 1255335
  misc_feature (1)..(357): Bit score of 704.9 for HMM based on sequences of Figure 16
  misc_feature (1)..(357): Functional Homolog Of SEQ ID NO. 368
MTVVVVADDAAAAAAAAQQQEELPPGHGQTVCVTGAAGYIASWLVKLLLERGYTVKGTVRNPDDPKNAHLKALDGADERLVLCKADLLDYDSIRAAVDGCHGVFHTASPVTDDPEQMVEPAVRGTEYVIKAAAEAGTVRRVVFTSSIGAVTMDPNRGPDVVVDESCWSDLEFCKKTKNWYCYGKAVAEQEACKAAEERGVDLVVVSPVLVVGPLLQPTVNASAVHILKYLDGSAKKYANAVQAYVDVRDVAAAHVRVFEAPEASGRHLCAERVLHREDVVHILGKLFPEYPVPTRCSDEVNPRKQPYKMSNKKLQDLGLHFIPVSDSLYETVKSLQEKGHLPVLSKEIPEELNGVPA

SEQ ID NO: 426 - DNA, 714 bp, Panicum virgatum
  misc_feature (1)..(714): Ceres Clone ID no. 1819180
  misc_feature (1)..(714): Encodes the peptide sequence at SEQ ID NO. 427
aaattcctcgacggatcgatcttgatttctcgccgccgtccgcgcatctctgccaccgccgccgccacctgcctgtttgggaggttgccaggccgcgcgcccatggccgtcaccgtgtgcgtcaccggcgccggcggcttcatcgggtcttggatcgtcaagctcctcctcgaccgcgggtacgccgtccggggcacctcccgccgcgcagatgaccccaagaacgcgcacctctgggcgctcgacggcgcggcggagcgcctcacgatgctgcaggtggacctgctcgaccgggccagcctccgcgccgccttcgacggctgcgacggcgtcatccacaccgcctcgccgatgcacgacaaccccgaggagatcatcgagccaattatcgccgggacgcggaacgtcgttgaggccgcggccgacgccggcgtgcggcgcctggtgatctcctccaccatcggcaccatgtacatgaacccgcaccgcgaccccgacgcgcccctggaggagtggagctggagcgacctcgagcactgcaagaagaccgcgaactggtactgctacgccaagacgatcgcggagcagagcgcgtggcaggcggcgcgggcgcggggcctggacctggcggtggtcatcccggtggtggtgctcggcgaactgatgcagccaagcatgaacaccagcaccctgcacatactcaagtacctcacc

SEQ ID NO: 427 - protein, 204 aa, Panicum virgatum
  misc_feature (5)..(204): Pfam Name: Epimerase Pfam Description: NAD dependent epimerase/dehydratase fam
  misc_feature (1)..(204): Ceres Clone ID no. 1819180
  misc_feature (1)..(204): Bit score of 328.1 for HMM based on sequences of Figure 16
  misc_feature (1)..(204): Functional Homolog Of SEQ ID NO. 368
MAVTVCVTGAGGFIGSWIVKLLLDRGYAVRGTSRRADDPKNAHLWALDGAAERLTMLQVDLLDRASLRAAFDGCDGVIHTASPMHDNPEEIIEPIIAGTRNVVEAAADAGVRRLVISSTIGTMYMNPHRDPDAPLEEWSWSDLEHCKKTANWYCYAKTIAEQSAWQAARARGLDLAVVIPVVVLGELMQPSMNTSTLHILKYLT

SEQ ID NO: 428 - DNA, 1472 bp, Zea mays
  misc_feature (1)..(1472): Ceres Clone ID no. 238838
  misc_feature (1)..(1472): Encodes the peptide sequence at SEQ ID NO. 429
aggatgaatcggaagagagaatcctaccaaacctagctaccaactcgatcgtcgtcatcacgctcgaccgcacaactgcaccgaggggggaggagacctaaaaactactacatcttttagctacacatctagctaaagatcgagaggggtaaataaggacgagcgggcgcgagctagaagagcagctgcaggtactaccatcatcgtcgtcgtcgtcgccaggatgaccgttgtcgacgccgtctcctccaccgatgccggcgccgccgccgccacggtaccggcggggaacgggcagaccgtgtgcgtcaccggcgcggccgggtacatcgcctcgtggttagtgaagctgctgctcgagaagggatacactgtgaagggcaccgtgaggaacccagatgacccgaagaacgcgcacctcaaggcgctggacggcgccgccgagcggctgatcctctgcaaggccgatctgctggactacgacgccatctgccgcgccgtgcagggctgccagggcgtcttccacaccgcctcccccgtcaccgacgacccggagcaaatggtggagccggcggtgcgcggcaccgagtacgtgatcaacgcggcggcggaggccggcacggtgcggcgggtggtgttcacgtcgtccatcggcgccgtgaccatggaccccaagcgcgggcccgacgtcgtggtcgacgagtcgtgctggagcgacctcgagttctgcgagaaaaccaggaactggtactgctacggcaaggcggtggcggagcaggcggcgtgggagacggcccggcggcggggcgtggacctggtggtggtgaaccccgtgctggtggtgggccccctgctgcaggcgacggtgaacgccagcatcgcgcacatcctcaagtacctggacggctcggcccgcaccttcgccaacgccgtgcaggcgtacgtggacgtgcgcgacgtggccgacgcgcacctccgcgtcttcgagagcccccgcgcgtccggccgccacctctgcgccgagcgcgtcctccaccgcgaggacgtcgtccgcatcctcgccaagctattccccgagtaccccgtcccagccaggtgctccgacgaggtgaatccgcgaaagcagccgtacaagttctccaaccagaagctccgggacctggggctgcagttccggccggtcagccagtcgctttacgacacggtgaagaacctccaggagaagggacacctgccggtgctcggagagcggacgacgacggaggccgccgacaaggatgcccccacggccgagatgcagcagggagggatcgccatccgtgcctgagagggcgatgccacacatgaacacaaagcaatgttcatactgctgccctgcacctgcaccttcccctgctgtgtaaacaggcctgtgtttgttctggctgatagtgatgtaccctaagacttgtaacgtcatgttcgttcttgtg

SEQ ID NO: 429 - protein, 367 aa, Zea mays
  misc_feature (27)..(266): Pfam Name: Epimerase Pfam Description: NAD dependent epimerase/dehydratase fam
  misc_feature (1)..(367): Ceres Clone ID no. 238838
  misc_feature (1)..(367): Bit score of 701.4 for HMM based on sequences of Figure 16
  misc_feature (1)..(367): Functional Homolog Of SEQ ID NO. 368
MTVVDAVSSTDAGAAAATVPAGNGQTVCVTGAAGYIASWLVKLLLEKGYTVKGTVRNPDDPKNAHLKALDGAAERLILCKADLLDYDAICRAVQGCQGVFHTASPVTDDPEQMVEPAVRGTEYVINAAAEAGTVRRVVFTSSIGAVTMDPKRGPDVVVDESCWSDLEFCEKTRNWYCYGKAVAEQAAWETARRRGVDLVVVNPVLVVGPLLQATVNASIAHILKYLDGSARTFANAVQAYVDVRDVADAHLRVFESPRASGRHLCAERVLHREDVVRILAKLFPEYPVPARCSDEVNPRKQPYKFSNQKLRDLGLQFRPVSQSLYDTVKNLQEKGHLPVLGERTTTEAADKDAPTAEMQQGGIAIRA

SEQ ID NO: 430 - DNA, 1273 bp, Brassica napus
  misc_feature (1)..(1273): Ceres Clone ID no. 1039956
  misc_feature (1)..(1273): Encodes the peptide sequence at SEQ ID NO. 431
gacgcattaatcattttcttcacaaaccgaagcatatactttagaccgccggaaaaatgccagtcgacgaatcctcaccggccggaaaaaccgtctgcgtcaccggagctggtggatacatagcttcttggattgttaagttactcctcgagagaggctacaccgtcaaaggaaccgtacggaatccagatgatccaaagaatacacatttgagagaactcgaaggagccaaggagagactgattctgtgcaaggcagatcttcaggactacgaggctcttaaagcggcgattgatggctgcgacggcgtgtttcacacggcttctccggtcactgacgatcccgagcaaatggtggagcctgccgtgaacggagccaagttcgtaattaatgcggctgctgaagccaaagtcaagcgcgtggtcatcacctcctcaattggtgcagtctacatggacccgaaccgtgaccctgaagccgtcgttgacgaaagttgttggagtgatcttgagttttgcaaaaacacaaagaattggtattgttacggcaagatggtggcggagcaagccgcgtgggagacggcgaaggagaaaggtgttgaccttgtggttttgaatcccgtgctggtccttggaccgccgctacagccgacgatcaacgccagtctcttccatgtcctcaagtatctaaccggctccgctaagacttacgctaatctgactcaggcttatgtggatgttcgcgatgtcgcgctggcccatgtgctggtctacgaggcaccctcggcctctggacgttatctcctcgcagagagcgcctttcaccgcggcgaagttgttgagattctggctaagttattcccggaatacccacttccgaccaagtgcaaggacgagaagaacccaagagccaagccatacaaattcactaaccaaaagattaaggacttgggcttagagttcacttccaccaagcaaagcctttatgatacagttaagagcttgcaagagaagggtcatcttcctccacctcctcctccttctacatcacaagaatcgagccaaaatggcatcaagatcgagtcttgaatagcttattccctgaagtatcatcctcagcgattgatatatgctttctatttcaaaaaaaacaaacaaacaaacagatgttttgttactgtctctgtttatgtgaaatccttgtttcaaatgtcatgtctgaattttgattttgtcttgaaggcttcaatgcttgcttcatgtttactctattt

SEQ ID NO: 431 - protein, 343 aa, Brassica napus
  misc_feature (13)..(251): Pfam Name: Epimerase Pfam Description: NAD dependent epimerase/dehydratase fam
  misc_feature (1)..(343): Ceres Clone ID no. 1039956
  misc_feature (1)..(343): Bit score of 746.5 for HMM based on sequences of Figure 16
  misc_feature (1)..(343): Functional Homolog Of SEQ ID NO. 368
MPVDESSPAGKTVCVTGAGGYIASWIVKLLLERGYTVKGTVRNPDDPKNTHLRELEGAKERLILCKADLQDYEALKAAIDGCDGVFHTASPVTDDPEQMVEPAVNGAKFVINAAAEAKVKRVVITSSIGAVYMDPNRDPEAVVDESCWSDLEFCKNTKNWYCYGKMVAEQAAWETAKEKGVDLVVLNPVLVLGPPLQPTINASLFHVLKYLTGSAKTYANLTQAYVDVRDVALAHVLVYEAPSASGRYLLAESAFHRGEVVEILAKLFPEYPLPTKCKDEKNPRAKPYKFTNQKIKDLGLEFTSTKQSLYDTVKSLQEKGHLPPPPPPSTSQESSQNGIKIES

SEQ ID NO: 432 - DNA, 1420 bp, Triticum aestivum
  misc_feature (1)..(1420): Ceres Clone ID no. 705402
  misc_feature (1)..(1420): Encodes the peptide sequence at SEQ ID NO. 433
agtacacacctcggtttggaacttggaagtcgagacacatacacacacacatactagatacatatccatacttctgttgctcattgcatctcctagttcagcaaattgccaaactgagacatgggaattgatcgtgtcaacacggcagccactggccgcggacgcaccgtctgtgtgaccggcgccggcggtttcatcgcgtcctggctagtgaagctcctcctggagaagggctacgccgtccacggcaccgtccggaaccctgatgacgtggcaaggaatgcgcacctgagagccttggaaggggcgacggagcgactgaccctcttccaggtggacctgcttgacaaggagagcctcgtcgctgctttccaaggatgcgaaggcgtattccacaccgcatgccccgtcaccgatgacccggaaaaaatgatcgagccggcagtgaacggaacgagaaacgtgttcaacgccgcggcagaggtgggcggcatccggcgtgtggtaatgacgtcgtcgatcggctccgtgtacatggatcctcgtcgtagcatcgatggggaggccgatgagacatgttggagcgacctcgagttctgcaagaacacaaagaattggtactgctatgcgaagacggtggcggagcaggccgcatgggagctcgccaaggagaggaagcttgaccttgtggtgatcaacccgtctctagtgttgggccctctgctacagatggcggtgaacgccagtacgtggcatattgccaagtatctggacggctcggtgcagacgtatgccaacgcggcacaggcgtacgtgcacgtccaggacgtcgcggacgcgcacgcgcgtgcgtacgagacgcccgatgcgcatggccggtacctctgcgcggggcgcacgctgcaccgtgccgaggtgtgtcgcatccttgccaagttcttcccggagtaccccgtgcccacgaggtgcaaggaaggggcgggcgagatgaagaagggttgtcggttcagcagtcggaggatcatggatctcggcgtcggcatcacgccggcgagccagtgtctctacgacacggtcaccagccttcaggacaagggcatcttaccacgtcgcgacgctgatatgtcctgacaactccatggtcaccttggtcaagttagcagcatgcatgcccgcttgatgattacaaagtcatggcatttaattctttatttacttcttagttgttcaaatataaggccctgtccagagcacctccaccccacaactccactccccaagttgatggagttacagttgaaaactgtggagcagctatttcctggctccacagctcccagaatttcgtggagctggtggatttccgaacaggccctaagtgtccattgtaaaagaatatgttatgatatgatgtttatcc

SEQ ID NO: 433 - protein, 336 aa, Triticum aestivum
  misc_feature (17)..(257): Pfam Name: Epimerase Pfam Description: NAD dependent epimerase/dehydratase fam
  misc_feature (1)..(336): Ceres Clone ID no. 705402
  misc_feature (1)..(336): Bit score of 639.1 for HMM based on sequences of Figure 16
  misc_feature (1)..(336): Functional Homolog Of SEQ ID NO. 368
MGIDRVNTAATGRGRTVCVTGAGGFIASWLVKLLLEKGYAVHGTVRNPDDVARNAHLRALEGATERLTLFQVDLLDKESLVAAFQGCEGVFHTACPVTDDPEKMIEPAVNGTRNVFNAAAEVGGIRRVVMTSSIGSVYMDPRRSIDGEADETCWSDLEFCKNTKNWYCYAKTVAEQAAWELAKERKLDLVVINPSLVLGPLLQMAVNASTWHIAKYLDGSVQTYANAAQAYVHVQDVADAHARAYETPDAHGRYLCAGRTLHRAEVCRILAKFFPEYPVPTRCKEGAGEMKKGCRFSSRRIMDLGVGITPASQCLYDTVTSLQDKGILPRRDADMS

SEQ ID NO: 434 - DNA, 1233 bp, Brassica napus
  misc_feature (1)..(1233): Ceres Clone ID no. 1115220
  misc_feature (1)..(1233): Encodes the peptide sequence at SEQ ID NO. 435
cgaaaaattcatcattttgcttctgcctcttcgaagaccgaagctttcactttcgaccacaccggaaaaaaaatgccagtcgacgaatctacagcggtcgggaaaacagtttgcgtcaccggagctggtggatacatcgcttcttggattgttaagttactacttgagagaggctacacggtcaaaggaaccgtacggaatccagatgatcccaagaatacacatttgagagaactcgaaggagccaaggagagactgattctgtgcaaagcagatcttcaggactacgatgctcttaagtcggctatcgatggttgtgacggcgtctttcatacggcttctccggtcactgacgatcccgagcagatggtggagccggccgtgaacggagccaagtttgtaattaatgctgcagctgaagccaaggttaagcgcgtggtaatcacctcctcaattggtgcggtctacatggacccgagccgtgaccctgaagccgtcgttgacgaaagttgctggagtgatcttgagttctgcaaaaacaccaagaattggtattgttacggcaagatggtggcggagcaagccgcgtgggagacggcagaggagaaaggtgttgacctggtggttctgaacccggtgctggttcttggaccgccgttacagccgacgatcaacgctagtctcttccacgttcttaagtatctaactggctcggctaagacttacgctaatttgactcaggcttatgtggatgttcgtgatgtcgcactagctcatgttctggtctacgaggccccctcagcctctggacgctatctcctggcggagagcgcacttcaccgcggtgaagttgttgagattctggctaagttattcccggagtacccaattccaaccaagtgtaaggacgagaagaaccctagagccaagccgtacaagttcactaatcaaaagattaaggacttaggcttagagttcacatccaccaagcaaagcctctacgacacagttaagagcttgcaagagaaaggtcatctccctcctccttcaacatctcaagaatccagccaaaatggcatcaagatcgagtcttgaataacttattccctggtgtattatccttagccactggcgtttcctttgttttagaaaaataaaccagatgtttaattattgtctctggttatgtgaaacctttgtttcaaaatgtcttgctctctgtttactcggatc

SEQ ID NO: 435 - protein, 340 aa, Brassica napus
  misc_feature (13)..(251): Pfam Name: Epimerase Pfam Description: NAD dependent epimerase/dehydratase fam
  misc_feature (1)..(340): Ceres Clone ID no. 1115220
  misc_feature (1)..(340): Bit score of 745.7 for HMM based on sequences of Figure 16
  misc_feature (1)..(340): Functional Homolog Of SEQ ID NO. 368
MPVDESTAVGKTVCVTGAGGYIASWIVKLLLERGYTVKGTVRNPDDPKNTHLRELEGAKERLILCKADLQDYDALKSAIDGCDGVFHTASPVTDDPEQMVEPAVNGAKFVINAAAEAKVKRVVITSSIGAVYMDPSRDPEAVVDESCWSDLEFCKNTKNWYCYGKMVAEQAAWETAEEKGVDLVVLNPVLVLGPPLQPTINASLFHVLKYLTGSAKTYANLTQAYVDVRDVALAHVLVYEAPSASGRYLLAESALHRGEVVEILAKLFPEYPIPTKCKDEKNPRAKPYKFTNQKIKDLGLEFTSTKQSLYDTVKSLQEKGHLPPPSTSQESSQNGIKIES

SEQ ID NO: 436 - DNA, 1140 bp, Sorghum bicolor
  misc_feature (1)..(1140): Ceres Annot ID no. 8713261
  misc_feature (1)..(1140): Encodes the peptide sequence at SEQ ID NO. 437
atgaccgtcgtcgacgccgtctccactgatgccgccggcgccgccccagctgccgccgcggcgccggtggtggtggcgcagcccgggaacgggcagaccgtgtgcgtcaccggcgcggccgggtacatcgcctcgtggctcgtcaagatgctgctcgagaagggatacactgtcaagggcaccgtcaggaacccaggcatgcttgttaactatgacccgaagaacgcgcacctcaaggcgctggacggcgcggccgagcggctgatcctctgcaaggccgacctcctggactacgacgccatctgccgcgccgtgcagggctgccagggcgtcttccacaccgcctcccccgtcaccgacgatccggagcaaatggtggagccggcggtgcgcggcacggagtacgtgatcaacgcggcggcggaggccggcacggtgcggcgggtggtgttcacgtcctccatcggcgcggtgaccatggaccccagccgcgggcccgacgtcgtggtcgacgagtcgtgctggagcgacctcgagttctgcaagaaaaccaggaactggtactgctacggcaaggcggtggcggagcaggcggcgtgggacgcggcccggcagcgcggcgtggacctggtggtggtgaacccggtgctggtggtgggcccgctgctgcagccgacggtgaacgccagcatcgcgcacgtgctcaagtacctggacggctccgcgcgcaccttcgccaacgccgtgcaggcgtacgtggacgtccgcgacgtcgccgacgcgcacctccgcgtcttcgagagccccgccgcgtccggccgatacctctgcgccgagcgcgtcctccaccgcgaggacgtcgtccgcatcctcgccaagctcttccccgagtaccccgtccccaccaggtgctccgacgaggtgaacccgcggaagcagccgtacaagttctcgaaccagaagctccgggacctgggattggagttccggccggtgagccagtcgctctacgatacggtgaagaaccttcaggagaagggccacctgccggtgctcggagagcagacgacggaggccgacaaggaggaggccaacgccgccgccgaggtgcagcagggaggaatcgccatccgtgcgtga

SEQ ID NO: 437 - protein, 379 aa, Sorghum bicolor
  misc_feature (34)..(278): Pfam Name: Epimerase Pfam Description: NAD dependent epimerase/dehydratase fam
  misc_feature (1)..(379): Ceres Annot ID no. 8713261
  misc_feature (1)..(379): Bit score of 692.7 for HMM based on sequences of Figure 16
  misc_feature (1)..(379): Functional Homolog Of SEQ ID NO. 368
MTVVDAVSTDAAGAAPAAAAAPVVVAQPGNGQTVCVTGAAGYIASWLVKMLLEKGYTVKGTVRNPGMLVNYDPKNAHLKALDGAAERLILCKADLLDYDAICRAVQGCQGVFHTASPVTDDPEQMVEPAVRGTEYVINAAAEAGTVRRVVFTSSIGAVTMDPSRGPDVVVDESCWSDLEFCKKTRNWYCYGKAVAEQAAWDAARQRGVDLVVVNPVLVVGPLLQPTVNASIAHVLKYLDGSARTFANAVQAYVDVRDVADAHLRVFESPAASGRYLCAERVLHREDVVRILAKLFPEYPVPTRCSDEVNPRKQPYKFSNQKLRDLGLEFRPVSQSLYDTVKNLQEKGHLPVLGEQTTEADKEEANAAAEVQQGGIAIRA

SEQ ID NO: 438 - DNA, 1250 bp, Zea mays
  misc_feature (1)..(1250): Ceres Clone ID no. 100960981
  misc_feature (1)..(1250): Encodes the peptide sequence at SEQ ID NO. 439
cgacgccgtcgtctcctccaccgatgccggcgcccctgctgccgccgccaccgcggtaccggcggggaacgggcagaccgtgtgcgtgaccggcgcggccgggtacatcgcctcgtggttggtgaagctgctgctcgagaagggatacactgtgaagggcaccgtcaggaacccagatgacccgaagaacgcgcacctcaaggcgctggacggcgccgccgagcggctgatcctctgcaaggccgatctgctggactacgacgccatctgccgcgccgtgcagggctgccagggcgtcttccacaccgcctcccccgtcaccgacgacccggagcaaatggtggagccggcggtgcgcggcaccgagtacgtgatcaacgcggcggcggaggccggcacggtgcggcgggtggtgttcacgtcgtccatcggcgccgtgaccatggaccccaagcgcgggcccgacgtcgtggtcgacgagtcgtgctggagcgacctcgagttctgcgagaaaaccaggaactggtactgctacggcaaggcggtggcggagcaggcggcgtgggagacggcccggcggcggggcgtggacctggtggtggtgaaccccgtgctggtggtgggccccctgctgcaggcgacggtgaacgccagcatcgcgcacatcctcwagtacctggacggctcggcccgcaccttcgccaacgccgtgcaggcgtacgtggacgtgcgcgacgtggccgacgcgcacctccgcgtcttcgagagcccccgcgcgtccggccgccacctctgcgccgagcgcgtcctccaccgcgaggacgtcgtccgcatcctcgccaagctcttccccgagtaccccgtcccagccaggtgctccgacgaggtgaatccgcggaagcagccgtacaagttctccaaccagaagctccgggacctggggctgcagttccggccggtcagccagtcgctttacgacacggtgaagaacctccaggagaagggacacctgccggtgctcggagagcggacgacgacggaggccgccgacaaggatgcccccacggccgagatgcagcagggagggatcgccatccgtgcctgagagggcgatgccacacatgaacacaaagcaatgttcatactgctgccctgcacctgctgtgtaaacaggcctgtgtttgttctggctgatagtgatgtaccctaagacttgtaacgtcatgttcgttcttgtgaactatagcgag

SEQ ID NO: 439 - protein, 367 aa, Zea mays
  misc_feature (27)..(266): Pfam Name: Epimerase Pfam Description: NAD dependent epimerase/dehydratase fam
  misc_feature (1)..(367): Ceres Clone ID no. 100960981
  misc_feature (1)..(367): Bit score of 697.5 for HMM based on sequences of Figure 16
  misc_feature (1)..(367): Functional Homolog Of SEQ ID NO. 368
  misc_feature (224)..(224): Xaa is any aa, unknown, or other
DAVVSSTDAGAPAAAATAVPAGNGQTVCVTGAAGYIASWLVKLLLEKGYTVKGTVRNPDDPKNAHLKALDGAAERLILCKADLLDYDAICRAVQGCQGVFHTASPVTDDPEQMVEPAVRGTEYVINAAAEAGTVRRVVFTSSIGAVTMDPKRGPDVVVDESCWSDLEFCEKTRNWYCYGKAVAEQAAWETARRRGVDLVVVNPVLVVGPLLQATVNASIAHILXYLDGSARTFANAVQAYVDVRDVADAHLRVFESPRASGRHLCAERVLHREDVVRILAKLFPEYPVPARCSDEVNPRKQPYKFSNQKLRDLGLQFRPVSQSLYDTVKNLQEKGHLPVLGERTTTEAADKDAPTAEMQQGGIAIRA

SEQ ID NO: 440 - DNA, 1385 bp, Panicum virgatum
  misc_feature (1)..(1385): Ceres Clone ID no. 1823576
  misc_feature (1)..(1385): Encodes the peptide sequence at SEQ ID NO. 441
agagagctagagagagagagagagacggggagcgagagatctagtgagatagcctagtgccaaccccttggaggattcttttcaccttgtaagtagcagcaacgcagtaacaggccggccgcgggcgcgttcgaatcgatcggcatgacggtcgtcgacggcggcggcgcggcggcgcccgggcgcgggcagacggtgtgcgtgaccggcgccggcgggtacatcgggtcgtggatcgtcaagctcctcctggagcggggctacgccgtccggggcaccgtgcgcaaccctgatgacgcgaagaacgcgcacctgaggacgctccccggcgcggcggagaggctggctctgtgccgcgccgacctgctcgactacgacgccatgcgggccgccgtcgccggctgccacggcgtcttccacaccgcgtcgccggtgaccgacgatccggagcaaatggtggagccggcggtgcggggcacgcgccacgtcatcgaggcggcggcggcggaggccggcacggtccgccgcgtggtgctcacgtcgtcggtcggcgccgtcgccatggaccccgggcgcgcgccggacgccgtcgtggacgagtcctgctggagcgacctcgacttctgcaggcgcaccaggaactggtactgctacgggaaggcggcggcggagcgggcggcgtgggaggcggcggcggcgcgcggggtggacctggtggtggtcgtccccgtgctggtgcagggcccggcgctgcagccagcggtgaacgccagcctcgcgcacgtgctcaagtacctcgacgggtccgtcgcgacgttcgccaacgccgtgcaggcgtacgtccacgtccgcgacgtcgccgacgcgcacgtccgcgtcttcgagacgcccggcgccgccggccgctacctctgcgccgacgccgtgctccaccgcgaggacgttgtcagaaccctccgcaagttcttccccgagtaccccgtcccggaaaggtgctctgacgaggtgaacccaaggaagcagccgtacaagatatcgaaccagcggctgagggatctaggcatggagttcacgccggcggcgcaggccctgtacgagaccgtcatatgcttccaggagaagggcatcctcccagtccctgctactgctactccgtcgccgtcgtcgctgccctgatcgctgagctacacatttcaggcgctgattcgatcggttcgataaaaaaaaaatgtagcagtcaatgtaatgtattccgttgtggtgggcttcaggtaccgaagtgcttaagattgagcagcagcagttttagtttttatgtcgtctgcagctagatttgatctcgaaataagcaaatgaaacaagatggcatgcatgcagtatgatcc

SEQ ID NO: 441 - protein, 343 aa, Panicum virgatum
  misc_feature (18)..(258): Pfam Name: Epimerase Pfam Description: NAD dependent epimerase/dehydratase fam
  misc_feature (1)..(343): Ceres Clone ID no. 1823576
  misc_feature (1)..(343): Bit score of 661.2 for HMM based on sequences of Figure 16
  misc_feature (1)..(343): Functional Homolog Of SEQ ID NO. 368
MTVVDGGGAAAPGRGQTVCVTGAGGYIGSWIVKLLLERGYAVRGTVRNPDDAKNAHLRTLPGAAERLALCRADLLDYDAMRAAVAGCHGVFHTASPVTDDPEQMVEPAVRGTRHVIEAAAAEAGTVRRVVLTSSVGAVAMDPGRAPDAVVDESCWSDLDFCRRTRNWYCYGKAAAERAAWEAAAARGVDLVVVVPVLVQGPALQPAVNASLAHVLKYLDGSVATFANAVQAYVHVRDVADAHVRVFETPGAAGRYLCADAVLHREDVVRTLRKFFPEYPVPERCSDEVNPRKQPYKISNQRLRDLGMEFTPAAQALYETVICFQEKGILPVPATATPSPSSLP

SEQ ID NO: 442 - DNA, 1370 bp, Arabidopsis thaliana
  misc_feature (1)..(1370): Ceres Clone ID no. 34141
  misc_feature (1)..(1370): Encodes the peptide sequence at SEQ ID NO. 443
aatatatacgaaacgtaccacaaatttctaactaaagcattcatagtctctcgaaagcctcttttcagaaccgaagctctttactttcgtccaccgggaaatatgccagtcgacgtagcctcaccggccggaaaaaccgtctgcgtcaccggagctggtggatacatcgcttcttggattgttaagatacttctcgagagaggttacacagtcaaaggaaccgtacggaatccagatgatccgaagaacacacatttgagagaactagaaggaggaaaggagagactgattctgtgcaaagcagatcttcaggactacgaggctcttaaggcggcgattgatggttgcgacggcgtctttcacacggcttctcctgtcaccgacgatccggaacaaatggtggagccggccgtgaatggagccaagtttgtaattaatgctgcggctgaggccaaggtcaagcgcgtggtcatcacctcctccattggtgccgtctacatggacccgaaccgtgaccctgaggctgtcgttgacgaaagttgttggagtgatcttgacttctgcaaaaacaccaagaattggtattgttacggcaagatggtggcggaacaagcggcgtgggagacagcaaaggagaaaggtgttgacttggtggtgttgaatccggtgctggttcttggaccgccgttacagccgacgatcaacgccagtctttaccacgtcctcaaatatctaaccggctcggctaagacttatgctaatttgactcaagcttatgtggatgttcgcgatgtcgcgctggctcatgttctggtctatgaggcaccctcggcctccggacgttatctcctagccgagagtgctcgccaccgcggggaagttgttgagattctggctaagctattcccggagtatcctcttccgaccaagtgcaaggacgagaagaaccctagagccaagccatacaaattcactaaccagaagattaaggacttaggcttagagttcacttccaccaagcaaagcctctacgacacagtcaagagcttacaagagaaaggccatcttgctcctcctcctcctcctccttcagcatcgcaagaatccgtggaaaatggcattaagatcgggtcttgaaaagcttattaattccctcaagtatcccccttaagtatccttaaccattgaagttgcttttgtttgttgtctctggttatgtgaaacctctgtttcaatatgtctcgtctggttatgaatctgtacactcagttctttggccaaaccgtttgatgtattttgtagtcaagtcttcatgtttgatctatgtaatagattacacttaagtaaacaacttcatttttattctatgc

SEQ ID NO: 443 - protein, 344 aa, Arabidopsis thaliana
  misc_feature (13)..(251): Pfam Name: Epimerase Pfam Description: NAD dependent epimerase/dehydratase fam
  misc_feature (1)..(344): Ceres Clone ID no. 34141
  misc_feature (1)..(344): Bit score of 736.3 for HMM based on sequences of Figure 16
  misc_feature (1)..(344): Functional Homolog Of SEQ ID NO. 368
MPVDVASPAGKTVCVTGAGGYIASWIVKILLERGYTVKGTVRNPDDPKNTHLRELEGGKERLILCKADLQDYEALKAAIDGCDGVFHTASPVTDDPEQMVEPAVNGAKFVINAAAEAKVKRVVITSSIGAVYMDPNRDPEAVVDESCWSDLDFCKNTKNWYCYGKMVAEQAAWETAKEKGVDLVVLNPVLVLGPPLQPTINASLYHVLKYLTGSAKTYANLTQAYVDVRDVALAHVLVYEAPSASGRYLLAESARHRGEVVEILAKLFPEYPLPTKCKDEKNPRAKPYKFTNQKIKDLGLEFTSTKQSLYDTVKSLQEKGHLAPPPPPPSASQESVENGIKIGS

SEQ ID NO: 444 - DNA, 1272 bp, Arabidopsis thaliana
  misc_feature (1)..(1272): Ceres Clone ID no. 32255
  misc_feature (1)..(1272): Encodes the peptide sequence at SEQ ID NO. 445
actactctcttaagccctttcataaccttgtaaaccattaagaggctttgctcaattacaagaagaagaaaaaatgcctgtcgacgggaaactcgtctgcgtcaccggagccggcggctacattgcttcttggatcgttaagttactcttagagagaggctacaccgttagaggaaccgtaaggaacccaactgatcccaagaacaaccatctcagagagcttcaaggagccaaggaaagactcactcttcacagtgcagatcttctcgactacgaagctctctgtgccgcaatcgacggttgcgatggcgttttccacactgcctctccgatgaccgacgatcccgagacaatgttggagccggcggtgaacggagccaagttcgtgattgacgcagcggctaaagccaaggtcaagcgcgtggttttcacgtcatcaattggtgcagtttacatgaaccctaaccgtgacactcaagccattgttgacgaaaactgctggagtgatcttgatttctgcaaaaacactaagaattggtattgctacgggaagatgttggcggaacaatcggcgtgggagacggccaaagcaaaaggtgtggacttagtggtgctaaatccggttttggttctcggaccaccgctccagtcagcgatcaacgctagtctagtccatattctcaagtacctcaccggctcagccaagacctacgctaacttgactcaggtctacgtggacgtccgtgacgtggcactaggccatgttctggtctacgaagcaccctccgcctcaggccgttacatcctcgccgagaccgcacttcaccgcggagaggttgttgagattctggccaaattcttcccggagtatccacttcccaccaagtgttcggacgagaagaatccgagggctaagccatacaagtttactacccaaaagataaaagacttaggcttggaatttaaacccatcaagcaatctctttacgaatatgtcaagagcttgcaagagaaaggtcatcttcctctacctcaagattcgaaccaaaacgaagtcatcatcgaaccttaggacacgatccacgaccctagaatctcttcatacctacatgaaaagctttattcttaagtaatacatacgttttggttttgactaaagtattgttaaatcttaaatcattatatatagctgattgttctttctttctttggttgtaattgagaatatgttacgcatatgtattatacgataatggaagcaatggttttatc

SEQ ID NO: 445 - protein, 332 aa, Arabidopsis thaliana
  misc_feature (8)..(246): Pfam Name: Epimerase Pfam Description: NAD dependent epimerase/dehydratase fam
  misc_feature (1)..(332): Ceres Clone ID no. 32255
  misc_feature (1)..(332): Bit score of 717.6 for HMM based on sequences of Figure 16
  misc_feature (1)..(332): Functional Homolog Of SEQ ID NO. 368
MPVDGKLVCVTGAGGYIASWIVKLLLERGYTVRGTVRNPTDPKNNHLRELQGAKERLTLHSADLLDYEALCAAIDGCDGVFHTASPMTDDPETMLEPAVNGAKFVIDAAAKAKVKRVVFTSSIGAVYMNPNRDTQAIVDENCWSDLDFCKNTKNWYCYGKMLAEQSAWETAKAKGVDLVVLNPVLVLGPPLQSAINASLVHILKYLTGSAKTYANLTQVYVDVRDVALGHVLVYEAPSASGRYILAETALHRGEVVEILAKFFPEYPLPTKCSDEKNPRAKPYKFTTQKIKDLGLEFKPIKQSLYEYVKSLQEKGHLPLPQDSNQNEVIIEP

SEQ ID NO: 446 - DNA, 1476 bp, Triticum aestivum
  misc_feature (1)..(1476): Ceres Clone ID no. 785059
  misc_feature (1)..(1476): Encodes the peptide sequence at SEQ ID NO. 447
aagcgcttccaactgcagaggcgctgttctcatctgaagtgtaaggagtatactcattcaactaaccgtccggggaggagatctttgtgccgcgccgcctcgtacgccccagcaaggagccagcatgaccgtcggcggcgaggccacagccacaggcaacgggcagacagtgtgcgtgaccggcgccggcggctacatcgggtcgtggatcgtcaagctcctgctcgagaaggggtacgccgtgcgaggcaccgtcaggaaccccgatgacgccaagaacgcgcacctgaggggcctcgccggcgcggtggagcgtctggtgctgtgcaaggccgacctgctcgacggcgacgcgctgcgcgccgccatcgccggctgccatggcgtcttccacaccgcctcgccggttaccgacgatccagaggagatggtggagccggcggtgaggggcacgcgctacgtcatcgacgccgcggcggagtccggcacggtccgccgcgtcgtgctgacgtcgtccatcggcgccgtcgccatggaccccagccgcggcccggacgccgtcgtcgacgagtcgtgctggagcgacctcgagttctgcaagaagaccaagaactggtactgctacgggaagacggtggcggagcgggaggcgtgggaggcagcggcggcgcgcggggtggacctggtggtggtgaacccggtgctggtgcagggcccggcgctgcagccagcggtgaacgccagcctgacgcacgtgctcaagtacctggacggctccgccaagacgtacgccaacgccgtgcaggcgtacgtgcacgtccgggacaccgccgccgcgcacgtcctcgtcttcgagtcccccgctgccgccggccgctacctctgcgtggccgacggcgccgtgctccaccgggaggacgtcgtcaccatcctccgcaagttcttccccgagtaccccatccccagcaggtgctctgacgaggtgaacccgagtaagcagccgtacaagatgtcgaacaagcggctccgtgagctgggcctcgagttcacgccggtggcgcagtgcctctacgacaccgtcgtcagcttccaggagaagggcgtcctcccggcccctcccgcctcggcaaagccggccatgaaagagaccaactgacagagtagtaatacttctagtaattacaaagaagcatccatggatgaatgaaatccttcagctatgtattggcatgccattctgattctggtgatcctacagccaggagctagggcatccgacggctcgcaaagacagccgtcgtcccaaaaacaaactagggataagcagacacactagacaaagctcacgaaaggaatggatccgatgcccatggcactgtgattggagcagtcgtggcgggtggtatgtgacgatgtcagaccgccttgtcaagcttaccgttggattacttttttccatgaagaatcaaatttatt

SEQ ID NO: 447 - protein, 343 aa, Triticum aestivum
  misc_feature (16)..(256): Pfam Name: Epimerase Pfam Description: NAD dependent epimerase/dehydratase fam
  misc_feature (1)..(343): Ceres Clone ID no. 785059
  misc_feature (1)..(343): Bit score of 673.0 for HMM based on sequences of Figure 16
  misc_feature (1)..(343): Functional Homolog Of SEQ ID NO. 368
MTVGGEATATGNGQTVCVTGAGGYIGSWIVKLLLEKGYAVRGTVRNPDDAKNAHLRGLAGAVERLVLCKADLLDGDALRAAIAGCHGVFHTASPVTDDPEEMVEPAVRGTRYVIDAAAESGTVRRVVLTSSIGAVAMDPSRGPDAVVDESCWSDLEFCKKTKNWYCYGKTVAEREAWEAAAARGVDLVVVNPVLVQGPALQPAVNASLTHVLKYLDGSAKTYANAVQAYVHVRDTAAAHVLVFESPAAAGRYLCVADGAVLHREDVVTILRKFFPEYPIPSRCSDEVNPSKQPYKMSNKRLRELGLEFTPVAQCLYDTVVSFQEKGVLPAPPASAKPAMKETN

SEQ ID NO: 448 - DNA, 1391 bp, Triticum aestivum
  misc_feature (1)..(1391): Ceres Clone ID no. 763048
  misc_feature (1)..(1391): Encodes the peptide sequence at SEQ ID NO. 449
agcgctccccacgcatacgttgttctcatctgcctgactagttgatatcgccaacacatctattcattcacctaaccgaccggaggggagatctttgtgccgcaccgcgccgcgccggacaggagccagcatgaccgtcggcggcgaggccacggggcacgggcagacggtgtgcgtgaccggcgccggcggctacatcgggtcgtggatcgtcaagctcctgctcgagaaggggtacgccgtacgaggcaccgtcaggaacccagatgacgcgaagaacgcgcacctgaggggcctcgccggcgcggcggagcggctggtgctgtgcaaggcggacctgctcgacggcgacgcgctgcgcgccgccatcgccggctgccacggcgtcttccacaccgcctcgccggttaccgacgatcccgaggagatggtggagccggcggtgagaggcacgcgctacgtcatcgacgccgcggcggagtccagcacggtccgccgcgtcgtgctgacgtcgtccatcggcgccgtcgccatggaccccagccgcgccccggacgccgtcgtcgacgagtcgtgctggagcgacctcgagttctgcaagaaaaccaagaactggtactgctacgggaagacggtggcggagcgggaggcgtgggaggcggcggcggcgcgcggggtggacctggtggtggtgaacccggtgctggtgcagggcccggcgctgcagccggcggtgaacgccagcctcacgcacgtgctcaagtacctggacggctccgccaagacgtacgcgaacgccgtgcaggcgtacgtgcacgtccgcgacaccgccgccgcgcacgtcctcgtcttcgagtcccccgccgccgccgggcgctacctctgcgtggccgacggcgccgtgctccaccgggaggacgtcgtcaccatcctccgcaagttcttccccgagtaccccatccccagcaggtgctcggacgaggtgaacccgaggaagcagccgtacaagatgtcgaaccagcggctccgtgagctgggcctggagttcacgccggtggcgcagtgcctctacgacaccgtcgtcagcttccaggagaagggcgtcctcccggcccctcctgccccggcacagccggcgacgaaagagatcaactgagagagtagtagtagtccttttactagtaactcagaagtatccatgcatgggtgaaaatctccagctatgtaacgcaacggcatgccattctggtgcctgctagctgttgcgccaagttgtagaatcaccgtatttgcacgttcgaaactttaagtagcatgcagttcggaaaggtgtggctactctccaaattaaaggaaacttgcgatgggacgctgtgctccttggtagcact

SEQ ID NO: 449 - protein, 341 aa, Triticum aestivum
  misc_feature (14)..(254): Pfam Name: Epimerase Pfam Description: NAD dependent epimerase/dehydratase fam
  misc_feature (1)..(341): Ceres Clone ID no. 763048
  misc_feature (1)..(341): Bit score of 678.3 for HMM based on sequences of Figure 16
  misc_feature (1)..(341): Functional Homolog Of SEQ ID NO. 368
MTVGGEATGHGQTVCVTGAGGYIGSWIVKLLLEKGYAVRGTVRNPDDAKNAHLRGLAGAAERLVLCKADLLDGDALRAAIAGCHGVFHTASPVTDDPEEMVEPAVRGTRYVIDAAAESSTVRRVVLTSSIGAVAMDPSRAPDAVVDESCWSDLEFCKKTKNWYCYGKTVAEREAWEAAAARGVDLVVVNPVLVQGPALQPAVNASLTHVLKYLDGSAKTYANAVQAYVHVRDTAAAHVLVFESPAAAGRYLCVADGAVLHREDVVTILRKFFPEYPIPSRCSDEVNPRKQPYKMSNQRLRELGLEFTPVAQCLYDTVVSFQEKGVLPAPPAPAQPATKEIN

SEQ ID NO: 450 - DNA, 1014 bp, Sorghum bicolor
  misc_feature (1)..(1014): Ceres Annot ID no. 8735461
  misc_feature (1)..(1014): Encodes the peptide sequence at SEQ ID NO. 451
atgaccgtcgtgggaggcgacgacgcggcggcggcggcggcgggacgcgggcagacgacgacggtgtgcgtgaccggcgccggcggctacgtcgggtcgtggatcgtcaagctcctgctcgagaggggggcagacgacgcgaagaacgcgcacctgagggcgcttcccggcgcgacggagaggctggcgctgtgcaaggccgatctgctcgactacgacacgctgcgggcggccatcgctggctgccacggcgtcttccataccgcgtcgcccgttaccgacgatccagaggaaatggtggagccagcggtgacagggacgcgctacatcatcgacgccgcggccgaggccggcacggtccgccgcgtcgtcctgacctcgtccatcggcgcggtcgccatggatcccaaccgctcgccggacgccgtcgtcgacgagtcgtgctggagcgacctcgacttctgcaagaagaccaagaactggtactgctacgggaaggcggtggcggagcaggcggcgtgggaggaggcggcggcgcgcggggtggacctggtggtggtgaacccggtgctggtgcaggggccggcgctgcagccgtcggtgaacgccagcctgatgcacgtgctcaagtacctgaacggctccgccaagacgtacgccaacgccgtgcaggcgtacgtgcacgtccgcgacgccgccgacgcgcacgtccgcgtcttcgaggcgccgcacgccgccggccggtacatctgcgccgacggcgccgtgctccaccgcgaggacgtcgtcaggacgctccgcaagttcttcccggactaccccgtcccggaaaggtgctctgatgaggtgaacccaaggaagcagccgtacaagatatccaaccagaagctgagggacttgggcttggagttcacgccggcggcgcaggccctgtacgacaccgtcatatgcttccaggagaagggcatcatccctatccctgccccaacgccgtcgccgtcgccggaggcctga

SEQ ID NO: 451 - protein, 337 aa, Sorghum bicolor
  misc_feature (22)..(252): Pfam Name: Epimerase Pfam Description: NAD dependent epimerase/dehydratase fam
  misc_feature (1)..(337): Ceres Annot ID no. 8735461
  misc_feature (1)..(337): Bit score of 637.8 for HMM based on sequences of Figure 16
  misc_feature (1)..(337): Functional Homolog Of SEQ ID NO. 368
MTVVGGDDAAAAAAGRGQTTTVCVTGAGGYVGSWIVKLLLERGADDAKNAHLRALPGATERLALCKADLLDYDTLRAAIAGCHGVFHTASPVTDDPEEMVEPAVTGTRYIIDAAAEAGTVRRVVLTSSIGAVAMDPNRSPDAVVDESCWSDLDFCKKTKNWYCYGKAVAEQAAWEEAAARGVDLVVVNPVLVQGPALQPSVNASLMHVLKYLNGSAKTYANAVQAYVHVRDAADAHVRVFEAPHAAGRYICADGAVLHREDVVRTLRKFFPDYPVPERCSDEVNPRKQPYKISNQKLRDLGLEFTPAAQALYDTVICFQEKGIIPIPAPTPSPSPEA

SEQ ID NO: 452 - DNA, 837 bp, Populus balsamifera subsp. trichocarpa
  misc_feature (1)..(837): Ceres Annot ID no. 1483659
  misc_feature (1)..(837): Encodes the peptide sequence at SEQ ID NO. 453
atgcctgtcgatatttcatcacttccatgccaaggccaaactgtctgtgtcaccggggctggtggcttcattgcttcatggattgttaaacttcttctagagaaaggttactctgttaaaggaactgtgaggaacccagctgatcccaagaattcccatttgagggagcttgagggagctcaagaaagattaactttatgcaaggctgatctccttgattatgagtctcttaaagaggctattcaagggtgtgatggagttttccatactgcttctcctgtcacagacgatccagagcaaatgctggagccagcagtgaatggaaccaagaatgtgatcatggcagcagctgaggcccaagtccgacgagtggttttcacgtcttcaattggtactgtgtacatggaccccaataggagccctgatgttgtcgttgatgaatcttgctggagtgatcttgagttctgcaagaacaccaagaattggtattgctatggaaagactgtggcagaacaggttgcatgggatgtggctaagaagaaaggagttgacctagtggtggtgaacccagtggtggtgcttggaccattgttgcaacccactgtcaatgctagcatccttcacatcctcaagtacctaaccggctcagccaagacatatgctaactctgttcaagcttatgtgcatgttagggatgtggcggtagcccacattttagtcttcgagacaccttctgcctccggccgttacatttgctttgagaaaatgcttcaccgtggagaggttgtggaaatccttgcaatgttcttcccggagtatcccatccccaccaagtaa

SEQ ID NO: 453 - protein, 278 aa, Populus balsamifera subsp. trichocarpa
  misc_feature (15)..(253): Pfam Name: Epimerase Pfam Description: NAD dependent epimerase/dehydratase fam
  misc_feature (1)..(278): Ceres Annot ID no. 1483659
  misc_feature (1)..(278): Bit score of 597.9 for HMM based on sequences of Figure 16
  misc_feature (1)..(278): Functional Homolog Of SEQ ID NO. 368
MPVDISSLPCQGQTVCVTGAGGFIASWIVKLLLEKGYSVKGTVRNPADPKNSHLRELEGAQERLTLCKADLLDYESLKEAIQGCDGVFHTASPVTDDPEQMLEPAVNGTKNVIMAAAEAQVRRVVFTSSIGTVYMDPNRSPDVVVDESCWSDLEFCKNTKNWYCYGKTVAEQVAWDVAKKKGVDLVVVNPVVVLGPLLQPTVNASILHILKYLTGSAKTYANSVQAYVHVRDVAVAHILVFETPSASGRYICFEKMLHRGEVVEILAMFFPEYPIPTK

SEQ ID NO: 454 - DNA, 1017 bp, Sorghum bicolor
  misc_feature (1)..(1017): Ceres Annot ID no. 8682158
  misc_feature (1)..(1017): Encodes the peptide sequence at SEQ ID NO. 455
atgtcgtcgtcctccgcctgcggtgatgaggaggaggaggagcagcagcagctggtctgcgtgaccggcgccggcggcttcatcggttcgtgggtggtcaaggagctgctccagcgcggctaccttgtcaggggaactgcaaggaaccctgagcacggcaagaacgcgcacctgctggctctggacggcgccaaggagcgtctcaccctgtgccgcgccgacgtcctcgacagcgcctccctccgcgccgccttcgtcggctgccacggcgtcttccacgtcgcctccccggtctccaacgacccggagctggttccggtggcggtggagggcacccggaacgtcatcaccgccgcggcggacgagggcgtgcgccgcgtcgtcttcacctcctcctacggcgccgtccacatggaccccaaccgcagccccgacgccgtcctcgacgagacctgctggagcgactacgacttctgcaagcgatcagacaacctgtactgctgcgccaagatgatggcggagatcacggcgacggaggtggcggcggcccgggggctgcagctggcagtggtggtgccgtgcataaccttggggccaatgctgcagcagacgctcaacgtcagcacccaccacatcttgcgctacgtcatgggcaccaagaggtccatccccaacgccgtcgccgcctacgtcgacatccgcgacgtcgcgcgcgcgcacgtcctcgcctacgagcgccccgccgcgcgcggccggtacctctgcatcggcaccgtgctgcaccgcgcacagctcgtcgccatgctcagggacctcttccccaagtaccccgtcacggccaagtgcgaagacgacggtaagccaatggtgaagccgtacaggttctccaaccagaggctcagagacctgggcttggaattcactccgctgagggagagcctgtacgagactgtggtgtgcttgcagcagaagggccacctgcctgtcatcaaacaaaaacaacgtgcgtgcttgtaa

SEQ ID NO: 455 - protein, 338 aa, Sorghum bicolor
  misc_feature (19)..(257): Pfam Name: Epimerase Pfam Description: NAD dependent epimerase/dehydratase f
  misc_feature (1)..(338): Ceres Annot ID no. 8682158
  misc_feature (1)..(338): Bit score of 544.4 for HMM based on sequences of Figure 16
  misc_feature (1)..(338): Functional Homolog Of SEQ ID NO. 368
MSSSSACGDEEEEEQQQLVCVTGAGGFIGSWVVKELLQRGYLVRGTARNPEHGKNAHLLALDGAKERLTLCRADVLDSASLRAAFVGCHGVFHVASPVSNDPELVPVAVEGTRNVITAAADEGVRRVVFTSSYGAVHMDPNRSPDAVLDETCWSDYDFCKRSDNLYCCAKMMAEITATEVAAARGLQLAVVVPCITLGPMLQQTLNVSTHHILRYVMGTKRSIPNAVAAYVDIRDVARAHVLAYERPAARGRYLCIGTVLHRAQLVAMLRDLFPKYPVTAKCEDDGKPMVKPYRFSNQRLRDLGLEFTPLRESLYETVVCLQQKGHLPVIKQKQRACL

SEQ ID NO: 456 - DNA, 727 bp, Panicum virgatum
  misc_feature (1)..(727): Ceres Clone ID no. 1996254
  misc_feature (1)..(727): Encodes the peptide sequence at SEQ ID NO. 457
acatgaccggcggcttctgctcgcgttcggcgccatttccgcgagtttaccgtacccgctccgctccgccccgccaataaatcctccccgaaattcctcgacggatcgatcttgatttctcgccgccgtccgcgcatctctgccaccgccgccaccacctgcctgtttgggaggttgccaggccgcgcgcccatggccgtcaccgtgtgcgtcaccggcgccggcggcttcatcgggtcttggatcgtcaagctcctcctcgaccgcgggtacgccgtccggggcacctcccgccgcgcagatgatcccaagaacgcgcacctctgggcgctcgacggcgcggcggagcgcctcacgatgctgcaggtggacctgctcgaccgggccagcctccgcgccgccttcgacggctgcgacggcgtcatccacaccgcctcgccgatgcacgacaaccccgaggagatcatcgagccaattatcgccgggacacggaacgtcgtggaggccgcggccgacgccggcgtgcggcgcctggtgatctcttccaccatcggcaccatgtacatgaacccgcaccgcgaccccgacgcgcccctggacgagtggagctggagcgacctcgagcactgcaagaagaccgcgaactggtactgctacgccaagacgatcgcggagcagagcgcgtgggaggcggcgcgggcgcgggggctggacctggcgggtggtc

SEQ ID NO: 457 - protein, 178 aa, Panicum virgatum
  misc_feature (5)..(176): Pfam Name: Epimerase Pfam Description: NAD dependent epimerase/dehydratase family
  misc_feature (1)..(178): Ceres Clone ID no. 1996254
  misc_feature (1)..(178): Bit score of 225.3 for HMM based on sequences of Figure 16
  misc_feature (1)..(178): Functional Homolog Of SEQ ID NO. 368
MAVTVCVTGAGGFIGSWIVKLLLDRGYAVRGTSRRADDPKNAHLWALDGAAERLTMLQVDLLDRASLRAAFDGCDGVIHTASPMHDNPEEIIEPIIAGTRNVVEAAADAGVRRLVISSTIGTMYMNPHRDPDAPLDEWSWSDLEHCKKTANWYCYAKTIAEQSAWEAARARGLDLAGG

SEQ ID NO: 458 - DNA, 996 bp, Sorghum bicolor
  misc_feature (1)..(996): Ceres Annot ID no. 8682157
  misc_feature (1)..(996): Encodes the peptide sequence at SEQ ID NO. 459
atgtcgtccaactgcggtgaggagaaggagctggtctgcgtgaccggcgccggcggcttcatcggctcctgggtggtcaaggagttgctccagcgtggctaccgtgtcaggggaactgcgagggaccctgcggacagcaagaacgcccacctgctggctctggatggcgccaaggagcgcctcaccctgtgccgcgccgacgtcctcgaccgcgcctccctccacgccgccttcgccggctgcaacggcgtcttccacgtcgcctccccggtctccaacgacccggagctggtgccggtggcggtggagggcacccggaacgtcatcaacgccgcggcggacgaaggcgcgcgccgcgtcgtcttcacctcctcctacggcgccgtccacatggaccccaaccgtagccccgacgccgtcctcgacgagacatgctggagcgactacgacttctgcaagcgatcagacaacctgtactgctgcgccaagatgatggcggagatcacggcgacggaggaggcggcggcgcgggggctgcagctggccgtggtgcttccctgcatgaccatgggccccatgctgcagcagacgctcaacttcagcaccaaccacgtcgcgcgctacctcatgggcaccaagcgctccatccccaacgccgtcgccgcctacgtcgacgtccgcgacgtcgcgcgcgcgcacgtcctcgcctacgagcgccccagcgcgtgcggacgctacctctgcatcggcaccgtgctgcaccgcgaacagctcgtcgccatgctcaaggaactcttcccgcagtaccccgtcacagccaagtgcgaggacgacggcaagccgatggcgaagccgttcaagttctccaaccagaggctcagggacctgggcttggagttcactccgctcaggaagagcttgtacgagaccgtggtgtgcctgcagcagaagggtcacctgcctgtcatccaacaacagcagcgcgcgtacttgtaa

SEQ ID NO: 459 - protein, 331 aa, Sorghum bicolor
  misc_feature (12)..(250): Pfam Name: Epimerase Pfam Description: NAD dependent epimerase/dehydratase fam
  misc_feature (1)..(331): Ceres Annot ID no. 8682157
  misc_feature (1)..(331): Bit score of 543.1 for HMM based on sequences of Figure 16
  misc_feature (1)..(331): Functional Homolog Of SEQ ID NO. 368
MSSNCGEEKELVCVTGAGGFIGSWVVKELLQRGYRVRGTARDPADSKNAHLLALDGAKERLTLCRADVLDRASLHAAFAGCNGVFHVASPVSNDPELVPVAVEGTRNVINAAADEGARRVVFTSSYGAVHMDPNRSPDAVLDETCWSDYDFCKRSDNLYCCAKMMAEITATEEAAARGLQLAVVLPCMTMGPMLQQTLNFSTNHVARYLMGTKRSIPNAVAAYVDVRDVARAHVLAYERPSACGRYLCIGTVLHREQLVAMLKELFPQYPVTAKCEDDGKPMAKPFKFSNQRLRDLGLEFTPLRKSLYETVVCLQQKGHLPVIQQQQRAYL

SEQ ID NO: 460 - DNA, 1227 bp, Oryza sativa
  misc_feature (1)..(1227): Ceres Annot ID no. 1224770
  misc_feature (1)..(1227): Encodes the peptide sequence at SEQ ID NO. 461
agagatgcgaagcagatatcagctgtaagcaaagcctactagtactagttacggcagagcagagaacaggcggccgaaccgatcgacgacgatggtcaccggccggagcgagcagatggtgtgcgtgaccggcgccggtggcttcatcgggtcgtggctggtgaaggagctcctccaccgcggatacttcgtgaggggagccatgagagaacctgcggacatcaagaatgctcatttgcatgttctggatggagctagagaaggcctgtccctctaccgagctgatgtgctcgaccgcaacagccttcgtgctgcgttcgccttatgcgatggcgttttccacgtggcatcgccagtctcaaatgaccctgaacttctgccagctgctatcgagggaaccaagaatgtcatcaacgctgctgcggacatgggcgtcaagcgtgtggtgtttacttcgtcttatggtgctgtccatatgaaccctaacagaagatctgaccagattgttgatgagagctgttggagtgaccttgagttctgcaaacaaacacagaactggtattgctacgcgaagatgttggccgagaggacggcgatggaggaggcgtcgaagagaggtgtgaatctgttggtggtcgtgccggccgtcaccgtgggggagatgctgcagccgacgctgaacgccagcgtccacagggtggccacctacatgaggggcaccaagagtgcgtacccgaacgccgtcgccgcgtacgtcgacgtgcgcgacgtcgcccgcgcgcacgcgctggtgtacgagcaccccgacgcgcgtggccgctacctctgcatcggcagcgtgctgcaccggtccgagtttgttcgcttgcttagggagctcttcccccagtaccctatcacctccagatgtaaggacaacagtaagccaatggtgaaaccatacaaattctctgtacaaaggctggagactttaggcatgcagttcactcctttgaaagagagtttatacagaacggtaataagcttacaagacaagggtcatctacctgcagcaatctcacgccgttcagccctgtgaatcatgatcagccctgggaagatttgaataaattgattgcgaatcatgatcagatataaattaaagggaagatttgaataaactgaatctgcgtgtatgcattgtgaaaaggaatggagttgaatcctagtgagtcaatgattatcgtt

SEQ ID NO: 461 - protein, 328 aa, Oryza sativa
  misc_feature (10)..(248): Pfam Name: Epimerase Pfam Description: NAD dependent epimerase/dehydratase fam
  misc_feature (1)..(328): Ceres Annot ID no. 1224770
  misc_feature (1)..(328): Bit score of 545.3 for HMM based on sequences of Figure 16
  misc_feature (1)..(328): Functional Homolog Of SEQ ID NO. 368
MVTGRSEQMVCVTGAGGFIGSWLVKELLHRGYFVRGAMREPADIKNAHLHVLDGAREGLSLYRADVLDRNSLRAAFALCDGVFHVASPVSNDPELLPAAIEGTKNVINAAADMGVKRVVFTSSYGAVHMNPNRRSDQIVDESCWSDLEFCKQTQNWYCYAKMLAERTAMEEASKRGVNLLVVVPAVTVGEMLQPTLNASVHRVATYMRGTKSAYPNAVAAYVDVRDVARAHALVYEHPDARGRYLCIGSVLHRSEFVRLLRELFPQYPITSRCKDNSKPMVKPYKFSVQRLETLGMQFTPLKESLYRTVISLQDKGHLPAAISRRSAL

SEQ ID NO: 462 - DNA, 1151 bp, Zea mays
  misc_feature (1)..(1151): Ceres Clone ID no. 100877847
  misc_feature (1)..(1151): Encodes the peptide sequence at SEQ ID NO. 463
accgagagagggagggagagagagaacctgacactgagactgaagcatcggcgctagctagcttgggcagcaacatcacgatgtcgtccaactgcggcgaggatgagaaggagctggtgtgcgtgaccggcgccggcggcttcatcggctcgtgggtggtgaatgagctgctccagcggggttaccgcgtcaggggaaccgcgagggaccctgcggacagcaagaacgcgcacctgctggctctggagggagccaaggagcgcctcaccctgtgccgcgccgacgtcctcgaccgcgcctccctgcgcgccgccttcgccggctgccacggcgtcttccacgtcgcctccccggtgtccaacgacccggagcttgtcccggtggcggtggagggcaccaggaacgtcatcaacgccgcggcggacgagggcgcgcgccgtgtcgtcttcacctcctcctatggcgccgtgcacatggaccccagccggagccccgacgccgtcctcgacgagacctgctggagcgactacgacttctgcaagcgaaccgacaacctgtactgctgcgccaagatgatggcggaggtgacggcggcggcggaggcggacgcgcggggcctgcagctggccgtggtgctgccctgcatgaccacgggccccatgctgcagcagacgctcaacttcagcaccaaccacgtcgcgcgctacctcatgggcaccaagcgctccatccccaacgccgtcgccgcctacgtcgacgtccgcgacgtcgcgcgcgcgcacgtgctcgcctacgagcgccccggagccaggggccggtacctttgcatcggcaccgtgctgcaccgcgccgacctcgtcgacatgctcagagacctctttccgcagtaccccgtcacggccaagtgcgaggaggacggcaagccaatggcgaagccgttcaagttctccaaccagaggctcagggacctggggctggagttcactccgctgaggaagagcctgtacgagaccgtgctgtgcctgcagcagaagggccacctgcctgtcatccaaccgcagcagcgcgcgtacctgtgatgtgaaacaaccgacatatataaacatgcatgcaatgaggcaaacgacacacacgtcagtggaagaacgaga

SEQ ID NO: 463 - protein, 332 aa, Zea mays
  misc_feature (13)..(251): Pfam Name: Epimerase Pfam Description: NAD dependent epimerase/dehydratase fam
  misc_feature (1)..(332): Ceres Clone ID no. 100877847
  misc_feature (1)..(332): Bit score of 536.3 for HMM based on sequences of Figure 16
  misc_feature (1)..(332): Functional Homolog Of SEQ ID NO. 368
MSSNCGEDEKELVCVTGAGGFIGSWVVNELLQRGYRVRGTARDPADSKNAHLLALEGAKERLTLCRADVLDRASLRAAFAGCHGVFHVASPVSNDPELVPVAVEGTRNVINAAADEGARRVVFTSSYGAVHMDPSRSPDAVLDETCWSDYDFCKRTDNLYCCAKMMAEVTAAAEADARGLQLAVVLPCMTTGPMLQQTLNFSTNHVARYLMGTKRSIPNAVAAYVDVRDVARAHVLAYERPGARGRYLCIGTVLHRADLVDMLRDLFPQYPVTAKCEEDGKPMAKPFKFSNQRLRDLGLEFTPLRKSLYETVLCLQQKGHLPVIQPQQRAYL

SEQ ID NO: 464 - DNA, 1147 bp, Panicum virgatum
  misc_feature (1)..(1147): Ceres Clone ID no. 2023344
  misc_feature (1)..(1147): Encodes the peptide sequence at SEQ ID NO. 465
aggtcagctcgatcagacactcattccactagcaagcttactagcttagcatcgatagccctcagagccacatgtcgtcgttgtcgtcgtcctattccaaggccagcaatggtggtgagccgcagctggtctgcgtcaccggagcaggcggcttcatcgggtcgtgggtcgtgaaggagctcctcctgcgcgggtaccgtgtcaggggaactgcaagggaccctgcggacagcaagaacgcgcacttgcttgcgctggagggggccagggagaggctcaccctctgccgcgccgacgtcctggactacgactcactccgtgcggcgttcaccggctgccatggcgtcctccacgtcgcctccccggtgtccaacaaccctgagctcgtgacggtggccgtggatggcaccaggaacgcgatcaacgccgcggcggacgagggtgttcgccgcgtggtcttcacctcctcgtacggcgccgtgcacatggaccccaaccggagccccgacgccgtcctcgacgagacctgctggagcgactacgaattctgcgagcagacaaacaacctgtactgctgcgccaagatgatggcggagatcacggcggtggagacggcggcggcgcgcgggctgccgctggcggtggtggtgccgagcgtcacgacgggcccgctgctgcagcaggcgctcaacgtcagcagcaaccacgtggcgcgctacctcatgggcaccaagaggacctaccccaacgccgtcgccgcctacgtcgacgtccgcgacgtcgcgcgcgcgcacgtcctggcctacgagcgccccgacgcgcgcggccgctacctctgcatcggcaccgtgctccaccgcgcccagctcatcgccgtgctcagggagctcttcccgcagtaccccgtcacggccaagtgtgaagacgacggcaagccgatggcgaagccgtacaagttttccaaccagagggccagggagttgggcttggagttcactccgctgaagaaaagtttgtacgaggctgtggtgtgcatgcagcagaaggggcaccttccagtcatcagccagcagcagcactcgtacttgtaaaccaaggcatgcgcgcgctgagtttgccactaattaaaataaaacagcgcaaacag

SEQ ID NO: 465 - protein, 339 aa, Panicum virgatum
  misc_feature (20)..(258): Pfam Name: Epimerase Pfam Description: NAD dependent epimerase/dehydratase f
  misc_feature (1)..(339): Ceres Clone ID no. 2023344
  misc_feature (1)..(339): Bit score of 535.8 for HMM based on sequences of Figure 16
  misc_feature (1)..(339): Functional Homolog Of SEQ ID NO. 368
MSSLSSSYSKASNGGEPQLVCVTGAGGFIGSWVVKELLLRGYRVRGTARDPADSKNAHLLALEGARERLTLCRADVLDYDSLRAAFTGCHGVLHVASPVSNNPELVTVAVDGTRNAINAAADEGVRRVVFTSSYGAVHMDPNRSPDAVLDETCWSDYEFCEQTNNLYCCAKMMAEITAVETAAARGLPLAVVVPSVTTGPLLQQALNVSSNHVARYLMGTKRTYPNAVAAYVDVRDVARAHVLAYERPDARGRYLCIGTVLHRAQLIAVLRELFPQYPVTAKCEDDGKPMAKPYKFSNQRARELGLEFTPLKKSLYEAVVCMQQKGHLPVISQQQHSYL

SEQ ID NO: 466 - DNA, 984 bp, Sorghum bicolor
  misc_feature (1)..(984): Ceres Annot ID no. 8659462
  misc_feature (1)..(984): Encodes the peptide sequence at SEQ ID NO. 467
atggtggaggcagctgctgagcagctggtgtgcgtgaccggagctggaggcttcattgggtcatggctggtcaaggagctgctccaacgcggctacgctgtcaggggcaccgccagggaccctgaggactcgaagaattcccatctgcgggcactggatggagctcaagaacggctatctctgtaccatgctgatgtgctggactacatgtcacttcgtcgtgccttcagcttatgtgatggtgtcttccatgttgcctccccgatatccaatgatcctgaccttgtgccggttgctattgagggaacaaagaacgttatgaacgctgcagcagacatgggggtgcaacgtgtggtgttcacctcatcttatggggctgtccacatgaaccctaacaggaaccctgatcggactgtggacgagagttgttggagtgatcttgacttctgcaagcaaacacagaattggtattgctacgcgaagacggttgctgagaagactgcaatggaagaggcatcaaagagagggatacaactactaatagttgtcccatcagtgacaataggcagaatgctacaaccaacattaaacttaactttatctgcagttgccacctacatgaacggcacaaagaaggcatactcgaacgcagttggagcatatgtcgatgtgcgggatgttgcccttgcccatattttcgtgtatgaagatttgagcacacatgggcggtacctctgcataggtgacatgctacatcaatcggaatttcttcaaatgatgagagagctcttcccacagtacccgatcaccaccaaatgcaaggatgaaaacaagccaatgatcaagccttacaagttctccacacaaaggctcgttgctttgggtatgaagttcactcctttgaaagagagtttatacaacacagtggtcagcctacaggagaatggtcatatcccattactgctacataagtcatccctgtga

SEQ ID NO: 467 - protein, 327 aa, Sorghum bicolor
  misc_feature (10)..(248): Pfam Name: Epimerase Pfam Description: NAD dependent epimerase/dehydratase fam
  misc_feature (1)..(327): Ceres Annot ID no. 8659462
  misc_feature (1)..(327): Bit score of 536.5 for HMM based on sequences of Figure 16
  misc_feature (1)..(327): Functional Homolog Of SEQ ID NO. 368
MVEAAAEQLVCVTGAGGFIGSWLVKELLQRGYAVRGTARDPEDSKNSHLRALDGAQERLSLYHADVLDYMSLRRAFSLCDGVFHVASPISNDPDLVPVAIEGTKNVMNAAADMGVQRVVFTSSYGAVHMNPNRNPDRTVDESCWSDLDFCKQTQNWYCYAKTVAEKTAMEEASKRGIQLLIVVPSVTIGRMLQPTLNLTLSAVATYMNGTKKAYSNAVGAYVDVRDVALAHIFVYEDLSTHGRYLCIGDMLHQSEFLQMMRELFPQYPITTKCKDENKPMIKPYKFSTQRLVALGMKFTPLKESLYNTVVSLQENGHIPLLLHKSSL

SEQ ID NO: 468 - DNA, 1306 bp, Panicum virgatum
  misc_feature (1)..(1306): Ceres Clone ID no. 1804701
  misc_feature (1)..(1306): Encodes the peptide sequence at SEQ ID NO. 469
aggaaggatcctaccaaacctaccaactcctcctccatcgatcgcccgcgcaaaggggaaacctaaaaactaactctcgccattcgccaactagctagctttctctctccgcttcggcgccgctgcggctccaccgcgttcgagcgagaggtttcgtgaagaaaccagatagtagcgtcgaggaactgatcgtcgatcgtgaagacgatgaccgtggtcgacgccgtgtccgcgggcgccggcgacgccgccgccgcggtgccgcagccggcggggaacgggcagaccgtgtgcgtcaccggcgcggccgggtacatcgcgtcgtggctcgtcaaactgctgctcgagaaggggtacactgtcaagggcaccgtcaggaacccagatgacccgaagaacgcgcacctcaaggcgctggacggcgccgccgagcggctcatcctctgcaaggccgacctcctggactacgacgccatctgccgcgccgtggagggctgccacggcgtcttccacaccgcctcccccgtcaccgacgaccccgagcaaatggtggagccggcggtgcgcggcacggagtacgtgatcagcgcggcggcggaggccggcacggtgcggcgggtggtgttcacgtcctccatcggcgccgtgaccatggaccccaaccgcggggccgacgtggtggtcgacgagtcctgctggagcgacctcgacttctgcaagaaaaccaggaactggtactgctacggcaaggcggtggcggagcaggcggcgtgggaggcggcgcggcagcgcggcgtggacctggtggtggtgaacccggtgctggtggtgggcccgctgctgcagccgacggtgaacgccagcatcgcgcacatcctcaagtacctggacggctccgcccgcaccttcgccaacgccgtgcaggcctacgtcgacgtccgcgacgtcgccgccgcgcacctccgcgtcttcgagagccccgccgcctccggccgccacctytgcgccgagcgcgtcctccaccgcgaggacgtcgtccgcatcctcgccaagctcttccccgagtaccccgtccccaccaggtacgcgtacgttgctccatcgtactacggcttctagttaataaatcgtttacttcgtagtagtcgatttatttggctgtttcggctgcctccgtgcatgctgaacgagctaccaaccacagctaccaaccacagtttgcaaatagcagtttttttttaacgaactaggcatgagagctgcagattatattaaaaagaagatgaaagctcagattgagcaatac

SEQ ID NO: 469 - protein, 303 aa, Panicum virgatum
  misc_feature (28)..(267): Pfam Name: Epimerase Pfam Description: NAD dependent epimerase/dehydratase fam
  misc_feature (1)..(303): Ceres Clone ID no. 1804701
  misc_feature (1)..(303): Bit score of 521.0 for HMM based on sequences of Figure 16
  misc_feature (1)..(303): Functional Homolog Of SEQ ID NO. 368
  misc_feature (265)..(265): Xaa is any aa, unknown, or other
MTVVDAVSAGAGDAAAAVPQPAGNGQTVCVTGAAGYIASWLVKLLLEKGYTVKGTVRNPDDPKNAHLKALDGAAERLILCKADLLDYDAICRAVEGCHGVFHTASPVTDDPEQMVEPAVRGTEYVISAAAEAGTVRRVVFTSSIGAVTMDPNRGADVVVDESCWSDLDFCKKTRNWYCYGKAVAEQAAWEAARQRGVDLVVVNPVLVVGPLLQPTVNASIAHILKYLDGSARTFANAVQAYVDVRDVAAAHLRVFESPAASGRHXCAERVLHREDVVRILAKLFPEYPVPTRYAYVAPSYYGF

SEQ ID NO: 470 - DNA, 839 bp, Gossypium hirsutum
  misc_feature (1)..(839): Ceres Clone ID no. 100056656
  misc_feature (1)..(839): Encodes the peptide sequence at SEQ ID NO. 471
ccccagaagacaagagtttcacctcaacaaaacacctacagagcaaatatgccaattgagagctcttccactaatgccccaaccgtctgtgtcaccggtgccggtggcttcatcgcctcctggattgtcaagcttcttcttgaaaaaggttacactgtcaagggcactgtaaggaacccagacgatcccaagaattgtcatttgagagagcttgaaggagcaaaggagaggctatctcttcacaaagctgaccttcttgattaccagtctcttaaggaagccattagcggttgcgatggagttttccatactgcttcacctgtgactgatgatcctgaacaaatggtggagccggccgtgattgggactaagaatgtgataatggcagcggcagaggccaaagttcgacgtgtggtgttcacatcttccataggtgccgtgtacatggaccccaacaggagccctgatgtggtggtcgatgagtcttgctggagcgacctcgagttttgcaaaaataccaagaattggtattgttatgggaaggcagtggcagaacaagcagcctgggaaacagccaaggaaaaaggggtggaccttgtggcgataaccccagttttggtgctgggtccattgctgcaaccaactgtgaatgccagcattgttcacatcctcaagtacttaaccggctcggcaaagacctatgccaattcagttcaagcctatgttcacgtcagagatgtcgcattagcacaccttctcgtgtatgagaatccctctgcctccggccgctacctctgcgctgagagcgtcctccaccgtggtgaagtggtggagatttt

SEQ ID NO: 471 - protein, 263 aa, Gossypium hirsutum
  misc_feature (13)..(251): Pfam Name: Epimerase Pfam Description: NAD dependent epimerase/dehydratase fam
  misc_feature (1)..(263): Ceres Clone ID no. 100056656
  misc_feature (1)..(263): Bit score of 545.7 for HMM based on sequences of Figure 16
  misc_feature (1)..(263): Functional Homolog Of SEQ ID NO. 368
MPIESSSTNAPTVCVTGAGGFIASWIVKLLLEKGYTVKGTVRNPDDPKNCHLRELEGAKERLSLHKADLLDYQSLKEAISGCDGVFHTASPVTDDPEQMVEPAVIGTKNVIMAAAEAKVRRVVFTSSIGAVYMDPNRSPDVVVDESCWSDLEFCKNTKNWYCYGKAVAEQAAWETAKEKGVDLVAITPVLVLGPLLQPTVNASIVHILKYLTGSAKTYANSVQAYVHVRDVALAHLLVYENPSASGRYLCAESVLHRGEVVEI

SEQ ID NO: 472 - DNA, 1328 bp, Panicum virgatum
  misc_feature (1)..(1328): Ceres Clone ID no. 1823484
  misc_feature (1)..(1328): Encodes the peptide sequence at SEQ ID NO. 473
aggaaggatcctaccaaacctaccaactcctcctccatcgatcgcccgcgcaaaggggaaacctaaaaactaactctcgccattcgccaactagctagctttctctctccgcttcggcgccgctgcggctccaccgcgttcgagcgagaggtttcgtgaagaaaccagatagtagcgtcgaggaactgatcgtcgatcgtgaagacgatgaccgtggtcgacgccgtgtccgcgggcgccggcgacgccgccgccgcggtgccgcagccggcggggaacgggcagaccgtgtgcgtcaccggcgcggccgggtacatcgcgtcgtggctcgtcaagctgctgcttgagaaggggtacactgtcaagggcaccgtcaggaacccagatgacccgaagaacgcgcacctcaaggcgctggacggcgccgccgagcggctcatcctctgcaaggccggcacggtgcggcgggtggtgttcacgtcctccatcggcgccgtgaccatggaccccaaccgcggggccgacgtggtggtcgacgagtcctgctggagcgacctcgacttctgcaagaaaaccaggaactggtactgctacggcaaggcggtggcggagcaggcggcgtgggaggcggcgcggcagcgcggcgtggacctggtggtggtgaacccggtgctggtggtgggcccgctgctgcagccgacggtgaacgccagcatcgcgcacatcctcaagtacctggacggctccgcccgcaccttcgccaacgccgtgcaggcctacgtcgacgtccgcgacgtcgccgccgcgcacctccgcgtcttccagagccccgccgcctccggccgccacctctgcgccgagcgcgtcctccaccgcgaggacgtcgtccgcatcctcgccaagctcttccccgagtaccccgtccccaccaggtgctccgacgaggtgaacccgcggaagcaggcgtacaagtttacgaaccagaagctccgggacctggggctggagttccggccggtgagccagtcgctgtacgacacggtgaagagcctccaggagaagggccacctgccggtgctcgccgacgagcaggcgccggaggccgcccccggcgccgaggcgcagcagggcgggatcgccatccgtgcgtgaggtccaggccgatggcgccacgaatgaacagaatgcaagcgatgttcatatactgcccctgatgtgtaacccaagtagtatttgttgcctgtctgatgtccctagcaagacttgaaacgtcgtgctcgtccttgtgaactacatggtgggtgaataaatatggttaatgttcgttc

SEQ ID NO: 473 - protein, 314 aa, Panicum virgatum
  misc_feature (28)..(217): Pfam Name: Epimerase Pfam Description: NAD dependent epimerase/dehydratase family
  misc_feature (1)..(314): Ceres Clone ID no. 1823484
  misc_feature (1)..(314): Bit score of 536.7 for HMM based on sequences of Figure 16
  misc_feature (1)..(314): Functional Homolog Of SEQ ID NO. 368
MTVVDAVSAGAGDAAAAVPQPAGNGQTVCVTGAAGYIASWLVKLLLEKGYTVKGTVRNPDDPKNAHLKALDGAAERLILCKAGTVRRVVFTSSIGAVTMDPNRGADVVVDESCWSDLDFCKKTRNWYCYGKAVAEQAAWEAARQRGVDLVVVNPVLVVGPLLQPTVNASIAHILKYLDGSARTFANAVQAYVDVRDVAAAHLRVFQSPAASGRHLCAERVLHREDVVRILAKLFPEYPVPTRCSDEVNPRKQAYKFTNQKLRDLGLEFRPVSQSLYDTVKSLQEKGHLPVLADEQAPEAAPGAEAQQGGIAIRA

SEQ ID NO: 474 - DNA, 987 bp, Sorghum bicolor
  misc_feature (1)..(987): Ceres Annot ID no. 8659864
  misc_feature (1)..(987): Encodes the peptide sequence at SEQ ID NO. 475
atggccacagcggccggcaagccgctggtgtgcgtgaccggagctggaggcttcattgggtcgtcgctcgtcaaagagctgctccagcgtggctaccgcgtgaggggcaccgcaaggaacccagaccgcaagaatgcccatctgcatgcactggacggagccaaagaacgcctctctctgtgccgtgctgatgtgttggactacaagtcgctcgttgcggcatttaggctttgtgagggcgtcttccatgtcgcttgcccggtttcaaacaatgaccctgaactcatggctgctgctattgagggaacgaagaatgccatcaacgctgctgcagatatgggagtgcaacgcgtggtgtacacttcatcctatggtgctgtccatatgaacccaaaaaggagtcctgatgaggttgtggatgagagttgctggagcgatcttgaattctgcctaaagacaaagaacttttactgcttcgcgaagacggttgctgagaaaacagccatggaggaggcatccaagagagggatacacctggtggtggtcgtgccggcgttcacgctaggtgaaacgctgcagccggggctgcacctggcgatgtacatgctcattgtctcctacgtgaagggcaccaggaagacgtacccgaacgctgtctccgggtttgtcgatgtgcaggatgttgcgcgtgcccatgtgttggtgtatgaaacccctactgcacatggacgctacctctgcattggcgaagtggtgcaccagtcggagtttattcaaatgatgatagagctcttcccacagtatcagatcaccgctaagtgtaaggatgaaaatgcaccaaaggtcaaaccgtacaagttctctacaaaaaggctacaggatctgggcatgaagttcactcctctaaaaaaaagtttacacaagacagtgatatgcctacaagaacaaggtcatatcccaaagctcccccacaaatcggccttgtga

SEQ ID NO: 475 - protein, 328 aa, Sorghum bicolor
  misc_feature (10)..(249): Pfam Name: Epimerase Pfam Description: NAD dependent epimerase/dehydratase f
  misc_feature (1)..(328): Ceres Annot ID no. 8659864
  misc_feature (1)..(328): Bit score of 489.8 for HMM based on sequences of Figure 16
  misc_feature (1)..(328): Functional Homolog Of SEQ ID NO. 368
MATAAGKPLVCVTGAGGFIGSSLVKELLQRGYRVRGTARNPDRKNAHLHALDGAKERLSLCRADVLDYKSLVAAFRLCEGVFHVACPVSNNDPELMAAAIEGTKNAINAAADMGVQRVVYTSSYGAVHMNPKRSPDEVVDESCWSDLEFCLKTKNFYCFAKTVAEKTAMEEASKRGIHLVVVVPAFTLGETLQPGLHLAMYMLIVSYVKGTRKTYPNAVSGFVDVQDVARAHVLVYETPTAHGRYLCIGEVVHQSEFIQMMIELFPQYQITAKCKDENAPKVKPYKFSTKRLQDLGMKFTPLKKSLHKTVICLQEQGHIPKLPHKSAL

SEQ ID NO: 476 - DNA, 1605 bp, Panicum virgatum
  misc_feature (1)..(1605): Ceres Clone ID no. 1780698
  misc_feature (1)..(1605): Encodes the peptide sequence at SEQ ID NO. 477
aggaaggatcctaccaaacctaccaactcctcctccatcgatcgcccgcgcaaaggggaaacctaaaaactaactctcgccattcgccaactagctaactttctctctccgcttcggcgccgctgcggctccaccgcgttcgagcgagaggtttcgtgaagaaaccagatagtagcgtcgaggaactgatcgtcgatcgtgaagacgatggccgtggtcgacgccgtgtccgcgggcgccggcgacgccgccgccgcggtgccgcagccggcggggaacgggcagaccgtgtgcgtcaccggcgcggccgggtacatcgcgtcgtggctcgtcaagctgctgcttgagaaggggtacactgtcaagggcaccgtcaggaacccaggcatgtgcatatacacacacacgcgcgtcgtggcgcagggatgattgtcgtagtacgaacagagagcgaggcacctgactaacgtcgttgtgttctttggattgtcgtcgatggcgatggcatgcagatgacccgaagaacgcgcacctcaaggcgctggacggcgccgccgagcggctcatcctctgcaaggccgacctcctggactacgacgccatctgccgcgccgtggagggctgccacggcgtcttccacaccgcctcccccgtcaccgacgaccccgagcaaatggtggagccggcggtgcgcggcacggagtacgtgatcagcgcggcggcggaggccggcacggtgcggcgggtggtgttcacgtcctccatcggcgccgtgaccatggaccccaaccgcggggccgacgtggtggtcgacgagtcctgctggagcgacctcgacttctgcaagaaaaccaggaactggtactgctacggcaaggcggtggcggagcaggcggcgtgggaggcggcgcggcagcgcggcgtggacctggtggtggtgaacccggtgctggtggtgggcccgctgctgcagccgacggtgaacgccagcatcgcgcacatcctcaagtacctggacggctccgcccgcaccttcgccaacgccgtgcaggcctacgtcgacgtccgcgacgtcgccgccgcgcacctccgcgtcttccagagccccgccgcctccggccgccacctctgcgccgagcgcgtcctccaccgcgaggacgtcgtccgcatcctcgccaagctgttccccgaataccccgtccccaccaggtactccgacgaggtgaacccgcggaagcaggcgtacaagtttacgaaccagaagctccgggacctggggctggagttccggccggtgagccagtcgctgtacgacacggtgaagagcctccaggagaagggccacctgccggtgctcgccgacgagcaggcgccggaggccgcccccggcgccgaggcgcagcagggcgggatcgccatccgtgcgtgaggtccaggccgatggcgccacgaatgaacagaatgcaagcgatgttcatatactgcccctgatgtgtaacccaagtagtgtttgttgcctgtctgatgtccctagcaagacttgaaacgtcgtgctcgtccttgtgaactacatggtgggtgaataaatatggttaatgttcgttc

SEQ ID NO: 477 - protein, 251 aa, Panicum virgatum
  misc_feature (1)..(154): Pfam Name: Epimerase Pfam Description: NAD dependent epimerase/dehydratase f
  misc_feature (1)..(251): Ceres Clone ID no. 1780698
  misc_feature (1)..(251): Bit score of 361.9 for HMM based on sequences of Figure 16
  misc_feature (1)..(251): Functional Homolog Of SEQ ID NO. 368
MVEPAVRGTEYVISAAAEAGTVRRVVFTSSIGAVTMDPNRGADVVVDESCWSDLDFCKKTRNWYCYGKAVAEQAAWEAARQRGVDLVVVNPVLVVGPLLQPTVNASIAHILKYLDGSARTFANAVQAYVDVRDVAAAHLRVFQSPAASGRHLCAERVLHREDVVRILAKLFPEYPVPTRYSDEVNPRKQAYKFTNQKLRDLGLEFRPVSQSLYDTVKSLQEKGHLPVLADEQAPEAAPGAEAQQGGIAIRA

SEQ ID NO: 478 - DNA, 1426 bp, Zea mays
  misc_feature (1)..(1426): Ceres Clone ID no. 218097
  misc_feature (1)..(1426): Encodes the peptide sequence at SEQ ID NO. 479
aaaaagagacctgggcaggacgacacaggcagagccgccggccctcgcttcttggtggggtctagtttctttctcgcctctgcctgtgcctgctggtggtaagtaataacagcgacacggtacccacgcacrgcggcggcggcggcgacgacgaagacgacatgaccgtcggcgacgacgcggcggcgccggggcgggggcagacggtgtgcgtdaccggcgccggcggctacgtcgggtcgtggatcgtcaagctcctgctcgagcggggctacgccgtccgcggcaccgtgcgcaaccctgacgacgcgaagaacgcgcacctgctggcgctccccggcgcggcggagcggctggcgctgtgcaaggccgacctgctcgactacggcgcgctaagggcggccgtcgccggctgccacargcgtcttccacgccgcgtcgccggtcaccgacgacccggaggagatggtggagccggcggtgcgggggacgcggtacgtcatcgacgcggcggccgaggccggcacggtccgccgcgtcgtcctgacgtcgtcgatcggcgcggtggccatggacccccgccgcgagccggacgccgtcgtcgacgagtcgtgctggagcgacctcgacttctgcaagaagaccaagaactggtactgctacggcaaggcggcggcggagcgggcggcgtgggagrcggcggcggcgcgcggggtggacctggtggtggtggtgccggtgctggtgcagggcccggcgctgcagccgtcggtgaacgccagcctgatgcacgtgctcaagtacctgaacgggtccgccaagacgtacgccaacgcggtgcaggcgtacgtgcacgtccgcgacgccgccgacgcgcacgtccgcgtcttcgaggcgccccgcgccgccggccgctacatctgcgccgacgccgtgctccaccgcgaggacgtcgtccgcaccctccgcaagtccttcccgggctacccggtcccggagaggtgctctgacgaggtgaacccgaggaagcagccgtacaagatctccaaccagcggctgagggagctgggcctggagttcaccccggcggcgcaggcgctgtacgacaccgtcgtgtgcttccaggagaagggcatcctccctctccytgtccccgccccaacgccggcgtcaccggacgcctgagctagctgatgagctggcccagaaccaacgaagaaacatgtttggcacgcaaacbgctattataacagtcgctgcttcgatcattctgccgctagagatagaatgtggagtgtgtgctactcgttgtgggcgtaagagtgtcagaagagtgcagcagtaactatatcgatgcgactttttatatgttgctatatcatgtgtgacaatctcctaataataaatatatggagtatcgtcctat

SEQ ID NO: 479 - protein, 239 aa, Zea mays
  misc_feature (1)..(154): Pfam Name: Epimerase Pfam Description: NAD dependent epimerase/dehydratase f
  misc_feature (1)..(239): Ceres Clone ID no. 218097
  misc_feature (1)..(239): Bit score of 328.5 for HMM based on sequences of Figure 16
  misc_feature (1)..(239): Functional Homolog Of SEQ ID NO. 368
  misc_feature (78)..(78): Xaa is any aa, unknown, or other
  misc_feature (228)..(228): Xaa is any aa, unknown, or other
MVEPAVRGTRYVIDAAAEAGTVRRVVLTSSIGAVAMDPRREPDAVVDESCWSDLDFCKKTKNWYCYGKAAAERAAWEXAAARGVDLVVVVPVLVQGPALQPSVNASLMHVLKYLNGSAKTYANAVQAYVHVRDAADAHVRVFEAPRAAGRYICADAVLHREDVVRTLRKSFPGYPVPERCSDEVNPRKQPYKISNQRLRELGLEFTPAAQALYDTVVCFQEKGILPLXVPAPTPASPDA

SEQ ID NO: 480 - DNA, 1205 bp, Arabidopsis thaliana
  misc_feature (1)..(1205): Ceres Clone ID no. 6748
  misc_feature (1)..(1205): Encodes the peptide sequence at SEQ ID NO. 481
acgcattcgtcatttggtccctccacttagagagaagcagacagaacataactaaaatcgagaaaaatggcaaacagtggtgaaggtaaagtggtgtgtgtaacaggagcctccggttacatcgcctcatggctcgtcaagttcctacttagccgtggctacactgttaaggcctccgtccgtgatcccagtgatccgaaaaagacacaacacttagtttcactagaaggtgcaaaggaaagacttcacttgttcaaagcagaccttttggaacaaggttctttcgactctgctattgatggttgccatggagttttccacactgcttctccattttttaatgatgccaaagacccacaggctgaacttattgatcctgcggtcaaggggacgcttaacgttttgaattcgtgcgccaaagcctcttcggttaagagggttgttgtaacctcctccatggctgccgttggttacaatggaaaaccacgcacacctgatgttaccgtcgatgaaacttggttctctgatcctgagctttgcgaggcctccaagatgtggtatgttctatccaagactttggcggaagatgcagcttggaaactcgctaaagagaaaggcttagacattgttactattaacccggctatggtgatcggtcctctcctacagccaactctgaacacgagtgctgctgctatattaaacttaatcaatggtgcaaagactttcccaaacttgagtttcggatgggttaatgtaaaagacgtagccaatgcgcacatccaaacatttgaggtcccttcagctaatgggcgttattgtttggtcgagcgtgtcgttcaccactccgagattgttaacattctacgtgagctttacccaaatctcccactacctgaaaggtgtgtggacgagaatccctacgtgccaacgtatcaagtgtccaaggataaaacgaggagccttggcatagactacatacccttgaaggttagcatcaaggagaccgtcgagtccttgaaggaaaaaggtttcgcacagttctgagaaagcatttgagccaatggatttaatccagattagataaagtatttggaagactatttcaaaaataatatttggaacatgtcaatgttctcaaggagatattagtatgttcttgtgtactttattgttgttccatcaaatgagttacttttcctttt

SEQ ID NO: 481 - protein, 326 aa, Arabidopsis thaliana
  misc_feature (10)..(267): Pfam Name: Epimerase Pfam Description: NAD dependent epimerase/dehydratase fam
  misc_feature (1)..(326): Ceres Clone ID no. 6748
  misc_feature (1)..(326): Bit score of 388.5 for HMM based on sequences of Figure 16
  misc_feature (1)..(326): Functional Homolog Of SEQ ID NO. 368
MANSGEGKVVCVTGASGYIASWLVKFLLSRGYTVKASVRDPSDPKKTQHLVSLEGAKERLHLFKADLLEQGSFDSAIDGCHGVFHTASPFFNDAKDPQAELIDPAVKGTLNVLNSCAKASSVKRVVVTSSMAAVGYNGKPRTPDVTVDETWFSDPELCEASKMWYVLSKTLAEDAAWKLAKEKGLDIVTINPAMVIGPLLQPTLNTSAAAILNLINGAKTFPNLSFGWVNVKDVANAHIQTFEVPSANGRYCLVERVVHHSEIVNILRELYPNLPLPERCVDENPYVPTYQVSKDKTRSLGIDYIPLKVSIKETVESLKEKGFAQF

SEQ ID NO: 482 - DNA, 1268 bp, Triticum aestivum
  misc_feature (1)..(1268): Ceres Clone ID no. 703077
  misc_feature (1)..(1268): Encodes the peptide sequence at SEQ ID NO. 483
acccacgacgcggacactactttgtacgcaggcagcgtctttccccttcctcttttgcctcccatctcccctctccgctcccactccacagtccacccagccgcggccggaagagcaggaggacgggatgagctccgggacggggaaggtggtgtgcgtcaccggcgcctcgggctacatcgcctcctggctcgtcaagttcctcctccagcgcggctacaccgtccgcgccaccgtcagggacaccgccgaccccaagaaaacattgcacctgcaggccctggatggagccaaggacaggctgcacttgtttaaagcaagcttgttggaagaaggcaccttcgatgatgctgttgccggctgcgattgtgtcttccacacggcatctcccttttatcacaatgtcaaggatcccaaggctgagttacttgatccagcagtcaatggaacgctcaatgttctccgttcctgcaagaaggcctctatcaagagagtgatcgtaacctcatccatggctgctgttgcctacaatgggaagccaaggactcctgatgtagtagttgacgagacatggttttcaagtgcagaggtctgcgaaaagaataagcaatggtatgtgctatccaagacccttgccgaggaggctgcatggaagtacgcaaatgataatggattagaaataattacaataaacccaacaatggtcatcggtcccctgttgcagcctacactgaatactagcacagaagcaatattgaagtttataaatggatcatcttctacatacgccaatttctgctttggatggataaacgttaaagatgttgccctggcacatatccttgcatatgaagttccttcagcaaacggaagatattgtatggttgaaagagtcattcaccactcggaccttgtcaagatcatacacgagatgtatcctgaatttccagtgccagacaagtgtgcagatgatgcgccgtttgccccaatctaccaggtatcaaaggacaggataagaagtctgggcatggagctgacccccctggagacgagcctcaaggagactatcgagagcttgagagagaaaggatttgtcacttctgagtcgagccatctgtgaaactttctttgctttggcatcactagtggcagacgctagatgcacacatgtttatgtgcacctgaaataaatcgaggcatagtgtattcttgagacatgtatttgtggatctgctgtgtttcaatggattcaagttcggagaatgtat

SEQ ID NO: 483 - protein, 330 aa, Triticum aestivum
  misc_feature (9)..(253): Pfam Name: Epimerase Pfam Description: NAD dependent epimerase/dehydratase fam
  misc_feature (1)..(330): Ceres Clone ID no. 703077
  misc_feature (1)..(330): Bit score of 406.6 for HMM based on sequences of Figure 16
  misc_feature (1)..(330): Functional Homolog Of SEQ ID NO. 368
MSSGTGKVVCVTGASGYIASWLVKFLLQRGYTVRATVRDTADPKKTLHLQALDGAKDRLHLFKASLLEEGTFDDAVAGCDCVFHTASPFYHNVKDPKAELLDPAVNGTLNVLRSCKKASIKRVIVTSSMAAVAYNGKPRTPDVVVDETWFSSAEVCEKNKQWYVLSKTLAEEAAWKYANDNGLEIITINPTMVIGPLLQPTLNTSTEAILKFINGSSSTYANFCFGWINVKDVALAHILAYEVPSANGRYCMVERVIHHSDLVKIIHEMYPEFPVPDKCADDAPFAPIYQVSKDRIRSLGMELTPLETSLKETIESLREKGFVTSESSHL

SEQ ID NO: 484 - DNA, 978 bp, Populus balsamifera subsp. trichocarpa
  misc_feature (1)..(978): Ceres Annot ID no. 1514866
  misc_feature (1)..(978): Encodes the peptide sequence at SEQ ID NO. 485
atgagcagtggagccggaaagatcgtgtgcgtgactggagcttcgggttacatagcatcatggcttgtgaagctcctcctctcgcgtggttacactgtcaaggcctctgttcgtgacccaaatgatcccaaaaagacagaacacttacgtgcacttaatggagctcaggagagacttcagctgttcaaagcaaatttactggaagaaggttcctttgattctattgtagaagggtgtgaaggtgttttccacactgcatctccgttttatcatgatgtgaaggacccacaggtagaattgctggatcctgcagtgaaaggaacactcaatgttcttggctcatgtgcaaaacacccgtcaatcagacgagttgttttaacatcttctgttgctgcagttgcttacaatgggaaacctcgaaccccagatgtagtagtggatgaaacttggttttctgatccaaacttgtgcagagaatctaaggtttggtatgtgctctcaaagactttggccgaggatgctgcatggaaatttgcaaaagaaaaggatatggacatggttgcaataaatccagcaatggtaattggtcctctcttgcagccaacactaaatacaagtgctgcggcaattttaagcctaattaaaggagcacaaactttccccaatgcatcttttggatggataaatgttaaagatgttgccaatgcacacattcaagcatttgagctgtcatcagctagtgggagatattgtttggttgagagagtggcacactactcagaagtagtgaagattctgcatgagctttaccccgatctccaactcccagaaaagtgtgccgatgataagccatatgtaccaatctatcaagtttccaaggaaaaagcaaaaagcttgggtgttgaattcattcctttggaagcaagcgttaaggaaacagttgaaagcttgaaggagaaaggatttgtcagtttttaa

SEQ ID NO: 485 - protein, 325 aa, Populus balsamifera subsp. trichocarpa
  misc_feature (9)..(253): Pfam Name: Epimerase Pfam Description: NAD dependent epimerase/dehydratase fam
  misc_feature (1)..(325): Ceres Annot ID no. 1514866
  misc_feature (1)..(325): Bit score of 372.5 for HMM based on sequences of Figure 16
  misc_feature (1)..(325): Functional Homolog Of SEQ ID NO. 368
MSSGAGKIVCVTGASGYIASWLVKLLLSRGYTVKASVRDPNDPKKTEHLRALNGAQERLQLFKANLLEEGSFDSIVEGCEGVFHTASPFYHDVKDPQVELLDPAVKGTLNVLGSCAKHPSIRRVVLTSSVAAVAYNGKPRTPDVVVDETWFSDPNLCRESKVWYVLSKTLAEDAAWKFAKEKDMDMVAINPAMVIGPLLQPTLNTSAAAILSLIKGAQTFPNASFGWINVKDVANAHIQAFELSSASGRYCLVERVAHYSEVVKILHELYPDLQLPEKCADDKPYVPIYQVSKEKAKSLGVEFIPLEASVKETVESLKEKGFVSF

SEQ ID NO: 486 - DNA, 1397 bp, Zea mays
  misc_feature (1)..(1397): Ceres Clone ID no. 297597
  misc_feature (1)..(1397): Encodes the peptide sequence at SEQ ID NO. 487
aaataggtagatgatgccgctaacagtaacacagagtaaaagactccaattttcccacggctactgaatcacggatgcttaaatctccccaatccgtatctctgtttccctcacagcgcggctgcctataaccactccaggtctccagcgaagcaggctcaggcgcaacgcaacaacacaaggcggcggttatggcctctgctgctgcgacggctacgatggggacggggaaggtggtgtgcgtcaccggcgcatcagggtacatcgcgtcctggattgtcaggctcctcctcgaccgcggctacaccgtccgcgccaccgtgcgagacaccgctgacccaaagaaaacattgcacctgactgcgttggatggtgctaaggataggctgcacttatttaaagctagcctgctagaagagggttctttcgatgctgcagttcatggatgcgacactgtatttcatactgcctctcccttttatcacaatgtcaaggatgctaaggcagagttacttgacccagcagttaagggaacactcaatgttctcggttcatgcaagaaagcttctattaaaaaggtggttgtaacatcatctatggctgctgtagcctacaacgggaggccaaggactcctgaggtcacagttgacgagacatggttttctgatccacaaatttgtgaaacaaatcagcaatggtatattttgtccaagacgctggcagaggaggctgcttggaagttctcaagggataatggacttgaaatcgttactataaacccagcgatggttattggtcccctgctgcagcctacactaaataccagtgctgaagcaatcctgaagttaatcaatgggtcatcgtctacatatcccaatttttgctttggatgggttaatgtcaaggatgttgccctggcccatatccttgcatacgaggttccctcatcaaatggaaggtactgcatggtggaaagagttgttcactactcagaactggtgaacattatccgcaacatgtatcctacccttcctcttccggacaagtgtgcagatgacaagccgtttgtcccaccctaccaagtatcaaaggagaagataaaaagcataggcatcgagttgattccactggagacgagcgtcaaggagaccatcgaaagcttgaaagagaaggggttcgctagtttttgactcgtgcaagctgtgaaacagaagtgttactgtactacgtgatgttgcattgtacacatgcatcggacttcgcagttcccaagctattttggtagctttggtctgtaagattacctaaaataaactgagccacgttgccacgctgtagcttttgtacatgttatgctttgatcggattgagacacgtgatatatggtcgttgcttac

SEQ ID NO: 487 - protein, 332 aa, Zea mays
  misc_feature (16)..(260): Pfam Name: Epimerase Pfam Description: NAD dependent epimerase/dehydratase fam
  misc_feature (1)..(332): Ceres Clone ID no. 297597
  misc_feature (1)..(332): Bit score of 366.8 for HMM based on sequences of Figure 16
  misc_feature (1)..(332): Functional Homolog Of SEQ ID NO. 368
MASAAATATMGTGKVVCVTGASGYIASWIVRLLLDRGYTVRATVRDTADPKKTLHLTALDGAKDRLHLFKASLLEEGSFDAAVHGCDTVFHTASPFYHNVKDAKAELLDPAVKGTLNVLGSCKKASIKKVVVTSSMAAVAYNGRPRTPEVTVDETWFSDPQICETNQQWYILSKTLAEEAAWKFSRDNGLEIVTINPAMVIGPLLQPTLNTSAEAILKLINGSSSTYPNFCFGWVNVKDVALAHILAYEVPSSNGRYCMVERVVHYSELVNIIRNMYPTLPLPDKCADDKPFVPPYQVSKEKIKSIGIELIPLETSVKETIESLKEKGFASF

SEQ ID NO: 488 - DNA, 987 bp, Sorghum bicolor
  misc_feature (1)..(987): Ceres Annot ID no. 8673965
  misc_feature (1)..(987): Encodes the peptide sequence at SEQ ID NO. 489
atgacgggggcggggaaggtggtgtgcgtcaccggcgcatcagggtacatcgcgtcctggatcgtcaggctgctcctcgaccgcggctacaccgtccgcgccaccgtgcgggacaccgctgacccaaagaaaacattgcacctgactgctctggatggagccaaggataggctgcacttatttaaagctagcctgctagaagagggctcttttgacgctgcagttcatggatgtgacaccgtattccatactgcctctcccttttatcacaatgtcaaggatcctaaggctgagttacttgacccagcagttaagggaacactcaatgttcttggttcatgcaagaaagcttctattacaaaagtggttataacatcctctatggctgctgtttcctacaacgagaagccaaggactcctgaggtcacagttgacgagacatggtttactgatccacaaatttgtgaaaagactcagcaatggtatgttttgtccaagacactcgcagagcaggctgcttggaagttttcaagggataatggatttgaaattgttactataaacccagcaatggttattggtcccctgctccagcctacactaaataccagtgctgaagcaatcctgaagttaatcaatggatcatctacatatcccaattcaagctttggatgggttaatgtcaaagatgttgccctggcccatatccttgcatatgagattccctcggcaaatggaaggtattgcatggtggaaagagttgttcactactcagaactagtcaaaatcatccgcaagatgtatcctaccattcgtcttccagacaagtgtgcagatgacaagccatttgtcccaacctaccaagtatcaaaggagaagataagaagcataggcattgagttaattccagtggagacgagcgtcaaggagactatcgaaagcttgaaagagaagggatttgttagttttgactcgagcaacctgtga

SEQ ID NO: 489 - protein, 328 aa, Sorghum bicolor
  misc_feature (8)..(251): Pfam Name: Epimerase Pfam Description: NAD dependent epimerase/dehydratase fam
  misc_feature (1)..(328): Ceres Annot ID no. 8673965
  misc_feature (1)..(328): Bit score of 380.2 for HMM based on sequences of Figure 16
  misc_feature (1)..(328): Functional Homolog Of SEQ ID NO. 368
MTGAGKVVCVTGASGYIASWIVRLLLDRGYTVRATVRDTADPKKTLHLTALDGAKDRLHLFKASLLEEGSFDAAVHGCDTVFHTASPFYHNVKDPKAELLDPAVKGTLNVLGSCKKASITKVVITSSMAAVSYNEKPRTPEVTVDETWFTDPQICEKTQQWYVLSKTLAEQAAWKFSRDNGFEIVTINPAMVIGPLLQPTLNTSAEAILKLINGSSTYPNSSFGWVNVKDVALAHILAYEIPSANGRYCMVERVVHYSELVKIIRKMYPTIRLPDKCADDKPFVPTYQVSKEKIRSIGIELIPVETSVKETIESLKEKGFVSFDSSNL

SEQ ID NO: 490 - DNA, 1260 bp, Glycine max
  misc_feature (1)..(1260): Ceres Clone ID no. 626124
  misc_feature (1)..(1260): Encodes the peptide sequence at SEQ ID NO. 491
atagtagattacactgaaacattaaaaaactggaggttgatagttaatctatctgcaacagcaacattgtgacagtgacagtgtcgtaggatggagaaggtggtatgtgtgaccggcggcagcggctgcattggttcatggctcgtccatctcctcttggatcgcggctacaccgttcacgccaccgtccaaaacctcaacgatgaagccgagacgaagcatcttcaatccctcgacggagcgtccacgcgcctccgcctcttccagatggatctcctccgccacgacaccgtcctcgccgccgtgcgtggctgcgccggcgtcttccacctcgcctctccctgcattgtcgaccaagtccacgacccccagaaggagcttctggacccggcgattaagggaaccatgaacgtgctcacggcggcgaargaagcaggggtgcggcgcgtggtgctcacgtcctccatctccgcggktacgccgagccccaattggcccggcgatgttgccaagacggaggagtgctggaccgacgttgaatattgcaagcaaaaggggttgtggtatccattgtcgaagactttagctgagaaagctgcttgggattttgctaaagagaatgatttggatgttgtggtggtgaatcctggcactgtgatgggtcctgttattccaccaaggcttaatgcgagcatggtcatgctcgtgcgccttctacaaggctgtgccgaaacatatgaggacttttttatgggatcggtccactttaaggatgtagcattggcacatattttggtgtatgagaacaaatcagcggctggtaggcatttgtgtgttgaagctatctctcactatggtgactttgtggcaaaagttgctgaactctatccagagtataatgtgcctaagatgcaacgagatacccagccgggattattgagaacaaaggatggagcaaagaaactgatggatttgggtttgcaattcattccaatggagaagattattaaggatgctgtagaggatttgaagagcaaagggttcctttcataaataatgctgctgctgctgctatttagaaccagagtgtaatgtttgcaatatgagtacttatgacacgagcctgtaatgtatagtctgtttcctctatgcctatgatgctatgcaaattggcgctgactcgatatgtattttcaatctgatgcttttttattaataaaaaataaaagctagaatagaccgggagaggttaaggacttg

SEQ ID NO: 491 - protein, 320 aa, Glycine max
  misc_feature (5)..(250): Pfam Name: Epimerase Pfam Description: NAD dependent epimerase/dehydratase fam
  misc_feature (1)..(320): Ceres Clone ID no. 626124
  misc_feature (1)..(320): Bit score of 351.3 for HMM based on sequences of Figure 16
  misc_feature (1)..(320): Functional Homolog Of SEQ ID NO. 368
  misc_feature (113)..(113): Xaa is any aa, unknown, or other
  misc_feature (129)..(129): Xaa is any aa, unknown, or other
MEKVVCVTGGSGCIGSWLVHLLLDRGYTVHATVQNLNDEAETKHLQSLDGASTRLRLFQMDLLRHDTVLAAVRGCAGVFHLASPCIVDQVHDPQKELLDPAIKGTMNVLTAAXEAGVRRVVLTSSISAXTPSPNWPGDVAKTEECWTDVEYCKQKGLWYPLSKTLAEKAAWDFAKENDLDVVVVNPGTVMGPVIPPRLNASMVMLVRLLQGCAETYEDFFMGSVHFKDVALAHILVYENKSAAGRHLCVEAISHYGDFVAKVAELYPEYNVPKMQRDTQPGLLRTKDGAKKLMDLGLQFIPMEKIIKDAVEDLKSKGFLS

SEQ ID NO: 492 - DNA, 1216 bp, Panicum virgatum
  misc_feature (1)..(1216): Ceres Clone ID no. 1724968
  misc_feature (1)..(1216): Encodes the peptide sequence at SEQ ID NO. 493
gattcttcgcagctaacagcacggcctgctaagtccactctctagtcgagactccacggcatgagctccgcggcggcggcgatgacgggggcggggaaggtggtgtgcgtgaccggcgcgtcggggtacatcgcgtcctggatcgtcaagctgcttctcgcccgcggatacaccgtccgtgccaccgtgcgggacaccgctgacccaaagaaaacattgcacctgagtgcgttggatggagctaaggataggctgcatttctttaaagcaagtctgctagaagagggatcatttgatgctgcagttgagggctgtgaaactgtgttccatactgcttctcccttttatcacaatgtcaaggatcctaaggctgagttacttgacccagcagttaagggaacgctcaatgttcttggttcatgcacgaaagcttctattaaaaaggttgttgtgacatcatccgttgctgctgttgcctacaatggaaagccaagaactcctgaagttatagttgatgagacatggttttctgatccacaaatttgtgaaaagaataagcaatggtatgttgtgtccaagacgcttgcagaggaggctgcatggaagttctctagagataatggattggaaattgttatgataaacccagcaatggttattggaccccttttgcagcctacactaaatactagtgctgaagcaatcctaaagctaattaacgggtcatggtctacatatcccaatttcagctttggatgggtgaatgttaaagatgttgcactggcacatatccttgcatatgaagttccctcagcaaatggaagatattgcatggtggaaagagttgttcactactcagaagttgtcaacatcatacgaaagatgtatcctacaattcctcttgcagacaagtgtgcagatgacaagccatttgtcccaacataccaggtatcaaaggagaaaataagaagcttaggcatcgagttgattccactggagacgagcatcagggagaccatcgagagcttaaaagagaagggatttgttagttttgactcgagcaatctgtgaaagaaagcaaaagcttgatgttacaagatcagtggtctgtaccagacttcgcagttcacatgattgtatggtacgccaagtagtatcgtggcctgtaactgtaaggtgacctgaaataaacgaggcattctgtagtttttggacc

SEQ ID NO: 493 - protein, 336 aa, Panicum virgatum
  misc_feature (15)..(259): Pfam Name: Epimerase Pfam Description: NAD dependent epimerase/dehydratase fam
  misc_feature (1)..(336): Ceres Clone ID no. 1724968
  misc_feature (1)..(336): Bit score of 380.3 for HMM based on sequences of Figure 16
  misc_feature (1)..(336): Functional Homolog Of SEQ ID NO. 368
MSSAAAAMTGAGKVVCVTGASGYIASWIVKLLLARGYTVRATVRDTADPKKTLHLSALDGAKDRLHFFKASLLEEGSFDAAVEGCETVFHTASPFYHNVKDPKAELLDPAVKGTLNVLGSCTKASIKKVVVTSSVAAVAYNGKPRTPEVIVDETWFSDPQICEKNKQWYVVSKTLAEEAAWKFSRDNGLEIVMINPAMVIGPLLQPTLNTSAEAILKLINGSWSTYPNFSFGWVNVKDVALAHILAYEVPSANGRYCMVERVVHYSEVVNIIRKMYPTIPLADKCADDKPFVPTYQVSKEKIRSLGIELIPLETSIRETIESLKEKGFVSFDSSNL

SEQ ID NO: 494 - DNA, 993 bp, Sorghum bicolor
  misc_feature (1)..(993): Ceres Annot ID no. 8743556
  misc_feature (1)..(993): Encodes the peptide sequence at SEQ ID NO. 495
atggacggcggcgacgcgggcaagacgaggacgatgaagaagacggtgtgcgtgacgggcgccggcggcttcgtcgcctcgtggctcgtgcagcgcctcctctccagaggcgactacctcgtgcgtggcactgttcgcgatccgagtgatcccaagaacgcgcacctgatggcgctggacggcgccggggagcgcctgcggctgttcaaggctgacttgttggaccgtgccagcgtcgccgccgccgttgctggctgcgacggcgtcttccacgtcgccagccccgtcccggccgtcgagcccaccaaccccgatgtggagatcatggctccggcggtgaccggcacgcagaacatgctggaggctagccacgcggccaacgtccgccgcgtcgtggtggtgtcgtcggtcgccgcggtgatcgcgaaccccaccagcatccccgatgacgccgtcgccgacgaagactgctggtcggacgaggactactgcagagccactaagaactggtactgcctttccaagacggtggccgaacgcgaggcactggcatacggcgagaggactgggatggacgtggtcaccgtctgtccgccgtgggttctgggtccgctgctgcagccgacggtgaacgccaccagcatgggtttcgtgaaatacctgaaaggagaaaacaccgatgagaagaggaggaacatggtggacgtgcgcgacgtcgcagacgctctggtcctgacgtacgagacgccggaggcggctggccggcgatacatctgtagcgcacacgccatgaaggtgtctgaaataatcagcctcgtcagcagcctgtacccagacctgaagctgcactaccccagggagtttgttcagaaggaagacgagaagggagtgagctccaagaggctgcaggcgctggggtggaaattcaggacggtggaggaaactctgagagacaccatcgactcgtacaaggctgctggaatcctcaactga

SEQ ID NO: 495 - protein, 330 aa, Sorghum bicolor
  misc_feature (16)..(260): Pfam Name: Epimerase Pfam Description: NAD dependent epimerase/dehydratase f
  misc_feature (1)..(330): Ceres Annot ID no. 8743556
  misc_feature (1)..(330): Bit score of 338.9 for HMM based on sequences of Figure 16
  misc_feature (1)..(330): Functional Homolog Of SEQ ID NO. 368
MDGGDAGKTRTMKKTVCVTGAGGFVASWLVQRLLSRGDYLVRGTVRDPSDPKNAHLMALDGAGERLRLFKADLLDRASVAAAVAGCDGVFHVASPVPAVEPTNPDVEIMAPAVTGTQNMLEASHAANVRRVVVVSSVAAVIANPTSIPDDAVADEDCWSDEDYCRATKNWYCLSKTVAEREALAYGERTGMDVVTVCPPWVLGPLLQPTVNATSMGFVKYLKGENTDEKRRNMVDVRDVADALVLTYETPEAAGRRYICSAHAMKVSEIISLVSSLYPDLKLHYPREFVQKEDEKGVSSKRLQALGWKFRTVEETLRDTIDSYKAAGILN

SEQ ID NO: 496 - DNA, 1210 bp, Gossypium hirsutum
  misc_feature (1)..(1210): Ceres Clone ID no. 1850477
  misc_feature (1)..(1210): Encodes the peptide sequence at SEQ ID NO. 497
gcaattgacagccacagaatagagcaaaaatcaccaaaaataaaaaagaaatattagtaaagggaggaaaatgagcagcggtgcaggaaaaaccgtgtgtgtaaccggagcctctggctacatcgcgtcatggcttgtgaagcagcttctacttcgtggttacactgtcaaagcctctgttcgtgacccaaatgatccaaggaagacacaacacttgcttggacttgagggtgctgagagcaggctcatgttgttaaaagcagacctattggaacaaggttcctttgatcctgtggttgaaggttgtgtaggtgttttccacactgcatctccattctatcacgatgtccttgacccagaggcagaattacttgatcccgctgtgaaaggaacactgaatgttttgagctcatgcgctaagaccccttccgttaaacgagtggtattgacatcttctatagctgcagtcgcatataacggaaaacctcgaactcccgatgttgtggttgacgagaattggtttagcgatcctgattactgtaaggacttaaagctatggtacgtagtctcaaaaacaatggccgaggattctgcctggaaattttcaaaggagaagggcattgacatggttgccataaaccctgcaatggtgattggccctcttttacagccaacacttaacaccagtgctgcagcaattttaaacttgattaaaggagcagaaacttttcccaatgcaacttttggttgggtgaatgttaaggatgttgcaactgcacatatccaggcatttgagattccattagctagtggtagatattgtttagttgagagggttgtacattactcagaaattgtcaacatcttacaccacctctatccttctttgcaacttccacaaaaatgtgcaggtgacaagccgtatgtgccaacatatcaggtgtcaaaggaaaaagcaaaaagcgtgggtatagaattcattcctttggatgccagcctcaaggaaacagtagaaagcctgaaggagaagggatttgtccatttgtcctctctttattagcttcttctacacgctattataatacaaatattagcgttgtttctggttttgatgtcacacttttcttgttttcgttttacttgaatggagaattctgaaaagaactgtgtaatcagctatgttatccaggttcaatcttttctagttttc

SEQ ID NO: 497 - protein, 329 aa, Gossypium hirsutum
  misc_feature (9)..(253): Pfam Name: Epimerase Pfam Description: NAD dependent epimerase/dehydratase fam
  misc_feature (1)..(329): Ceres Clone ID no. 1850477
  misc_feature (1)..(329): Bit score of 376.7 for HMM based on sequences of Figure 16
  misc_feature (1)..(329): Functional Homolog Of SEQ ID NO. 368
MSSGAGKTVCVTGASGYIASWLVKQLLLRGYTVKASVRDPNDPRKTQHLLGLEGAESRLMLLKADLLEQGSFDPVVEGCVGVFHTASPFYHDVLDPEAELLDPAVKGTLNVLSSCAKTPSVKRVVLTSSIAAVAYNGKPRTPDVVVDENWFSDPDYCKDLKLWYVVSKTMAEDSAWKFSKEKGIDMVAINPAMVIGPLLQPTLNTSAAAILNLIKGAETFPNATFGWVNVKDVATAHIQAFEIPLASGRYCLVERVVHYSEIVNILHHLYPSLQLPQKCAGDKPYVPTYQVSKEKAKSVGIEFIPLDASLKETVESLKEKGFVHLSSLY

SEQ ID NO: 498 - protein, 343 aa, Panicum virgatum
  misc_feature (5)..(244): Pfam Name: Epimerase Pfam Description: NAD dependent epimerase/dehydratase f
  misc_feature (1)..(343): Bit score of 795.2 for HMM based on sequences of Figure 16
  misc_feature (1)..(343): Functional Homolog Of SEQ ID NO. 368
MAVTVCVTGAGGFIGSWIVKLLLDRGYAVRGTSRRADDPKNAHLWALDGAAERLTMLQVDLLDRASLRAAFDGCDGVIHTASPMHDNPEEIIEPIIAGTRNVVEAAADAGVRRLVISSTIGTMYMNPHRDPDAPLEEWSWSDLEHCKKTANWYCYAKTIAEQSAWQAARARGLDLAVVIPVVVLGELMQPSMNTSTLHILKYLTGQAKDYVNESHAYVHVKDAAEAHVQVLEAPGAGGHRYVCAERTLHRGELCRMLAQLFPEYPIPTRCKDEVNPPKKGYKFTNQPLKDLGIRFTPAHEYLYEAVKSLQEKGFLSKASVTEVTESSSSPPQKLRLTTLISNL

SEQ ID NO: 499 - protein, 343 aa, Panicum virgatum
  misc_feature (5)..(244): Pfam Name: Epimerase Pfam Description: NAD dependent epimerase/dehydratase f
  misc_feature (1)..(343): Bit score of 790.5 for HMM based on sequences of Figure 16
  misc_feature (1)..(343): Functional Homolog Of SEQ ID NO. 368
MAVTVCVTGAGGFIGSWIVKLLLDRGYAVRGTSRRADDPKNAHLWALDGAAERLTMLQVDLLDRASLRAAFDGCDGVIHTASPMHDNPEEIIEPIIAGTRNVVEAAADAGVRRLVISSTIGTMYMNPHRDPDAPLEEWSWSDLEHCKKTANWYCYAKTIAEQSAWQAARARGLDLAVVIPVVVLGELMQPSMNTSTLHILKYLTGQAKDYVNESHAYVHVKDAAEAHVQVLEAPGAGGHRYVCAERTLHRGELCRMLAQLFPEYPIPTRCKDEVNPPKKGYKFTNQPLKDLGIRFTPAHEYLYEAVKSLQEKDFLSKASVTEVTESSSSPPQKLRLTTLISNL

SEQ ID NO: 500 - protein, 343 aa, Panicum virgatum
  misc_feature (5)..(244): Pfam Name: Epimerase Pfam Description: NAD dependent epimerase/dehydratase f
  misc_feature (1)..(343): Bit score of 786.4 for HMM based on sequences of Figure 16
  misc_feature (1)..(343): Functional Homolog Of SEQ ID NO. 368
MAVTVCVTGAGGFIGSWIVKLLLDRGYAVRGTSRRADDPKNAHLWALDSAAERLTMLQVDLLDRASLRAAFDGCDGVIHTASPMHDNPEEIIEPIIAGTRNVVEAAADAGVRRLVISSTIGTMYMNPHRDPDAPLDEWSWSDLAHCKKTANWYCYAKTIAEQSAWQAARARGLDLAVVIPVVVLGELMQPSMNTSTLHILKYLTGQAKDYVNESHAYVHVKDAAEAHVRVLEAPGTGGHRYVCAERTLHRGELCRMLAQLFPEYPIPTRCKDGVNPPKKGYKFTNQPLKDLGIRFTPTHEYLYEAVKSLQEKGFLPKASVTEVTESSSSPPQKLRLTTLISNL

SEQ ID NO: 501 - protein, 343 aa, Sorghum bicolor
  misc_feature (5)..(244): Pfam Name: Epimerase Pfam Description: NAD dependent epimerase/dehydratase f
  misc_feature (1)..(343): Bit score of 808.0 for HMM based on sequences of Figure 16
  misc_feature (1)..(343): Functional Homolog Of SEQ ID NO. 368
MAVVVCVTGAGGFIGSWIVKILLARGYAVRGTSRRADDPKNAHLWALDGAAERLTMLQVDLLDRASLRAAFRGCDGVIHTASPMHDNPEEIIEPIIVGTRNVVEAAADAGVRRLVLSSTIGTMYMDPRRDPDAALGDSSWSDLEYCKSTKNWYCYAKTIAEQGAWEAARARGLDLAVVIPVVVLGELLQPSMNTSTLHILKYLTGQTKEYVNESHAYVHVKDAAEAHVRVLEAPGAGGRRYVCAERTLHRGELCRILAGLFPEYPIPTRCKDQVNPPKKGYKFTNQPLKDLGIKFTPVHEYLYEAVKSLQEKGFLQKTSNTKVPERRSRLPEQSQPPVLISKL

SEQ ID NO: 502 - protein, 346 aa, Zea mays
  misc_feature (5)..(245): Pfam Name: Epimerase Pfam Description: NAD dependent epimerase/dehydratase f
  misc_feature (1)..(346): Bit score of 797.4 for HMM based on sequences of Figure 16
  misc_feature (1)..(346): Functional Homolog Of SEQ ID NO. 368
MAAVVCVTGAGGFIGSWIVKILLARGYAVRGTSRREAADPKNAHLWALDGAAERLTMLQVDLLDRASLRAAFRGCDGVIHTASPMHDNPEEIIEPIIAGTRNVVEAAADAGVRRLVLSSTIGTMYMDPRRDPDAPLGDSSWSDLEYCKSTENWYCYAKTVAEQGAWEAARARGLDLAVVIPVVVLGELLQPSMNTSTLHILKYLTGQTKEYVNESHAYVHVRDAAEAHVRVLEAPGAGGRRYVCAERTLHRGELCRILAGLFPEYPIPTRCKDQVNPPKKGYKFTNQPLKDLGVKFTPVHGYLYEAVKSLQDKGFLPKTSGAKVPERRSYLPQTTSQPPPEIVSKL

SEQ ID NO: 503 - DNA, 2580 bp, Panicum virgatum
  misc_feature (1)..(2580): Ceres Clone ID no. 1882035
  misc_feature (1)..(2580): Encodes the peptide sequence at SEQ ID NO. 504
aaaacacggctaagttatcgcgctgctgagaccgcggccgccggctcctccgcagagcaatgtcggtagcctccccccatcaccgcagcaccgtcatgccgacgccgcggcagcagatgatggcgcagctcgagcacgggtccctgctggtcggcgggcgcgaactcctcgcccgcgcaccgcccaacgtcaccctccgccccgccggcgtcgccgacgccgaggctgccccgggcaccgcgttcctgggagccagggcggcggagccgtccagccgccacgttttctcggtcggcaccctggctagtggatggaggtggatgtccctgttcaggttcaagatctggtggatggccccggccaccggcgcgggcgcggcggccgtgccggcggagacgcagatgctgctcttggagtccagggatgaggcgggttctgccgccgcggaggggagcgcggtgtacgcgctgatgctgccggttcttgacggcgatttcagggccagcctccaggggagcccccagaacgagctccagttctgcttcgagagcggtgatcctgatgtccagacgatggaagcagttgatgcagtattcatcaactcaggggataacccattcaagctaatgaaggaatccatcaagctgctatcgaagatcaaaggaactttcaggcatatagaggataaggagattcctgcaaatttggactggtttgggtggtgcacatgggatgcattttacaaagctgttaacccagcagggatcgaggagggcattcagagtctgcacgaaggtggtgcgccaccgaggtttctgattatagatgatggttggcaagaaacagttgacgaattcaaggaagtggatgaaaccctccgtgagcagactgtgtttgcacagaggctaattgatcttaaggagaatcataagttcaggggagaaacctgcaagaatcttggaaacctcgtgaagaagatcaaagaaaaacatggagtcaagtttgtttacatgtggcatgctttacttgggtattggggaggcgtcttagcaacatccgatgcgatgaagaagtacaatccaaagcttgcttacccagtccagtcaccaggtaatgttgccaatctgagggacattgccatcgacagcttggagaaatttggagtgggcatcattgatcctgacaagatttatgagttctacaatgatcagcacagctacctttctagtgtgggtgtggatggtgtgaaggttgatgtgcagaacgtgttggaaactcttgtgcatggcttcggtggccgtgttgcagtaacacgaaagtatcagcacgctcttgaggactccattgcccagaacttcaaaagaaacaacctaatctgctgcatgagtcacaattcagacagcatctttagtgccttgaaaagtgcggttgctagagcctctgaagatttcatgcctcgggaaccaacactgcaaactctgcacatcggttatgtggcattcaatagcattttgttgggagaaatcttcatacctgactgggatatgttccttagcaagcatgaaacagcagaatttcacggagcagctagagcactgagtggaggtggcgtctatgtgagtgacaaacccggggtgcatgacttcagtgtcctcaaaaagcttgttctaccagatggctcgattctaagagcaagatatgctggccggcctacacgtgattgtctgttcaatgacccggtcatggatggcaaaagtctgctgaaaatatggaacctgaacaattcttctggtgtcatcggtgcgttcaattgtcagggagccgggcaatgggtttggccagtgaaagacattgcttatgttcccaccagcatcaacatcaccgaccatctctctccttcagatgtagaatctcttgatgagattgccggtgataattggagtggagagactgcagtatatgctttcaattcatgttctctttcaaggcttcagaagcaccaaaatttggaggtttcactgtctaccatggcatgtgagatctacaccatttcaccgataaaggttttcagcaaagccattcagttcgcacctctgggactgatcaacatgttcaactctggcggcgcacttaatgatgtttcgagcacatctgattcttcagctaccacaattcacgtcagatgccgagggccagggcggttcggggcgtattcagccaccaggccggagctctgcagagttgatggccagcaagtggagttcagtcatacagaggatggcctgctagcctttgaccttcctcactgctcatcccacgacggcgacctgtggcgcattgagattctctacagaattccctgaatccgtttaccctcccaacatgcgaggattttcggaggaagttttcagagaagccattgttcagagaaagttttcagagaagccattgttcagttggttctgatggtgctgcattctgctatggccgtgttgtgtgtaattttattcacaatgtgattgttgtgttgtactggtattactgtgattttggtataaaagagagcagcagcgccaattc

SEQ ID NO: 504 - protein, 747 aa, Panicum virgatum
  misc_feature (2)..(727): Pfam Name: Raffinose_syn Pfam Description: Raffinose synthase or seed inhibition p
  misc_feature (1)..(747): Ceres Clone ID no. 1882035
  misc_feature (1)..(747): Bit score of 1919.8 for HMM based on sequences of Figure 3
  misc_feature (1)..(747): in Figure 3
MAQLEHGSLLVGGRELLARAPPNVTLRPAGVADAEAAPGTAFLGARAAEPSSRHVFSVGTLASGWRWMSLFRFKIWWMAPATGAGAAAVPAETQMLLLESRDEAGSAAAEGSAVYALMLPVLDGDFRASLQGSPQNELQFCFESGDPDVQTMEAVDAVFINSGDNPFKLMKESIKLLSKIKGTFRHIEDKEIPANLDWFGWCTWDAFYKAVNPAGIEEGIQSLHEGGAPPRFLIIDDGWQETVDEFKEVDETLREQTVFAQRLIDLKENHKFRGETCKNLGNLVKKIKEKHGVKFVYMWHALLGYWGGVLATSDAMKKYNPKLAYPVQSPGNVANLRDIAIDSLEKFGVGIIDPDKIYEFYNDQHSYLSSVGVDGVKVDVQNVLETLVHGFGGRVAVTRKYQHALEDSIAQNFKRNNLICCMSHNSDSIFSALKSAVARASEDFMPREPTLQTLHIGYVAFNSILLGEIFIPDWDMFLSKHETAEFHGAARALSGGGVYVSDKPGVHDFSVLKKLVLPDGSILRARYAGRPTRDCLFNDPVMDGKSLLKIWNLNNSSGVIGAFNCQGAGQWVWPVKDIAYVPTSINITDHLSPSDVESLDEIAGDNWSGETAVYAFNSCSLSRLQKHQNLEVSLSTMACEIYTISPIKVFSKAIQFAPLGLINMFNSGGALNDVSSTSDSSATTIHVRCRGPGRFGAYSATRPELCRVDGQQVEFSHTEDGLLAFDLPHCSSHDGDLWRIEILYRIP

SEQ ID NO: 505 - DNA, 2535 bp, Zea mays
  misc_feature (1)..(2535): Ceres Clone ID no. 457093
  misc_feature (1)..(2535): Encodes the peptide sequence at SEQ ID NO. 506
ataagacgtcgcgctgctgctgccaccgcagtcgccgactcgtccgcagtgcaatgccgggggcctgccaggacctcagcaccatcacgcccacaccacggcggcagagtatggcgcagctccagcgcgggtccgtgctggttggtgggcgcgagctcctcgtccgcgccccgcccaacgtcaacctacggcccgccggtgccggcgtcgccgacggcggggccgcctcgggcgccgcgttcctcggagccagggctccggccgcgtccagccgccacgtgttctccgtcggaaacctggctagtgggtggaggtggttgtcgttgttcaggttcaagatctggtggatgatcccggccacgggcgtcggcgcggcggctgtgccggcggagacgcagatgctgcttctggagtacaggagcgaggcgggtcctgcggccgcgacggagcgtggctcactgtacgcgctggtgctgccagttcttgacggcggcttccgagccagcctccaggggagccccgaggacgagctacagttctgcttcgagagcggtgatcctgatgtccagacgatggaagcagttgatgcagtgttcgtcaactcaggggacaaccccttcaagcttctgaaagaatccatcaagatgttgtccaagatcaaaggaactttcagtcatatagaggacaaggagatcccttcaaatttggactggtttgggtggtgcacttgggatgcattttacaaagctgttaacccaagtgggattgaggagggccttcaaagtctgcgtgaaggtggtgtgccgccaaggtttctgattatagatgatggttggcaagaaacagttgacgaaatcaaggaagtgaatgaagccctccgtgagcagactgtatttgcgcagaggctggctgatctgaaggagaatcataagttcagaggggaaacctgcaagaatcttgaggaccttgttaaaacgataaaaggaaaacatggagtcaagtgtgtctacatgtggcatgctttacttggatattggggaggtaccttagcaacatccgaagtgatgaagaagtataatccaaagcttgtttatccagtccaatcgcggggtaatgttgcgaatctgagggatattgccatggacagcttggagaaatttggagtgggcatcgttgatcctgacaagatatatgagttctacaatgatcagcacagctacctttctagtgtgggtgtggatggcgtgaaggttgatgttcagaacgtgttggaaacccttggacgcggatttggtggtcgtgttgcagtaactcgaaagtaccagcaggctcttgaggaatcaattgcccagaacttcaaaacaaacaacctaatctgctgcatgagtcacaattcagacagcatctttagtgccttgaagggtgcagttgctagagcctcagaagatttcatgcctcgggaaccaacactgcaaactctgcacattgcgtctgtggcattcaatagcctattgttgggagaaatcttcatacctgactgggatatgttccatagcaagcatgaatcagcggaattccacggagcagctagagccctgagtggaggtggtgtttatgtcagtgacaaacctggggtgcatgatttcagtgttctaaaaaagcttgttctaccagatggttcgattctaagagcaaggtatgctggtcgtcctacacgcgattgtctgttcactgacccagtcatggatggcaaaagtctgatgaagatatggaacttgaacaatttcactggtgtcattggagtgttcaattgtcagggagctggacagtgggtttggccagttaaacaaactgcttatgttcctaccaacataaacatcactggtcagctctcaccgtctgacgtagaatctctcgaggagatagctggtgatgactggaatggggagactgcagtatatgctttcggttcatgttctctttcaaggcttcagaaacaccaaagtttggaggtgtcactgtctactatgacatgtgagatctacagcatttcaccaataaagattttcagcgaagtcgtccagtttacgcctcttggactgatcgacatgttcaactccggtggtgcacttgacaatatttcaagcgttgcagattcttcagctacgacagttcatataagatgccgaggaccagggcggtttggggcgtattcagacaccaggccagagctttgcagagttgatgaacacgaagtggagttcactcttgcagaggatggcctcctgaccttttaccttcccccttcttcctcccaggacaacctgagacacgttgagattgtctacaaagcatcatgaacgacatttacccttatgattcttacgctccagcatgcaatttctggcgtgctcttcagtaaccaccacacatgcacattgacatgatgtaacaaggaacccattttgttggatttgactgtgtatgctgtgctgcaaatacctgttttatacgattgttctgcacctggactgc

SEQ ID NO: 506 - protein, 768 aa, Zea mays
  misc_feature (21)..(749): Pfam Name: Raffinose_syn Pfam Description: Raffinose synthase or seed inhibition p
  misc_feature (1)..(768): Ceres Clone ID no. 457093
  misc_feature (1)..(768): Bit score of 1925.6 for HMM based on sequences of Figure 3
  misc_feature (1)..(768): Functional Homolog Of SEQ ID NO. 504
  misc_feature (1)..(768): in Figure 3
MPGACQDLSTITPTPRRQSMAQLQRGSVLVGGRELLVRAPPNVNLRPAGAGVADGGAASGAAFLGARAPAASSRHVFSVGNLASGWRWLSLFRFKIWWMIPATGVGAAAVPAETQMLLLEYRSEAGPAAATERGSLYALVLPVLDGGFRASLQGSPEDELQFCFESGDPDVQTMEAVDAVFVNSGDNPFKLLKESIKMLSKIKGTFSHIEDKEIPSNLDWFGWCTWDAFYKAVNPSGIEEGLQSLREGGVPPRFLIIDDGWQETVDEIKEVNEALREQTVFAQRLADLKENHKFRGETCKNLEDLVKTIKGKHGVKCVYMWHALLGYWGGTLATSEVMKKYNPKLVYPVQSRGNVANLRDIAMDSLEKFGVGIVDPDKIYEFYNDQHSYLSSVGVDGVKVDVQNVLETLGRGFGGRVAVTRKYQQALEESIAQNFKTNNLICCMSHNSDSIFSALKGAVARASEDFMPREPTLQTLHIASVAFNSLLLGEIFIPDWDMFHSKHESAEFHGAARALSGGGVYVSDKPGVHDFSVLKKLVLPDGSILRARYAGRPTRDCLFTDPVMDGKSLMKIWNLNNFTGVIGVFNCQGAGQWVWPVKQTAYVPTNINITGQLSPSDVESLEEIAGDDWNGETAVYAFGSCSLSRLQKHQSLEVSLSTMTCEIYSISPIKIFSEVVQFTPLGLIDMFNSGGALDNISSVADSSATTVHIRCRGPGRFGAYSDTRPELCRVDEHEVEFTLAEDGLLTFYLPPSSSQDNLRHVEIVYKAS

SEQ ID NO: 507 - DNA, 2268 bp, Sorghum bicolor
  misc_feature (1)..(2268): Ceres Annot ID no. 8701524
  misc_feature (1)..(2268): Encodes the peptide sequence at SEQ ID NO. 508
atgcgggtaggagcctgccatgacctcagcaccgtcacgcccacgccgcggcagcagagtatggcggcgcagctcgagcgcgggtccctactggttggcgggcgcgagctcctcgtccgcgccccgcctaacgtcaccctacggcctgccggtgaggccgccgccgccgccgactcgggcgccgcgttcctcggagccacggcggcggcggcgtccagccgccacgtgttctccgtcggaaacctggcaaggttcaagatctggtggatgatcccggccacgggcgccggcgcggcggctatgccggcggagacgcagatgctgcttctggagtacaggagcgaggccaggacggagcgtggctcactgtacgcgctgatgctgccggttcttgacggcggcttccgggccagcctccaggggagccccgaggacgagctccagttctgcttcgagagcggtgatcctgatgtccagacgatggaagcagttgatgcagtgtttatcaactcaggggacaaccccttcaagcttctgaaggaatccatcaagatggtgtccaagatcaaaggaactttcagtcatatagaggacaaggagattccttcaaatttggactggtttgggtggtgcacttgggatgcattttacaaagctgttaacccaagtgggattgaggagggccttcaaagtctgcgtgaaggtggtgtgccaccaaggtttctgattatagatgatggctggcaagaaacagttgacgaattcaaggaaggggacgaagccatccgtgagcaggccgtatttgcgcataggctgagtgatctgaaggagaaccataagttcaggggagaaacctgcaagaatcttgaggacctcattaagaagataaaagaaaaacatggagtcaagtacatctacatgtggcatgctctacttggatattggggaggcgtcttagcaacatctgatgcgatgaagaagtataatccaaagcttctttacccagtccaatcaccgggtaatgttgcgaatctgagggatattgccatggacagcttggagaaatttggagtgggcatcgttgatcctgacaagatatatgagttctacaatgatcagcacagctacctttctagtgtgggtgtggatggagtgaaggttgatgttcagaacgtgttggaaactcttggacgcggacttggtggacgtgttgcagtaactcaaaagtatcagcaggctcttgaggaatccattgcccagaacttcaaaacaaacaacctaatctgctgcatgagtcacaattcagacagcatctttagtgccttgaagagtgcagttgctagagcctcagaagatttcatgcctagggaaccaacactgcaaactctgcacatcgcttctgtggcattcaatagcctattgttgggagagatcttcatacctgactgggatatgttccatagcaagcatgaatcagcggaatttcacggagctgctagagccctgagtggtggtggggtttatgtcagcgataaacctggggtgcatgatttcaatgttctaaaaaagcttgttctaccagacggctcgattctaagagcaaggtatgctggtcgtcctacacgcgattgtctgttcactgacccagtcatggatggcaaaagtctgctgaagatatggaacttgaacaatttcactggtgtcattggagtgttcaattgtcagggagctggacagtgggtttggccagtgaaagaaactgcttatgttcctatcaacgtaaacatcattggtcagctctcaccgtccgatgtagagtctctcgaggagatagctggtgatgattgggatggagagactgcagtatatgctttcggttcatgttctctttcaaggcttcagaagcacaaaagtttggaggtttcattgtctactatggcatgtgagatttacaacatttcaccaataaagattttcagcgaagccgtttggtttgcgcctcttggactgatcgacatgttcaactccggtggtgcacttcacaatgtttcaagtgttgcagattcttcagctacgaccgttcatatcagatgccgaggaccagggtggtttggggcgtattcagccaccaggccagagctttgcagagttgatgaacacgaagtggagttcactcatgcagaggatggcctgctgaccttttatctccccctttcttcctcccaggacaacctgagacacattgaaattgtctacagagctttatga

SEQ ID NO: 508 - protein, 755 aa, Sorghum bicolor
  misc_feature (23)..(736): Pfam Name: Raffinose_syn Pfam Description: Raffinose synthase or seed inhibition p
  misc_feature (1)..(755): Ceres Annot ID no. 8701524
  misc_feature (1)..(755): Bit score of 1901.3 for HMM based on sequences of Figure 3
  misc_feature (1)..(755): Functional Homolog Of SEQ ID NO. 504
  misc_feature (1)..(755): in Figure 3
MRVGACHDLSTVTPTPRQQSMAAQLERGSLLVGGRELLVRAPPNVTLRPAGEAAAAADSGAAFLGATAAAASSRHVFSVGNLARFKIWWMIPATGAGAAAMPAETQMLLLEYRSEARTERGSLYALMLPVLDGGFRASLQGSPEDELQFCFESGDPDVQTMEAVDAVFINSGDNPFKLLKESIKMVSKIKGTFSHIEDKEIPSNLDWFGWCTWDAFYKAVNPSGIEEGLQSLREGGVPPRFLIIDDGWQETVDEFKEGDEAIREQAVFAHRLSDLKENHKFRGETCKNLEDLIKKIKEKHGVKYIYMWHALLGYWGGVLATSDAMKKYNPKLLYPVQSPGNVANLRDIAMDSLEKFGVGIVDPDKIYEFYNDQHSYLSSVGVDGVKVDVQNVLETLGRGLGGRVAVTQKYQQALEESIAQNFKTNNLICCMSHNSDSIFSALKSAVARASEDFMPREPTLQTLHIASVAFNSLLLGEIFIPDWDMFHSKHESAEFHGAARALSGGGVYVSDKPGVHDFNVLKKLVLPDGSILRARYAGRPTRDCLFTDPVMDGKSLLKIWNLNNFTGVIGVFNCQGAGQWVWPVKETAYVPINVNIIGQLSPSDVESLEEIAGDDWDGETAVYAFGSCSLSRLQKHKSLEVSLSTMACEIYNISPIKIFSEAVWFAPLGLIDMFNSGGALHNVSSVADSSATTVHIRCRGPGWFGAYSATRPELCRVDEHEVEFTHAEDGLLTFYLPLSSSQDNLRHIEIVYRAL

SEQ ID NO: 509 - protein, 738 aa, Oryza sativa subsp. indica
  misc_feature (2)..(719): Pfam Name: Raffinose_syn Pfam Description: Raffinose synthase or seed inhibition p
  misc_feature (1)..(738): Public GI ID no. 90265053
  misc_feature (1)..(738): Bit score of 1897.0 for HMM based on sequences of Figure 3
  misc_feature (1)..(738): Functional Homolog Of SEQ ID NO. 504
  misc_feature (1)..(738): in Figure 3
MARLERGSLVVGGRELLERAPPSVALRRPAVVASPGDAAFLGATAPAPSSRHVFSLGTLASGWKWLSLFRFKIWWMIPTVGEDAAGVPAETQMLLLESRSEAGAALYALMLPVLDGGFRASLQGSPENELQFCFESGDPEVQTLEAVDAVFINSGDSPFKLMKESIKMLSKIKGTFSHIEDKEIPANLDWFGWCTWDAFYKSVNPVGIEEGLKSLCEGGAPPRFLIIDDGWQETVNGFKEVDEAFIEQTVFAERLIDLTENDKFRGETCKNLGDHVKKIKEHYGVKYVYIWHALHGYWGGVLTTPDAMKKYNPQLVYPVQSPGNVANLRDIAMDSLEKFGVGIIDPAMIYDFYNDQHSYLSSVGVDGVKVDVQNVMETLGKGFGGRVALTQKYQQALEESITRNFKGNNLICCMSHNTDSIFSSLKSAVARASEDFMPREPTMQTLHIATVAFNSLLLGEIFIPDWDMFHSKHESAEFHGAARALSGGGVYVSDKPGMHDFSVLKKLVLPDGLILRAKHAGRPTRDCLFNDPVMDGKSLLKIWNLNKFSGVIGVFNCQGAGNWIYPVKENAHVPTTVCITGDLSPSDVELLEEIAGDDWNGETAVFAFNSCSLSRLQKHQTMEVSLSTMTCEIYTIALIKVFGGFVQFAPLGLVNMYNSGGALENVTSTGDCSEITIQIQCRGPGRFGAYSATRPEICSVDEHEVEFKHTDDGFLAFDLSHGSSQDNLRNIEILYRAS

SEQ ID NO: 510 - DNA, 2259 bp, Populus balsamifera subsp. trichocarpa
  misc_feature (1)..(2259): Ceres Annot ID no. 1473716
  misc_feature (1)..(2259): Encodes the peptide sequence at SEQ ID NO. 511
atgacaatcaaagccacgcctatcatcaaagatggctgcctcatggtgagaggcaaggtggttctgagcagagttccacaaaacattcttgtttctccggcaagcaatggctctgctttctttggtgctacatctccatctcctagttctcgccatgtgtttagccttggagttcttgagaagtacaggttcttgtgcctttttagagtcaaaatctggtggatgatacctcgtgtagggaaatccggtagtgaaattcccatggaaactcaaatgcttttgttggaagcaacagaggaatctgccctgaatgacgaggtgaattcttctgaaacatcgacagataacactttctacattcttttcttgcctgtcttggatggactatttcgatctagtttgcaaggaacttcggaaaatgagctccacttctgcgttgaaagcggagatgctaatgtccaaacctcacaagcacttgaagcagtatttgtgaactcaggggagaacccttttgagcttattaagaattctgtcaagatactggagcaacacaaggggaccttttgccacattgagaacaagaagattcctgcacatttagactggtttggctggtgtacttgggatgctttttacactcaagtaaatccacaaggaatcaaagagggtcttcaaagtttcttagaaggtgggtgttcaccgaagtttcttattattgatgatggatggcaagacacagtgaatgaatttcgcaaggaaggtgaacctcttatcgaagggacacagtttgctactagattggtagatataaaagaaaatggaaaattcagaagttcaggtccagatgaaggctgcaccgatttgcatgaatttattgataccatcaaagagaaatatggattaaaatttgtttatatgtggcacgctttagctggttattggggaggggttcttccatcatctgattcaatgaaaaagtacaacccgaaacttgtatatccaattcagtcacctggtaatgtggggaacatgagagacattgcaatggacagcttggagaaatatggagttggagtcattgatcccagtaagatatttgatttctacaatgatcttcatagctatctggcaagcaatggtgtagatggagtcaaggtggacgtccagaatctgattgaaactttaggttctggatgtggaggtcgagtgacgttgactagacagtatcaggaagcacttgagagatctatttcaagaaactttaaagaaaataatctaatttgttgcatgagtcacaactctgactcaatttacagttcgaagagaagtgcaattgcaagagcatcagaggatttcatgccaagagagccaacatttcagaccttgcacattgcgtctgtagctttcaacagctttcttcttggggagattgttgttccagactgggacatgttccatagcaaacatgataccgctgatttccatggtgctgcaagagcattgggtggatgtgcagtatatgtaagtgacaagccaggcattcatgacttcaaaatccttaagaagctcgtgttgcctgacgggtctatcctgagagctagacatgctggccgtcccacaagagattgcttatttgaagatcctgtcatggatgcgaaaagtttgttgaagatatggaacttgaacaagttaactggggtcatcggtgtttttaattgccaaggagcaggaagttggccaatgaaacaagaagctgaagaaatacctactgtgccttccgggccttcatccctttcaggtcatgtgagtcctattgatgttgaatttctcgacgatattgccggtgaagattggaatggagattgtgcaatctatgctttcaattcaggatctctttccatgctgccaaagaaagggattcttgaggtgtccctgaccactctaaaatacgagatatataccatctctccaattaaggtttttggtcagaatcttcagttttctccgataggattgcttgacatgtacaactcaggaggagcagtggaagctgtgaactgcattatcgatgtttcatcttacacaatcaaagtcaatggccgaggcggtggccgatttggagcctactccaacactaaaccaaccttttgcagggtggacatgaaagaagaagagttcacttacaacgacaaaaatggattattgatagtcaaacttgaatgcacaggcaatttaagagagattgaattcatatattag

SEQ ID NO: 511 - protein, 752 aa, Populus balsamifera subsp. trichocarpa
  misc_feature (9)..(739): Pfam Name: Raffinose_syn Pfam Description: Raffinose synthase or seed inhibition p
  misc_feature (1)..(752): Ceres Annot ID no. 1473716
  misc_feature (1)..(752): Bit score of 1954.2 for HMM based on sequences of Figure 3
  misc_feature (1)..(752): Functional Homolog Of SEQ ID NO. 504
  misc_feature (1)..(752): in Figure 3
MTIKATPIIKDGCLMVRGKVVLSRVPQNILVSPASNGSAFFGATSPSPSSRHVFSLGVLEKYRFLCLFRVKIWWMIPRVGKSGSEIPMETQMLLLEATEESALNDEVNSSETSTDNTFYILFLPVLDGLFRSSLQGTSENELHFCVESGDANVQTSQALEAVFVNSGENPFELIKNSVKILEQHKGTFCHIENKKIPAHLDWFGWCTWDAFYTQVNPQGIKEGLQSFLEGGCSPKFLIIDDGWQDTVNEFRKEGEPLIEGTQFATRLVDIKENGKFRSSGPDEGCTDLHEFIDTIKEKYGLKFVYMWHALAGYWGGVLPSSDSMKKYNPKLVYPIQSPGNVGNMRDIAMDSLEKYGVGVIDPSKIFDFYNDLHSYLASNGVDGVKVDVQNLIETLGSGCGGRVTLTRQYQEALERSISRNFKENNLICCMSHNSDSIYSSKRSAIARASEDFMPREPTFQTLHIASVAFNSFLLGEIVVPDWDMFHSKHDTADFHGAARALGGCAVYVSDKPGIHDFKILKKLVLPDGSILRARHAGRPTRDCLFEDPVMDAKSLLKIWNLNKLTGVIGVFNCQGAGSWPMKQEAEEIPTVPSGPSSLSGHVSPIDVEFLDDIAGEDWNGDCAIYAFNSGSLSMLPKKGILEVSLTTLKYEIYTISPIKVFGQNLQFSPIGLLDMYNSGGAVEAVNCIIDVSSYTIKVNGRGGGRFGAYSNTKPTFCRVDMKEEEFTYNDKNGLLIVKLECTGNLREIEFIY

SEQ ID NO: 512 - protein, 750 aa, Vitis vinifera
  misc_feature (8)..(737): Pfam Name: Raffinose_syn Pfam Description: Raffinose synthase or seed inhibition p
  misc_feature (1)..(750): Public GI ID no. 225456842
  misc_feature (1)..(750): Bit score of 1938.4 for HMM based on sequences of Figure 3
  misc_feature (1)..(750): Functional Homolog Of SEQ ID NO. 504
  misc_feature (1)..(750): in Figure 3
MTITAKPSITDSGLMVGGRVVCNRVAENLVVSPESSGSAFLGATSPAPRSRHVFNVGVLEGYRFICLFRAKFWWMIPRVGKSASEIPMETQMLLLDVREESALDDENSSDMTSESTFYVLFLPVLDGPFRTSLQGTSENVLQFCVESGDPSVQASQVLEAVLINSGDNPFELLKNSIKILEKRKGTFAHIEHKKAPPHLDWFGWCTWDAFYTEVNPQGIREGLQSFLEGGCPPKFLIIDDGWQETINEFHKGSKLHIDGTQFATRLVDIRENSKFKSSGSESSCIDLHDFIQTIKERYRLKFVYMWHAIIGYWGGVLPSSKMMEKYNPKLAYPIQSPGNIGNLRDIAVDSLEKYGVGMIDPEKIFHFYNDLHGYLASSGVDGVKVDVQNILETIGKGYGGRVLLTRQYQFALDESIARNFKDNSLICCMSHNSDSIYSSRKSAVARASEDFMPKEPTFQTVHIASVAFNSLLLGEIVVPDWDTFHSNHSTAEFHGAARALGGCAVYVSDRPGTHDFRILKRLVLPDGSVLRAKYPGRPTRDCLFKDPVMDGESLLKIWNLNKLSGVVGVFNCQGAGNWPMKDAEAVPVLASTPTFLSGHVSPLDVEYLDQVAGDNWRGDSAVYAFYSGSLSRLSKKANLEVSLAVLKCEIFTICPVRVLGQNLQFAPIGLLDMYNSGGAVEALEHTNHPAGCRVKISVRGCGRFGAYSSKKPLSCIVDMQEEEFQYNAEGGLLTLKLQGECSLREIKIVY

SEQ ID NO: 513 - protein, 765 aa, Brassica oleracea
  misc_feature (7)..(749): Pfam Name: Raffinose_syn Pfam Description: Raffinose synthase or seed inhibition p
  misc_feature (1)..(765): Public GI ID no. 488787
  misc_feature (1)..(765): Bit score of 1936.0 for HMM based on sequences of Figure 3
  misc_feature (1)..(765): Functional Homolog Of SEQ ID NO. 504
  misc_feature (1)..(765): in Figure 3
MTITSNISVQNDNLVVQGKTILTKIPDNIILTPVAGAGSDSGAFIGATFKQSKSLHVFPIGVLEGLRFMCCFRFKLWWMTQRMGASGKDIPLETQFMLLESKDEVNGDDAPTVYTVFLPLLEGQFRAVLQGNEKNEIEICLESGDKAVGTSQGTHLVYVHAGTNPFEVITQSVKAAERQMQTFHHREKKKLPSFVDWFGWCTWDAFYTDVTAEGVDEGLRSLSEGGTPPRFLIIDDGWQQIENKEKDSNCLVQEGAQFATRLVGIKENAKFQKNDPKDTQVSGLKSVVDNAKQRHNVKQVYAWHALAGYWGGVKPRASGMEHYDSALAYPVQSPGVLGNQPDIVMDSLAVHGLGLVNPKKVFNFYNELHSYLASCGIDGVKVDVQNIIETLGAGLGGRVSLTRSYHQALEASIARNFKDNGCISCMCHNTDGLYSAKQTAIVRASDDYYPRDPASHTIHIASVAYNTLFLGEFMQPDWDMFHSLHPTAEYHAAARAVGGCAIYVSDKPGNHNFDLLRKLVLPDGSVLRARLPGRPTRDCLFADPARDGTSLLKIWNMNKFTGIVGVFNCQGAGWCKDTKKNRIHDTSPGTLTGLVRAEDADLISEVAGQDWGGDSIVYAYKSGELVRLPKGASIPLTLKVLEYELFHISPLKEITASISFAPIGLLDMFNSSGAIQSMEINTVTDEKPELSSSSVVSENRSPTALISLGVRGCGRFGAYSSQRPLRCAVDGTETEFNYDAEVGLVTLNLPVTREEMFRWRVEILV

SEQ ID NO: 514 - protein, 772 aa, Cucumis sativus
  misc_feature (7)..(756): Pfam Name: Raffinose_syn Pfam Description: Raffinose synthase or seed inhibition p
  misc_feature (1)..(772): Public GI ID no. 91075914
  misc_feature (1)..(772): Bit score of 1939.6 for HMM based on sequences of Figure 3
  misc_feature (1)..(772): Functional Homolog Of SEQ ID NO. 504
  misc_feature (1)..(772): in Figure 3
MTVTPKITVNDGNLVVHGKTILTGVPDNIVLTPGSGLGLVAGAFIGATASNSKSLHVFPVGVLEGTRFLCCFRFKLWWMTQRMGTSGRDIPFETQFLLMESQGNDGEDPDNSSTIYTVFLPLLEGQFRAALQGNEKNEMEICLESGDNTVETNQGLSLVYMHAGTNPFEVITQAVKAVEKHTQTFLHREKKKLPSFLDWFGWCTWDAFYTDVTAEGVVEGLQSLSDGGAPPKFLIIDDGWQQIEAKPKDADCVVQEGAQFASRLSGIKENHKFQKNGNNYDQVPGLKVVVDDAKKQHKVKFVYAWHALAGYWGGVKPASPGMEHYDSALAYPVQSPGMLGNQPDIVVDSLAVHGIGLVHPKKVFNFYNELHSYLASCGIDGVKVDVQNIIETLGAGHGGRVTLTRSYHQALEASIARNFSDNGCIACMCHNTDSLYSAKQTAVVRASDDYYPRDPASHTIHISSVAYNSLFLGEFMQPDWDMFHSLHPTAEYHGAARAIGGCAIYVSDKPGNHNFDLLKKLVLPDGSVLRAQLPGRPTRDSLFNDPARDGTSLLKIWNMNKCSGVVGVFNCQGAGWCRITKKTRIHDESPGTLTTSVRAADVDAISQVAGADWKGDTIVYAYRSGDLTRLPKGASVPVTLKVLEYDLFHISPLKDITSNISFAPIGLVDMFNIGGAVEQVDIQVVEPIPEFDGEVASELTCSLPDDRPPTATITMKARGCGRFGLYSSQRPLKCSVDKVGTDFVYDDVTGLVTFEIPIPTEEMYRWNIEIEV

SEQ ID NO: 515 - protein, 773 aa, Arabidopsis thaliana
  misc_feature (7)..(757): Pfam Name: Raffinose_syn Pfam Description: Raffinose synthase or seed inhibition p
  misc_feature (1)..(773): Public GI ID no. 15292677
  misc_feature (1)..(773): Bit score of 1947.5 for HMM based on sequences of Figure 3
  misc_feature (1)..(773): Functional Homolog Of SEQ ID NO. 504
  misc_feature (1)..(773): in Figure 3
MTITSNISVQNDNLVVQGKTILTKIPDNIILTPVTGNGFVSGSFIGATFEQSKSLHVFPIGVLEGLRFMCCFRFKLWWMTQRMGSCGKDIPLETQFMLLESKDEVEGNGDDAPTVYTVFLPLLEGQFRAVLQGNEKNEIEICFESGDKAVETSQGTHLVYVHAGTNPFEVIRQSVKAVERHMQTFHHREKKKLPSFLDWFGWCTWDAFYTDVTAEGVDEGLKSLSEGGTPPKFLIIDDGWQQIENKEKDENCVVREGAQFATRLVGIKENAKFQKSDQKDTQVSGLKSVVDNAKQRHNVKQVYAWHALAGYWGGVKPAASGMEHYDSALAYPVQSPGVLGNQPDIVMDSLAVHGLGLVNPKKVFNFYNELHSYLASCGIDGVKVDVQNIIETLGAGLGGRVSLTRSYQQALEASIARNFTDNGCISCMCHNTDGLYSAKQTAIVRASDDFYPRDPASHTIHIASVAYNSLFLGEFMQPDWDMFHSLHPTAEYHAAARAVGGCAIYVSDKPGNHNFDLLRKLVLPDGSVLRAKLPGRPTRDCLFADPARDGISLLKIWNMNKFTGIVGVFNCQGAGWCKETKKNQIHDTSPGTLTGSIRADDADLISQVAGEDWSGDSIVYAYRSGEVVRLPKGASIPLTLKVLEYELFHISPLKEITENISFAPIGLVDMFNSSGAIESIDINHVTDKNPEFFDGEISSASPALSDNRSPTALVSVSVRGCGRFGAYSSQRPLKCAVESTETDFTYDAEVGLVTLNLPVTREEMFRWHVEILV

SEQ ID NO: 516 - protein, 757 aa, Hordeum vulgare subsp. vulgare
  misc_feature (7)..(741): Pfam Name: Raffinose_syn Pfam Description: Raffinose synthase or seed inhibition p
  misc_feature (1)..(757): Public GI ID no. 167100
  misc_feature (1)..(757): Bit score of 1909.8 for HMM based on sequences of Figure 3
  misc_feature (1)..(757): Functional Homolog Of SEQ ID NO. 504
  misc_feature (1)..(757): in Figure 3
MTVTPQITVGDGRLAVRGRTVLSGVPDNVTAAHAAGAGLVDGAFVGATAAEAKSHHVFTFGTLRDCRFMCLFRFKLWWMTQRMGTSGRDVPLETQFILIEVPAAAGNDDGDSSDGDSEPVYLVMLPLLEGQFRTVLQGNDQDELQICIESGDKAVETEQGMNNVYVHAGTNPFDTITQAVKAVEKHTQTFHHREKKTVPSFVDWFGWCTWDAFYTDVTADGVKQGLRSLAEGGAPPRFLIIDDGWQQIGSENKDDPGVAVQEGAQFASRLTGIRENTKFQSEHNQEETPGLKRLVDETKKEHGVKSVYVWHAMAGYWGGVKPSAAGMEHYEPALAYPVQSPGVTGNQPDIVMDSLSVLGLGLVHPRRVHRFYDELHAYLAACGVDGVKVDVQNIVETLGAGHGGRVALTRAYHRALEASVARNFPDNGCISCMCHNTDMLYSAKQTAVVRASDDFYPRDPASHTVHISSVAYNTLFLGEFMQPDWDMFHSLHPAAEYHGAARAIGGCPIYVSDKPGNHNFDLLRKLVLPDGSVLRAQLPGRPTRDCLFSDPARDGASLLKIWNMNKCAGVVGVFNCQGAGWCRVAKKTRIHDEAPGTLTGSVRAEDVEAIAQAAGTGDWGGEAVVYAHRAGELVRLPRGATLPVTLKRLEYELFHVCPVRAVAPGVSFAPIGLLHMFNAGGAVEECTVETGEDGNAVVGLRVRGCGRFGAYCSRRPAKCSVDSADVEFTYDSDTGLVTADVPVPEKEMYRCALEIRV

SEQ ID NO: 517 - protein, 738 aa, Oryza sativa subsp. japonica
  misc_feature (2)..(719): Pfam Name: Raffinose_syn Pfam Description: Raffinose synthase or seed inhibition p
  misc_feature (1)..(738): Public GI ID no. 38345247
  misc_feature (1)..(738): Bit score of 1892.7 for HMM based on sequences of Figure 3
  misc_feature (1)..(738): Functional Homolog Of SEQ ID NO. 504
MARLERGSLVVGGRELLERAPPSVALRRPAVVASPGGAAFLGATAPAPSSRHVFSLGTLASGWKWLSLFRFKIWWMIPTVGEDAAGVPAETQMLLLESRSEAGAALYALMLPVLDGGFRASLQGSPENELQFCFESGDPEVQTLEAVDAVFINSGDNPFKLMKESIKMLSKIKGTFSHIEDKEIPANLDWFGWCTWDAFYKSVNPVGIEEGLKSLCEGGAPPRFLIIDDGWQETVNGFKEVDEAFIEQTVFAERLIDLTENDKFRGETCKNLGDHVKKIKEHYGVKYVYIWHALHGYWGGVLTTPDAMKKYNPQLVYPVQSPGNVANLRDIAMDSLEKFGVGIIDPAMIYDFYNDQHSYLSSVGVDGVKVDVQNVMETLGKGFGGRVALTQKYQQALEESIARNFKGNNLICCMSHNTDSIFSSLKSAVARASEDFMPREPTMQTLHIATVAFNSLLLGEIFIPDWDMFHSKHESAEFHGAARALSGGGVYVSDKPGMHDFSVLKKLVLPDGLILRTKHAGRPTRDCLFNDPVMDGKSLLKIWNLNKFSGVIGVFNCQGAGNWTYPVKENAHVPTTVCITGDLSPSDVELLEEIAGDDWNGETAVFAFNSCSLSRLQKHQTMEVSLSTMTCKIYTIALIKVFGGFVQFAPLGLVNMYNSGGALENVTSTGDCSEITIQIQCRGPGRFGAYSATRPEICSVDEHEVEFKHTDDGFLAFDLSHGSSQDNLRNIEILYRAS

SEQ ID NO: 518 - DNA, 2328 bp, Populus balsamifera subsp. trichocarpa
  misc_feature (1)..(2328): Ceres Annot ID no. 1480323
  misc_feature (1)..(2328): Encodes the peptide sequence at SEQ ID NO. 519
atggtgagtatgacaacgttaactaggcctcggaaacccaattcttgtttctcctcctcctccacattcttaccccattgtaatatccagaccctgagattccttccacacaggtctcttctgcgtctcaataagaacaattgttacaaatggaagcattctatgtttatcagtacaaagcccttgctaaaagatggaactctcagtctaaatggccaagaagcaatcacaggagtgcctgacaatgtcttccttacacctttgtcggattcatctgcattcttgggtgctacttcctctcaaagcagttccagacatgttttcaagcttggagttattcaggatgtgagactactgagtctgtttagatttaaagtttggtggatgatacctagagtggggaattcaggaagtgacattcctattgaaactcagatgttgctgctggaagctaggaaaggaccagatttagacaagtcaaatgattctccctcttatatcatattcttgcctttgctagatggtgaatttcgaagcagcttgcaggggaactcatcaaatgaacttgagttctgtcttgaaagtggtgaccccgctatagttacttcagaatccataagagcagtttttgtgaattatgggaaccatccatttgatctaatgaaggaatcaatgaagattttggaggagcagactggaaccttttctatgccaggaatactagatgtgtttggttggtgcacctgggatgctttttatcaggaagtaaatcctcaaggaataaaagatggcttgaaaagtttatccgagggaggcactccagcaaagtttttgataatagatgacggttggcaggataccactaatgaattccaaaaagaagtagagccatttattgatggttcacagctttctgatctcccccaaatttcaggtttggaggcagatattaagaggaattttggccttaagtacgtctatgtatggcatgccctcatgggatattggggaggccttgttccaaatgctcgtgatactaagaagtataatcccaaattaacctacccactgcaatcgccagggaacttggcaaatatgagggatctagctatggattgcatggagaagtatggtgttggtgcaattgaccctgacagaatatctcagttttatgatgatctacacagctatcttgtttcacaggatgtggatggggttaaggttgatgttcagaatatactggaaactattgcgactgatttaggaggtcgagtctcacttaccagacatttccaagaagcacttgagaagtctatagcttccaacttccaggacaacagcattatctgctgtatgggtctgagcacagactccatttaccactcaaaaagaagtgctattacacgggcctctgatgattactatccgaaaaatccagctacacagacactgcacatagctgctgtggcttttaacagcatatttcttggcgaagttgttgttccagattgggatatgttctatagtctccatgatgcagctgaatttcatgccatcgctagagctgtgggagggtgtcctgtctatgtcagtgataaacctggtgagcatgatcacaagatacttaagaggcttgtacttcctgatggatcagtgcttagagccaaatatccaggaagaccatcaagagattgtttattcattgacccagttatggatgggaagagtcttctgaagatttggaatttgaacaaatgcactggagttattggtgtgttcaactgccaaggagcaggaagctggccttgtctggataacacaaaccagaatcatgtcagtaatagtgcagaggtatctggacaagtttctcctgctgatgttgagtattttgaagaggtctctgggaaactgtggaccggagattgtgcaatctattctttcaataaaggatcagtgtctcggttaccgaaggaagaaaagtttggtgttggattacaaactctggaatgtgatgtctttactgtatcacctatcaaggtttactatcagaggattgagttcgcacccatcggattgatgaacatgtacaacagtggtggagctatagagtcagttgagcagtgtggtgatccatcaagctataatggaagaatacacataaagggaagaggggcaggtagttttggtggatactcgagtgtgaagccaaagggttgctccataaatggagaagaagaagaaatgaagtacggagaagaagataaactggtgacagtaaccatagatgcctccaataatagtggttgggacatggatatatggtactga

SEQ ID NO: 519 - protein, 775 aa, Populus balsamifera subsp. trichocarpa
  misc_feature (63)..(761): Pfam Name: Raffinose_syn Pfam Description: Raffinose synthase or seed inhibition p
  misc_feature (1)..(775): Ceres Annot ID no. 1480323
  misc_feature (1)..(775): Bit score of 1376.5 for HMM based on sequences of Figure 3
  misc_feature (1)..(775): Functional Homolog Of SEQ ID NO. 504
MVSMTTLTRPRKPNSCFSSSSTFLPHCNIQTLRFLPHRSLLRLNKNNCYKWKHSMFISTKPLLKDGTLSLNGQEAITGVPDNVFLTPLSDSSAFLGATSSQSSSRHVFKLGVIQDVRLLSLFRFKVWWMIPRVGNSGSDIPIETQMLLLEARKGPDLDKSNDSPSYIIFLPLLDGEFRSSLQGNSSNELEFCLESGDPAIVTSESIRAVFVNYGNHPFDLMKESMKILEEQTGTFSMPGILDVFGWCTWDAFYQEVNPQGIKDGLKSLSEGGTPAKFLIIDDGWQDTTNEFQKEVEPFIDGSQLSDLPQISGLEADIKRNFGLKYVYVWHALMGYWGGLVPNARDTKKYNPKLTYPLQSPGNLANMRDLAMDCMEKYGVGAIDPDRISQFYDDLHSYLVSQDVDGVKVDVQNILETIATDLGGRVSLTRHFQEALEKSIASNFQDNSIICCMGLSTDSIYHSKRSAITRASDDYYPKNPATQTLHIAAVAFNSIFLGEVVVPDWDMFYSLHDAAEFHAIARAVGGCPVYVSDKPGEHDHKILKRLVLPDGSVLRAKYPGRPSRDCLFIDPVMDGKSLLKIWNLNKCTGVIGVFNCQGAGSWPCLDNTNQNHVSNSAEVSGQVSPADVEYFEEVSGKLWTGDCAIYSFNKGSVSRLPKEEKFGVGLQTLECDVFTVSPIKVYYQRIEFAPIGLMNMYNSGGAIESVEQCGDPSSYNGRIHIKGRGAGSFGGYSSVKPKGCSINGEEEEMKYGEEDKLVTVTIDASNNSGWDMDIWY

SEQ ID NO: 520 - DNA, 2719 bp, Panicum virgatum
  misc_feature (1)..(2719): Ceres Clone ID no. 1807161
  misc_feature (1)..(2719): Encodes the peptide sequence at SEQ ID NO. 521
aatcctgattgcgagggcagctaattactagtgctaagctcgctagcgtaattagccacgactggtagctttgtttgtcgccgcgctaattagtgattagcgtgtgacagaggaggtaatagtaattccggtggcggttctctgatctcggcggagagagagagatgacggtgacgccgaagatcacggtgggggatgggcggctggtggcgcacgggcggaccatcctgaccggcgtgccggagaacatcgtgctgacgcacgcctccggggcggagctcgtcgacggcgccttcgtcggcgccacggccggcgaggccaagagcatgcacgtcttcaccttcggcaccctcagggacctgcggttcatgtgctgcttccggttcaagctgtggtggatgacccagcgcatgggcacctccggccgcgacgtcccgctggagacgcagttcatgctcctggagagccggccgggcgccggcgccggcggcgacgacgacagcggcgagccggtgtacctggtgatgctgccgctgctggagggccagttccgcgccgcgctgcagggcaacgaccgcgacgagctggagatcaccctcgagagcggggacaaggaggttcagacggcgcaggggacctacatggtgtacgtgcacgccgggaccaaccccttcgacaccatcactcaggctgtcaaggttgtggagaggcacctgcagacgttccaccacagggacaagaaaaagctgccgtccttcgtggactggttcgggtggtgcacatgggacgccttctacaccgacgtcaccgccgagggcgtcaagcagggcctgcagagcttggcggagggcggcacgccgccgcggttcctgatcatcgacgacgggtggcagcagatcggcagcgagaacaaggaggaggccaatgccgtcgtgcaggaaggcgcgcagttcgccagcaggctgacggggatcaaggagaacgccaagttccagaacaagaaggaggaggcagagcagcagcagagccagcagcaggccgagcagggccccgggctgaagcttctggtggaggaggcgaagcgcgagcacggcgtcaagtacgtgtacgtgtggcacgccatggcggggtactggggcggcgtgaagccggcggcggaggggatggagcactacgagagcgcgctggcgttccccgtgcagtcgccgggggtgatgggcaaccagccggacatcgtcatggactccctctccgtgctggggctgggcctggtgcacccgcgcaaggccctccgcttctacgacgagctccactcgtacctggccacctgcggcgtggacggcgtcaaggtggacgtgcagaacatcatcgagaccctgggcgccgggcacggcggccgcgtgtcgctcacccgcgcctaccaccacgcgctcgaggcctccgtggcgcgcaacttccccgacaacggctgcatctcctgcatgtgccacaacaccgacatgctctacagcgcccgccagaccgccgtcgtgcgcgcctccgacgacttctacccgcgcgacccggcctcgcacaccatccacatctcctccgtcgcctacaacacgctcttcctcggcgagttcatgcagcccgactgggacatgttccatagcctgcacccggcggcggagtaccacggcgcggcgcgggcgatcggcggctgccctatctacgtcagcgacaagccgggcaaccacaacttcgagctgctcaagaagctcgtgctccccgacggctccgtgctccgcgcgcagctccccggccgccccacccgcgactgcctcttcgccgacccggcgcgcgacggcaccagcctgctcaagatctggaacgtgaacaagtgcacgggcgtggtgggcgtgttcaactgccagggcgccggctggtgccgcgtcaccaagaagacccgcgtccacgacgccgcgccggggacgctcaccgggtccgtccgcgccgaggacgtcgacgccatcgccgacctcgccggcccgggctggggcggcgaggccgtcgtgtacgcctaccggtcgggggagctcatccggctgcccaggggcgccacgctgccggtgacgctcagggtcctcgagttcgagctgttccacgtcgcccccgtcaaggaggtggcgccgggcgtgtcgttcgcgcccatcgggctgctcggcatgttcaacgccggcggcgcggtggagcagtgcgaggccgcggacggcgcggccgccgccgtgcggctcagggtccgcggctgcggccggttcggcgcctactgctcgcggaggccggcgcggtgcacgctggacgcggcggaggcggagttcacctacgacgcagacacgggactcgtcgcgctcgacatccccgtgccggagcaggagttgtacagatggaacctggagatccaggtctaggaggctcttcgatccgaccttctcaggaggctcttcgatcttctccgtcgacgtgtccgtgatggtgctcgcctcattcttcggtggacttgaccattttacgcgtgtgtggttggtgtggccatggagaggtgcgtgtgtgcacgaaatgaagccgtccgccattgatgcgtcctctctctctctctccctagaagaataaactagcgctgctctgtatactgcactacttctgttgcatatgcaataaacgaccactccatgtatgc

SEQ ID NO: 521 - protein, 761 aa, Panicum virgatum
  misc_feature (7)..(745): Pfam Name: Raffinose_syn Pfam Description: Raffinose synthase or seed inhibition p
  misc_feature (1)..(761): Ceres Clone ID no. 1807161
  misc_feature (1)..(761): Bit score of 1789.3 for HMM based on sequences of Figure 3
  misc_feature (1)..(761): Functional Homolog Of SEQ ID NO. 504
MTVTPKITVGDGRLVAHGRTILTGVPENIVLTHASGAELVDGAFVGATAGEAKSMHVFTFGTLRDLRFMCCFRFKLWWMTQRMGTSGRDVPLETQFMLLESRPGAGAGGDDDSGEPVYLVMLPLLEGQFRAALQGNDRDELEITLESGDKEVQTAQGTYMVYVHAGTNPFDTITQAVKVVERHLQTFHHRDKKKLPSFVDWFGWCTWDAFYTDVTAEGVKQGLQSLAEGGTPPRFLIIDDGWQQIGSENKEEANAVVQEGAQFASRLTGIKENAKFQNKKEEAEQQQSQQQAEQGPGLKLLVEEAKREHGVKYVYVWHAMAGYWGGVKPAAEGMEHYESALAFPVQSPGVMGNQPDIVMDSLSVLGLGLVHPRKALRFYDELHSYLATCGVDGVKVDVQNIIETLGAGHGGRVSLTRAYHHALEASVARNFPDNGCISCMCHNTDMLYSARQTAVVRASDDFYPRDPASHTIHISSVAYNTLFLGEFMQPDWDMFHSLHPAAEYHGAARAIGGCPIYVSDKPGNHNFELLKKLVLPDGSVLRAQLPGRPTRDCLFADPARDGTSLLKIWNVNKCTGVVGVFNCQGAGWCRVTKKTRVHDAAPGTLTGSVRAEDVDAIADLAGPGWGGEAVVYAYRSGELIRLPRGATLPVTLRVLEFELFHVAPVKEVAPGVSFAPIGLLGMFNAGGAVEQCEAADGAAAAVRLRVRGCGRFGAYCSRRPARCTLDAAEAEFTYDADTGLVALDIPVPEQELYRWNLEIQV

SEQ ID NO: 522 - protein, 772 aa, Cucumis melo
  misc_feature (7)..(756): Pfam Name: Raffinose_syn Pfam Description: Raffinose synthase or seed inhibition p
  misc_feature (1)..(772): Public GI ID no. 29838631
  misc_feature (1)..(772): Bit score of 1917.9 for HMM based on sequences of Figure 3
  misc_feature (1)..(772): Functional Homolog Of SEQ ID NO. 504
MTVTPKISVNDGNLVVHGKTILTGVPDNIVLTPGSGLGLVAGAFIGATASNSKSLHVFPVGVLEGTRFLCCFRFKLWWMTQRMGTSGRDIPFETQFLLMESKGNDGEDPDNSSTIYTVFLPLLEGQFRAALQGNEKNEMEICLESGDNTVETNQGLSLVYMHAGTNPFEVITQAVKAVEKHTQTFLHREKKKLPSFLDWFGWCTWDAFYTDATAEGVVEGLKSLSEGGAPPKFLIIDDGWQQIEAKPKDADCVVQEGAQFASRLSGIKENHKFQKNGNNYDQVPGLKVVVDDAKKQHKVKFVYAWHALAGYWGGVKPASPGMEHYDSALAYPVQSPGMLGNQPDIVVDSLAVHGIGLVHPKKVFNFYNELHSYLASCGIDGVKVDVQNIIETLGAGHGGRVTLTRSYHQALEASIARNFSDNGCIACMCHNTDSLYSAKQTAVVRASDDYYPRDPTSHTIHISSVAYNSLFLGEFMQPDWDMFHSLHPTAEYHGAARAIGGCAIYVSDKPGNHNFDLLKKLVLPDGSVLRAQLPGRPTRDSLFNDPARDGISLLKIWNMNKCSGVVGVFNCQGAGWCRITKKTRIHDESPGTLTTSVRAADVDAISQVAGADWKGDTIVYAYRSGDLIRLPKGASVPVTLKVLEYDLLHISPLKDIASNISFAPIGLLDMFNTGGAVEQVNVQVVEPIPEFDGEVASELTCSLPNDRPPTATITMKARGCRRFGLYSSQRPLKCSVDKVDVDFVYDEVTGLVTFEIPIPTEEMYRWDIEIQV

SEQ ID NO: 523 - DNA, 2714 bp, Arabidopsis thaliana
  misc_feature (1)..(2714): Ceres Annot ID no. 875520
  misc_feature (1)..(2714): Encodes the peptide sequence at SEQ ID NO. 524
agccaaacacaccgttctgattactgattcttcattgacggtaggagtcaccacttttggcggcgattccttgttctctattttttttgcacaagcaacatttagcttctgcaaactccagttcatctctcaaccctcatatcgccgtgttttctcgctctagtaccgcgagctcggacgaaccaggaagcaatccgttaatctagaagcggtgttgagaagatgacgattacatcaaatatctctgtacagaacgataacctcgttgttcaagggaagactatccttaccaaaatccctgacaacattatcctaactccggttaccggtaatggattcgtttccggttcatttataggcgcgacgtttgaacaaagcaagagtcttcatgtgttccccatcggtgtattggagggtcttcggttcatgtgctgtttccggtttaagctatggtggatgactcagagaatgggaagctgtggaaaagacattcctttggagacacagttcatgctactggaaagcaaggatgaggttgaagggaatggggatgatgctcctactgtttataccgtctttctccctctccttgaaggccagttcagagctgttctgcaaggaaatgagaagaatgagattgagatttgttttgagagtggagataaggcggtggaaactagccagggaactcaccttgtttatgttcatgctggaaccaatccctttgaagttatcagacaatccgtaaaggctgtggagagacacatgcagacatttcatcatcgtgagaagaagaagcttccttctttcctagactggtttggctggtgcacatgggacgctttctacacagatgtgactgccgagggtgttgatgaaggccttaaaagtctttctgaaggaggtacccctccgaagtttctgatcatagacgatggttggcaacaaatagaaaacaaagagaaagatgaaaactgcgttgttcaggaaggagcacagtttgctactaggcttgttggtatcaaggagaatgcaaaatttcagaagagtgatcagaaggatacgcaagtgtcaggactaaagagtgtagttgacaatgcgaagcagcgccataatgtgaagcaagtttatgcatggcatgctttagctggatactggggtggagtaaaacccgctgcttctggaatggaacactatgatagtgcattagcatacccagttcagtctccaggtgtcttagggaaccaaccagatatagtaatggacagccttgctgttcatggtctcggacttgtcaatccgaagaaagttttcaacttctacaacgaactgcattcatacttggcttcatgtggtatagatggagtcaaagttgacgtccagaacatcattgaaaccctaggtgctggtcttggcgggagagtctctctcactcgtagctaccagcaagctttagaagcttcaattgcccggaacttcacagataatggttgcatatcttgcatgtgtcacaacacagacggactttacagcgcaaaacaaaccgctattgttagagcttccgatgatttctacccaagagatcctgcttctcacaccatccacattgcatcggttgcatacaacagccttttccttggagagttcatgcaacctgactgggatatgttccatagtctacacccaactgcagagtaccatgctgcagcgcgtgcagtgggtggatgcgcaatctatgtcagtgataagccaggcaaccacaactttgatctattgaggaagctggttcttcctgatggttcagttcttcgggctaagctcccgggtaggcctacccgtgactgcttattcgctgatccagctagagatggaatcagcttgctcaagatctggaacatgaataagtttactggtattgttggtgtattcaattgtcaaggtgctggttggtgcaaggaaacgaagaagaaccagatccatgatacttctcctggcacactcacgggttcaatccgtgcggatgatgctgatctaatctctcaagtggctggtgaagattggagtggagattcaatagtctatgcatacagatcaggtgaggtggtaagactacctaaaggtgcttcaattcctctcaccctcaaagtccttgaatatgaactcttccacatctctcctttgaaggaaatcactgaaaacatttcgttcgcaccaataggacttgtagacatgttcaactcaagtggagcaatcgagtcgattgatatcaatcacgtgaccgacaagaatcctgaattcttcgatggagagatctcctcggcttctcccgcgctcagcgataaccgttctccaacagctctggtatctgtcagtgtcagaggctgtggtcgttttggagcttactcttctcagcgtcctctaaaatgcgccgttgaaagcacagagactgatttcacgtacgacgccgaggttgggcttgtgactttgaatctgccggtgacgagggaggaaatgttcagatggcatgttgagattctggtctagaccaccaataagttattttttttcaccaatttgtcattcatcattttgtagtataaaggcatcaataaattaggaaattaatggtcattcttcgctttgtaataatgtaatctcgtcaagttggggaagcaccgtccccttgtagtttcgttctaataatatagtacctt

SEQ ID NO: 524 - protein, 773 aa, Arabidopsis thaliana
  misc_feature (7)..(757): Pfam Name: Raffinose_syn Pfam Description: Raffinose synthase or seed inhibition p
  misc_feature (1)..(773): Ceres Annot ID no. 875520
  misc_feature (1)..(773): Bit score of 1947.7 for HMM based on sequences of Figure 3
  misc_feature (1)..(773): Functional Homolog Of SEQ ID NO. 504
MTITSNISVQNDNLVVQGKTILTKIPDNIILTPVTGNGFVSGSFIGATFEQSKSLHVFPIGVLEGLRFMCCFRFKLWWMTQRMGSCGKDIPLETQFMLLESKDEVEGNGDDAPTVYTVFLPLLEGQFRAVLQGNEKNEIEICFESGDKAVETSQGTHLVYVHAGTNPFEVIRQSVKAVERHMQTFHHREKKKLPSFLDWFGWCTWDAFYTDVTAEGVDEGLKSLSEGGTPPKFLIIDDGWQQIENKEKDENCVVQEGAQFATRLVGIKENAKFQKSDQKDTQVSGLKSVVDNAKQRHNVKQVYAWHALAGYWGGVKPAASGMEHYDSALAYPVQSPGVLGNQPDIVMDSLAVHGLGLVNPKKVFNFYNELHSYLASCGIDGVKVDVQNIIETLGAGLGGRVSLTRSYQQALEASIARNFTDNGCISCMCHNTDGLYSAKQTAIVRASDDFYPRDPASHTIHIASVAYNSLFLGEFMQPDWDMFHSLHPTAEYHAAARAVGGCAIYVSDKPGNHNFDLLRKLVLPDGSVLRAKLPGRPTRDCLFADPARDGISLLKIWNMNKFTGIVGVFNCQGAGWCKETKKNQIHDTSPGTLTGSIRADDADLISQVAGEDWSGDSIVYAYRSGEVVRLPKGASIPLTLKVLEYELFHISPLKEITENISFAPIGLVDMFNSSGAIESIDINHVTDKNPEFFDGEISSASPALSDNRSPTALVSVSVRGCGRFGAYSSQRPLKCAVESTETDFTYDAEVGLVTLNLPVTREEMFRWHVEILV

SEQ ID NO: 525 - protein, 774 aa, Vitis vinifera
  misc_feature (7)..(758): Pfam Name: Raffinose_syn Pfam Description: Raffinose synthase or seed inhibition p
  misc_feature (1)..(774): Public GI ID no. 225441787
  misc_feature (1)..(774): Bit score of 1847.2 for HMM based on sequences of Figure 3
  misc_feature (1)..(774): Functional Homolog Of SEQ ID NO. 504
MTVTPKISINEGNLVVQGKTILTGVPDNIVLTPGSGGGLVAGTFIGATASHSKSLHVFPMGTLDGLRFMCCFRFKLWWMTQRMGTCGKDVPFETQFMLIESKETTEGGEHDDAPTIYTVFLPLLEGQFRAVLQGNDKNEIEICLESGDTAVETNQGLHLVYMHSGTNPFEVIDQAVKAVEKHMQTFLHREKKKLPSFLDWFGWCTWDAFYTDVTAEGIEEGLQSLSKGGAPPKFLIIDDGWQQIGNENKDNNCVVQEGAQFANRLTGIKENEKFQKNGRNNEQVPGLKHVVEDAKQRHNVKFVYVWHALAGYWGGVKPAAAGMEHYECALAYPVQSPGVMGNQPDIVMDSLSVHGLGLVPPRTVFNFYNELHAYLASCGVDGVKVDVQNIIETLGAGHGGRVALTRSYQQALEASIARNFTDNGCISCMCHNTDGLYSTKQTAVVRASDDFYPRDPASHTIHISSVAYNTLFLGEFMQPDWDMFHSLHPAAEYHGAARAVGGCAIYVSDKPGHHNFELLRKLVLPDGSVLRAQLPGRPTRDCLFADPARDGTSLLKIWNVNKCSGVVGVFNCQGAGWCKIEKKTRVHDTSPDTLTGSVCAADVDQIAHVAGTNWKGDVVVYAYKSGEVVRLPEGASLPVTLKVLEFEVFHFCPLKEIATNISFAPIGLLDMLNSGGAVEQFEVHMASEKPELFDGEIPFELSTSLSENRSPTATIALTARGCGRFGAYSSQRPLKCQVGDAEVEFSYDPNNGLLTFTIPIPEEEMYRWSIAIQV

SEQ ID NO: 526 - protein, 763 aa, Oryza sativa subsp. japonica
  misc_feature (7)..(747): Pfam Name: Raffinose_syn Pfam Description: Raffinose synthase or seed inhibition p
  misc_feature (1)..(763): Public GI ID no. 115471135
  misc_feature (1)..(763): Bit score of 1726.6 for HMM based on sequences of Figure 3
  misc_feature (1)..(763): Functional Homolog Of SEQ ID NO. 504
MTVTPQITVSDGRLAVRGRTVLTGVPENVTAAHASGAGLVDGAFVGADAGEAKSHHVFTFGTLRECRFMCLFRFKLWWMTQRMGSSGRDVPLETQFMLIEVPATAAGDGHDGGGDGEPVFVVMLPLLEGKFRAALQGNDDDELQICIESGDKAVQTEQGVNMVYIHAGTNPFDTITQAIKAVEKRMQTFHHRDKKKMPSFLDWFGWCTWDAFYTDVTADGVKQGLRSLANGGAPPRFLIIDDGWQQIGTEDDDTDEHPAVAVQEGAQFASRLTGIKENVKFQSKNGGAGEDTPGLRMLVEEVKGEHGVRQVYVWHAMAGYWGGVAPAPAMERYEAALAYPVQSPGVTANQPDIVMDSLSVLGLGLVHPRKVLDFYDELHAYLASCGVDGVKVDVQNIIETLGAGHGGRVALTRAYNRALEASVARSFPDNGCISCMCHNTDMLYSARQTAVVRASDDFYPRDPASHTIHVASVAYNTVFLGEFMQPDWDMFHSLHPAAEYHGAARAIGGCPIYVSDKPGNHNFDLLRKLVLPDGSVLRARLPGRPTRDCLFSDPARDGESLLKIWNLNNCGGVVGVFNCQGAGWCRVAKKTRVHDAAPGTLTGAVRADDVDAIAQVAGGDGGGWDGEAVVYAHRARELVRLPRGAALPVTLGALEYEVFHVCPVRAIAAAPGGAAVAFAPVGLLDMFNAGGAVEECAVDAAAAVALRVRGCGRFGAYFSRRPARCALDGADVGFTYDGDTGLVAVDLPVPEQEMYRWNLEIHV

SEQ ID NO: 527 - protein, 770 aa, Oryza sativa subsp. indica
  misc_feature (7)..(754): Pfam Name: Raffinose_syn Pfam Description: Raffinose synthase or seed inhibition p
  misc_feature (1)..(770): Public GI ID no. 125546144
  misc_feature (1)..(770): Bit score of 1742.1 for HMM based on sequences of Figure 3
  misc_feature (1)..(770): Functional Homolog Of SEQ ID NO. 504
MTVTPRITVAEGRLVAHGRTILTGVADNIALTHASGAGLVDGAFVGATADEPKSLHVFTFGTLRDLRFMCCFRFKLWWMTQRMGTSGRDVPLETQFMLLESRDGGGGGGGEAVYVVMLPLLEGQFRAALQGNDRDELEICIESGDKAVQTAQGTYMVYVHAGANPFDTITQAVKVVERHLQTFHHREKKKLPSFLDWFGWCTWDAFYTDVTADGVKQGLQSLAEGGTPPRFLIIDDGWQQIGSENKEDAGNAVVQEGAQFASRLIGIKENTKFQKTTTTAMADGGETAASAAGLKALVEEAKKEHGVKYVYVWHAMAGYWGGVKPAAEGMEHYESAVAFPVQSPGVMGNQPDIVMDSLSVLGLGLVHPRMALAFYGELHAYLASCGVDGVKVDAQNIIETLGAGHGGRVSLTRAFHRALEASVARSFPDNGCISCMCHNTDMLYSARQTAVVRASDDFYPLDPASHTIHISSVAYNTLFLGEFMQPDWDMFHSLHPAAEYHGAARAIGGCPIYVSDKPGNHNFELLKKLVLPDGSVLRARLPGRPTRDCLFVDPARDGASLLKIWNVNKCTGVVGVFNCQGAGWCRISKKTRVHDAAPGTLTGSVRADDVDAIADVAGTGWTGDAVVYAHRSGELIRLPKGATLPVTLKVLEFELFHVCPVMTVAPGGGGGGGVTFAPIGLLDMFNSGGAVEECDVVRALDAAGEAEAAVVRLRARGCGRFGAYSSRRPARCALDAAEVEFSYDADTGLVALDVPVPAHELYKWTVEIQV

SEQ ID NO: 528 - DNA, 2807 bp, Zea mays
  misc_feature (1)..(2807): Ceres Clone ID no. 1533376
  misc_feature (1)..(2807): Encodes the peptide sequence at SEQ ID NO. 529
aaaacccgccagcatctccctccgagtccagggggcaggggcaccattaccgagtagtttaattagtgctagttgtattaccgttgttagtgacataattaccctcacgcgaagaacccctaccttggctagtcctcctacgtatacgtctcttctcttcgcttaatcttggtcggtgatttgattctgcacttcttgggcgcattgcagagggtgctcggtctgcagctatcttaggttaaccagtcgtgtgtggtctatcggtttcgatatagtactactgctctgttataatcagcggggaggaggaagatgacggtgacgccacggatcacggtgagcgacgggcggctgacggtgcgcggccgtacggtgctcaccggcgtgccggacaacgtgtcggcggcgcacgcggccggggcggggctcgtcgacggggccttcgtcggcgcccacgccggcgaggccaagagccaccacgtcttcactttcggcacgctccgggactgccggttcctgtgcctgttccggttcaagctgtggtggatgacgcagcggatgggcgtctccggccgcgacgtccctctggagacccagttcatgctcgtcgaggtccctgccagtgacggcgacggcgacgacgcccccgcgtacgtggtgatgcttccgctgctggaggggcagtttcgggcggcgctgcaggggaacgaccgcgacgagctgcagatctgcatcgagagcggggacaaggcggtgcagacggaccaggccgcgcacatggtgtacctccacgccggcgacaaccccttcgacaccgtcaccgccgccgtcaaggcggtggagaagcacctgcagacgttccaccaccgcgacaagaagaagctgccgtcgttcctcgactggttcggctggtgcacctgggacgccttctacaccgacgtcaccgccgacggcgtcaagaacggccttcagagcctgtccaagggcggcgcgccgccgcggttcctcatcatcgacgacggctggcagcagatcgcctccgagaacaagcccgaccccaacgtcgccgtccaggagggcgcgcaattcgccagccggctgaccgggatcaaggagaacaccaagttccagaccaagcccgacggagacggcgacggcgagcaggcggcgggcgggctgaagcgactggtggccgagaccaaggacgcgcacggcgtgaagcaggtgtacgtgtggcacgccatggccgggtactggagcggcgtgacgccgacggcggggacggcgatggagcgctacgagccggcgctggcgtaccccgtgcagtccccgggcgtgacgggcaaccagccggacatcgtcatggactcgctgtccgtcctggggctgggcctggtgcacccgcgccgggtgcgggacttctacggcgagctccacgcgtacctcgcctcctgcggcgtcgacggcgtcaaggtggacgtgcagaacatcatcgagacgctgggcgccggccacggcggccgcgtcgccatcacccgcgcctaccaccgcgcgctcgaggcctccgtggcgcgcagcttcccagacaacggctgcatctcctgcatgtgccacaactccgacatgctgtacagcgccaggcagaccgccgtcgtgcgcgcctccgacgacttctacccgcgcgacccggcatcgcacaccgtccacgtcgcctccgtcgcgtacaacaccgtcttcctcggcgagttcatgcagcccgattgggacatgttccatagcttgcatccggcggcggagtaccacggcgcggcgagggccatcggtggctgcccgatatacgtcagcgacaagccggggaaccacaacttcgagctgctcaggaagctcgtgctccccgacggctccgtgctacgcgcgcagcttcccggccggcccacacgcgactgcctcttctccgacccggcgcgcgacggcgcgagtttgctcaagatctggaacctgaacaagtgcggtggcgtggtgggtgtgttcaactgccagggagccgggtggtgccgcgtgaccaagcggacgcgcgtgcacgacgcgtcgccgggcacgctgaccggcaccgtgcgtgccgacgacgtcgacgccatagcgcgcgtcgctagtgacggcggcgggtgggacggcgagaccgtggtgtatgcgcaccgcacgcgggagctagtgcgacttccgcggggcgtcgcgctgcccgtgacgctaggcccgctccagtatgaggtgttccatgtgtgcccgctccgcgccgtcgtgccgggggtctcgttcgcgcccgtcgggctgctggacatgttcaacgccgggggcgccgttgaggagtgcgacgtgatcagcgatgctggcggcaaggccatggctctcagggttcgcgggtgcggtcggttcggcgcttactgctcgcgggagccggcgaggtgcctattggactcggcggaagtggagttcagctacgatatcgacactggcctcgtgtccgtcgacttgctggtgccggagcaggagctatacctttggacgctggagattatgatctaggtcgtgatgctgtgcgccgacgccaacgcttgccttcgcggctgagccattatgagtcggacgacattgtcatttgctatgtgcacgagagatagatgtattgtggtggtgttgtataattggcatggggagtgttttttttgttatgttcttatctgtatatcatacgtgctctgaatgttatataatacttgataataaaggatgggtgctcctttaatacg

SEQ ID NO: 529 - protein, 756 aa, Zea mays
  misc_feature (7)..(740): Pfam Name: Raffinose_syn Pfam Description: Raffinose synthase or seed inhibition p
  misc_feature (1)..(756): Ceres Clone ID no. 1533376
  misc_feature (1)..(756): Bit score of 1708.1 for HMM based on sequences of Figure 3
  misc_feature (1)..(756): Functional Homolog Of SEQ ID NO. 504
MTVTPRITVSDGRLTVRGRTVLTGVPDNVSAAHAAGAGLVDGAFVGAHAGEAKSHHVFTFGTLRDCRFLCLFRFKLWWMTQRMGVSGRDVPLETQFMLVEVPASDGDGDDAPAYVVMLPLLEGQFRAALQGNDRDELQICIESGDKAVQTDQAAHMVYLHAGDNPFDTVTAAVKAVEKHLQTFHHRDKKKLPSFLDWFGWCTWDAFYTDVTADGVKNGLQSLSKGGAPPRFLIIDDGWQQIASENKPDPNVAVQEGAQFASRLTGIKENTKFQTKPDGDGDGEQAAGGLKRLVAETKDAHGVKQVYVWHAMAGYWSGVTPTAGTAMERYEPALAYPVQSPGVTGNQPDIVMDSLSVLGLGLVHPRRVRDFYGELHAYLASCGVDGVKVDVQNIIETLGAGHGGRVAITRAYHRALEASVARSFPDNGCISCMCHNSDMLYSARQTAVVRASDDFYPRDPASHTVHVASVAYNTVFLGEFMQPDWDMFHSLHPAAEYHGAARAIGGCPIYVSDKPGNHNFELLRKLVLPDGSVLRAQLPGRPTRDCLFSDPARDGASLLKIWNLNKCGGVVGVFNCQGAGWCRVTKRTRVHDASPGTLTGTVRADDVDAIARVASDGGGWDGETVVYAHRTRELVRLPRGVALPVTLGPLQYEVFHVCPLRAVVPGVSFAPVGLLDMFNAGGAVEECDVISDAGGKAMALRVRGCGRFGAYCSREPARCLLDSAEVEFSYDIDTGLVSVDLLVPEQELYLWTLEIMI

SEQ ID NO: 530 - protein, 763 aa, Oryza sativa subsp. indica
  misc_feature (7)..(747): Pfam Name: Raffinose_syn Pfam Description: Raffinose synthase or seed inhibition p
  misc_feature (1)..(763): Public GI ID no. 125557655
  misc_feature (1)..(763): Bit score of 1726.4 for HMM based on sequences of Figure 3
  misc_feature (1)..(763): Functional Homolog Of SEQ ID NO. 504
MTVTPQITVSDGRLAVRGRTVLTGVPENVTAAHASGAGLVDGAFVGADAGEAKSHHVFTFGTLRECRFMCLFRFKLWWMTQRMGSSGRDVPLETQFMLIEVPATAAGDGHDGGGDGEPVFVVMLPLLEGKFRAALQGNDDDELQICIESGDKAVQTEQGVNMVYIHAGTNPFDTITQAIKAVEKRMQTFHHRDKKKMPSFLDWFGWCTWDAFYTDVTADGVKQGLRSLANGGAPPRFLIIDDGWQQIGTEDDDTDEHPAVAVQEGAQFASRLTGIKENVKFQSKNGGAGEDTPGLRMLVEEVKGEHGIRQVYVWHAMAGYWGGVAPAPAMERYEAALAYPVQSPGVTANQPDIVMDSLSVLGLGLVHPRKVLDFYDELHAYLASCGVDGVKVDVQNIIETLGAGHGGRVALTRAYNRALEASVARSFPDNGCISCMCHNTDMLYSARQTAVVRASDDFYPRDPASHTIHVASVAYNTVFLGEFMQPDWDMFHSLHPAAEYHGAARAIGGCPIYVSDKPGNHNFDLLRKLVLPDGSVLRARLPGRPTRDCLFSDPARDGESLLKIWNLNKCGGVVGVFNCQGAGWCRVAKKTRVHDAAPGTLTGAVRADDVDAIAQVAGGDGGGWDGEAVVYAHRARELVRLPRGAALPVTLGALEYEVFHVCPVRAIAAAPGGAAVAFAPVGLLDMFNAGGAVEECAVDAAAAVALRVRGCGRFGAYFSRRPARCALDGADVGFTYDGDTGLVAVDLPVPEQEMYRWNLEIHV

SEQ ID NO: 531 - DNA, 2322 bp, Sorghum bicolor
  misc_feature (1)..(2322): Ceres Annot ID no. 8632040
  misc_feature (1)..(2322): Encodes the peptide sequence at SEQ ID NO. 532
atgacggtgacgccgaggattacggtgggggatgggcggctggtggcgcacgggcggaccatcctcaccggcgtgccggacaacatcgcgctcacgcacgcctccggtgcggggctcgtcgacggcgccttcgtcggcgccacggccgccgagcccagtagcatgcacgtcttcaccttcggcaccctccgggagctgcggttcatgtgctgcttccggttcaagctatggtggatgacccagcgcatgggcacctccggccgcgacgtcccgctggagacacagttcatgctcctggagagccgcccaggcacgggcgacaccaccggcggcggcggcgacggcgacagcggcgagacggtgtacgttgtgatgctgccgctgctggagggccaattccgggcggcgctgcagggcaacgaccgcgacgagctggagatcaccctcgagagcggggacaaggcggtgcagacggcgcaggggacctacatggtgtacgtgcacgccgggaccaaccctttcgacaccatcactcaggccgtcaaggtggtggagaggcacctgcaaacgttccatcacagggagaagaaaaagctgccgtcgttcgtggactggttcggctggtgcacgtgggacgccttctacaccgacgtcaccgccgagggcgtcaagcaaggtctcaagagcttggcggagggcggcacgccgccgcggttcctgatcatcgacgacgggtggcagcagatcggcagcgagaacaaggaggagtccaacaacgccgtcgtccaggaaggagcgcagttcgcaagcaggctgacagggatcaaggagaacgccaagttccagaagaagaagaataagaagaagagcgacgacgacaaggatggcggcgatgatcagcaggcccaggcgccggggctgaagctggtggtggaggaggcgaagcgcgaccacggcgtgaagtacgtgtacgtgtggcacgccatggcggggtactggggcggcgtgaagccggcggcggaagggatggagcactacgagagcgcgctggcgtacccggtgcagtcccccggggtgatgggcaaccagccggacatcgtcatggactcgctctccgtgctgggcctggggctggtgcacccgcgcagggtgctcagcttctacgacgagctgcactcgtacctcgcctcctgcggcgtcgacggcgtcaaggtggacgtgcagaacatcatcgagacgctcggcgccgggcacggcggccgcgtcgcgctcacccgcgcctaccaccgcgcgctcgaggcctccgtcgcccgcaacttccccgacaacggctgcatctcctgcatgtgccacaacaccgacatgctctacagcgcgcgacagaccgccgtcgtccgcgcctccgacgacttctacccgcgcgacccggcgtcgcacaccgtccacgtctcctccgtcgcctacaacaccctcttcctcggcgagttcatgcagccagactgggacatgttccatagcctgcacccggcggcggagtaccacggcgcggcgagggcgatcggcggctgcccgatctacgtcagcgacaagccaggcaaccacaacttcgagctgctcaagaagctggtcctccccgacggctccgtgctccgcgcgcagctccccggccgccccacccgcgactgcctcttcgccgacccggcacgcgacggcaccagcctgctcaagatctggaacgtgaacaagtgcacgggcgtggtgggcgtgttcaactgccagggcgccgggtggtgccgcgtcaccaagaagacccgcgtgcacgacgccgcgccggggacgctgacgggatcaatccgcgccgacgacgtggacgcgatcgccggcctcgcgggggccggctggagcggcgaggccgtcgtgtacgcctacaggtcgggggagctcgtcaggctgcccggtggcgccacgctgccggtgacgctcaaggtgctggagtacgaggtgttccacgtctgccccgtcagcggggtcgcgccgggcgtgtcgttcgcgcccatcggcctgctcgacatgttcaactccggcggggcggtggagcagtgcgaggtccgcggcggcggcggtggcgcgggcgccgtcgtcgcgctcagggtccgcggctgcggccggttcggcgcgtactgctcgcggaggcccgcgaggtgcaggctggacgcggcggaggtggacttcagctacgacgacgacacggggctcgtcgcgctccatatccccgtgccggagcaggagttctacagatgggacctggagatcgatgtctag

SEQ ID NO: 532 - protein, 773 aa, Sorghum bicolor
  misc_feature (7)..(757): Pfam Name: Raffinose_syn Pfam Description: Raffinose synthase or seed inhibition p
  misc_feature (1)..(773): Ceres Annot ID no. 8632040
  misc_feature (1)..(773): Bit score of 1792.5 for HMM based on sequences of Figure 3
  misc_feature (1)..(773): Functional Homolog Of SEQ ID NO. 504
MTVTPRITVGDGRLVAHGRTILTGVPDNIALTHASGAGLVDGAFVGATAAEPSSMHVFTFGTLRELRFMCCFRFKLWWMTQRMGTSGRDVPLETQFMLLESRPGTGDTTGGGGDGDSGETVYVVMLPLLEGQFRAALQGNDRDELEITLESGDKAVQTAQGTYMVYVHAGTNPFDTITQAVKVVERHLQTFHHREKKKLPSFVDWFGWCTWDAFYTDVTAEGVKQGLKSLAEGGTPPRFLIIDDGWQQIGSENKEESNNAVVQEGAQFASRLTGIKENAKFQKKKNKKKSDDDKDGGDDQQAQAPGLKLVVEEAKRDHGVKYVYVWHAMAGYWGGVKPAAEGMEHYESALAYPVQSPGVMGNQPDIVMDSLSVLGLGLVHPRRVLSFYDELHSYLASCGVDGVKVDVQNIIETLGAGHGGRVALTRAYHRALEASVARNFPDNGCISCMCHNTDMLYSARQTAVVRASDDFYPRDPASHTVHVSSVAYNTLFLGEFMQPDWDMFHSLHPAAEYHGAARAIGGCPIYVSDKPGNHNFELLKKLVLPDGSVLRAQLPGRPTRDCLFADPARDGTSLLKIWNVNKCTGVVGVFNCQGAGWCRVTKKTRVHDAAPGTLTGSIRADDVDAIAGLAGAGWSGEAVVYAYRSGELVRLPGGATLPVTLKVLEYEVFHVCPVSGVAPGVSFAPIGLLDMFNSGGAVEQCEVRGGGGGAGAVVALRVRGCGRFGAYCSRRPARCRLDAAEVDFSYDDDTGLVALHIPVPEQEFYRWDLEIDV

SEQ ID NO: 533 - protein, 771 aa, Oryza sativa subsp. japonica
  misc_feature (7)..(755): Pfam Name: Raffinose_syn Pfam Description: Raffinose synthase or seed inhibition p
  misc_feature (1)..(771): Public GI ID no. 50540754
  misc_feature (1)..(771): Bit score of 1744.8 for HMM based on sequences of Figure 3
  misc_feature (1)..(771): Functional Homolog Of SEQ ID NO. 504
MTVTPRITVAEGRLVAHGRTILTGVADNIALTHASGAGLVDGAFVGATADEPKSLHVFTFGTLRDLRFMCCFRFKLWWMTQRMGTSGRDVPLETQFMLLESRDGGGGGEAVYVVMLPLLEGQFRAALQGNDRDELEICIESGDKAVQTAQGTYMVYVHAGANPFDTITQAVKVVERHLQTFHHREKKKLPSFLDWFGWCTWDAFYTDVTADGVKQGLQSLAEGGTPPRFLIIDDGWQQIGSENKEDAGNAVVQEGAQFASRLIGIKENTKFQKTTTTAMADGGETAASAAGLKALVEEAKKEHGVKYVYVWHAMAGYWGGVKPAAEGMEHYESAVAFPVQSPGVMGNQPDIVMDSLSVLGLGLVHPRMALAFYGELHAYLASCGVDGVKVDAQNIIETLGAGHGGRVSLTRAFHRALEASVARSFPDNGCISCMCHNTDMLYSARQTAVVRASDDFYPLDPASHTIHISSVAYNTLFLGEFMQPDWDMFHSLHPAAEYHGAARAIGGCPIYVSDKPGNHNFELLKKLVLPDGSVLRARLPGRPTRDCLFVDPARDGASLLKIWNVNKCTGVVGVFNCQGAGWCRITKKTRVHDAAPGTLTGSVRADDVDAIADVAGTGWTGDAVVYAHRSGELIRLPKGATLPVTLKVLEFELFHVCPVMTVAPGGGGGGVTFAPIGLLDMFNSGGAVEECDVVRALDAAGEAEAEAEAAVVRLRARGCGRFGAYSSRRPARCALDAVEVEFSYDADTGLVALDVPVPAHELYKWTVEIQV

SEQ ID NO: 534 - DNA, 2295 bp, Sorghum bicolor
  misc_feature (1)..(2295): Ceres Annot ID no. 8645125
  misc_feature (1)..(2295): Encodes the peptide sequence at SEQ ID NO. 535
atgacggtgacgccgtggatcacggtgagcgacgggacgctggcggtgcgcggccgcacggtgctcaccggcgtgccggacaacgtgtccgcggcgcacgccgccggtgccggcctcgtcgacggggccttcgtcggcgcccacgccgccgagcccaagagccaccacgtcttcaccttcggcacgctccgggactgccggtttctgtgcctgttccggttcaagctatggtggatgacgcagcggatgggcgtctccggccgcgacgtgcctctcgagacccagttcatgctcatcgaggtccctcctgccgccaccgacggcgacggcaaacccgcgtacgtggtgatgctgccgctgctggaggggcagttccgggcggcgctgcaggggaacgaccgcgacgagctggagatctgcgtcgagagcggcgacaaggcggtgcagacggagcagggcgcgcgcatggtatacctccacgccggcgacagccccttcgacgccgtcaccgccgcggtcaaggcggtggagaagcacctgcagacgttccaccaccgagagaggaagaggatgccgtcgttcctcgactggttcggctggtgcacctgggacgccttctacaccgacgtcaccgccggcggcgtcaagcacggcctccagagcctgtccaagggcggcgcgccgccgcggttcctcatcatcgacgacggctggcagcagatcgcctccgacaacaagaagcccgacgaccccaacgtcgccgtccaggagggcgcgcaattcgccagtcggctgacggggatcaaggagaacaccaagttccagaccaagccggacggcgacggcgacggcgacggcgggctgaagcggctggtgtcggagaccaagggcgtgcacggcgtgaagcaggtgtacgtgtggcacgcgatggcggggtactggggcggcgtggcgccgtcgtcggggacagcgatggagcgttacgagccggcgctggcgtacccggtgcagtccccaggcgtgacggcgaaccagccggacatcgtcatggactcgctgtccgtcctgggcctcggcctggtgcacccgcggcgggcgcgggacttctacggcgagctccacgcgtacctggcctcctgcggcgtggacggcgtcaaggtggacgtgcagaacatcatcgagacgctgggcgccggccatggcggccgcgtcgcgctcaccagggcctaccaccgcgcgctcgaggcctccgtggcgcgcagcttccccgacaacggctgcatctcctgcatgtgccacaacaccgacatgctctacagcgccaggcagaccgccgtggtgcgcgcctccgacgacttctacccgcgcgacccggcctcccacaccgtccatgtcgcctccgtcgcctacaacaccgtcttcctcggcgagttcatgcagcccgactgggacatgttccatagcttgcacccggcggcggagtaccacggcgcggcgagggccatcggcggctgcccgatatatgtcagcgacaagccggggaaccacaacttcgagctgctcaggaagctcgtcctccccgacggctccgtgctccgcgcgcagctccccggccggcccacacgcgactgcctcttctccgacccggcgcgcgacggcgcaagcctgctcaagatctggaacctgaacaagtgcggcggcgtggtgggcgtgttcaactgccagggcgccgggtggtgccgcgtgacgaagcggacgcgcgtgcacgacgcggcgccgggcacgctgaccggcgccgtgcgcgccgacgacgtggacgccatagcgcgcgtcgccggcgacggcggcaacgatggcgacaacggcagcaacggcgagtgggacggcgaggccgtggtgtacgcgcaccgcgcgcgggagctggtgcggctgccgcgtggcgccgcgctgcccgtgacgctggcgccgctgcagtacgaggtgttccacgtgtgcccgctccgcgccgccgcgccgggggtggcgttcgcgcccgtggggctgctcgacatgttcaacgccgggggcgccgtcgaggagtgccgcgcagtggacggcggcgggaaggccgtggtggcgctcagggtgcgcgggtgcggccggttcggtgcctactgctcgcgggagccggcgaggtgcctgctggactcggcggaagtggagttcggctacgacgccgacaccggcctcgtgtccgtcgacctgccggtgccggagaaggagatgtaccggtggacgctggagattgtggtctag

SEQ ID NO: 535 - protein, 764 aa, Sorghum bicolor
  misc_feature (7)..(748): Pfam Name: Raffinose_syn Pfam Description: Raffinose synthase or seed inhibition p
  misc_feature (1)..(764): Ceres Annot ID no. 8645125
  misc_feature (1)..(764): Bit score of 1704.0 for HMM based on sequences of Figure 3
  misc_feature (1)..(764): Functional Homolog Of SEQ ID NO. 504
MTVTPWITVSDGTLAVRGRTVLTGVPDNVSAAHAAGAGLVDGAFVGAHAAEPKSHHVFTFGTLRDCRFLCLFRFKLWWMTQRMGVSGRDVPLETQFMLIEVPPAATDGDGKPAYVVMLPLLEGQFRAALQGNDRDELEICVESGDKAVQTEQGARMVYLHAGDSPFDAVTAAVKAVEKHLQTFHHRERKRMPSFLDWFGWCTWDAFYTDVTAGGVKHGLQSLSKGGAPPRFLIIDDGWQQIASDNKKPDDPNVAVQEGAQFASRLTGIKENTKFQTKPDGDGDGDGGLKRLVSETKGVHGVKQVYVWHAMAGYWGGVAPSSGTAMERYEPALAYPVQSPGVTANQPDIVMDSLSVLGLGLVHPRRARDFYGELHAYLASCGVDGVKVDVQNIIETLGAGHGGRVALTRAYHRALEASVARSFPDNGCISCMCHNTDMLYSARQTAVVRASDDFYPRDPASHTVHVASVAYNTVFLGEFMQPDWDMFHSLHPAAEYHGAARAIGGCPIYVSDKPGNHNFELLRKLVLPDGSVLRAQLPGRPTRDCLFSDPARDGASLLKIWNLNKCGGVVGVFNCQGAGWCRVTKRTRVHDAAPGTLTGAVRADDVDAIARVAGDGGNDGDNGSNGEWDGEAVVYAHRARELVRLPRGAALPVTLAPLQYEVFHVCPLRAAAPGVAFAPVGLLDMFNAGGAVEECRAVDGGGKAVVALRVRGCGRFGAYCSREPARCLLDSAEVEFGYDADTGLVSVDLPVPEKEMYRWTLEIVV

SEQ ID NO: 536 - protein, 754 aa, Cucumis melo
  misc_feature (7)..(738): Pfam Name: Raffinose_syn Pfam Description: Raffinose synthase or seed inhibition p
  misc_feature (1)..(754): Public GI ID no. 29838629
  misc_feature (1)..(754): Bit score of 1484.0 for HMM based on sequences of Figure 3
  misc_feature (1)..(754): Functional Homolog Of SEQ ID NO. 504
MTVGAGITISDANLTVLGNRVLSDVHNNITLTAAPGGGVMNGAFIGVDQSDQIGSRRVFPIGKLIGLRFLCAFRFKLWWMTQRMGCSGQEVPFETQFLVVETRDGSNIAGNGEEGDAVYTVFLPILEGDFRAVLQGNDNNEIEICLESGDPSVDGFEGSHLVFVGAGSDPFETITYAVKSVEKHLQTFAHRERKKMPDILNWFGWCTWDAFYTDVTSDGVKKGLESFENGGIPPKFVIIDDGWQSVAKDATSADCKADNTANFANRLTHIKENYKFQKDGKEGERIENPALGLQHIVSYMKEKHATKYVYVWHAITGYWGGVSAGVKEMEQYESKIAYPVASPGVESNEPCDALNSITKTGLGLVNPEKVFNFYNEQHSYLASAGVDGVKVDVQNILETLGAGHGGRVKLARKYHQALEASISRNFQDNGIISCMSHNTDGLYSSKRNAVIRASDDFWPRDPASHTIHIASVAYNSLFLGEFMQPDWDMFHSLHPMAEYHGAARAVGGCAIYVSDKPGQHDFNLLKKLVLPDGSILRAKLPGRPTKDCLFTDPARDGKSLLKIWNLNDLSGVVGVFNCQGAGWCKVGKKNLIHDENPDTITGVIRAKDVSYLWKIAGESWTGDAVIFSHLAGEVVYLPQDASMPITLKPREFDVFTVVPVKELVNDIKFAPIGLIKMFNSGGAVKEMNHQPGSSNVSLKVRGSGPFGAYSSSKPKRVAVDSEEVEFMYDEGGLITIDLKVPEKELYLWDIRIEL

SEQ ID NO: 537 - protein, 753 aa, Cucumis sativus
  misc_feature (7)..(737): Pfam Name: Raffinose_syn Pfam Description: Raffinose synthase or seed inhibition p
  misc_feature (1)..(753): Public GI ID no. 87128422
  misc_feature (1)..(753): Bit score of 1486.1 for HMM based on sequences of Figure 3
  misc_feature (1)..(753): Functional Homolog Of SEQ ID NO. 504
MTVGAGITISDANLTVLGNRVLSDVHNNITLTAAPGGGVMNGAFIGVQSDQIGSRRVFPIGKLIGLRFLCAFRFKLWWMTQRMGCSGQEIPFETQFLVVETRDGSNIAGNGEEGDAVYTVFLPILEGDFRAVLQGNDNNELEICLESGDPSVDGFEGSHLVFVGAGSDPFETITYAVKSVEKHLQTFAHRERKKMPDILNWFGWCTWDAFYTDVTSDGVKKGLESFENGGIPPKFVIIDDGWQSVAKDAASTDCKADNTANFANRLTHIKENYKFQKDGKEGERIENPALGLQHIVSYMKEKHATKYVYVWHAITGYWGGVSSGVKEMEQYESKIAYPVASPGVESNEPCDALNSISKTGLGLVNPEKVFNFYNEQHSYLASAGVDGVKVDVQNILETLGAGHGGRVKLARKYHQALEASISRNFQDNGIISCMSHNTDGLYSSKRNAVIRASDDFWPRDPASHTIHIASVAYNSLFLGEFMQPDWDMFHSLHPMAEYHGAARAVGGCAIYVSDKPGQHDFNLLKKLVLHDGSILRAKLPGRPTKDCLFADPARDGKSLLKIWNMNDLSGVVGVFNCQGAGWCKVGKKNLIHDENPDTITGVIRAKDVSYLWKIAGESWTGDAVIFSHLAGEVVYLPQDASMPITLKSREFDVFTVVPVKELANDIKFAPIGLMKMFNSGGAVKEMNHQPGSSNVSLKVRGSGPFGAYSSSKPKRVAVDSEEVEFIYDEGGLITIDLKVPEKELYLWDIRIEL

SEQ ID NO: 538 - DNA, 2562 bp, Triticum aestivum
  misc_feature (1)..(2562): Ceres Clone ID no. 826233
  misc_feature (1)..(2562): Encodes the peptide sequence at SEQ ID NO. 539
aaacaccacaaccgcgcgccgcgccacacccaaagatccccgccgtcgtaaatccactcacgttcttttattggaggattgcggtgcgtggggaggaagatgacggtggtagccgggatcgcggtccaggaagacggcagcctggcggcgctgggggccacggtcctgagggaggtgcgcgacaatgtgctcgtcacgccggccgccgggggcggcatgctcaacggcgccttcctcggcatccggtcggcccccgccggcagccgcagcgtcttccccgtcgggaagctcagggacctgcgattcatgtgcacgttcaggttcaagatgtggtggatgacacagaggatggggtcgtcgggccgcgacatccccgtcgagacgcagttcttgatcctcgaggccgccgacgacgccggagacgagaaatcggcggtgtacaccgtcttcctcccgatcctggagggctcattccgagctgtactacaggggaacgaaaatgatgagctggaaatttgcttggagagtggtgatccagctgtagaatcatttgaaggcacccatctagttttcgtcggtgcgggatcggatccgtttgaggtcatcacaaatgctgtcaaagcagttgagaggcacctgcagacattctctcacagggaaaaaaagaagatgccagacatgctaaactggtttggctggtgcacatgggatgcattttacactgatgttactgctgaaggagtgaaggaaggactacagagttttgaaaaaggtggaacagctccaaagtttgtcataattgatgatgggtggcaatcggtcagtatggaccctgctggaagtgcattcgtatctgataatgcagccaacttcgcaaacagattatatgatatcaaggagaaccacaaatttcagaaaaatgggaggaagggtcacagggaagaagatccagcaaatggcctcacgcatattgtcagtgaaattaaggggaaacatgagctaaagtacgtttatgtatggcatgcgattaccggatattggggtggcgtaaggcccggtgctgatgggatggagcattaccaatcaaagatgcaattccctgtgtcatcaccaggagttcagaagaacgaatcctgtgaggccttcaacagcatagcagataacggccttggccttgtcaaccctgacaaagtattcagcttctacaatgagctccattcatatcttgcatctgccggggtcgatggcgtgaaagtagacgtgcagaacattctcgaggcgctaggcggtggtcatggtgggagagtggttctggcgaggaagtatcagcaggctctagaagcttccatcgcacggaatttccgcgacaacggtataatatgttgcatgagccacaacactgataacttatacagttcaaaaagaaacgcggttgtgagagcctccgatgatttctggcctagagacccagcttcccacactatacacatcgcatctgtcgcgtacaatactgtttttcttggagagttcatgcagccggactgggacatgttccatagcgttcacccgatggcggaataccacgccgcggcgcgggcagtcggcggttgcgctatatacgtgagtgacaaacctggaaaccatgacttcgatctgctgaggaagcttgtgcttcctgacggatcgatcctgcgagccaaactccccgggagaccgaccagggactgcctcttctctgatcctgcaagggacagcaaaagcattctcaagatctggaacctgaacgcgcactccggcgtcatcggcgccttcaactgccaaggcgccggctggtgccgggaagggaagaagaacctcatccacgacgtgcagcccgggaccatcaccggggccgtccgggggcgggacgtcagccgccttccggaggtcgccggcgatggctggaacggcgacgtggtcgtgtactcgcacgtcgcaggggaggtgaccgtcctgcccaaggacgcggcgctgccggtgacgctgaagccgcgccagtacgaggtgttcaccgtggtgccgctgaaacggctgccgaacggcgcatccttcgcgccggtcggcctgatcgggatgttcaactccggcggggcggtgacggaggtgaggtacggcgacgacgccggcgtggaggtgaaggtgcggggagcgggcacggttggagcctactcctccgcgaggccgaagagcgtggctgtggattcggaggcggttggtttctcctacgacgacggctccggcctggccacgttcgaggtcggcgtgccggagcgggagctctattcgtggacggtctcggtagagtactgagacgagatcgtctggtcgggtggcagtaagtttgcaaagatcgaatgaaggctcctgagagggcaccgaagccacgcctggggaagctgtgatacctttgttcttgcagacgttgccgctattttgcgctgcgagtacatggtgcttgacttgtattccctgatggaagctaaaaattgtattgtgatttttgaacaccaaccattttagtac

SEQ ID NO: 539 - protein, 749 aa, Triticum aestivum
  misc_feature (7)..(733): Pfam Name: Raffinose_syn Pfam Description: Raffinose synthase or seed inhibition p
  misc_feature (1)..(749): Ceres Clone ID no. 826233
  misc_feature (1)..(749): Bit score of 1475.5 for HMM based on sequences of Figure 3
  misc_feature (1)..(749): Functional Homolog Of SEQ ID NO. 504
MTVVAGIAVQEDGSLAALGATVLREVRDNVLVTPAAGGGMLNGAFLGIRSAPAGSRSVFPVGKLRDLRFMCTFRFKMWWMTQRMGSSGRDIPVETQFLILEAADDAGDEKSAVYTVFLPILEGSFRAVLQGNENDELEICLESGDPAVESFEGTHLVFVGAGSDPFEVITNAVKAVERHLQTFSHREKKKMPDMLNWFGWCTWDAFYTDVTAEGVKEGLQSFEKGGTAPKFVIIDDGWQSVSMDPAGSAFVSDNAANFANRLYDIKENHKFQKNGRKGHREEDPANGLTHIVSEIKGKHELKYVYVWHAITGYWGGVRPGADGMEHYQSKMQFPVSSPGVQKNESCEAFNSIADNGLGLVNPDKVFSFYNELHSYLASAGVDGVKVDVQNILEALGGGHGGRVVLARKYQQALEASIARNFRDNGIICCMSHNTDNLYSSKRNAVVRASDDFWPRDPASHTIHIASVAYNTVFLGEFMQPDWDMFHSVHPMAEYHAAARAVGGCAIYVSDKPGNHDFDLLRKLVLPDGSILRAKLPGRPTRDCLFSDPARDSKSILKIWNLNAHSGVIGAFNCQGAGWCREGKKNLIHDVQPGTITGAVRGRDVSRLPEVAGDGWNGDVVVYSHVAGEVTVLPKDAALPVTLKPRQYEVFTVVPLKRLPNGASFAPVGLIGMFNSGGAVTEVRYGDDAGVEVKVRGAGTVGAYSSARPKSVAVDSEAVGFSYDDGSGLATFEVGVPERELYSWTVSVEY

SEQ ID NO: 540 - DNA, 2382 bp, Populus balsamifera subsp. trichocarpa
  misc_feature (1)..(2382): Ceres Annot ID no. 1474940
  misc_feature (1)..(2382): Encodes the peptide sequence at SEQ ID NO. 541
atgacggtgacaccaaagatttcaatcaatgatgggaaccttctggttcatgggaagacaattttaactggagttcctgataacattgtcttgactcctggctctggtgttggacctgttgctggtgcttttattggtgccaccgcttctcatagccaaagtctccatgtttttcctgttggggttttagaggatcttcgttttatgtgttgtttccgattcaagttatggtggatgacccagagaatggggaaatgtgggaaagatattcctctggagactcaattcatgctagtggaaagcaggaatggcggtgaaggagttgatcaagatgatgcacagacaatctacaccgtcttccttcccctactagaaggccagttccgtgctgtactgcaaggcagcgacaggaatgagatggagatttgccttgatagcggggatagtgctgttgaaaccaatcaaggacttaacctggtctacatgcatgctgggactaacccctttgaagtcataaaccaggctgtcatggctgtggaaaaatatatgcaaacttttcttcatcgggaaaagaaaaagctgccctcttttcttgactggtttggctggtgtacctgggatgccttttacacggatgtcaccgctgagggtgttagggaaggccttgagagtctgtcagaaggagggactcccccacgatttttgatcattgatgatggttggcaacagatcgaaaataaagcaaaggaggatgctaatgttgttgtacaagaaggagcacaatttgcaagtaggcttactggaataaaggagaattcaaaattccagaagaactgtgaaaagaatgaacaggtgattggactgaagcatgttgtggacgatgctaagcaatgccataatgtgaagtgtgtttatgtatggcatgctttggctggttactggggtggagttaaaccagcggctgctggtatggagcattatgacactgcactggcttatccggttcaatctcctggtgttataggcaaccaacctgacgttgttatggacagcctatcagttcatggccttggtttagtgcatccaaagaaggttttcaacttctacaatgagctccatgcctatttagcatcatgtggagttgatggagtaaaagttgatgctcagaacattattgaaacacttggtgctggccatggtggaagagtgtctctcacccgtagctatcaccaagctcttgaggcctcaattgcaagaaacttccctgacaatggatgcattgcctgcatgtgtcataacactgatggaatctatagtgccaagcagactgctgtagtgagagcttctgatgatttctatcctcgggaccctgcttcccacaccatccatatctcctctgtggcttacaacactcttttccttggagaatttatgcaaccagactgggatatgttccatagtttacacccggctgcagagtatcatggggctgctcgtgctattggtggatgtgcaatctatgtcagtgataaaccagggaaccacaactttgacctattgaagaagctggtcctccctgatggatctgtcctccgtgcccaacttccaggccggccaacacttgacagtctctttgctgacccagcaagagatggaactagcttactcaagatctggaatgtgaacaaatgcaccggtgtagtaggtgtcttcaactgccaaggtgcggggtggtgcaagattgagaagaagacccgcattcatgatgaaactccaggtactctcacgggctctgtttgtgctagtgatgttgattgcattgctcaagttactggtgcaaaatggaatggggaaaccgtggtgtatgcctacaaatcaggggagttggttcggttgcctaaaggtgcttcagtgccagtgacactaaaagttcttgaatatgaactcttccatttctgtcctatcgatgatatcgcttccaacatttcatttgcaccaataggcttgcttgacatgttcaactcaggcggtgctgtggagcaggttgaaatccatatgacttctgacaaggcgccagagcactttgatggtgaagtctcctcagagctgactacttctctcagtgagaaccggtttccaactgcaaccattgcactgagagtcaggggctgcggacggtttggtgcttactcttcccagcgccctctaaaatgcactgtgggcaatgttgacacagacttcaatcatgactctgccactgggctactgaccctgactctccctgtagcagaagaggaaatgtacagatggcctgtggagatacaggctgtgattgattttcaacagcaaggtaaactgtctattgtactgcgaggccattaa

SEQ ID NO: 541 - protein, 793 aa, Populus balsamifera subsp. trichocarpa
  misc_feature (7)..(760): Pfam Name: Raffinose_syn Pfam Description: Raffinose synthase or seed inhibition p
  misc_feature (1)..(793): Ceres Annot ID no. 1474940
  misc_feature (1)..(793): Bit score of 1839.9 for HMM based on sequences of Figure 3
  misc_feature (1)..(793): Functional Homolog Of SEQ ID NO. 504
MTVTPKISINDGNLLVHGKTILTGVPDNIVLTPGSGVGPVAGAFIGATASHSQSLHVFPVGVLEDLRFMCCFRFKLWWMTQRMGKCGKDIPLETQFMLVESRNGGEGVDQDDAQTIYTVFLPLLEGQFRAVLQGSDRNEMEICLDSGDSAVETNQGLNLVYMHAGTNPFEVINQAVMAVEKYMQTFLHREKKKLPSFLDWFGWCTWDAFYTDVTAEGVREGLESLSEGGTPPRFLIIDDGWQQIENKAKEDANVVVQEGAQFASRLTGIKENSKFQKNCEKNEQVIGLKHVVDDAKQCHNVKCVYVWHALAGYWGGVKPAAAGMEHYDTALAYPVQSPGVIGNQPDVVMDSLSVHGLGLVHPKKVFNFYNELHAYLASCGVDGVKVDAQNIIETLGAGHGGRVSLTRSYHQALEASIARNFPDNGCIACMCHNTDGIYSAKQTAVVRASDDFYPRDPASHTIHISSVAYNTLFLGEFMQPDWDMFHSLHPAAEYHGAARAIGGCAIYVSDKPGNHNFDLLKKLVLPDGSVLRAQLPGRPTLDSLFADPARDGTSLLKIWNVNKCTGVVGVFNCQGAGWCKIEKKTRIHDETPGTLTGSVCASDVDCIAQVTGAKWNGETVVYAYKSGELVRLPKGASVPVTLKVLEYELFHFCPIDDIASNISFAPIGLLDMFNSGGAVEQVEIHMTSDKAPEHFDGEVSSELTTSLSENRFPTATIALRVRGCGRFGAYSSQRPLKCTVGNVDTDFNHDSATGLLTLTLPVAEEEMYRWPVEIQAVIDFQQQGKLSIVLRGH

SEQ ID NO: 542 - DNA, 2633 bp, Triticum aestivum
  misc_feature (1)..(2633): Ceres Clone ID no. 927786
  misc_feature (1)..(2633): Encodes the peptide sequence at SEQ ID NO. 543
aacaccacaaccgcgcgccgcgccaccacacccgcagatccccgccgtcgtaaatctacctacgtgctttgattggagggttgcggtgccggggaggaagatgacggtgggagccgggatcgcggtccaggaagacggcagcctggcggcgctgggggccacggtcctgacggaggtgcgcgacaatgtgctcgtcacgccggccgccgggggcggcatgctgaacggcgcgttcctcggcgtccggtcggcccccgccggcagccgcagcgtcttccccgtcgggaagctcagggacctgcgattcatgtgcacgttcaggttcaagatgtggtggatgacacagaggatgggctcgtcgggccgcgacatccccgtcgagacgcagttcttgatcgtcgaggccgttgactgcgccggggacgagcaatctgcggtgtacaccgtcttcctcccgatcctggagggctcattccgagctgtactacaggggaacgaaaatgatgagctggaaatttgcttggagagtggtgatccagctgtagaatcatttgaaggcacccatctagttttcgttggtgcgggatcggatccgtttgaggtcatcactaatgctgtcaaagcagttgagaggcacctgcagacattctctcacagggaaaaaaagaagatgccagacatgctaaactggtttggctggtgcacatgggatgcattttacactgatgttactgctgaaggagtgaaggaaggactacagagttttgaaaaaggtggaacagctccaaagtttgtcataatcgatgatgggtggcaatcggtcagtatggaccctgctggaagtgcattcgtatctgataatgcagccaacttcgcaaacagattatatgatatcaaggagaaccacaaatttcagaaaaatgggaggaagggtcacagggaagaagatccagcaaatggcctcgcgcatattgtcagtgaaattaaggggaaacatgagctaaagtacgtctatgtatggcatgcgattaccgggtattggggtggcgtaaggcccggtgctgacgggatggagcattaccaatccaagatgcagtaccctgtgtcgtcaccaggagtccagaagaacgaaccctgtgaggccttcaacagcatagcagataacggccttggccttgtggaccctgacaaagtattcagcttctacaatgagctccattcatatcttgcatctgccggggtcgacggcgtgaaagtagacgtgcagaacattctcgaggcgctaggcggtggtcatggtgggagagtgcttctgtctaggaagtaccagcaggctctagaagcttccatcgctcggaatttccgcgacaacggcataatatgttgcatgagccacaacactgacaacttatacagttcaaaaagaaatgcggttgtaagagcctctgatgatttctggcctagagacccagcttcgcataccatacacatcgcatccgtcgcttacaataccgttttccttggagagttcatgcagccggactgggacatgttccatagcgtccacccgatggccgaataccacgccgcggcgcgggcagtcggcggttgcgctatatacgtgagtgacaaaccaggaaaccatgacttcgatctgctgaggaagcttgtgcttcctgacggatcgatcctgcgggccaaactgcccgggagaccgaccggggactgcctcttctctgatcctgcaagggacggcaaaagcattctcaagatctggaacctgaacgcgcactccggcgtcatcggcgccttcaactgccagggcgcgggctggtgccgagaagggaagaagaacctcatccacgatgtgcagcccgggaccatcaccggggccgtccggggacgggacgtgagccgccttcaggaggtcgccggcgatggctggaacggcgacgtggtcgtgtactcgcacgtcgcaggagatgtgaccgtcctgcccaaggacgcggcgctgccggtgacgctgaagccgcgagagtacgaggtgttcaccgtggtgccgctgaagcggctgccgaacggcgcctccttcgcgccgatcggcctgatcgggatgttcaactccggcggggcggtgacggaggtgaggtgcgccggcggcgccggcgtggaggtgaaggtgcggggcgcgggcacggttggagcctactcctcggcgaggccgaagcgcgtggccgtggattcggaggcggttggtttctcctacgacgacggctccggcctggccatgttccaggtcggcgtgccggagcgggagctctactcgtggacggtctcgatagagtgctgagacgagatcgtctggtcgggtgacagtaagacgagggcaccgaagccgcgcctggggaagctgtgatatctttgttcttgcagacgttgccgctagttcgtgttgcctgtgatttattatttgcgctgcgagtacatggtgcttgacttgtattccctgatggaaactaaaaattgtattgtgatttctgaacaccaaccattttagtgcagacagtttttcctttttttctcttactactatgtatgtgcctgtgtgttgtcaggcggaaaaaatatttatt

SEQ ID NO: 543 - protein, 749 aa, Triticum aestivum
  misc_feature (7)..(733): Pfam Name: Raffinose_syn Pfam Description: Raffinose synthase or seed inhibition p
  misc_feature (1)..(749): Ceres Clone ID no. 927786
  misc_feature (1)..(749): Bit score of 1481.7 for HMM based on sequences of Figure 3
  misc_feature (1)..(749): Functional Homolog Of SEQ ID NO. 504
MTVGAGIAVQEDGSLAALGATVLTEVRDNVLVTPAAGGGMLNGAFLGVRSAPAGSRSVFPVGKLRDLRFMCTFRFKMWWMTQRMGSSGRDIPVETQFLIVEAVDCAGDEQSAVYTVFLPILEGSFRAVLQGNENDELEICLESGDPAVESFEGTHLVFVGAGSDPFEVITNAVKAVERHLQTFSHREKKKMPDMLNWFGWCTWDAFYTDVTAEGVKEGLQSFEKGGTAPKFVIIDDGWQSVSMDPAGSAFVSDNAANFANRLYDIKENHKFQKNGRKGHREEDPANGLAHIVSEIKGKHELKYVYVWHAITGYWGGVRPGADGMEHYQSKMQYPVSSPGVQKNEPCEAFNSIADNGLGLVDPDKVFSFYNELHSYLASAGVDGVKVDVQNILEALGGGHGGRVLLSRKYQQALEASIARNFRDNGIICCMSHNTDNLYSSKRNAVVRASDDFWPRDPASHTIHIASVAYNTVFLGEFMQPDWDMFHSVHPMAEYHAAARAVGGCAIYVSDKPGNHDFDLLRKLVLPDGSILRAKLPGRPTGDCLFSDPARDGKSILKIWNLNAHSGVIGAFNCQGAGWCREGKKNLIHDVQPGTITGAVRGRDVSRLQEVAGDGWNGDVVVYSHVAGDVTVLPKDAALPVTLKPREYEVFTVVPLKRLPNGASFAPIGLIGMFNSGGAVTEVRCAGGAGVEVKVRGAGTVGAYSSARPKRVAVDSEAVGFSYDDGSGLAMFQVGVPERELYSWTVSIEC

SEQ ID NO: 544 - DNA, 2331 bp, Populus balsamifera subsp. trichocarpa
  misc_feature (1)..(2331): Ceres Annot ID no. 1453705
  misc_feature (1)..(2331): Encodes the peptide sequence at SEQ ID NO. 545
atgacggtgacaccaaagatttcaatcaatgatgggaaccttgtggttcatgggaagacaattttaactggagttcctgataacattgttctgactcctggctctggtgttggacttgttgctggtgcttttattggtgctactgcttctcataacaaaagtctccatgtttttcctgttgggggtttagaggatcttcgatttatgtgttgcttccgattcaagttatggtggatgacccagagaatggggaagtgtgggaaagatattccactggagactcaattcatgctagtggaaagcaagggtggtggtgaagaagttgatcaagatgatgcacagacaatctacactgttttccttcccctgcttgaaggccagttccgtgctgtactgcaaggcaacgacaggaatgagatggagatttgccttgagagcggcgatagtgctgttgaaaccaaccaaggccttcacctggtctacatgcatgctgggaccaatccttttgaagtcataaaccaagctgtaaaggctgtggaaaaacatttgcaaacctttcttcatcgggagaagaaaaagatgccctcatttcttgactggtttggctggtgtacttgggatgccttttacacagatgtcaccgctgagggtgttgaggaaggccttaagagtctgtcagagggagggactcctccacgatttttgatcatcgatgatggttggcaacagattgaaaataaagcaaaggaggatgctaatgctgttgtacaagaaggagcacaatttgcaagtaggcttactggaataaaggagaactctaaattccagaagaatggtgaaaagaatgagcaggccataggactgaagcttgttgtggacaatgccaagcaacaacacaatgtgaagtatgtttatgcatggcatgctttggctggttattggggtggagttaaaccagcagctgctggtatggagcattatgacactgccctggcttatccagttcaatctcctggcgtgttaggcaaccaacctgatattgttatggacagcctagcagttcatggccttggtttggtgcatccaaagaaggtcttcaacttctacaatgagctccatgcctacttagcatcgtgtggagttgatggagtgaaagtcgatgttcagaacattattgaaacccttggtgctggccatggtggaagagtttctctgactcgtagctatcaacaagcacttgaggcttcaattgcacgaaacttccctgacaatggatgtatttcctgcatgtgtcataacactgatggaatctatagcaccaagcagacagctgtagtgagagcttctgatgatttctatcctcgggatcctgcttcccacaccatccatatctcctctgtggcttacaacactctattccttggagaatttatgcaaccagactgggatatgttccatagtttacacccggctgcagattatcatggggcagctcgtgctattggtggatgtgcaatctatgtcagtgataagccaggcaaccacaactttgatctattgaagaagctggtcctccctgatggatctgtccttcgtgctcaacttccaggcaggccaacacgtgacagcctctttgttgatccagcaagagatggaatgagcttactcaaggtctggaatgtgaacaaatgcactggtgtggttggtgtcttcaactgccaaggtgcgggttggtgcaagattgagaagaagacccgcattcatgacacaactccggggaccctcactgcttctgttcgtgccagcgacgttgactgcattgctcaagttgctggtgcaaattgggatggggagaccgtggtctatgcctacaaatcaggggagttggttcggttgcctaaaggtgcttcaatgccagtgacattgaaagttcttgaatacgaactcttccatttctgtcctatcaatgagatcacttccaacatttcatttgcaccaataggcttgcttgacatgttcaacacaggaggtgctgtggagcaggttgaaattcaaatggcttctgacaagtcaccggagcactttgatggtgaagtctcctcagagctgaccacttctctcagtgagagccggtctccaactgcaaccattgcgctgaaagtcagggggtgtggaaggtttggtgcttactcttcccaaagacctctgaaatgcactgtgggcaatgttttcaccgacttcaattatgactctgccactgggctagttaccctgactctgcctgtaccagtagtggaaatgtacagatggcctgtggagatacaagtttaa

SEQ ID NO: 545 - protein, 776 aa, Populus balsamifera subsp. trichocarpa
  misc_feature (7)..(760): Pfam Name: Raffinose_syn Pfam Description: Raffinose synthase or seed inhibition p
  misc_feature (1)..(776): Ceres Annot ID no. 1453705
  misc_feature (1)..(776): Bit score of 1860.8 for HMM based on sequences of Figure 3
  misc_feature (1)..(776): Functional Homolog Of SEQ ID NO. 504
MTVTPKISINDGNLVVHGKTILTGVPDNIVLTPGSGVGLVAGAFIGATASHNKSLHVFPVGGLEDLRFMCCFRFKLWWMTQRMGKCGKDIPLETQFMLVESKGGGEEVDQDDAQTIYTVFLPLLEGQFRAVLQGNDRNEMEICLESGDSAVETNQGLHLVYMHAGTNPFEVINQAVKAVEKHLQTFLHREKKKMPSFLDWFGWCTWDAFYTDVTAEGVEEGLKSLSEGGTPPRFLIIDDGWQQIENKAKEDANAVVQEGAQFASRLTGIKENSKFQKNGEKNEQAIGLKLVVDNAKQQHNVKYVYAWHALAGYWGGVKPAAAGMEHYDTALAYPVQSPGVLGNQPDIVMDSLAVHGLGLVHPKKVFNFYNELHAYLASCGVDGVKVDVQNIIETLGAGHGGRVSLTRSYQQALEASIARNFPDNGCISCMCHNTDGIYSTKQTAVVRASDDFYPRDPASHTIHISSVAYNTLFLGEFMQPDWDMFHSLHPAADYHGAARAIGGCAIYVSDKPGNHNFDLLKKLVLPDGSVLRAQLPGRPTRDSLFVDPARDGMSLLKVWNVNKCTGVVGVFNCQGAGWCKIEKKTRIHDTTPGTLTASVRASDVDCIAQVAGANWDGETVVYAYKSGELVRLPKGASMPVTLKVLEYELFHFCPINEITSNISFAPIGLLDMFNTGGAVEQVEIQMASDKSPEHFDGEVSSELTTSLSESRSPTATIALKVRGCGRFGAYSSQRPLKCTVGNVFTDFNYDSATGLVTLTLPVPVVEMYRWPVEIQV

SEQ ID NO: 546 - protein, 777 aa, Pisum sativum
  misc_feature (7)..(761): Pfam Name: Raffinose_syn Pfam Description: Raffinose synthase or seed inhibition p
  misc_feature (1)..(777): Public GI ID no. 148925503
  misc_feature (1)..(777): Bit score of 1783.1 for HMM based on sequences of Figure 3
  misc_feature (1)..(777): Functional Homolog Of SEQ ID NO. 504
MTVTPKISVNDGNLVVHGKTILKGVPENVVLTPGSGNGLLTGGAFIGATASNSKSLHVFPIGILEGLRFVCCFRFKLWWMTQRMGTCGRDIPLETQFMLIESKDSEGEEGNSPVIYTVLLPLLEGPFRSVLQGNEKSEIEICFESGDHAVETNQGLHMVYMHAGTNPFEVINQAVKAVEKHMQTFHHREKKRLPSFLDMFGWCTWDAFYTDVTAEGVEQGLKSLSEGGTPPRFLIIDDGWQQIESKAKDPGCVVQEGAQFATMLTGIKENAKFQKNKNEEHSEPTSGLKHLVDGVKKHHNVKNVYVWHALAGYWGGVKPAATGMEHYDTALAYPVQSPGVLGNQPDIVMDSLSVHGLGLVHPKKVFNFYNELHAYLASCGVDGVKVDVQNIIETLGAGHGGRVSLTRSYHHALEASIARNFSDNGCIACMCHNTDGLYSAKQTAVVRASDDFYPRDPASHTIHISSVAYNSLFLGEFMQPDWDMFHSLHPAAEYHAAARAIGGCPIYVSDKPGNHNFDLLKKLVLSDGSVLRAQLPGRPTRDSLFVDPARDRTSLLKIWNMNKCTGVVGVFNCQGAGWCKVEKKTRIHDISPGTLTSSVCASDVDLITQVAGAEWHGETIVYAYRSGEVIRLPKGVSIPVTLKVLEFELFHFCPIQEISSSISFATIGLMDMFNTGGAVEEVEIHRETDNKQELFEGEAVSSELITSLGPNRTTTATITLKVRGSGKFGVYSSQRPIKCMVDGTETDFNYDSETGLTTFIIPVPQEELYKWLIEIQV

SEQ ID NO: 547 - DNA, 2253 bp, Sorghum bicolor
  misc_feature (1)..(2253): Ceres Annot ID no. 8714640
  misc_feature (1)..(2253): Encodes the peptide sequence at SEQ ID NO. 548
atgacggtgggcgccgggatcgccgtccaggacggcagcctcctggcgctgggggccaaggtcctgcgggaggtgcgccccaacgtgctcgtcacgcccgccgccggcggaggcctcaccaacggcgcgttcctcggcgtccgctccgcacccgccggcagccgcagcgtcttccccgtcggcaagctccgtgaccagcgattcatgtgcacgttccggttcaagatgtggtggatgacgcagaggatgggctcatcaggccgcgacatccccttcgagacgcagttcctgatcgtcgaaggcaccgatggactgcagtccaccggcgatggcaccggcgagcagcctgtcgtgtacaccatcttcctccccatattggagggctcattccgtgctgttcttcaggggaacgctgacgatgagctggagatttgcttagagagcggcgatccagatgtggaatccttcgaaggctcccatctggtcttcgttggcgccggatcggatccgttcgaggtcatcacaaattcagtaaaagtcgttgagaggcacttgcagacgttttctcacagggaaaagaaaaagatgccagacatgctcaactggtttggttggtgcacatgggatgcattctacaccaatgtcactgctcaaggagtgaagaaaggattgcagagctttgagaaaggtggggtttctcctagatttgtcataattgacgatggatggcagtcggtcgctatggatcctgtgggaatcgcttgcttatctgataactcagccaagttgactcacattaaggagaaccacaagtttcagaaaaatggcagggagggtcacagggaagatgatccagcaaagggcctagcacacatcgtcaatgaaatcaaagggaaacatgagctgaagtacgtgtatgtatggcatgccattaccggttactggggtggagtcaggccaggtgtagctggaatggagcactacgaatcaaagatgcagcagcctgtgtcatcaccaggggttcagaaaaacgagccctgtgatgctttggacagcataacgaccaatggaatgggccttgtgaaccctgagaaagtattcagtttctacaatgaactccactcgtatcttgcatctgctgggatcgacggggtcaaggtagacgtgcagaacatccttgagacgctaggtgctggccatggtggaagggtactgctagctagaaagtaccagcaggctctagaagcttccgtcgctaggaacttccctgacaatggcatcatatcatgcatgagccacaacactgacaacttatacagttcaaaacggagcgcggtgattagagcctctgatgatttctggccgagagaccctgcttcccataccatacacattgcatctgtcgcctataacaccgtctttcttggtgaattcatgcagccagattgggacatgttccatagtgttcatccgatggctgaataccatgctgcagctcgagcggttggtggttgtgccatatatgtgagtgacaagcctggaaaccatgacttcaatctgcttaagaagcttgtgcttcctgatggatcgatcctgcgtgcaaaactccctgggagaccaactagagattgcctcttctcagatcccgcaagggacggcaaaagcattctcaagatatggaacctgaacgaacactccggtgtcattggcgccttcaactgccaaggcgccggctggtgccaggtagggaagaagaacctcatccacgacgagcagcccggaacagtgacaggcgtcatccgggcacaggatgtgggctaccttgcaaaggttgctgatcagagctggaacggtgacgtgatcgtgtattcccacgtaggaggggaggtggtgtacctgccgaagaacgcctcgctgcctgtgacgctgagatcacgcgagtacgaggtgttcaccgtggtccctctgaagcacctgccaaacggcgtctccttcgcgccgatcggcctggtcggcatgttcaactccggtggcgcggtgagggaggtgaggttcagtgaggatgccgacgtcgagctcaaagtgcggggctcgggcacggtcggcgcttattcctcgacgaggccgaggagtgtcaccatcgattcgaaggcggttggtttttgctacgatgacgcctgtggccagctcacctttgagcttggcctctccgaacaagaactatacttttggacagtttcagtgggctactga

SEQ ID NO: 548 - protein, 750 aa, Sorghum bicolor
  misc_feature (7)..(734): Pfam Name: Raffinose_syn Pfam Description: Raffinose synthase or seed inhibition p
  misc_feature (1)..(750): Ceres Annot ID no. 8714640
  misc_feature (1)..(750): Bit score of 1448.4 for HMM based on sequences of Figure 3
  misc_feature (1)..(750): Functional Homolog Of SEQ ID NO. 504
MTVGAGIAVQDGSLLALGAKVLREVRPNVLVTPAAGGGLTNGAFLGVRSAPAGSRSVFPVGKLRDQRFMCTFRFKMWWMTQRMGSSGRDIPFETQFLIVEGTDGLQSTGDGTGEQPVVYTIFLPILEGSFRAVLQGNADDELEICLESGDPDVESFEGSHLVFVGAGSDPFEVITNSVKVVERHLQTFSHREKKKMPDMLNWFGWCTWDAFYTNVTAQGVKKGLQSFEKGGVSPRFVIIDDGWQSVAMDPVGIACLSDNSAKLTHIKENHKFQKNGREGHREDDPAKGLAHIVNEIKGKHELKYVYVWHAITGYWGGVRPGVAGMEHYESKMQQPVSSPGVQKNEPCDALDSITTNGMGLVNPEKVFSFYNELHSYLASAGIDGVKVDVQNILETLGAGHGGRVLLARKYQQALEASVARNFPDNGIISCMSHNTDNLYSSKRSAVIRASDDFWPRDPASHTIHIASVAYNTVFLGEFMQPDWDMFHSVHPMAEYHAAARAVGGCAIYVSDKPGNHDFNLLKKLVLPDGSILRAKLPGRPTRDCLFSDPARDGKSILKIWNLNEHSGVIGAFNCQGAGWCQVGKKNLIHDEQPGTVTGVIRAQDVGYLAKVADQSWNGDVIVYSHVGGEVVYLPKNASLPVTLRSREYEVFTVVPLKHLPNGVSFAPIGLVGMFNSGGAVREVRFSEDADVELKVRGSGTVGAYSSTRPRSVTIDSKAVGFCYDDACGQLTFELGLSEQELYFWTVSVGY

SEQ ID NO: 549 - DNA, 2361 bp, Populus balsamifera subsp. trichocarpa
  misc_feature (1)..(2361): Ceres Annot ID no. 1528375
  misc_feature (1)..(2361): Encodes the peptide sequence at SEQ ID NO. 550
atgacggtgacaccaaagatttcaatcaatgatgggaaccttctggttcatgggaagacaattttaactggagttcctgataacattgtcttgactcctggctctggtgttggacctgttgctggtgcttttattggtgccaccgcttctcatagccaaagtctccatgtttttcctgttggggttttagaggatcttcgttttatgtgttgtttccgattcaagttatggtggatgacccagagaatggggaaatgtgggaaagatattcctctggagactcaattcatgctagtggaaagcaggaatggcggtgaaggagttgatcaagatgatgcacagacaatctacaccgtcttccttcccctactagaaggccagttccgtgctgtactgcaaggcagcgacaggaatgagatggagatttgccttgatagcggggatagtgctgttgaaaccaatcaaggacttaacctggtctacatgcatgctgggactaacccctttgaagtcataaaccagcttgtaatcaccattttcctaacaacttatgaaaacagggctgtggaaaaatatatgcaaacttttcttcatcgggaaaagaaaaagctgccctcttttcttgactggtttggctggtgtacctgggatgccttttacacggatgtcaccgctgagggtgttagggaaggccttgagagtctgtcagaaggagggactcccccacgatttttgatcattgatgatggttggcaacagatcgaaaataaagcaaaggaggatgctaatgttgttgtacaagaaggagcacaatttgcaagtaggcttactggaataaaggagaattcaaaattccagaagaactgtgaaaagaatgaacaggtgattggactgaagcatgttgtggacgatgctaagcaatgccataatgtgaagtgtgtttatgtatggcatgctttggctggttactggggtggagttaaaccagcggctgctggtatggagcattatgacactgcactggcttatccggttcaatctcctggtgttataggcaaccaacctgacgttgttatggacagcctatcagttcatggccttggtttagtgcatccaaagaaggttttcaacttctacaatgagctccatgcctatttagcatcatgtggagttgatggagtaaaagttgatgctcagaacattattgaaacacttggtgctggccatggtggaagagtgtctctcacccgtagctatcaccaagctcttgaggcctcaattgcaagaaacttccctgacaatggatgcattgcctgcatgtgtcataacactgatggaatctatagtgccaagcagactgctgtagtgagagcttctgatgatttctatcctcgggaccctgcttcccacaccatccatatctcctctgtggcttacaacactcttttccttggagaatttatgcaaccagactgggatatgttccatagtttacacccggctgcagagtatcatggggctgctcgtgctattggtggatgtgcaatctatgtcagtgataaaccagggaaccacaactttgacctattgaagaagctggtcctccctgatggatctgtcctccgtgcccaacttccaggccggccaacacttgacagtctctttgctgacccagcaagagatggaactagcttactcaagatctggaatgtgaacaaatgcaccggtgtagtaggtgtcttcaactgccaaggtgcggggtggtgcaagattgagaagaagacccgcattcatgatgaaactccaggtactctcacgggctctgtttgtgctagtgatgttgattgcattgctcaagttactggtgcaaaatggaatggggaaaccgtggtgtatgcctacaaatcaggggagttggttcggttgcctaaaggtgcttcagtgccagtgacactaaaagttcttgaatatgaactcttccatttctgtcctatcgatgatatcgcttccaacatttcatttgcaccaataggcttgcttgacatgttcaactcaggcggtgctgtggagcaggttgaaatccatatgacttctgacaaggcgccagagcactttgatggtgaagtctcctcagagctgactacttctctcagtgagaaccggtttccaactgcaaccattgcactgagagtcaggggctgcggacggtttggtgcttactcttcccagcgccctctaaaatgcactgtgggcaatgttgacacagacttcaatcatgactctgccactgggctactgaccctgactctccctgtagcagaagaggaaatgtacagatggcctgtggagatacaggtttaa

SEQ ID NO: 550 - protein, 786 aa, Populus balsamifera subsp. trichocarpa
  misc_feature (7)..(770): Pfam Name: Raffinose_syn Pfam Description: Raffinose synthase or seed inhibition p
  misc_feature (1)..(786): Ceres Annot ID no. 1528375
  misc_feature (1)..(786): Bit score of 1819.4 for HMM based on sequences of Figure 3
  misc_feature (1)..(786): Functional Homolog Of SEQ ID NO. 504
MTVTPKISINDGNLLVHGKTILTGVPDNIVLTPGSGVGPVAGAFIGATASHSQSLHVFPVGVLEDLRFMCCFRFKLWWMTQRMGKCGKDIPLETQFMLVESRNGGEGVDQDDAQTIYTVFLPLLEGQFRAVLQGSDRNEMEICLDSGDSAVETNQGLNLVYMHAGTNPFEVINQLVITIFLTTYENRAVEKYMQTFLHREKKKLPSFLDWFGWCTWDAFYTDVTAEGVREGLESLSEGGTPPRFLIIDDGWQQIENKAKEDANVVVQEGAQFASRLTGIKENSKFQKNCEKNEQVIGLKHVVDDAKQCHNVKCVYVWHALAGYWGGVKPAAAGMEHYDTALAYPVQSPGVIGNQPDVVMDSLSVHGLGLVHPKKVFNFYNELHAYLASCGVDGVKVDAQNIIETLGAGHGGRVSLTRSYHQALEASIARNFPDNGCIACMCHNTDGIYSAKQTAVVRASDDFYPRDPASHTIHISSVAYNTLFLGEFMQPDWDMFHSLHPAAEYHGAARAIGGCAIYVSDKPGNHNFDLLKKLVLPDGSVLRAQLPGRPTLDSLFADPARDGTSLLKIWNVNKCTGVVGVFNCQGAGWCKIEKKTRIHDETPGTLTGSVCASDVDCIAQVTGAKWNGETVVYAYKSGELVRLPKGASVPVTLKVLEYELFHFCPIDDIASNISFAPIGLLDMFNSGGAVEQVEIHMTSDKAPEHFDGEVSSELTTSLSENRFPTATIALRVRGCGRFGAYSSQRPLKCTVGNVDTDFNHDSATGLLTLTLPVAEEEMYRWPVEIQV

SEQ ID NO: 551 - DNA, 2433 bp, Panicum virgatum
  misc_feature (1)..(2433): Ceres Clone ID no. 1768954
  misc_feature (1)..(2433): Encodes the peptide sequence at SEQ ID NO. 552
ggaggcgacggaccacggaccagagagagctcaccgccgtcgcgagataaaccacccgtggctccacggattccgagctgccgctgcccgtcgggaggaagatgacggtgggcgccgggatcgcggtccaggacgggagcctggtggcgctgggggccaagatcctgcgggaggtgcgcggcaatgtgcacgtcacgccggccgccgggggcggcctcaccaacggcgccttcctcggcgtgcggtccgcgcccgccggcagccgcagcgtcttccccgttgggaagctccgggacctacggttcatgtgcactttccggttcaagatgtggtggatgacgcagaggatgggctcgtcaggccgtgacatccccttcgagacacagttcttgatcgtcgagggcactgatggaccgcagttcaccagcgatagcaccgagcgacctgtggtgtacactgtcttccttccgatattggaggggtcattccgtgctgttcttcaggggaacgctgatgatgagctggagatttgcttggagagtggtgatccagatgtggaatcctttgaaggcacccatcttgttttcgtcggtgctggatcggatccatttgaagtgatcacaaattcagtaaaagctgttgagaggcacttgcagacgttttctcacagggaaaagaaaaagatgccagacattctaaactggtttggttggtgcacgtgggatgcattttacacaaacgttactgctgaaggagtgaaggagggattacagagctttcaaaaaggtggagtttctcctaagtttgtcataattgacgatggatggcaatcggtcggtatggatcccgtgggaattgcgtgcttagctgataactcagccaactttgcaaacaggttgactcacattaaggagaaccacaagtttcagaaaaatgggagggagggtcacagggaagatgatccagcaaaaggccttgcacatatcgtcagtgaaattaaaggaaagcatgagctgaagtatgtgtatgtgtggcacgcgattaccggatactggggtggagtcaggccaggtgttgttggaatggagcaatatgaatcgaagatgcagcaccctgtgtcatcaccaggagttcagaaaaacgaaccctgtgatgctttgaacagtataacaactaatggactgggccttgtgaaccctgaaaaagtattcagtttctacaatgagctccattcttatcttgcatctgctgggatcgatggagttaaggtggacgtgcagaacatccttgagacactaggtgctggccatgggggaagggtactgctggctagaaagtatcaacaggctttggaagcttccatcgctaggaacttccctgacaatggcatcatatcatgcatgagccacaacacagacaacttatatagttcaaaaaggagcgcagttgtgagagcctctgatgatttctggccgagagacctggcttcccatactatacacattgcatctgttgcctataacactgtctttctcggagaattcatgcagcctgattgggacatgttccatagtgttcaccctatggctgaataccacgctgcagcccgagcagttggcggttgtgccatatacgtcagtgacaagcctggaagccatgacttcaatttgctgaagaaacttgtgcttcctgacggatcgatcctgcgtgccaaactccctgggagaccaaccagagactgcctgttctccgatcctgccagggacggcaaaagcatcctcaagatctggaacctgaacgatcactccggtgtcattggcgccttcaactgccaaggtgccggctggtgccgggtagggaagaagaaccttgtccatgatgagcagcccggaacggtcaccggtgtcatccgggcacgggatgtggactaccttgcaaaggttgctgatcaaagctggaacggcgacgtgatcgtgtattcgcacgtcggaggagaggtggtctacctgccgaagaacgcctccttgcccgtgacgctgagatcacgcgagtacgaggtgttcaccgtcgtcccagtgaaatgcctgccgagtggcgcctcctttgcgccgatcggcctgaccggaatgttcaactccggcggcgcggtgagggagctgagattcggcgaggacgcaggcgtccagctcaaagtgcggggctcgggcactgtggcggcatactcctcagcaaagccgaagagtgtagccgtcgattccacggtggttgatttctcctacgacgaggcctgtggtttggtcacctttgagcttggccttcccaagcaagaactgtacctgtggaccgtttcggtagagtactgagatcgatgtaatgagaaaagttttttttaaagatgtaatgagaaaagttcagatatggcttcctgagagc

SEQ ID NO: 552 - protein, 753 aa, Panicum virgatum
  misc_feature (7)..(737): Pfam Name: Raffinose_syn Pfam Description: Raffinose synthase or seed inhibition p
  misc_feature (1)..(753): Ceres Clone ID no. 1768954
  misc_feature (1)..(753): Bit score of 1468.9 for HMM based on sequences of Figure 3
  misc_feature (1)..(753): Functional Homolog Of SEQ ID NO. 504
MTVGAGIAVQDGSLVALGAKILREVRGNVHVTPAAGGGLTNGAFLGVRSAPAGSRSVFPVGKLRDLRFMCTFRFKMWWMTQRMGSSGRDIPFETQFLIVEGTDGPQFTSDSTERPVVYTVFLPILEGSFRAVLQGNADDELEICLESGDPDVESFEGTHLVFVGAGSDPFEVITNSVKAVERHLQTFSHREKKKMPDILNWFGWCTWDAFYTNVTAEGVKEGLQSFQKGGVSPKFVIIDDGWQSVGMDPVGIACLADNSANFANRLTHIKENHKFQKNGREGHREDDPAKGLAHIVSEIKGKHELKYVYVWHAITGYWGGVRPGVVGMEQYESKMQHPVSSPGVQKNEPCDALNSITTNGLGLVNPEKVFSFYNELHSYLASAGIDGVKVDVQNILETLGAGHGGRVLLARKYQQALEASIARNFPDNGIISCMSHNTDNLYSSKRSAVVRASDDFWPRDLASHTIHIASVAYNTVFLGEFMQPDWDMFHSVHPMAEYHAAARAVGGCAIYVSDKPGSHDFNLLKKLVLPDGSILRAKLPGRPTRDCLFSDPARDGKSILKIWNLNDHSGVIGAFNCQGAGWCRVGKKNLVHDEQPGTVTGVIRARDVDYLAKVADQSWNGDVIVYSHVGGEVVYLPKNASLPVTLRSREYEVFTVVPVKCLPSGASFAPIGLTGMFNSGGAVRELRFGEDAGVQLKVRGSGTVAAYSSAKPKSVAVDSTVVDFSYDEACGLVTFELGLPKQELYLWTVSVEY

SEQ ID NO: 553 - protein, 756 aa, Solanum lycopersicum
  misc_feature (7)..(740): Pfam Name: Raffinose_syn Pfam Description: Raffinose synthase or seed inhibition p
  misc_feature (1)..(756): Public GI ID no. 23452226
  misc_feature (1)..(756): Bit score of 1455.9 for HMM based on sequences of Figure 3
  misc_feature (1)..(756): Functional Homolog Of SEQ ID NO. 504
  misc_feature (663)..(663): Xaa is any aa, unknown, or other
MTVGAGICVAERKLNVLGQSILSDVDENIIVTQPNGKAFTNGAFLGVNSDRIGSHRVFPIGKLQGLRFMCGFRFKLWWMTQRMGTSGQDIPFETQFLIVEGNDGSNFDQDNQQNSALYVVFLPILEGDFRAVLQGNSNDELEICLESGDPAVQDFEGSHLVYVAAGPDPFDVITNAVKTVERHLQTFCHRDRKKMPDMLNWFGWCTWDAFYTTVTSEGVKQGLESLEKGGIPPKFVLIDDGWQSVSMDPDGIESIADNHANFANRLTHIKENHKFQKNGKEGHRVNDPAMGLRHVVTNIKDQHNLKYVYMWHALAGYWGGVRPGVPGMEHYESKLSFPVSSPGTESQEPDDALSSLIKNGLGLVNPEKVLYFYNELHSYLASAGIDGVKVDVQNILETLGAGHGGRVKLARKYHQALEASIARNFPDNGIISCMSHSNDSLFSAKRSAVIRASDDFWPRDPASHTIHIASVAYNTIFLGEFMQPDWDMFHSVHPMAEYHGAARAVGGCAIYVSDKPGQHDFNLLKKLVLPDGSILRAKLPGRPTRDCLFSDPARDGISLLKIWNLNDFNGVVGVFNCQGAGWCKVGKKNLIHDCQPGTITGIVRANDVNYLPRIAHDGWTGDAILYSHLHRELINLPKNTSIPITLNAREYEVFTVVPINEMXTGSRFAPIGLVNMFNSGGAIKEVKYETEGKCGLVSMKVRGCGTFGAYSSGKPKRIHVDNEEVQFDYDESSGLFTINITVPDQELYLWDVKVET

SEQ ID NO: 554 - protein, 779 aa, Persea americana
  misc_feature (7)..(763): Pfam Name: Raffinose_syn Pfam Description: Raffinose synthase or seed inhibition p
  misc_feature (1)..(779): Public GI ID no. 7242785
  misc_feature (1)..(779): Bit score of 1765.1 for HMM based on sequences of Figure 3
  misc_feature (1)..(779): Functional Homolog Of SEQ ID NO. 504
  misc_feature (260)..(260): Xaa is any aa, unknown, or other
  misc_feature (370)..(370): Xaa is any aa, unknown, or other
  misc_feature (377)..(377): Xaa is any aa, unknown, or other
  misc_feature (379)..(379): Xaa is any aa, unknown, or other
  misc_feature (652)..(652): Xaa is any aa, unknown, or other
MTVTPKISINDGNLVVHGKTILTGVPDNIVLTPRTGDGLVAGCFIGATASESESIHVFPMGTLEGLRFTCCFRFKLWWMTQRMGMCGKDVPLETQFMLIESKDGAAAIDDDEEEAPTIYTVFLPLLEGQFRAVLQGNESNQIEICLESGDCAVRTNQGMYLVYMHAGTNPFQVINQAVKAVEKHLYSFQHLEKKKIPSFLDWFGWCTWDAFFTDVTDEGVEEGLKSLSGGGTPPRFLIIDDGWQQIGSEETKDDSNCVVXEGAQFASRLTGIKENDKFQKNGKSEHVPGLKLVVDDAKQHHNVKFVYVWHALAGYWGGVKPPAAGMEHYDTALAYPVQSPGVMGNQPDIVMDSLSVHGLGLVHPRKVFNXYNELHAXLXSCGVNGVKVDVQNIIETLGAGHGGRVSLTRSYIQALEGSIARNFPDNGCIACMCHNTDSIYSAKQTAVVRASDDFYPRDPASHTIHVSSVANNSLFLGEFMQPDWDMFHSLHPAAEYHGAARAVGGCPIYVSDKPGHHNFELLKKLVLPDGSVLRARLPGRPTRDSLFVDPARDGVSLLKIWNMNKCLGVVGVFNCQGAGWCKITKKTRIHDAAPGTLSGSIRAHDVEFINQLAGQDWNGEVIVFTYGSGEVVRLPKCASIPVTLEVLEYELXHICPVKEITSNISFAPIGLLDMFNSGGAVEQFDVRMDSNNAEPPLFDGKVASKLSSSLSNNQSPSATVVLRVRGCGRFGAYSSQRPLKCTVDLVETEFNYDSVTGLVTLIIPVPDQEMYKWSVEFQL

SEQ ID NO: 555 - protein, 656 aa, Arabidopsis thaliana
  misc_feature (7)..(656): Pfam Name: Raffinose_syn Pfam Description: Raffinose synthase or seed inhibition p
  misc_feature (1)..(656): Public GI ID no. 30694660
  misc_feature (1)..(656): Bit score of 1604.0 for HMM based on sequences of Figure 3
  misc_feature (1)..(656): Functional Homolog Of SEQ ID NO. 504
MTITSNISVQNDNLVVQGKTILTKIPDNIILTPVTGNGFVSGSFIGATFEQSKSLHVFPIGVLEGLRFMCCFRFKLWWMTQRMGSCGKDIPLETQFMLLESKDEVEGNGDDAPTVYTVFLPLLEGQFRAVLQGNEKNEIEICFESGDKAVETSQGTHLVYVHAGTNPFEVIRQSVKAVERHMQTFHHREKKKLPSFLDWFGWCTWDAFYTDVTAEGVDEGLKSLSEGGTPPKFLIIDDGWQQIENKEKDENCVVQEGAQFATRLVGIKENAKFQKSDQKDTQVSGLKSVVDNAKQRHNVKQVYAWHALAGYWGGVKPAASGMEHYDSALAYPVQSPGVLGNQPDIVMDSLAVHGLGLVNPKKVFNFYNELHSYLASCGIDGVKVDVQNIIETLGAGLGGRVSLTRSYQQALEASIARNFTDNGCISCMCHNTDGLYSAKQTAIVRASDDFYPRDPASHTIHIASVAYNSLFLGEFMQPDWDMFHSLHPTAEYHAAARAVGGCAIYVSDKPGNHNFDLLRKLVLPDGSVLRAKLPGRPTRDCLFADPARDGISLLKIWNMNKFTGIVGVFNCQGAGWCKETKKNQIHDTSPGTLTGSIRADDADLISQVAGEDWSGDSIVYAYRSGEVVRLPKGASIPLTLKVLEYELFHISPLKDL

SEQ ID NO: 556 - DNA, 2259 bp, Populus balsamifera subsp. trichocarpa
  misc_feature (1)..(2259): Ceres Annot ID no. 1532021
  misc_feature (1)..(2259): Encodes the peptide sequence at SEQ ID NO. 557
atgacgatcaaaccggcggttcgaatttcggaaagcaaattggtcgttaaagaccggacgatattgactggtgtaccagacaatgttatggcaacatctggttcaagttcaggtccggtcgacggagtgtttctaggtgttgttttcgatcaagaaaatagtagacatgtggtttctttgggtgctctacgtgatgtccggttcatggcttgtttccggtttaagctatggtggatggctcaaaagatgggagatcaagggagagatattcctctagagacacagtttttattggtggaaactaaagacggttcccaccttgaatcagacggtggagatgaagagaatcagattgtatacactgttttcctgccgttgattgaaggatcattcagggcctgtttgcaggggaatgttgacgatgagcttgaactctgtttggaaagtggtgatgcagagactaaaaggacatcgttttctcattctgtgttcattcatgctgggacggatccgtttaggactataacggaggctgttagagccgtcaagttgcatctgaagactttccgtcaacggcacgagaaaaaattgcctggaattgttgattattttggttggtgtacctgggatgccttctatcaagaagttacacaagaaggggtggaagccgggctagaaagtctggcttctggtggtaccccaccaaagtttgtgatcattgatgatggatggcaatcggtcggtggtgacccacaagaggaaagcaatgatcaagatgagaagaaagaaaatcagcaaccgttgcttaggttgactgggattaaagaaaatgcaaagttccaaaagaaagatgatccaacagcggggattaagagcatagtgaatgtagcaaaggaaaaacatgggctaaaatatgtgtatgtgtggcatgctattactggatattggggtggggtccgcccagaagttaaggagatggaggagtatggttcaacgctgaaatatctgatggtgtcaaagggggtggtggagaacgatcccacatggaaaaacgatgccttggcgttgcagggattagggctggtgaatccaaaaaatgtgtacaagttttataacgagttgcatagttatctggcatctgctggcattgatggggttaaggtggatgttcaatgtatattggagacacttggtgctggtttgggtggtagggttcaattgactaggcaataccatcaggcccttgatgcttctgtcgcaaggaacttccctgataacggctgcattgcttgcatgagccataatactgatgctttgtactgctccaaacaaacggcagtggtgagagcatcggatgatttctacccgcatgatccagtatcacacaccatccatatagcagcggtggcgtataacagtgttttcttgggagagttcatgcagcctgattgggacatgttccattctctacatccaactgctgaatatcatgcttctgctagggctattagtggtggacccatctatgttagtgatgcacctgggaagcacaactttgagctactaaagaaattgatccttcctgatgggtcaattcttcgagcccgtttgcctggtaggcctacccgtgactgcttgttctccgacccagcccgcgacggtgttagcttattgaaaatatggaacatgaacaagttcacaggggtcctaggagtctacaattgccaaggagcagcatggaacaacactgaaagaaagaacacgttccaccaaaccaaaaatgaggtactgacaggcgccattaggggtcgtgatgtgcacctcatcgctgaagctgccatggaccccaactgggatggtaattgtgctgtctattgtcatcggactggagaacttatcaccctcccatacaatgcagcgttgccaatgtcactcaaagtccttgagcatgacatatttacagtcacacccatcaaggacttggcacccgggttcagctttgcacccctggggctaatcaacatgttcaatgctggtggagccattgaggggctgaagtatgaagtgaaagggaaagttagcatggaggttaaaggatgcggcaagtttggtgcttactcatctgctaagccaaggaagtgcattgtggacgcaaatgtggtcgaatttgtgtacgattcagattctagtttggttagtcttagcttggatagcatgcctgaggagggcaagcttcatgtagttgagattgagttatag

SEQ ID NO: 557 - protein, 752 aa, Populus balsamifera subsp. trichocarpa
  misc_feature (7)..(736): Pfam Name: Raffinose_syn Pfam Description: Raffinose synthase or seed inhibition p
  misc_feature (1)..(752): Ceres Annot ID no. 1532021
  misc_feature (1)..(752): Bit score of 1381.1 for HMM based on sequences of Figure 3
  misc_feature (1)..(752): Functional Homolog Of SEQ ID NO. 504
MTIKPAVRISESKLVVKDRTILTGVPDNVMATSGSSSGPVDGVFLGVVFDQENSRHVVSLGALRDVRFMACFRFKLWWMAQKMGDQGRDIPLETQFLLVETKDGSHLESDGGDEENQIVYTVFLPLIEGSFRACLQGNVDDELELCLESGDAETKRTSFSHSVFIHAGTDPFRTITEAVRAVKLHLKTFRQRHEKKLPGIVDYFGWCTWDAFYQEVTQEGVEAGLESLASGGTPPKFVIIDDGWQSVGGDPQEESNDQDEKKENQQPLLRLTGIKENAKFQKKDDPTAGIKSIVNVAKEKHGLKYVYVWHAITGYWGGVRPEVKEMEEYGSTLKYLMVSKGVVENDPTWKNDALALQGLGLVNPKNVYKFYNELHSYLASAGIDGVKVDVQCILETLGAGLGGRVQLTRQYHQALDASVARNFPDNGCIACMSHNTDALYCSKQTAVVRASDDFYPHDPVSHTIHIAAVAYNSVFLGEFMQPDWDMFHSLHPTAEYHASARAISGGPIYVSDAPGKHNFELLKKLILPDGSILRARLPGRPTRDCLFSDPARDGVSLLKIWNMNKFTGVLGVYNCQGAAWNNTERKNTFHQTKNEVLTGAIRGRDVHLIAEAAMDPNWDGNCAVYCHRTGELITLPYNAALPMSLKVLEHDIFTVTPIKDLAPGFSFAPLGLINMFNAGGAIEGLKYEVKGKVSMEVKGCGKFGAYSSAKPRKCIVDANVVEFVYDSDSSLVSLSLDSMPEEGKLHVVEIEL

SEQ ID NO: 558 - protein, 741 aa, Physcomitrella patens subsp. patens
  misc_feature (7)..(726): Pfam Name: Raffinose_syn Pfam Description: Raffinose synthase or seed inhibition p
  misc_feature (1)..(741): Public GI ID no. 168002098
  misc_feature (1)..(741): Bit score of 1375.1 for HMM based on sequences of Figure 3
  misc_feature (1)..(741): Functional Homolog Of SEQ ID NO. 504
MTVEGGITIQGGQLLVYGQPLLRNVPSNVTFTSESNLHGGFLGASFSESNSHHVVPLGVLEEVRFLCCFRFKLWWMTQRMGSCGQEVPYETQFMLLEGPSNKYSVLLPILDGAFRACLQGNAENELQLCVESGDPAVVTNRLDYSIYMHVGSDPFEVIEDAVRAVEAHLQTFVHREKKKIPGILDYFGWCTWDAFYTDVSAKGVMQGLSSLAEGGTPARFLIIDDGWQSVAAGDESAGQSTAVTQGTQYASRLTHIKENHKFQKDGVAGSWPEDQSLGLRHTVLDAKANFNLKYVYVWHALAGYWGGVQPGGSNTKIYDSSLVYPVHSPSVLENQPDMSVDSLTVNGLGLVNPTEFFSFYDELHRYLADAAVDGVKVDAQNIFETLGAGLGGRVKLAQQVHQALEASIARNFPENGCISCMSHSTDNLYHSKQTAVVRASDDFWPRDPASHTIHIASVAYNSLFLAEFMQPDWDMFHSLHPAAEYHAAARAVGGCAIYVSDKPGNHDFNLLKKLVLPDGSVLRALLPGRPTRDCLFSDPARDGKSLLKIWNMNKYGGVIGIFNCQGAGWCKLDKKYTIHEIRPDAISSSVRAADIDRLADAAPEGWDGACVVFSHQSCELVRITLHAALPITLRKLEYELFTVAPVKKLDTDLSFAPLGLIEMFNSGGALKGLDFDTQGKSVTMQVFGWGTFGVYASQRPRACALNCSTDIPLSYDQTSGLASVSLPRGEEGCLWTVTITF

SEQ ID NO: 559 - DNA, 2457 bp, Panicum virgatum
  misc_feature (1)..(2457): Ceres Clone ID no. 1806608
  misc_feature (1)..(2457): Encodes the peptide sequence at SEQ ID NO. 560
atccttgccaagcatctcgcaatcctagataggcgaagaggagatgacgatcacatcatccgtcaagctcgccggcggcacgctgtcggtctgcgggaggacggtgctgtccggcgtgccagccgccgtggcggcgtcctctgcgtcagcggccggagcggtcgacggggtcttcattggcgccgacctcgccgagccggcgtcccaccacgtcatttccctcggcaccttaaggggcgtgcgtttcatggcgtgcttccggagcaagctgtggtggatgtcgcagcggatgggggacaagggcggcgatgtcccgcacgagacgcagttcctgctcgtggagtccacgggcgccggtggcaaggacgcggcggcggcggcgtacgtcgtgttcctcccgctcgtggagggcgcgttccgggccagcctccagggcggcgccggcgaggcgctggagctctgcgtcgagagcggggacgacgacacgcgcgcggcgtccatcgagcgcgcgctcttcgtgggcgctgcggagtcggaccccttcgcagccgtcgccggcgccgtcgccgccgccaggtccgcgctcaagacgttccgggtccgcgccgagaagaagctcccgggcatcgtggactactttgggtggtgcacctgggacgccttctaccaggacgtcacgcaggagggcgtcgaggccgggctccgcagcctcgtcaccggcggcgcgccgcccaagttcgtcatcatcgacgacggctggcagtccgtcggcacggaccagcccagccccagccccgacgaacacgccggagaggccacgcagccgcgcctgccccggctcaccggtatcagggagaacagcaagttccagaacgccgacgacccggccgccggcatcaaggcggtggtgcgcgcagcgaaggaggagtacgggctcaagtacgtcttcgtctggcacgccatcatcggctactggggcggcgtccgtccgggcgccgccgggatggagcgctaccgctccagcatgcagttccccaagatctcgccgggcgtcgccgagaacgaccccggcatgaggaccgactggatcaccgcccagggggtcggcctggtgcccccccgcgccgtgtaccggttctacgacgagcagcacgcgtacctcgccgccgccggcgttgacggcgtcaaggtggacgagcagtgcatcctggagacgctcggcgccggccacggcggccgcgcgcagctcaccaggcagtaccaccaggcgctcgacgcgtccgtcgccaagaacttccccgagaacggcatcatcgcgtgcatgagccacaacaccgacgccctatactgctcgaagcagacggcggtggtgagggcgtctgatgatttcttcccgagggaccccgtctcgcacacgatccacatcgccgcggtggcgtacaacagcgtgttcctcggcgagttcatgctcccggactgggacatgttccactccctccacccggccggcgagtaccacggctcggcccgggcgatcagcggcggccccgtctatgtcagtgatgcccccgggaagcacgacttcgagctgctgaagaagatcgtcttgccggacggctcggtgctccgcgcgcgcctgcctggccggccgaccaaggactgcctgttcaccgacccggcacgcgacggcgtcagcttgctcaagatatggaacatgaacaagttcaccggcgtgctgggcgtgtacaactgccagggcgcggcgtggagcttcgtggagaagaagaccacgttccaccgcaccggcgccggcgccctgacctgcggcgtcaaaggcagcgacgtccacctcatctccgacgccgcgacggacccggatcagtggagcggcgactgcgccgtgtaccgccacggcagcggtgacctcgccgtcctccccgacggcgcggcgctgcccgtctccctcaaggtcctcgagcaagacatcctcaccgtgtcgccgatcaaggacctggcacccgggttcaggttcgccccggtcgggctggtcggcatgttcaacggcggcgcggcggtggaaggcctgacctaccacctcctcgacgggggcaagcttgtcggcgacggcggctctgctgcttgcaggtcagaggaggccgtcggattggtgtgcatggaagtgcgggggcgtggcagattcggcgcctactcttctgtcaggccgaggaggtgcatgctgggctcggctgagatcgagttctcctacgtcccttcgtccgggctgctgactctgctgctggaggagatgcccggggagagggttcacaagattgtcgtcgagttgtagacttgcggtgcggtagcatcacaaatccagagcacccgcttttttgtttttttggcccttgccgaaagaatttcacaaatagacccagaaggaaatgttttccgtttccg

SEQ ID NO: 560 - protein, 767 aa, Panicum virgatum
  misc_feature (7)..(752): Pfam Name: Raffinose_syn Pfam Description: Raffinose synthase or seed inhibition p
  misc_feature (1)..(767): Ceres Clone ID no. 1806608
  misc_feature (1)..(767): Bit score of 1251.1 for HMM based on sequences of Figure 3
  misc_feature (1)..(767): Functional Homolog Of SEQ ID NO. 504
MTITSSVKLAGGTLSVCGRTVLSGVPAAVAASSASAAGAVDGVFIGADLAEPASHHVISLGTLRGVRFMACFRSKLWWMSQRMGDKGGDVPHETQFLLVESTGAGGKDAAAAAYVVFLPLVEGAFRASLQGGAGEALELCVESGDDDTRAASIERALFVGAAESDPFAAVAGAVAAARSALKTFRVRAEKKLPGIVDYFGWCTWDAFYQDVTQEGVEAGLRSLVTGGAPPKFVIIDDGWQSVGTDQPSPSPDEHAGEATQPRLPRLTGIRENSKFQNADDPAAGIKAVVRAAKEEYGLKYVFVWHAIIGYWGGVRPGAAGMERYRSSMQFPKISPGVAENDPGMRTDWITAQGVGLVPPRAVYRFYDEQHAYLAAAGVDGVKVDEQCILETLGAGHGGRAQLTRQYHQALDASVAKNFPENGIIACMSHNTDALYCSKQTAVVRASDDFFPRDPVSHTIHIAAVAYNSVFLGEFMLPDWDMFHSLHPAGEYHGSARAISGGPVYVSDAPGKHDFELLKKIVLPDGSVLRARLPGRPTKDCLFTDPARDGVSLLKIWNMNKFTGVLGVYNCQGAAWSFVEKKTTFHRTGAGALTCGVKGSDVHLISDAATDPDQWSGDCAVYRHGSGDLAVLPDGAALPVSLKVLEQDILTVSPIKDLAPGFRFAPVGLVGMFNGGAAVEGLTYHLLDGGKLVGDGGSAACRSEEAVGLVCMEVRGRGRFGAYSSVRPRRCMLGSAEIEFSYVPSSGLLTLLLEEMPGERVHKIVVEL

SEQ ID NO: 561 - DNA, 2490 bp, Solanum lycopersicum
  misc_feature (1)..(2490): Ceres Annot ID no. 8457131
  misc_feature (1)..(2490): Encodes the peptide sequence at SEQ ID NO. 562
atgacagtaggagcaggaatttgtgtggctgaaagaaagcttaatgtattggggcaaagcattctaagtgatgttgatgaaaatattattgttactcagccaaatggtaaagcttttactaatggggcatttcttggtgttaattcagacagaattggtagtcatagagtcttccctattggcaaactacaaggattgagatttatgtgtggtttccggttcaagttatggtggatgacacagagaatgggtacatctggccaagatataccattcgagactcagtttttgattgtagaaggaaatgatggttcaaattttgatcaagacaaccagcaaaattcagcattgtatgttgttttcttgcctattctagaaggtgattttagggccgttcttcaagggaattcaaacgatgagttagagatatgtttggaaagtggagatcctgctgtgcaagatttcgagggaagccatttggtttacgtagcagctggaccagacccttttgatgtcatcactaatgctgtcaagtatgttttagtcctttctttcatggtttccattcttgaagaaatttccttagtcaactgtgcaactcattgtcttcacataactatagagtcgtcccaaggacaactatatggtaatggggaaaacggagtcctttccgaaaaatgcctagagaaaaaggaagatacattttgccttgctgaaatgcaaatgattgttaaaattcttcatcaacacaggacggtggagaggcatttacagacattttgtcaccgtgatagaaagaagatgccagacatgttgaactggttcggatggtgcacgtgggatgctttctatactaccgttacttcagagggagtgaagcaagggttagagagtttggagaaaggaggtattcccccaaagtttgtactcattgatgatggatggcaatcagtgagtatggatcccgatggtatcgaatccattgctgataaccatgcaaactttgctaacaggttaactcatatcaaagagaaccataagtttcagaaaaatggaaaagaaggtcatagggttaacgatcctgcaatgggacttcgacatgttgttaccaatatcaaagaccaacacaatttgaagtatgtgtacatgtggcatgcacttgctggttactggggcggtgtgagacccggggtccctgggatggaacactatgaatccaagttatctttcccagtttcatctcccgggactgagtcacaggaacctgatgatgctttgagcagcttgataaagaacggtcttggtctagtgaaccctgagaaagttttatacttctataatgaactgcactcataccttgcttctgcgggtatagatggggttaaagtagatgttcagaacatccttgaaacacttggagctggtcatggtggaagggtaaaactcgcaaggaagtatcatcaagcattagaggcatctattgctcgaaattttcctgataatggaattatttcatgcatgagccatagtaatgatagtttgttcagtgcaaagcgttcagctgtaattagagcatcggatgatttctggccacgagaccctgcatcacacacaattcacatagcatcagtggcgtacaacaccattttccttggtgaattcatgcagcctgattgggatatgtttcacagtgtgcatcccatggctgaataccacggagctgcacgagctgttggaggctgtgctatttacgttagtgacaagcctggacagcacgactttaatcttctgaagaagcttgtacttccagatggttccatattacgcgccaaacttccaggaaggccaactagagactgcttgttttctgatccagcaagagacgggataagtcttttaaaaatctggaatctcaacgatttcaatggagtagtcggtgtattcaactgtcaaggtgctggatggtgtaaggttggcaagaagaatctaatccacgattgtcaaccagggacaataactgggattgttcgtgctaatgatgtcaattacttaccaaggattgctcatgatggatggaccggcgatgccattctgtattctcatcttcatagggaattgatcaatcttcctaaaaatacttcgattccaatcactctaaacgcgagagaatatgaagtctttacagttgttccaatcaatgaaatgtctacaggatcaagatttgctccgattggtcttgtgaatatgttcaattcaggaggagcaatcaaagaggtgaaatatgaaacagagggaaaatgtggactagtttccatgaaggttcgcggatgtggaacgtttggagcttattcatctgggaagcctaaacgaattcatgttgacaacgaagaagtacagtttgattacgacgaatcctctggattgttcaccattaacattacagttcctgatcaagaattatacctttgggatgttaaagttgaaacgtga

SEQ ID NO: 562 - protein, 829 aa, Solanum lycopersicum
  misc_feature (7)..(813): Pfam Name: Raffinose_syn Pfam Description: Raffinose synthase or seed inhibition p
  misc_feature (1)..(829): Ceres Annot ID no. 8457131
  misc_feature (1)..(829): Bit score of 1361.3 for HMM based on sequences of Figure 3
  misc_feature (1)..(829): Functional Homolog Of SEQ ID NO. 504
MTVGAGICVAERKLNVLGQSILSDVDENIIVTQPNGKAFTNGAFLGVNSDRIGSHRVFPIGKLQGLRFMCGFRFKLWWMTQRMGTSGQDIPFETQFLIVEGNDGSNFDQDNQQNSALYVVFLPILEGDFRAVLQGNSNDELEICLESGDPAVQDFEGSHLVYVAAGPDPFDVITNAVKYVLVLSFMVSILEEISLVNCATHCLHITIESSQGQLYGNGENGVLSEKCLEKKEDTFCLAEMQMIVKILHQHRTVERHLQTFCHRDRKKMPDMLNWFGWCTWDAFYTTVTSEGVKQGLESLEKGGIPPKFVLIDDGWQSVSMDPDGIESIADNHANFANRLTHIKENHKFQKNGKEGHRVNDPAMGLRHVVTNIKDQHNLKYVYMWHALAGYWGGVRPGVPGMEHYESKLSFPVSSPGTESQEPDDALSSLIKNGLGLVNPEKVLYFYNELHSYLASAGIDGVKVDVQNILETLGAGHGGRVKLARKYHQALEASIARNFPDNGIISCMSHSNDSLFSAKRSAVIRASDDFWPRDPASHTIHIASVAYNTIFLGEFMQPDWDMFHSVHPMAEYHGAARAVGGCAIYVSDKPGQHDFNLLKKLVLPDGSILRAKLPGRPTRDCLFSDPARDGISLLKIWNLNDFNGVVGVFNCQGAGWCKVGKKNLIHDCQPGTITGIVRANDVNYLPRIAHDGWTGDAILYSHLHRELINLPKNTSIPITLNAREYEVFTVVPINEMSTGSRFAPIGLVNMFNSGGAIKEVKYETEGKCGLVSMKVRGCGTFGAYSSGKPKRIHVDNEEVQFDYDESSGLFTINITVPDQELYLWDVKVET

SEQ ID NO: 563 - DNA, 2298 bp, Sorghum bicolor
  misc_feature (1)..(2298): Ceres Annot ID no. 8735307
  misc_feature (1)..(2298): Encodes the peptide sequence at SEQ ID NO. 564
atgaccatctcctcgtccgtcaagctcgccggaggcacgctgtcggtatgcgggcggacggtgctgtccggggtgccggacgcggtggtggcctcgtcggcggcggcggggggagcggtcgacggggtcttcatcggcgccgacttcgccgagcccgccgcccggcacgtcgtctccctcggggacctgaggggcgtgcggttcatggcgtgcttccggttcaagctctggtggatggcgcagcggatgggggagaaaggcggcgacgtcccgcgcgagacgcagttcctgctcgtcgagtccaagggcgccggcgacggcgccgcggcggcgtacgtcgtgttcctgcccctcgtcgagggcgcgttccgtgccagcctccagggcggcgcgggcgacgcgctggagctctgcgtcgagagcggggacgcggagacgcgcgcggcgtccttcgagcgcgcgctcttcgtgggcgccgcggagtccgaccccttcgcggccatctccggcgccgtcggtgccgccaagtccgcgctcaggacgttccgggtccgcgccgagaagaagctgccgggcatcgtcgactacttcggctggtgcacctgggacgccttctaccaggatgtcacccaggagggcgtcgaggccgggctccgcagcctcatcgccggcggcgcgccgcccaagttcgtcatcatcgacgacggctggcagtccgtcggcaccgacaagtccgccaccgacaccgacaccgacgaacctgccggagaggacaagccgccccgcctgtctcgcctcaccggcatcaaggagaacagcaagttccagaacgtggacgacccggccgccggcatcaagacggtggtgcgcgcggcgaaggaggagtacgggctcaagtacgtctacgtctggcacgccatcaccggctactggggcggcgtccgacccggcgaacccgggacggagcactaccgctccagcatgcagttccccaaggtctcgccgggcgtcatggagaacgagcccggcatgaagaccgacgtgctcaccgtgcagggactcggcctcgtgcacccgcgcgccgtgtaccgcttctacgacgagctccacgcctacctcgccgccgccggtgtcgacggcgtcaaggtagacgtgcagtgcatcctggagacgctcggcgccggccacggcggccgcgtgcagctcaccaggcagtaccaccaggcgctcgacgcctccatcgccaagaacttcccggagaacggcatcatcgcctgcatgagccacaacaccgacgccctttactgctccaagcagacggcggtggtgagggcgtcggatgatttctatccgagggaccccgtgtcgcatacgatccatatcgcctcggtggcgtacaacagcgtgttcctcggcgagttcatgctgccggactgggacatgttccactcgctccaccaggccggcgactaccacggctcggcacgcgcgatcagtggaggcccggtctacgtcagtgatgcccccgggaagcacaacttcgagctgctcaagaagattgtcttgcccgacggctccattctccgcgcgcgtctgccaggccggccgaccaaggattgcctgttcaccgacccggcacgcgacggcgtcagcctgctcaagatatggaacatgaacaagttcaccggcgtgctcggcgtgtacaactgccagggcgcggcgtggagctccgtggagaagaagaacacctttcatcataccggcaccgaggccctgacctgcggtatcaagggcagcgacgtccacctcatctccgaggccgcgacggaccctgaatggaacggcgactgtaccgtgtaccgacatgccgacagcgacctcgccgtcctcccgtacggtgcggcgttgcctgtctctctcaaggtcctggaacatgacatcctcaccgtgtcaccgatcaaggacttggcacctggtttcaggttcgccccgattgggctggtggacatgttcaatagcggcggggcggtggaaggcctgacctaccacctcctcggcggcgcaaagctgctcgacggcggcaacggttctgcttcgggctccgaggctgtcggattggcgtgcatggaggtgaagggctgtggaaggttcggtgcctactcttcagtcaggccaaggaaatgcatgctgggttcagctcagctggagttctcctatgattcttcctcagggctggtggttcttcagctggagaagatgcccaaggagagggttcacaagattgttgtcgagttgtag

SEQ ID NO: 564 - protein, 765 aa, Sorghum bicolor
  misc_feature (7)..(750): Pfam Name: Raffinose_syn Pfam Description: Raffinose synthase or seed inhibition p
  misc_feature (1)..(765): Ceres Annot ID no. 8735307
  misc_feature (1)..(765): Bit score of 1278.5 for HMM based on sequences of Figure 3
  misc_feature (1)..(765): Functional Homolog Of SEQ ID NO. 504
MTISSSVKLAGGTLSVCGRTVLSGVPDAVVASSAAAGGAVDGVFIGADFAEPAARHVVSLGDLRGVRFMACFRFKLWWMAQRMGEKGGDVPRETQFLLVESKGAGDGAAAAYVVFLPLVEGAFRASLQGGAGDALELCVESGDAETRAASFERALFVGAAESDPFAAISGAVGAAKSALRTFRVRAEKKLPGIVDYFGWCTWDAFYQDVTQEGVEAGLRSLIAGGAPPKFVIIDDGWQSVGTDKSATDTDTDEPAGEDKPPRLSRLTGIKENSKFQNVDDPAAGIKTVVRAAKEEYGLKYVYVWHAITGYWGGVRPGEPGTEHYRSSMQFPKVSPGVMENEPGMKTDVLTVQGLGLVHPRAVYRFYDELHAYLAAAGVDGVKVDVQCILETLGAGHGGRVQLTRQYHQALDASIAKNFPENGIIACMSHNTDALYCSKQTAVVRASDDFYPRDPVSHTIHIASVAYNSVFLGEFMLPDWDMFHSLHQAGDYHGSARAISGGPVYVSDAPGKHNFELLKKIVLPDGSILRARLPGRPTKDCLFTDPARDGVSLLKIWNMNKFTGVLGVYNCQGAAWSSVEKKNTFHHTGTEALTCGIKGSDVHLISEAATDPEWNGDCTVYRHADSDLAVLPYGAALPVSLKVLEHDILTVSPIKDLAPGFRFAPIGLVDMFNSGGAVEGLTYHLLGGAKLLDGGNGSASGSEAVGLACMEVKGCGRFGAYSSVRPRKCMLGSAQLEFSYDSSSGLVVLQLEKMPKERVHKIVVEL

SEQ ID NO: 565 - DNA, 2355 bp, Populus balsamifera subsp. trichocarpa
  misc_feature (1)..(2355): Ceres Annot ID no. 1453769
  misc_feature (1)..(2355): Encodes the peptide sequence at SEQ ID NO. 566
atgacgatcaaaccagcggttcgtatttcagacgggaaattgatcgttaaagaccggacaatattgactggtgtgccagacaatgtgatagcaacatccggttcaacttcaggtccggtggagggagtgtttttaggtgcggtgtttgatcaagaaaatagtagacacgtgacttctttgggcgccttacgtgatgtccggttcatggcttgtttccggttcaagttgtggtggatggctcagaaaatgggggatcaagggagagatattcctctagagacacagtttttattagtggaaactaaagatgggtcccaccttgaatcagacggtggagatgaagataatcaggttgtttacactgtttttctgccgttgattgaagggtcatttagggcttgtttgcaggggaatgttagcgatgagcttgaactctgtttggagagtggtgatgcagagaccaaaacgtcgtcgtttactcacactttgttcattcatgccgggaccgatccgtttaggacaataacggaggctgttagagccgttaagttgcatctgaagacttttcgtcaacggcatgagaaaagattgcctggaattattgatcattttggttggtgtacctgggatgccttttatcaagaagtgactcaagaaggggtagaagctgggctacaaagtctagcttctggtggtaccccgccaaaattcgtgatcattgatgatggatggcaatcagttggtggtgacccagaagaggaaaccaatggtcaagatgtgaagaaacaagatcagcaaccgttgcttaggttgaccgggattaaagagaacgcaaagttccaaaagaaagatgatccagcagcggggatcaagagcatagtgaacatagctaaagaaaaatacggtttaaaatatgtgtatgtgtggcatgctattactggttattggggtggggtccgtccaggagttaaggagatggaggaatatgggtcaatgatgaagtatccaatggtgtcaaagggggtggtggagaatgagcccatatggaaaaacgatgcattgacattgcagggattagggttagtgaatccaaaaaatgtgtacaggttttataatgagttgcatagttatttggcagcagctggtatcgatggggttaaggtggatgttcaatgtattttggagacacttggtgctggtttaggaggaagggttgaattgactaggcaatatcatcaagcccttgatgcttctgttgctaggaacttccttgataatggttgcattgcttgcatgagccacaacactgatgccttgtactgctccaaacaaacagcagtggtgagagcatcagatgatttctacccgcgcgatccagtatcacacaccattcatatagcagcagtggcatataacagtgttttcttgggagagttcatgcagcctgattgggacatgttccattctctacatgcagctgcagagtatcatgcttctgctagggctattagtggtggacctatctatgtcagtgatgcacctgggaagcacaactttgagctattaaagaaggtggtacttcccgatgggtctattcttcgagctcgtttgcctggaaggcccacctctgactgcttgttctctgaccctgcccgtgatggagtgagcttattgaaaatatggaacatgaacaagttcacaggggtcctaggtgtctacaattgccaaggagcagcttggagcagcactgaaagaaagaacgctttccaccaaaccacaactgaggccctaacaggcacaattaggggccgtgatgttcacctcgttgctgaagctgccacggaccccaactgggatggcaattgtgctttctattgtcaccggacaggagagctaatcaccctcccttacaatgcagcattgccagtgtcactcaaagtccttgagcatgacatattcactgtaacacccatcaaggttttagcacctgggttcagttttgcacccctagggctaatcaacatgttcaatgcaggtggagccattgaggggctgaagtatgaagtgaaaggtggtgctgaattatcagagcttgatgatggatataggggtgaaagtagtggtgtgactgaagagagggtggggaactatagcgatgaattggtagggaaagtttgcgtagaggttaaagggtgtggcaagtttggtgcttattcatctgctaagccaaggaagtgcattgtggactcaaatgtggttgattttgtgtatgattcgaattctgggttggttggttttaacttggatagcttgcttgaggagggcaaacttcgtattgttgagattgagttatag

SEQ ID NO: 566 - protein, 784 aa, Populus balsamifera subsp. trichocarpa
  misc_feature (7)..(768): Pfam Name: Raffinose_syn Pfam Description: Raffinose synthase or seed inhibition p
  misc_feature (1)..(784): Ceres Annot ID no. 1453769
  misc_feature (1)..(784): Bit score of 1381.7 for HMM based on sequences of Figure 3
  misc_feature (1)..(784): Functional Homolog Of SEQ ID NO. 504
MTIKPAVRISDGKLIVKDRTILTGVPDNVIATSGSTSGPVEGVFLGAVFDQENSRHVTSLGALRDVRFMACFRFKLWWMAQKMGDQGRDIPLETQFLLVETKDGSHLESDGGDEDNQVVYTVFLPLIEGSFRACLQGNVSDELELCLESGDAETKTSSFTHTLFIHAGTDPFRTITEAVRAVKLHLKTFRQRHEKRLPGIIDHFGWCTWDAFYQEVTQEGVEAGLQSLASGGTPPKFVIIDDGWQSVGGDPEEETNGQDVKKQDQQPLLRLTGIKENAKFQKKDDPAAGIKSIVNIAKEKYGLKYVYVWHAITGYWGGVRPGVKEMEEYGSMMKYPMVSKGVVENEPIWKNDALTLQGLGLVNPKNVYRFYNELHSYLAAAGIDGVKVDVQCILETLGAGLGGRVELTRQYHQALDASVARNFLDNGCIACMSHNTDALYCSKQTAVVRASDDFYPRDPVSHTIHIAAVAYNSVFLGEFMQPDWDMFHSLHAAAEYHASARAISGGPIYVSDAPGKHNFELLKKVVLPDGSILRARLPGRPTSDCLFSDPARDGVSLLKIWNMNKFTGVLGVYNCQGAAWSSTERKNAFHQTTTEALTGTIRGRDVHLVAEAATDPNWDGNCAFYCHRTGELITLPYNAALPVSLKVLEHDIFTVTPIKVLAPGFSFAPLGLINMFNAGGAIEGLKYEVKGGAELSELDDGYRGESSGVTEERVGNYSDELVGKVCVEVKGCGKFGAYSSAKPRKCIVDSNVVDFVYDSNSGLVGFNLDSLLEEGKLRIVEIEL

SEQ ID NO: 567 - DNA, 2355 bp, Populus balsamifera subsp. trichocarpa
  misc_feature (1)..(2355): Ceres Annot ID no. 1478531
  misc_feature (1)..(2355): Encodes the peptide sequence at SEQ ID NO. 568
atgacgatcaaaccggcggttcgaatttcggaaagcaaattggtcgttaaagaccggacgatattgactggtgtaccagacaatgttatggcaacatctggttcaagttcaggtccggtcgacggagtgtttctaggtgttgttttcgatcaagaaaatagtagacatgtggtttctttgggtgctctacgtgatgtccggttcatggcttgtttccggtttaagctatggtggatggctcaaaagatgggagatcaagggagagatattcctctagagacacagtttttattggtggaaactaaagacggttcccaccttgaatcagacggtggagatgaagagaatcagattgtatacactgttttcctgccgttgattgaaggatcattcagggcctgtttgcaggggaatgttgacgatgagcttgaactctgtttggaaagtggtgatgcagagactaaaaggacatcgttttctcattctgtgttcattcatgctgggacggatccgtttaggactataacggaggctgttagagccgtcaagttgcatctgaagactttccgtcaacggcacgagaaaaaattgcctggaattgttgattattttggttggtgtacctgggatgccttctatcaagaagttacacaagaaggggtggaagccgggctagaaagtctggcttctggtggtaccccaccaaagtttgtgatcattgatgatggatggcaatcggtcggtggtgacccacaagaggaaagcaatgatcaagatgagaagaaagaaaatcagcaaccgttgcttaggttgactgggattaaagaaaatgcaaagttccaaaagaaagatgatccaacagcggggattaagagcatagtgaatgtagcaaaggaaaaacatgggctaaaatatgtgtatgtgtggcatgctattactggatattggggtggggtccgcccagaagttaaggagatggaggagtatggttcaacgctgaaatatctgatggtgtcaaagggggtggtggagaacgatcccacatggaaaaacgatgccttggcgttgcagggattagggctggtgaatccaaaaaatgtgtacaagttttataacgagttgcatagttatctggcatctgctggcattgatggggttaaggtggatgttcaatgtatattggagacacttggtgctggtttgggtggtagggttcaattgactaggcaataccatcaggcccttgatgcttctgtcgcaaggaacttccctgataacggctgcattgcttgcatgagccataatactgatgctttgtactgctccaaacaaacggcagtggtgagagcatcggatgatttctacccgcatgatccagtatcacacaccatccatatagcagcggtggcgtataacagtgttttcttgggagagttcatgcagcctgattgggacatgttccattctctacatccaactgctgaatatcatgcttctgctagggctattagtggtggacccatctatgttagtgatgcacctgggaagcacaactttgagctactaaagaaattgatccttcctgatgggtcaattcttcgagcccgtttgcctggtaggcctacccgtgactgcttgttctccgacccagcccgcgacggtgttagcttattgaaaatatggaacatgaacaagttcacaggggtcctaggagtctacaattgccaaggagcagcatggaacaacactgaaagaaagaacacgttccaccaaaccaaaaatgaggtactgacaggcgccattaggggtcgtgatgtgcacctcatcgctgaagctgccatggaccccaactgggatggtaattgtgctgtctattgtcatcggactggagaacttatcaccctcccatacaatgcagcgttgccaatgtcactcaaagtccttgagcatgacatatttacagtcacacccatcaaggacttggcacccgggttcagctttgcacccctggggctaatcaacatgttcaatgctggtggagccattgaggggctgaagtatgaagtgaaaggtggtgctgaattattaaatcttgatgatggatataagggtgaaagtagttgtgtgagtgaacagagggtggaaaactatagcgatgaactggtagggaaagttagcatggaggttaaaggatgcggcaagtttggtgcttactcatctgctaagccaaggaagtgcattgtggacgcaaatgtggtcgaatttgtgtacgattcagattctagtttggttagtcttagcttggatagcatgcctgaggagggcaagcttcatgtagttgagattgagttatag

SEQ ID NO: 568 - protein, 784 aa, Populus balsamifera subsp. trichocarpa
  misc_feature (7)..(768): Pfam Name: Raffinose_syn Pfam Description: Raffinose synthase or seed inhibition p
  misc_feature (1)..(784): Ceres Annot ID no. 1478531
  misc_feature (1)..(784): Bit score of 1380.3 for HMM based on sequences of Figure 3
  misc_feature (1)..(784): Functional Homolog Of SEQ ID NO. 504
MTIKPAVRISESKLVVKDRTILTGVPDNVMATSGSSSGPVDGVFLGVVFDQENSRHVVSLGALRDVRFMACFRFKLWWMAQKMGDQGRDIPLETQFLLVETKDGSHLESDGGDEENQIVYTVFLPLIEGSFRACLQGNVDDELELCLESGDAETKRTSFSHSVFIHAGTDPFRTITEAVRAVKLHLKTFRQRHEKKLPGIVDYFGWCTWDAFYQEVTQEGVEAGLESLASGGTPPKFVIIDDGWQSVGGDPQEESNDQDEKKENQQPLLRLTGIKENAKFQKKDDPTAGIKSIVNVAKEKHGLKYVYVWHAITGYWGGVRPEVKEMEEYGSTLKYLMVSKGVVENDPTWKNDALALQGLGLVNPKNVYKFYNELHSYLASAGIDGVKVDVQCILETLGAGLGGRVQLTRQYHQALDASVARNFPDNGCIACMSHNTDALYCSKQTAVVRASDDFYPHDPVSHTIHIAAVAYNSVFLGEFMQPDWDMFHSLHPTAEYHASARAISGGPIYVSDAPGKHNFELLKKLILPDGSILRARLPGRPTRDCLFSDPARDGVSLLKIWNMNKFTGVLGVYNCQGAAWNNTERKNTFHQTKNEVLTGAIRGRDVHLIAEAAMDPNWDGNCAVYCHRTGELITLPYNAALPMSLKVLEHDIFTVTPIKDLAPGFSFAPLGLINMFNAGGAIEGLKYEVKGGAELLNLDDGYKGESSCVSEQRVENYSDELVGKVSMEVKGCGKFGAYSSAKPRKCIVDANVVEFVYDSDSSLVSLSLDSMPEEGKLHVVEIEL

SEQ ID NO: 569 - DNA, 2538 bp, Zea mays
  misc_feature (1)..(2538): Ceres Clone ID no. 1575663
  misc_feature (1)..(2538): Encodes the peptide sequence at SEQ ID NO. 570
gccggccggaccacccgagccagaagcgcgtcgccagctgataactaacccaacccaacccaaataagctcgatcctgctctctgccgacgcggccggattcgaattcgaggacgatcgatgacggtgggcgccggcatcgccgtccaggacggcagcctcctggcgctgggcgccaaggtcctgcgggaggtgcgcggcaacgtgctcgtgacgccggccgccggcgggggcctaaccaacggcgcgttcctcggcgtccggtccgcgcccgccgccagccgcagcatcttccccgtcgggaagctccgggaccagcggttcgtgtgcacgttccggttcaagatgtggtggatgacgcagaggatgggctccgcaggccgcgacatcccctccgagacgcagttcctgctcgtggaagtgtccggcggcggcgagcagcccgccgtcgtgtacaccgtcttcctccccgtgctggagggctcattccgtgccgttcttcaggggaacgccgacgacgagctggagatctgcctggagagcggcgacccggacgtggaatctttccaaggctcccatctggtcttcgttggcgccggatcggacccgttcgaggtcatcacaagttcagtcaaggctgtcgagaggcacttgcagacgttctctcacagggagaagaaaaagatgccagacattctgaactggtttggctggtgcacgtgggacgcgttctacaccaatgtcaccgcccagggagtgaagcaaggattccagagcttggagaaaggcggggtttctcctaggttcgtcataatcgacgacggatggcagtccgtcgccatggaccctgtgggaatcgcttgcctatctgacaactcagccaacttcgcaaacaggctgactcacatcagggagaaccacaagtttcagaaaaatggcagggagggtcacagggaagatgacccagcgaagggcctagcacacgtcgtcaatgagattaaggggaagcatcagctcaagtatgtgtacgtatggcatgccatcaccggatactggggcggagtgaggccgggtgcagctggaatggagcactacggatcaaagatgcagcggcccgtgccatcgccgggggttcagaagaacgagcgctgcgaagccctggacagcatgacggccaacgggctgggcctcgtgaaccttgacagggcgttcagtttctacgacgagctccactcgtacctcgcgtctgccgggatcgacggggtgaaggtggacgtgcagaacgtcctcgagacgctgggcgccggccatggcgggagggtgatgctggcgaggaagtaccagcaggctctggaagcgtccgtcgccaggaacttccccgacaatggcatcatatcgtgcatgagccacagcacggacaacttgtacagctcgaaacggagcgcggtgattagagcctctgacgatttctggccgagagactctgcttcccataccatacacgtcgcgtccgtcgcttataacaccgtctttcttggggagttcatgcagccagactgggacatgttccatagtgttcatcccatggctgagtaccatgctgcggctcgagcggttggtggctgtgccatatatgtcagcgacaagcctgggagccatgacttcaatctgctcaagaagctcgtgcttcccgacggatcgatcctgcgcgcaaagctccccgggaggccaaccagagactgcctcttctctgaccccgcaagggacggcaaaagcgttctcaagatatggaacctgaacgaacactccggcgtcgttggcgccttcaactgccaaggcgccggctggtgccgggtagccaagaagaacctcatccatgaccagcagcccggaacggtgagcggcgtcatccgggcgcaggacgtggagcaccttgcaagggtggctgatcacggctggaacggcgacgtggtcgtgtactcgcacgtgggaggggaggtggtgtacctgccgaagaacgccttgctgcctgtgacgttgagatcgcgcgagtacgaggtgttcaccgtcgtccctctcaagcacctgccaaacggtgcctctttgcggcgatcggccttctcggcatgttcaactccggtggcgcgatgagggagctgagattcggtggtgaggatgccgacgtcgagctcaaagtgcggggctcgggcacggtcggagcttattcctcgacgaagccaacgtgtgtcgccgtcgattctaaggcggttggtttctcctacgatggcacctgtggcctcatcagcttcgagctcggcatccccgaccaagaaatgtacttgtggacggttacagtagggtactgaagttacaattgagaattgagatagattttctaatgcgtcagagaacgccggtggtgtaggtattctgatttatccagtgttgtactttctactgttagttatatatattctgtacacatcccgggattttatgacaaatctagataaggggcggtccttagattttaggagcc

SEQ ID NO: 570 - protein, 676 aa, Zea mays
  misc_feature (7)..(674): Pfam Name: Raffinose_syn Pfam Description: Raffinose synthase or seed inhibition p
  misc_feature (1)..(676): Ceres Clone ID no. 1575663
  misc_feature (1)..(676): Bit score of 1201.4 for HMM based on sequences of Figure 3
  misc_feature (1)..(676): Functional Homolog Of SEQ ID NO. 504
MTVGAGIAVQDGSLLALGAKVLREVRGNVLVTPAAGGGLTNGAFLGVRSAPAASRSIFPVGKLRDQRFVCTFRFKMWWMTQRMGSAGRDIPSETQFLLVEVSGGGEQPAVVYTVFLPVLEGSFRAVLQGNADDELEICLESGDPDVESFQGSHLVFVGAGSDPFEVITSSVKAVERHLQTFSHREKKKMPDILNWFGWCTWDAFYTNVTAQGVKQGFQSLEKGGVSPRFVIIDDGWQSVAMDPVGIACLSDNSANFANRLTHIRENHKFQKNGREGHREDDPAKGLAHVVNEIKGKHQLKYVYVWHAITGYWGGVRPGAAGMEHYGSKMQRPVPSPGVQKNERCEALDSMTANGLGLVNLDRAFSFYDELHSYLASAGIDGVKVDVQNVLETLGAGHGGRVMLARKYQQALEASVARNFPDNGIISCMSHSTDNLYSSKRSAVIRASDDFWPRDSASHTIHVASVAYNTVFLGEFMQPDWDMFHSVHPMAEYHAAARAVGGCAIYVSDKPGSHDFNLLKKLVLPDGSILRAKLPGRPTRDCLFSDPARDGKSVLKIWNLNEHSGVVGAFNCQGAGWCRVAKKNLIHDQQPGTVSGVIRAQDVEHLARVADHGWNGDVVVYSHVGGEVVYLPKNALLPVTLRSREYEVFTVVPLKHLPNGASLRRSAFSACSTPVAR

SEQ ID NO: 571 - protein, 565 aa, Arabidopsis thaliana
  misc_feature (7)..(564): Pfam Name: Raffinose_syn Pfam Description: Raffinose synthase or seed inhibition p
  misc_feature (1)..(565): Public GI ID no. 42572711
  misc_feature (1)..(565): Bit score of 1220.6 for HMM based on sequences of Figure 3
  misc_feature (1)..(565): Functional Homolog Of SEQ ID NO. 504
MTITSNISVQNDNLVVQGKTILTKIPDNIILTPVTGNGFVSGSFIGATFEQSKSLHVFPIGVLEGLRFMCCFRFKLWWMTQRMGSCGKDIPLETQFMLLESKDEVEGNGDDAPTVYTVFLPLLEGQFRAVLQGNEKNEIEICFESGDKAVETSQGTHLVYVHAGTNPFEVIRQSVKAVERHMQTFHHREKKKLPSFLDWFGWCTWDAFYTDVTAEGVDEGLKSLSEGGTPPKFLIIDDGWQQIENKEKDENCVVQEGAQFATRLVGIKENAKFQKSDQKDTQVSGLKSVVDNAKQRHNVKQVYAWHALAGYWGGVKPAASGMEHYDSALAYPVQSPGVLGNQPDIVMDSLAVHGLGLVNPKKVFNFYNELHSYLASCGIDGVKVDVQNIIETLGAGLGGRVSLTRSYQQALEASIARNFTDNGCISCMCHNTDGLYSAKQTAIVRASDDFYPRDPASHTIHIASVAYNSLFLGEFMQPDWDMFHSLHPTAEYHAAARAVGGCAIYVSDKPGNHNFDLLRKLVLPDGSVLRAKLPGRPTRDCLFADPARDGIRCWLVQGNEEEPDP

SEQ ID NO: 572 - protein, 810 aa, Sorghum bicolor
  misc_feature (69)..(791): Pfam Name: Raffinose_syn Pfam Description: Raffinose synthase or seed inhibition p
  misc_feature (1)..(810): Bit score of 1934.6 for HMM based on sequences of Figure 3
  misc_feature (1)..(810): Functional Homolog Of SEQ ID NO. 504
MALTRLLMMASRPPCSLSLSLPSPSYKTSRCCCCHCHRGRRLLRSAMRVGACHDLSTVTPTPRQQSMAAQLERGSLLVGGRELLVRAPPNVTLRPAGEAAAAADSGAAFLGATAAAASSRHVFSVGNLASGWRWLSLFRFKIWWMIPATGAGAAAMPAETQMLLLEYRSEARTERGSLYALMLPVLDGGFRASLQGSPEDELQFCFESGDPDVQTMEAVDAVFINSGDNPFKLLKESIKMVSKIKGTFSHIEDKEIPSNLDWFGWCTWDAFYKAVNPSGIEEGLQSLREGGVPPRFLIIDDGWQETVDEFKEGDEAIREQAVFAHRLSDLKENHKFRGETCKNLEDLIKKIKEKHGVKYIYMWHALLGYWGGVLATSDAMKKYNPKLLYPVQSPGNVANLRDIAMDSLEKFGVGIVDPDKIYEFYNDQHSYLSSVGVDGVKVDVQNVLETLGRGLGGRVAVTQKYQQALEESIAQNFKTNNLICCMSHNSDSIFSALKSAVARASEDFMPREPTLQTLHIASVAFNSLLLGEIFIPDWDMFHSKHESAEFHGAARALSGGGVYVSDKPGVHDFNVLKKLVLPDGSILRARYAGRPTRDCLFTDPVMDGKSLLKIWNLNNFTGVIGVFNCQGAGQWVWPVKETAYVPINVNIIGQLSPSDVESLEEIAGDDWDGETAVYAFGSCSLSRLQKHKSLEVSLSTMACEIYNISPIKIFSEAVWFAPLGLIDMFNSGGALHNVSSVADSSATTVHIRCRGPGWFGAYSATRPELCRVDEHEVEFTHAEDGLLTFYLPLSSSQDNLRHIEIVYRAL

SEQ ID NO: 573 - protein, 768 aa, Zea mays
  misc_feature (21)..(749): Pfam Name: Raffinose_syn Pfam Description: Raffinose synthase or seed inhibition p
  misc_feature (1)..(768): Bit score of 1919.3 for HMM based on sequences of Figure 3
  misc_feature (1)..(768): Functional Homolog Of SEQ ID NO. 504
  misc_feature (47)..(47): Xaa is any aa, unknown, or other
  misc_feature (55)..(55): Xaa is any aa, unknown, or other
MPGACQDLSTITPTPRRQSMAQLQRGSVLVGGRELLVRAPPNVNLRXPPVPASPXGAASGAAFLGARAPAASSRHVFSVGNLASGWRWLSLFRFKIWWMIPATGVGAAAVPAETQMLLLEYRSEAGPAAATERGSLYALVLPVLDGGFRASLQGSPEDELQFCFESGDPDVQTMEAVDAVFVNSGDNPFKLLKESIKMLSKIKGTFSHIEDKEIPSNLDWFGWCTWDAFYKAVNPSGIEEGLQSRREGGVPPRFLIIDDGWQETVDEIKEVDEALREQTVFAQRLADLKENHKFRGETCKNLEDLVKTIKEKHGVKCVYMWHALLGYWGGTLAASEVMKKYNPKLVYPVQSRGNVANLRDIAMDSLEKFGVGIVDPDKIYEFYNDQHSYLSSVGVDGVKVDVQNVLETLGRGFGGRVAVTRKYQQALEESIAQNFKTNNLICCMSHNSDSIFSALKSAVARASEDFMPREPTLQTLHIASVAFNSLLLGEIFIPDWDMFHSKHESAEFHGAARALSGGGVYVSDKPGVHDFSVLKKLVLPDGSILRARYAGRPTRDCLFTDPVMDGKSLMKIWNLNNFTGVIGVFNCQGAGQWVWPVKQTAYVPTNINITGQLSPSDVESLEEIAGDDWNGETAVYAFGSCSLSRLQKHQSLEVSLSTMTCEIYSISPIKIFSEVVQFAPLGLIDMFNSGGALDNISSVADSSATTVHIRCRGPGRFGAYSDTRPELCRVDEHEVEFTLAEDGLLTFYLPPSSSQDNLRHVEIVYKAS

SEQ ID NO: 574 - protein, 738 aa, Oryza sativa
  misc_feature (2)..(719): Pfam Name: Raffinose_syn Pfam Description: Raffinose synthase or seed inhibition p
  misc_feature (1)..(738): Bit score of 1891.4 for HMM based on sequences of Figure 3
  misc_feature (1)..(738): Functional Homolog Of SEQ ID NO. 504
MARLERGSLVVGGRELLERAPPSVALRRPAVVASPGGAAFLGATAPAPSSRHVFSLGTLASGWKWLSLFRFKIWWMIPTVGEDAAGVPAETQMLLLESRSEAGAALYALMLPVLDGGFRASLQGSPENELQFCFESGDPEVQTLEAVDAVFINSGDNPFKLMKESIKMLSKIKGTFSHIEDKEIPANLDWFGWCTWDAFYKSVNPVGIEEGLKSLCEGGAPPRFLIIDDGWQETVNGFKEVDEAFIEQTVFAERLIDLTENDKFRGETCKNLGDHVKKIKEHYGVKYVYIWHALHGYWGGVLTTPDAMKKYNPQLVYPVQSPGNVANLRDIAMDSLEKFGVGIIDPAMIYDFYNDQHSYLSSVGVDGVKVDVQNVMETLGKGFGGRVALTQKYQQALEESIARNFKGNNLICCMSHNTDSIFSSLKSAVARASEDFMPREPTMQTLHIATVAFNSLLLGEIFIPDWDMFHSKHESAEFHGAARALSGGGVYVSDKPGMHDFSVLKKLVLPDGLILRTKHAGRPTRDCLFNDPVMDGKSLLKIWNLNKFSGVIGVFNCQGAGNWTYPVKENAHVPTTVCITGDLSPSDVELLEEIAGDNWNGETAVFAFNSCSLSRLQKHQTMEVSLSTMTCKIYTIALIKVFGGFVQFAPLGLVNMYNSGGALENVTSTGDCSEITIQIQCRGPGRFGAYSATRPEICSVDEHEVEFKHTDDGFLAFDLSHGSSQDNLRNIEILYRAS

SEQ ID NO: 575 - protein, 733 aa, Oryza sativa
  misc_feature (2)..(714): Pfam Name: Raffinose_syn Pfam Description: Raffinose synthase or seed inhibition p
  misc_feature (1)..(733): Bit score of 1714.8 for HMM based on sequences of Figure 3
  misc_feature (1)..(733): Functional Homolog Of SEQ ID NO. 504
MARLERGSLVVGGRELLERAPPSVALRRPAVVASPGGAAFLGATAQAPSSRQRVLPRHPRQVEPRPPEQRLRGWKWLSLFRFKIWWMIPTVGEDAAGVPAETQMLLLESRSEAGAALYALMLPVLDGGFRASLQGSPENELQFCFESGDPEVQTLEAVDAVFINSGDNPFKLMKESIKMLSKIKGTFSHIEDKEIPANLDWFGWCTWDAFYKSVNPVGIEEGLKSLCEGGAPPRFLIIDDGWQETVNGFKEVDEAFIEQTVFAERLIDLTENDKFRGETCKNLGDHVKKIKEHYGVKYVYIWHALHGYWGGVLTTPDAMKKYNPQLVYPVQSPGNVANLRDIAMDSLEKFGVGIIDPAMIYDFYNDQHSYLSSVGVDGVKVDVQNVMETLGKGFGGRVALTQKYQQALEESIARNFKGNNLICCMSHNTDSIFSSLKSAVARASEDFMPREPTMQTLHIATVAFNSLLLGEIFIPDWDMFHSKHESAEFHGAARALSGGGVYVSDKPGMHDFSVLKKLVLPDGLILRTKHAGRPTRDCLFNDPVMGWQKGAGNWTYPVKENAHVPTTVCITGDLSPSDVELLEEIAGDDWNGETAVFAFNSSTPSGSLSRLQKHQTMEVSLSTMTCKIYTIALIKVFGGFVQFAPLGLVNMYNSGGALENVTSTGDCSEITIQIQCRGPGRFGAYSATRPEICSVDEHEVEFKHTDDGFLAFDLSHGSSQDNLRNIEILYRAS

SEQ ID NO: 576 - protein, 799 aa, Oryza sativa
  misc_feature (58)..(780): Pfam Name: Raffinose_syn Pfam Description: Raffinose synthase or seed inhibition p
  misc_feature (1)..(799): Bit score of 1673.1 for HMM based on sequences of Figure 3
  misc_feature (1)..(799): Functional Homolog Of SEQ ID NO. 504
  misc_feature (792)..(792): Xaa is any aa, unknown, or other
MAMTGTAPWRSPLRAPPPTPSRGNNSRPRGLVPAQCRPWPRPSLSSAAVACPRSEEMARLERGSLVVGGRELLERAPPSVALRRPAVVASPGGAAFLGATAPAPSSRHVFSLGTLASGWKWLSLFRFKIWWMIPTVGEDAAGVPAETQMLLLESRSEAGAALYALMLPVLDGGFRASLQGSPENELQFCFESGRFILDLLDSEVFELKRTANFGISVGISEEYSGGLFLGDPEVQTLEAVDAVFINSGDNPFKLMKESIKMLSKIKGTFSHIEDKEIPANLDWFGWCTWDAFYKSVNPVGIEEGLKRFAERLIDLTENDKFRGETCKNLGDHVKKIKEHYGVKYVYIWHALHGYWGGVLTTPDAMKKYNPQLVYPVQSPGNVANLRDIAMDSLEKFGVGIIDPAMIYDFYNDQHSYLSSVGVDGVKVDVQNVMETLGKGFGGRVALTQKYQQALEESIARNFKGNNLICCMSHNTDSIFSSLKSAVARASEDFMPREPTMQTLHIATVAFNSLLLGEIFIPDWDMFHSKHESAEFHGAARALSGGGVYVSDKPGMHDFSVLKKLVLPDGLILRTKHAGRPTRDCLFNDPVMDGKSLLKIWNLNKFSGVIGVFNCQGAGNWTYPVKENAHVPTTVCITGDLSPSDVELLEEIAGDDWNGETAVFAFNSSTPSGSLSRLQKHQTMEVSLSTMTCKIYTIARIKVFGGFVQFAPLGLVNMYNSGGALENVTSTGDCSEITIQIQCRGPGRFGAYSATRPEICSVDEHEVEFKHTDDGFLAFDLSHGSSQDNLRNXEILYRAS

SEQ ID NO: 577 - protein, 663 aa, Oryza sativa
  misc_feature (1)..(644): Pfam Name: Raffinose_syn Pfam Description: Raffinose synthase or seed inhibition p
  misc_feature (1)..(663): Bit score of 1638.0 for HMM based on sequences of Figure 3
  misc_feature (1)..(663): Functional Homolog Of SEQ ID NO. 504
MIPTVGEDAAGVPAETQMLLLESRSEAGAALYALMLPVLDGGFRASLQGSPENELQFCFESGDPEVQTLEAVDAVFINSGDNPFKLMKESIKMLSKIKGTFSHIEDKEIPANLDWFGWCTWDAFYKSVNPVGIEEGLKSLCEGGAPPRFLIIDDGWQETVNGFKEVDEAFIEQTVFAERLIDLTENDKFRGETCKNLGDHVKKIKEHYGVKYVYIWHALHGYWGGVLTTPDAMKKYNPQLVYPVQSPGNVANLRDIAMDSLEKFGVGIIDPAMIYDFYNDQHSYLSSVGVDGVKVDVQNVMETLGKGFGGRVALTQKYQQALEESIARNFKGNNLICCMSHNTDSIFSSLKSAVARASEDFMPREPTMQTLHIATVAFNSLLLGEIFIPDWDMFHSKHESAEFHGAARALSGGGVYVSDKPGMHDFSVLKKLVLPDGLILRTKHAGRPTRDCLFNDPVMDGKSLLKIWNLNKFSGVIGVFNCQGAGNWTYPVKENAHVPTTVCITGDLSPSDVELLEEIAGDDWNGETAVFAFNSCSLSRLQKHQTMEVSLSTMTCKIYTIALIKVFGGFVQFAPLGLVNMYNSGGALENVTSTGDCSEITIQIQCRGPGRFGAYSATRPEICSVDEHEVEFKHTDDGFLAFDLSHGSSQDNLRNIEILYRAS

SEQ ID NO: 578 - protein, 728 aa, Oryza sativa
  misc_feature (2)..(709): Pfam Name: Raffinose_syn Pfam Description: Raffinose synthase or seed inhibition p
  misc_feature (1)..(728): Bit score of 1601.2 for HMM based on sequences of Figure 3
  misc_feature (1)..(728): Functional Homolog Of SEQ ID NO. 504
MARLERGSLVVGGRELLERAPPSVALRRPAVVASPGGAAFLGATAPAPSSRHVFSLGTLASGWKWLSLFRFKIWWMIPTVGEDAAGVPAETQMLLLESRSEAGAALYALMLPVLDGGFRASLQGSPENELQFCFESGRFILDLLDSEVFELKRTANFGISVGISEEYSGGLFLGDPEVQTLEAVDAVFINSGDNPFKLMRNQSSNIPANLDWFGWCTWDAFYKSVNPVGIEEGLKRFAERLIDLTENDKFRGETCKNIGDHVKKIKEHYGVKYVYIWHALHGYWGGVLTTPDAMKKYNPQLVYPVQSPGNVANLRDIAMDSLEKFGVGIIDPAMIYDFYNDQHSYLSSVGVDGVKVDVQNVMETLGKGFGGRVALTQKYQQALEESIARNFKGNNLICCMSHNTDSIFSSLKSAVARASEDFMPREPTMQTLHIATVAFNSLLLGEIFIPDWDMFHSKHESAEFHGAARALSGGGVYVSDKPGMHDFSVLKKLVLPDGLILRAKHAGRPTRDCLFNDPVMDGKSLLKIWNLNKFSGVIGVFNCQGAGNWTYPVKENAHVPTTVCITGDLSPSDVELLEEIAGDDWNGETAVFAFNSSTPSGSLSRLQKHQIMEVSLSTMTCEIYTIALIKVFGGFVQFAPLGLVNMYNSGGALENVTSTGDCSEITIQIQCRGPGRFGAYSATRPEICSVDEHEVEFKHTDDGFLAFDLSHGSSQDNLRNIEILYRAS

SEQ ID NO: 579 - DNA, 1008 bp, Panicum virgatum
  misc_feature (1)..(1008): Ceres Clone ID no. 1724480
  misc_feature (1)..(1008): Encodes the peptide sequence at SEQ ID NO. 580
acccaggtccacccagcacatcacctgcccctccccccaagccaaacgcgagtacctcgcccgtgatctccccgatctccggcgatggccgcgcggcggcccggatcccccgcctccaggtggctgcgcccatccgcgctgcttctccttgtcgccttcgctctcctctcggccccaaggccggcgcgcgccctcctgttcgacctcgagtccggccacaccaagtgcatctccgacgagatcaagatcaactccatggccgtcgacaagtaccacgtcgtcgggcccgaccccaacttccccgacgcccagctccccgaatcgcatcgcatctccctcagggtgacgtcgccgtacgggaacagcatgcactacgcggagaacgtgcagtcagggcacttcgccttcacggcgacggaggccggcgactacctagcctgcttctgggcgcccgaccacaagccgccggtcaccatcggcttcgagtttgactggaggagcggcgtctcggccaaggactggcccagcgttgccaagaagggcaaggtcgatatgatggaattggagctgaagaagctggaggaaaccataaaaaatatacatgaagaaatgttctatctccgtgaaagggaggaggaaatgcaggacctgaacaggcgaacaaactcgaggatggcttggcttgggttcctctcactcggcatctgcttatcagtggcaggcttgcagctgtggcacctgaagactttcttcgagagaaagaagctgctgtagttcccccaattattcacgatagcacacagcactagagcggacaggtgtaactttttgtgtgtgaacggttaatccatgttacagaaacgtgaaccccatgcaggaaacggtgtttgtcatacttgagaattgtgcttcaatgtgatttagtctgtccagttgaaattaaaaaaaatgttgtaagaaaaatctcaaatgccttcaagtctataattcatgctgtaatttcggggc

SEQ ID NO: 580 - protein, 229 aa, Panicum virgatum
  misc_feature (36)..(224): Pfam Name: EMP24_GP25L Pfam Description: emp24/gp25L/p24 family/GOLD
  misc_feature (1)..(229): Ceres Clone ID no. 1724480
  misc_feature (1)..(229): Bit score of 585.3 for HMM based on sequences of Figure 12
  misc_feature (1)..(229): in Figure 12
MAARRPGSPASRWLRPSALLLLVAFALLSAPRPARALLFDLESGHTKCISDEIKINSMAVDKYHVVGPDPNFPDAQLPESHRISLRVTSPYGNSMHYAENVQSGHFAFTATEAGDYLACFWAPDHKPPVTIGFEFDWRSGVSAKDWPSVAKKGKVDMMELELKKLEETIKNIHEEMFYLREREEEMQDLNRRTNSRMAWLGFLSLGICLSVAGLQLWHLKTFFERKKLL

SEQ ID NO: 581 - DNA, 1036 bp, Zea mays
  misc_feature (1)..(1036): Ceres Clone ID no. 100919106
  misc_feature (1)..(1036): Encodes the peptide sequence at SEQ ID NO. 582
gcgaactcccgtgccgtgacctcccgatctcaggcgatggccgcgcggcgcctcggatcccccgcctctaggtggctgcgcccgtccgcgctgctcctcctggtcgcttccgctctcctctcggccccgtcgccggcccgcgcgctgcggttcgacctcgagtccggccacaccaagtgcatctccgacgagatcaaggttaacgccatggccgtcggcaagtaccacatcgtcagccccgaccccaacttccccgatgcccagctccccgaatcgcaccgcatctccctcagggtgacgtcgccgtacgggaacagcatgcactacgcggagaacgtgcagtcgggccacttcgccttcacggcggcggaggccggcgactacctggcctgcttctgggcgcccgaccataagccaccggtcaccatcgggttcgagttcgactggaggagcggcgtctccgccaaggactatcccagcgtcgccaagaagggcaaggtcgatatgatggaattggagctgaagaagctagaggaaactataaaaaatatacatgaagagatgttttatctgcgtgaaagggaagaggaaatgcaggacctgaacaggcgaacaaactcaaggatggcttggttagggttcctctcccttggcgtctgcttatcggtggcaggtttgcagctgtggcacctgaagaccttctttgagaggaagaagttgctgtagttgccccacggtatatttttgggtgaactgtcagatgtgttacagagcttggaatcccatgtagcaaacgctatgccagatactagagaaatatgcttcacaatgcttggaatcccatgtagcaaacgctatgccagatactagagaaatatacttcactatgcttggaatcccatgtagcaaacgctatgccagatactagagaaatatgcttcactatgctttagcctgtccagtgaacctctaaggaacttcaaagagaaactaaattgtcttcattttagctcgtgttgtaatttggacatctgga

SEQ ID NO: 582 - protein, 229 aa, Zea mays
  misc_feature (36)..(224): Pfam Name: EMP24_GP25L Pfam Description: emp24/gp25L/p24 family/GOLD
  misc_feature (1)..(229): Ceres Clone ID no. 100919106
  misc_feature (1)..(229): Bit score of 589.0 for HMM based on sequences of Figure 12
  misc_feature (1)..(229): Functional Homolog Of SEQ ID NO. 580
  misc_feature (1)..(229): in Figure 12
MAARRLGSPASRWLRPSALLLLVASALLSAPSPARALRFDLESGHTKCISDEIKVNAMAVGKYHIVSPDPNFPDAQLPESHRISLRVTSPYGNSMHYAENVQSGHFAFTAAEAGDYLACFWAPDHKPPVTIGFEFDWRSGVSAKDYPSVAKKGKVDMMELELKKLEETIKNIHEEMFYLREREEEMQDLNRRTNSRMAWLGFLSLGVCLSVAGLQLWHLKTFFERKKLL

SEQ ID NO: 583 - DNA, 690 bp, Sorghum bicolor
  misc_feature (1)..(690): Ceres Annot ID no. 8656883
  misc_feature (1)..(690): Encodes the peptide sequence at SEQ ID NO. 584
atggccgcgcggcgtctcggatccaccgcctccaggtggctgcgcccgtccgcgctgcttctcctggtcgcctccgctctcctcttggccccgtcgccggccagggccctccggttcgacctcgagtccggccacaccaagtgcatctccgacgagatcaaggtcaacgccatggccgtcggcaagtaccacatcgtcgggcccgaccccaacttccccgacgcccagctccccgaatcgcaccgcatctccctcagggtgacgtcgccgtacgggaacagcatgcactacgcggagaacgtgcagtcgggccacttcgccttcaccgcggcggaggccggcgactacctggcctgcttctgggcgcccgaccacaagcctccggtcaccatcgggttcgagttcgactggaggagcggcgtctccgccaaggactatcccagcgtcgccaagaagggcaaggtcgatatgatggaattggagctgaagaagctagaggaaactattagaaatatacatgaagagatgttttatctgcgtgaaagggaagaggaaatgcaggacctgaacaggcgaacaaactcaaggatggcttggttagggttcctctcccttggcatctgcttatcagtggcaggtttgcagctgtggcacctgaagaccttctttgagaggaagaagttgctgtag

SEQ ID NO: 584 - protein, 229 aa, Sorghum bicolor
  misc_feature (36)..(224): Pfam Name: EMP24_GP25L Pfam Description: emp24/gp25L/p24 family/GOLD
  misc_feature (1)..(229): Ceres Annot ID no. 8656883
  misc_feature (1)..(229): Bit score of 589.1 for HMM based on sequences of Figure 12
  misc_feature (1)..(229): Functional Homolog Of SEQ ID NO. 580
  misc_feature (1)..(229): in Figure 12
MAARRLGSTASRWLRPSALLLLVASALLLAPSPARALRFDLESGHTKCISDEIKVNAMAVGKYHIVGPDPNFPDAQLPESHRISLRVTSPYGNSMHYAENVQSGHFAFTAAEAGDYLACFWAPDHKPPVTIGFEFDWRSGVSAKDYPSVAKKGKVDMMELELKKLEETIRNIHEEMFYLREREEEMQDLNRRTNSRMAWLGFLSLGICLSVAGLQLWHLKTFFERKKLL

SEQ ID NO: 585 - protein, 230 aa, Oryza sativa subsp. japonica
  misc_feature (37)..(225): Pfam Name: EMP24_GP25L Pfam Description: emp24/gp25L/p24 family/GOLD
  misc_feature (1)..(230): Public GI ID no. 115473539
  misc_feature (1)..(230): Bit score of 581.1 for HMM based on sequences of Figure 12
  misc_feature (1)..(230): Functional Homolog Of SEQ ID NO. 580
  misc_feature (1)..(230): in Figure 12
MAARRPGSPAPRWAPWPLLAAAAVLLLLSAAPRTARALRFDLESGHTKCISDEIKVNSMVVGKYHVVGPDPNFPDNPLPDSHRISLRVTSPYGNSVHYAENVPSGNFAFTATEAGDYLACFWAPDHKPPVSIGFEFDWRSGVAAKDWSNVAKKGQVDVMEMELKKLEETIKSIHEEMFYLREREEEMQNLNKQTNSRMAWLGFLSLGICLSVAGLQLWHLKTFFERKKLL

SEQ ID NO: 586 - DNA, 1057 bp, Triticum aestivum
  misc_feature (1)..(1057): Ceres Clone ID no. 632946
  misc_feature (1)..(1057): Encodes the peptide sequence at SEQ ID NO. 587
  misc_feature (1039)..(1039): n is a, c, t, g, unknown, or other
atcccatcccagtcagccaaacgcccaacaccacctcgtgacttcgtccgcagaccttccctcgcgcttcgactcccactccgatctccggccatggccgcggcgcgccccggatcccctgcccccagacggctgcccccctccacgctcctcctcctggccgccgtcctcctcgcggcctcgccgccggcgcgcgccctccggttcgacctcgagtccggccacaccaagtgcatctccgacgagatcaaggtcgactctatggccgtcggcaagtacagcgtggtcgcccccgaccccagctaccccgacgcacagctccccgagtcgcaccgcgtctccctcagggtgacgtcgccgtacgggaacagcatgcactactccgagaacgtgcagtcggggcacttcgccttcacggcggtggaggccggggactacctggcctgcttctgggcgcctgaccacaagccacccgtcaccgtcaccttcgagttcgactggaagagcggcgtcacggccaaggactggtccaacgtcgccaagaagggcaaggtcgatatgatggaactagagctgaagaagctagaggataccatcaaatctattcacgaggaaatgttttatctacgtgaaagggaggagcaaatgcagaacatcaacaggcagacgaactcgaggatggggtggctgagtttcctctcacttggcatctgcttatccgtggcagggctgcagctgtggcatctgaagacctttttcgagagaaagaagttgctgtagtttcccccatgatcacaaacaaatcgttgcgaattagggtatattgtttctgccagctattaacctatgtttccgagcgaatactcgaaccatcagtaagaaagaaaccgtcgatcatcatacttgtgaaatgcctttctgtgccctagcttctctccaatcaaatacagttgtaaaatgttctttttttcttgaacaggggtgaaatgtttctgttgatggtttcaaaaaaaaaaaaaaaagaaaaaagaatgaattnacaaatgctgagaagcat

SEQ ID NO: 587 - protein, 228 aa, Triticum aestivum
  misc_feature (35)..(223): Pfam Name: EMP24_GP25L Pfam Description: emp24/gp25L/p24 family/GOLD
  misc_feature (1)..(228): Ceres Clone ID no. 632946
  misc_feature (1)..(228): Bit score of 584.3 for HMM based on sequences of Figure 12
  misc_feature (1)..(228): Functional Homolog Of SEQ ID NO. 580
  misc_feature (1)..(228): in Figure 12
MAAARPGSPAPRRLPPSTLLLLAAVLLAASPPARALRFDLESGHTKCISDEIKVDSMAVGKYSVVAPDPSYPDAQLPESHRVSLRVTSPYGNSMHYSENVQSGHFAFTAVEAGDYLACFWAPDHKPPVTVTFEFDWKSGVTAKDWSNVAKKGKVDMMELELKKLEDTIKSIHEEMFYLREREEQMQNINRQTNSRMGWLSFLSLGICLSVAGLQLWHLKTFFERKKLL

SEQ ID NO: 588 - DNA, 651 bp, Populus balsamifera subsp. trichocarpa
  misc_feature (1)..(651): Ceres Annot ID no. 1511794
  misc_feature (1)..(651): Encodes the peptide sequence at SEQ ID NO. 589
atgattaccccaagactcaacctttatctccttgtaataatgactgtaattgggcttttatcatctccatcaaaatcactccgtttcgagctagagtcaggacacacgaaatgcatatcagaagacatcaaaagcaattctatgactgttggaaagtacagcattgttaacccccatgatagccagcccttgcccgaatcacataaactcactgtcagggtgacatcgagttacgggaatagttatcattattcagagcgtgtggaatcagggcagtttgctttcacggcggcggaagcaggggattacatggcgtgtttttgggcggcggatcataagccaactgtgactttgtctgttgattttgattggaagactggtgtggctgctaaggattggtctaatgttgccaagaaaggctctgtggatgttatggaaatggagctgaagaaaatgtatgacacagtcatttccattcaagaggaaatgaattatctccgtgaaagagaagacgaaatgcaagatctgaacacatctactaatgtaaagatggcctggttgagttttctttcgattattgtatgtttatcagtggcgggcttgcaagtgtggcacttgaagacctttttccagaaaaagaagctcatttaa

SEQ ID NO: 589 - protein, 216 aa, Populus balsamifera subsp. trichocarpa
  misc_feature (26)..(211): Pfam Name: EMP24_GP25L Pfam Description: emp24/gp25L/p24 family/GOLD
  misc_feature (1)..(216): Ceres Annot ID no. 1511794
  misc_feature (1)..(216): Bit score of 564.1 for HMM based on sequences of Figure 12
  misc_feature (1)..(216): Functional Homolog Of SEQ ID NO. 580
  misc_feature (1)..(216): in Figure 12
MITPRLNLYLLVIMTVIGLLSSPSKSLRFELESGHTKCISEDIKSNSMTVGKYSIVNPHDSQPLPESHKLTVRVTSSYGNSYHYSERVESGQFAFTAAEAGDYMACFWAADHKPTVTLSVDFDWKTGVAAKDWSNVAKKGSVDVMEMELKKMYDTVISIQEEMNYLREREDEMQDLNTSTNVKMAWLSFLSIIVCLSVAGLQVWHLKTFFQKKKLI

SEQ ID NO: 590 - DNA, 1019 bp, Glycine max
  misc_feature (1)..(1019): Ceres Clone ID no. 661231
  misc_feature (1)..(1019): Encodes the peptide sequence at SEQ ID NO. 591
ctcctcgctgttctcttcaccagagtggttggcattggcaccttgtttggttgcacacttcaattaccttaccattattaaattctcatcatctctctcagctaaatcttcttctccaccatctcttcgcccataacctaattagtgctcaatcacaaaacatcaatttctctatgatcatgatgatgatgatgggttcaaacacaaaaccccttgtgcacctttctcttctaattttggttctcttttcttcttcaaccgaatccctcagattcgaactccaatctgggcacaccaaatgcatctccgaggacatcaagagcaattccatgaccgtgggcaagtaccaaattgttaactccaacgagggtcagcctcttcccgattcccacagagtcaccgtcagggtgacttcgtcttatgggaacaactatcactacggggatcgcgttcagacggggcattttgcgtttgcggcagtggaggctggagattacatgacttgcttttgggctgtggatcacaaccctgtggaaacgttgactgtggattttgattggaaaacgggtgttgcagccaaggattggtctaatgttgctaaaaaaggccaagttgatgtaatggagctagagctaaagaagttgcaggatactgtttcctccattcatgaggagatgttttatcttcgtgaaagagaagaagaaatgcaggaactcaacagaacaaccaacagcagaatgttctggttgagtttgctttcgctctttgtctgtttatccgtagcagggatgcaactatggcacttgaagaccttcttcgagaaaaagaaacttatttaaaattttgtgatagtttttttacatttttcttatgtgctcttgtaacatataccagcattaatttatccaaaggatacgcataacggtagtcagtataatctcagaatatttcctttgttaaacgcaaatcagagttatggcaacacgagtttcagaggaaatgttggcgttcttcagttc

SEQ ID NO: 591 - protein, 221 aa, Glycine max
  misc_feature (31)..(216): Pfam Name: EMP24_GP25L Pfam Description: emp24/gp25L/p24 family/GOLD
  misc_feature (1)..(221): Ceres Clone ID no. 661231
  misc_feature (1)..(221): Bit score of 572.0 for HMM based on sequences of Figure 12
  misc_feature (1)..(221): Functional Homolog Of SEQ ID NO. 580
  misc_feature (1)..(221): in Figure 12
MIMMMMMGSNTKPLVHLSLLILVLFSSSTESLRFELQSGHTKCISEDIKSNSMTVGKYQIVNSNEGQPLPDSHRVTVRVTSSYGNNYHYGDRVQTGHFAFAAVEAGDYMTCFWAVDHNPVETLTVDFDWKTGVAAKDWSNVAKKGQVDVMELELKKLQDTVSSIHEEMFYLREREEEMQELNRTTNSRMFWLSLLSLFVCLSVAGMQLWHLKTFFEKKKLI

SEQ ID NO: 592 - protein, 210 aa, Vitis vinifera
  misc_feature (20)..(205): Pfam Name: EMP24_GP25L Pfam Description: emp24/gp25L/p24 family/GOLD
  misc_feature (1)..(210): Public GI ID no. 225452883
  misc_feature (1)..(210): Bit score of 547.6 for HMM based on sequences of Figure 12
  misc_feature (1)..(210): Functional Homolog Of SEQ ID NO. 580
  misc_feature (1)..(210): in Figure 12
MSRFKTLIVIVGLMCTAADSMRFDLTSGGTKCISEDIKTNAMSVGKYSVINPNEGFPLPDTHKITAQVSSPYGNNYHTGDHIESGNFAFTAAEEGDYTACFWAPQHKPPLTVTIDFDWRTGVAAKDWSKVAKKGQVEVMELELKKLYDTVTSIHEEMFYLREREEEMQELNRATNSKMATFSFLSLLVCLSVAGLQLWHLKTFFERKKLL

SEQ ID NO: 593 - DNA, 868 bp, Arabidopsis thaliana
  misc_feature (1)..(868): Ceres Annot ID no. 865775
  misc_feature (1)..(868): Encodes the peptide sequence at SEQ ID NO. 594
cttcgtcttccatctctctaccaactccacgatcaacgaaaccaaagatctctcttcaaagcttccaccatgtttctccgatcactcaatctctgtacaatactactcttcctagcgatttcatcacaagtttctcaatctctccacttcgaattgcaatctggtcgaacaaaatgtatatcggaagacataaaaagcaattcaatgaccgtcgggaagtacaccgtcgttaaccctaacgaagctcatccttctcctcaatctcacaagatctccatcagagtgacatcgagttacgggaacacgtatcatcacgcggaagatgtagaatcgggacaattcgcgttcacggcggtggagtctggagattacatggcttgttacacagctgttgatcataaacctgaggttacattgagtattgatttcgattggagaactggtgttcaatctaaaagctggagtagtgttgctaagaagagccaagtcgaagttatggagtttgatgtaaaaagacttattgaaaccgtcaattcgattcatgaagagatgttttatctcagagaaagggaagaagagatgcagaatctgaaccgggctactaactcgaaaatggcgtggttgagtttcctctctcttttcgtatgcttaggagtcgcgggaatgcagtttgtgcatttgaagacgtttttcgagaagaagaaagtcatctaagatggttagatgaaacaaatcccactcttttcttttcccaactcaaaggagtcttctattcctccatgagttttgtacatttagatctttacttttgagtatgtactctcggaactggaaattaaatgaatatgaaagtattgcccctttttgc

SEQ ID NO: 594 - protein, 214 aa, Arabidopsis thaliana
  misc_feature (24)..(209): Pfam Name: EMP24_GP25L Pfam Description: emp24/gp25L/p24 family/GOLD
  misc_feature (1)..(214): Ceres Annot ID no. 865775
  misc_feature (1)..(214): Bit score of 539.5 for HMM based on sequences of Figure 12
  misc_feature (1)..(214): Functional Homolog Of SEQ ID NO. 580
  misc_feature (1)..(214): in Figure 12
MFLRSLNLCTILLFLAISSQVSQSLHFELQSGRTKCISEDIKSNSMTVGKYTVVNPNEAHPSPQSHKISIRVTSSYGNTYHHAEDVESGQFAFTAVESGDYMACYTAVDHKPEVTLSIDFDWRTGVQSKSWSSVAKKSQVEVMEFDVKRLIETVNSIHEEMFYLREREEEMQNLNRATNSKMAWLSFLSLFVCLGVAGMQFVHLKTFFEKKKVI

SEQ ID NO: 595 - protein, 228 aa, Picea sitchensis
  misc_feature (29)..(223): Pfam Name: EMP24_GP25L Pfam Description: emp24/gp25L/p24 family/GOLD
  misc_feature (1)..(228): Public GI ID no. 116781949
  misc_feature (1)..(228): Bit score of 532.0 for HMM based on sequences of Figure 12
  misc_feature (1)..(228): Functional Homolog Of SEQ ID NO. 580
  misc_feature (1)..(228): in Figure 12
MGSLRMYQMERFRAFLLVFLCLGLCQVQCIRFELPSGQTKCIAEEIQNNVMVLGNYHVVAPGSDEHHYGTGSAQPVADDHKITVRVTSPYGNSLHYADKVESGQFAFTTTESGDYMACFWILPSQPPITASVELEWKTGVFAKDWTKIAKRDKIDGMELELRKLEEYVTSIHDEMIYLRAREEEMQNLNASTNSKMAWFGLMSFLVCLSVAAWQLWHLKSFFERKKLL

SEQ ID NO: 596 - protein, 212 aa, Medicago truncatula
  misc_feature (22)..(207): Pfam Name: EMP24_GP25L Pfam Description: emp24/gp25L/p24 family/GOLD
  misc_feature (1)..(212): Public GI ID no. 124360246
  misc_feature (1)..(212): Bit score of 532.7 for HMM based on sequences of Figure 12
  misc_feature (1)..(212): Functional Homolog Of SEQ ID NO. 580
  misc_feature (1)..(212): in Figure 12
MLNSILLLIAIVPALMCNVVNSMRFDLKSGNPKCIVEEIMSNAMTVGNYSVVNPNEGYPIPDSHKLTVRLRSPYGNKHHFGDRVASGNFAFTTAEAGDYTACFSVPDQKPTITVTIDFEWRTGVAAKDWYKIAKKDQIDVMESELQRLYDTVLFIHDEMFYLRGREEEMQDLNRETDRRMFTFIFCSIIICLSVAGMQLWHLKIFFERKKLL

SEQ ID NO: 597 - DNA, 921 bp, Zea mays
  misc_feature (1)..(921): Ceres Clone ID no. 241236
  misc_feature (1)..(921): Encodes the peptide sequence at SEQ ID NO. 598
gtgtcatcgccttcccctccccacaagccaaacgcgaataccacccccgtgacttcccgatctccggcgatggccgcgcggcgcctcggatcccccgcatctaggtggctgcgcccgtctgcgctgctcctcctggtcgcctctgctctcctctcggccccgtcgccggcccgggccctccggttcgacctcgagtccggccacaccaagtgcgtctccgacgagatcaaggtcaacgccatggccgtcggaaagtaccacatcgtcgggcccgaccccaactcacccgacgcccagctccccgaatcgcaccgcatctccctcagggtgacgtcgccgtacgggaacagcatgcactacgcggagaacgtgcagtcgggccacttcgccttcacggcggcggaggccggcgactacctggcctgcttctgggctcccgaccacaagcctccggtcaccatcgggttcgagttcgactggaggagcggcgtctccgccaaggactatcccagcgtcgccaagaagggcaaggtcgatatgatggaattggagctgaagaagctagaggaaactataaaaaatatacatgaagagatgctttatctgcgtgaaagggaagaggaaatgcaggacgtgaacaggcgaacgaactcaaggatggcttggctagggttcctctcccttggcgtctgcttatcagtggcaggtttgcagctgtggcacctgaaaaccttctttgaaaggaagaagttattgtagactgtagttggcccatggttcacggtagacctcagcgcaggtgtaacctatttttgggtgaactgccgatctgttacggagcttggaatcccatgtaacaaacggtatgtcgtacttgagaaatatgctttagcctgtccagttgaaattctaagaaacttg

SEQ ID NO: 598 - protein, 229 aa, Zea mays
  misc_feature (36)..(224): Pfam Name: EMP24_GP25L Pfam Description: emp24/gp25L/p24 family/GOLD
  misc_feature (1)..(229): Ceres Clone ID no. 241236
  misc_feature (1)..(229): Bit score of 577.3 for HMM based on sequences of Figure 12
  misc_feature (1)..(229): Functional Homolog Of SEQ ID NO. 580
MAARRLGSPASRWLRPSALLLLVASALLSAPSPARALRFDLESGHTKCVSDEIKVNAMAVGKYHIVGPDPNSPDAQLPESHRISLRVTSPYGNSMHYAENVQSGHFAFTAAEAGDYLACFWAPDHKPPVTIGFEFDWRSGVSAKDYPSVAKKGKVDMMELELKKLEETIKNIHEEMLYLREREEEMQDVNRRTNSRMAWLGFLSLGVCLSVAGLQLWHLKTFFERKKLL

SEQ ID NO: 599 - DNA, 854 bp, Zea mays
  misc_feature (1)..(854): Ceres Clone ID no. 100923096
  misc_feature (1)..(854): Encodes the peptide sequence at SEQ ID NO. 600
ctccggcgatggccgcgcggcgcctcggatcccccgcatctaggtggctgcgcccgtccgcgctgctcctcctggtcgcctctgctctcctctcggccccgtcgccggcccgggccctccggttcgacctcgagtccggccacaccaagtgcgtctccgacgagatcaaggtcaacgccatggccgtcggaaagtaccacatcgtcgggcccgaccccaactcacccgacgcccagctccccgagtcgcaccgcatctccctcagggtgacgtcgccgtacgggaacagcatgcactacgcggagaacgtgcagtcgggccacttcgccttcacggcggcggaggccggcgactacctggcctgcttctgggctcccgaccacaagccgccggtcaccatcgggttcgagttcgactggaggagcggcgtctccgccaaggactatcccagcgtcgccaagaagggcaaggtsgatwtgatggaattggagctgaagaagctagrggaaactwtaaaaaatatmcatgaagrgatgctttwtytgcgtgaaagggaagrggaaatgcaggacgtgamcaggsgaacgaactcaaggakggstkggstrgggttcytytcccttggsgtytgyttwtcagkggcrggtttgcagctgkggcmcctgaagmccttytttgaaaggaagaagttgttgtagactgtagttggcccatggttcmcggtagacctcagcgcgggggtaacctttttttgggggaactgccgttttgttagggggcttgaaatcccatgtaacaaacgttatgttgtacttgggaaaatatgctttagcctgtccagttgaaattttaag

SEQ ID NO: 600 - protein, 229 aa, Zea mays
  misc_feature (36)..(224): Pfam Name: EMP24_GP25L Pfam Description: emp24/gp25L/p24 family/GOLD
  misc_feature (1)..(229): Ceres Clone ID no. 100923096
  misc_feature (1)..(229): Bit score of 457.4 for HMM based on sequences of Figure 12
  misc_feature (1)..(229): Functional Homolog Of SEQ ID NO. 580
  misc_feature (155)..(155): Xaa is any aa, unknown, or other
  misc_feature (157)..(157): Xaa is any aa, unknown, or other
  misc_feature (166)..(166): Xaa is any aa, unknown, or other
  misc_feature (169)..(169): Xaa is any aa, unknown, or other
  misc_feature (172)..(172): Xaa is any aa, unknown, or other
  misc_feature (175)..(175): Xaa is any aa, unknown, or other
  misc_feature (178)..(178): Xaa is any aa, unknown, or other
  misc_feature (179)..(179): Xaa is any aa, unknown, or other
  misc_feature (184)..(184): Xaa is any aa, unknown, or other
  misc_feature (190)..(190): Xaa is any aa, unknown, or other
  misc_feature (192)..(192): Xaa is any aa, unknown, or other
  misc_feature (197)..(197): Xaa is any aa, unknown, or other
  misc_feature (198)..(198): Xaa is any aa, unknown, or other
  misc_feature (199)..(199): Xaa is any aa, unknown, or other
  misc_feature (200)..(200): Xaa is any aa, unknown, or other
  misc_feature (203)..(203): Xaa is any aa, unknown, or other
  misc_feature (206)..(206): Xaa is any aa, unknown, or other
  misc_feature (207)..(207): Xaa is any aa, unknown, or other
  misc_feature (208)..(208): Xaa is any aa, unknown, or other
  misc_feature (209)..(209): Xaa is any aa, unknown, or other
  misc_feature (211)..(211): Xaa is any aa, unknown, or other
  misc_feature (212)..(212): Xaa is any aa, unknown, or other
  misc_feature (217)..(217): Xaa is any aa, unknown, or other
  misc_feature (218)..(218): Xaa is any aa, unknown, or other
  misc_feature (221)..(221): Xaa is any aa, unknown, or other
  misc_feature (222)..(222): Xaa is any aa, unknown, or other
MAARRLGSPASRWLRPSALLLLVASALLSAPSPARALRFDLESGHTKCVSDEIKVNAMAVGKYHIVGPDPNSPDAQLPESHRISLRVTSPYGNSMHYAENVQSGHFAFTAAEAGDYLACFWAPDHKPPVTIGFEFDWRSGVSAKDYPSVAKKGKXDXMELELKKLXETXKNXHEXMLXXREREXEMQDVXRXTNSRXXXXGFXSLXXXXSXXGLQLXXLKXXFERKKLL

SEQ ID NO: 601 - protein, 217 aa, Oryza sativa subsp. japonica
  misc_feature (37)..(212): Pfam Name: EMP24_GP25L Pfam Description: emp24/gp25L/p24 family/GOLD
  misc_feature (1)..(217): Public GI ID no. 125601197
  misc_feature (1)..(217): Bit score of 516.9 for HMM based on sequences of Figure 12
  misc_feature (1)..(217): Functional Homolog Of SEQ ID NO. 580
MAARRPGSPAPRWAPWPLLAAAAVLLLLSAAPRTARALRFDLESGHTKCISDEIKVNSMVVGKYHVVGPDPNFPDNPLPDSHRISLRNVPSGNFAFTATEAGDYLACFWAPDHKPPVSIGFEFDWRSGVAAKDWSNVAKKGQVDVMEMELKKLEETIKSIHEEMFYLREREEEMQNLNKQTNSRMAWLGFLSLGICLSVAGLQLWHLKTFFERKKLL

SEQ ID NO: 602 - DNA, 645 bp, Sorghum bicolor
  misc_feature (1)..(645): Ceres Annot ID no. 8640957
  misc_feature (1)..(645): Encodes the peptide sequence at SEQ ID NO. 603
atggccacgcgcgtccgcgggtgcctcctgctcgtcctcctcgcgaccgcggcccccgccggcgccctgcgcttcgacctgctctcgggccacaccaagtgcatctccgacgacatcaaggtcggtgccatggccgtcggtaagtaccacgtcacgggccccgactcccagacccagcagcagctcccggactcccaccgcatctcgctgcgggtcacctcgccctacggcaacagcctgcactacgcggagaacgtgcactcgggcaacttcgccttcacggcctccgagaacggcgactacctcgcctgcttctgggcgcccgatcaccgcccgcccgccaccgtcgcgttcgagttcgactggcgcagtggcgtctccgccaaggattggagcgccatcgccaagaagagtcaggtcgaaatgatggaattggagctcaggaagctggaggaaaacatcagatctatccatgaagaaatgtattaccttcgtgaaagggaagaagaaatgcaggaactgaacaggagaacaaactcaaggatggcttggcttggtttcctctcgctcaccatctgcctatcagtggcgggcttgcagttatggcacctgaagaatttctttgaaagaaagaagctactataa

SEQ ID NO: 603 - protein, 214 aa, Sorghum bicolor
  misc_feature (22)..(209): Pfam Name: EMP24_GP25L Pfam Description: emp24/gp25L/p24 family/GOLD
  misc_feature (1)..(214): Ceres Annot ID no. 8640957
  misc_feature (1)..(214): Bit score of 497.1 for HMM based on sequences of Figure 12
  misc_feature (1)..(214): Functional Homolog Of SEQ ID NO. 580
MATRVRGCLLLVLLATAAPAGALRFDLLSGHTKCISDDIKVGAMAVGKYHVTGPDSQTQQQLPDSHRISLRVTSPYGNSLHYAENVHSGNFAFTASENGDYLACFWAPDHRPPATVAFEFDWRSGVSAKDWSAIAKKSQVEMMELELRKLEENIRSIHEEMYYLREREEEMQELNRRTNSRMAWLGFLSLTICLSVAGLQLWHLKNFFERKKLL

SEQ ID NO: 604 - protein, 232 aa, Oryza sativa subsp. japonica
  misc_feature (28)..(227): Pfam Name: EMP24_GP25L Pfam Description: emp24/gp25L/p24 family/GOLD
  misc_feature (1)..(232): Public GI ID no. 115453237
  misc_feature (1)..(232): Bit score of 518.9 for HMM based on sequences of Figure 12
  misc_feature (1)..(232): Functional Homolog Of SEQ ID NO. 580
MAARSLHHLLLLLFLAGFHSLSLSPAAALRFDLQSGHTKCISDDIKVGAMAVGKYHVVVPEGGGSTSSSSSSSSSAQPLLPESHRVSLRVTSPYGNSLHYSENVQSGNFAFTASEAGDYLACFWAPDHRPTATVGFEFDWRSGVSARDWTNVAKKGQVDMMEVELKKLEDTINSIHEEMFYLRAREEEMQELNRRTNSRMAWLGFFSLAICLSVAGLQLWHLKNFFERKKLL

SEQ ID NO: 605 - DNA, 878 bp, Zea mays
  misc_feature (1)..(878): Ceres Clone ID no. 373329
  misc_feature (1)..(878): Encodes the peptide sequence at SEQ ID NO. 606
aacaccgcaacgctccctcgatctagccgccatggccgcgcgcgtccccggttccctcttggctctcctcctgctcatcctcgcgaccgcgtcccccaccggcgccctccgcttcgacctgcgttcgggccacaccaagtgcatctccgacgacatcaaggtgggcgccatggccgtcgggaagtaccaagtcatggcccccgacggcgtcgcctcttcgtcgtcgtcgccacagcagctcccggactctcaccgcatctcgctgcgggtcacctcgccctacggcaacagtctgcactacgcggagaacgtgcactcgggcaacttcgccttcacggcctccgaggccggcgactacctcgcctgcttctgggcgcccgatcaccgcccgcccgccatcgtcgcgttcgagttcgactggcgcagcggcgtctccgccagggactggagcgccgtcgccaagaagggtcaggtccaaatgatggaattggaactcaggaagctggagggtaacatcaaatctatccatgatgaaatgttttaccttcgtgaaagggaagtagagatgcaggaactgaacaggagaacaaactcaaggatggcttggcttggtttcctctcgctcgccatctgcctatcagtggcgggctttcagttatggcacctgaagaacttctttgaaagaaagaagctactatagttcttttcgattaccacagaacatattttggcgcaacttttttggttaccttttcttctttgatgtttagtggatgtagattttctgctgatgaacaaagatatagcagcgttgataaatattgatttttagtttcctaggacaaaattaaatatatgcggagtgtaaagctgacagc

SEQ ID NO: 606 - protein, 222 aa, Zea mays
  misc_feature (25)..(217): Pfam Name: EMP24_GP25L Pfam Description: emp24/gp25L/p24 family/GOLD
  misc_feature (1)..(222): Ceres Clone ID no. 373329
  misc_feature (1)..(222): Bit score of 490.9 for HMM based on sequences of Figure 12
  misc_feature (1)..(222): Functional Homolog Of SEQ ID NO. 580
MAARVPGSLLALLLLILATASPTGALRFDLRSGHTKCISDDIKVGAMAVGKYQVMAPDGVASSSSSPQQLPDSHRISLRVTSPYGNSLHYAENVHSGNFAFTASEAGDYLACFWAPDHRPPAIVAFEFDWRSGVSARDWSAVAKKGQVQMMELELRKLEGNIKSIHDEMFYLREREVEMQELNRRTNSRMAWLGFLSLAICLSVAGFQLWHLKNFFERKKLL

SEQ ID NO: 607 - protein, 214 aa, Populus x generosa
  misc_feature (24)..(209): Pfam Name: EMP24_GP25L Pfam Description: emp24/gp25L/p24 family/GOLD
  misc_feature (1)..(214): Public GI ID no. 118489897
  misc_feature (1)..(214): Bit score of 524.6 for HMM based on sequences of Figure 12
  misc_feature (1)..(214): Functional Homolog Of SEQ ID NO. 580
MSRFNLYLLLITTVIAILSSTSKSIRFELQSGNTKCIAEDIKSNSMTVGKYSIVNPHDGQPLPASYKLTVRVTSSYGNNYHHSELVESGQFAFTASEAGDYMACFWAADHKPAVTLNIDFDWKTGVAAKDWTNVAKKGSVDVMELELKKMYDTVISVQEEMNYLREREEEMQDLNISTNVKMAWLSFLSIAVCLSVAGLQVWHLKTFFQKKKLI

SEQ ID NO: 608 - protein, 214 aa, Populus balsamifera subsp. trichocarpa
  misc_feature (24)..(209): Pfam Name: EMP24_GP25L Pfam Description: emp24/gp25L/p24 family/GOLD
  misc_feature (1)..(214): Public GI ID no. 224112183
  misc_feature (1)..(214): Bit score of 521.8 for HMM based on sequences of Figure 12
  misc_feature (1)..(214): Functional Homolog Of SEQ ID NO. 580
MSRFNLYLLLITTVIAILSSTSKSIRFELESGNTKCIAEDIKSNSMTVGKYSIVNPHDGQPLPDSYKLTVRVTSSSGNNYHHSELVESGQFAFTASEAGDYMACFWAADHKPAVTLNIDFDWKTGVAAKDWTNVAKKGSVDVMELELKKMYDTVISVQEEMNYLREREEEMQDLNISTNVKMAWLSFLSIVVCLSVAGLQVWHLKTFFQKKKLI

SEQ ID NO: 609 - DNA, 868 bp, Arabidopsis thaliana
  misc_feature (1)..(868): Ceres Clone ID no. 117183
  misc_feature (1)..(868): Encodes the peptide sequence at SEQ ID NO. 610
cttcgtcttcgatctctctaccaactccacgatcaacgaaaccaaagatctctcttcaaagcttccaccatgtttctccgatcactcaatctctgtacaatactactcttcctagcgatttcatcacaagtttctcaatctctccacttcgaattgcaatctggtcgaacaaaatgtatatcggaagacataaaaagcaattcaatgaccgtcgggaagtacaccgtcgttaaccctaacgaagctcatccttctcctcaatctcacaagatctccatcagagtgacatcgagttacgggaacacgtatcatcacgcggaagatgtagaatcgggacaattcgcgttcacggcggtggagtctggagattacatggcttgttacacagctgttgatcaaaaacctgaggttacattgagtattgatttcgattggagaactggtgttcaatctaaaagctggagtagtgttgctaagaagagccaagtcgaagttatggagtttgatgtaaaaagacttattgaaaccgtcaattcgattcatgaagagatgttttatctcagagaaagggaagaagagatgcagaatctgaaccgggctactaactcgaaaatggcgtggttgagtttcctctctcttttcgtatgcttaggagtcgcgggaatgcagtttgtgcatttgaagacgtttttcgagaagaagaaagtcatctaagatggttagatgaaacaaatcccactcttttcttttcccaactcaaaggagtcttctattcctccatgagttttgtacatttagatctttacttttgagtatgtactctcggaactggaaattaaatgaatatgaaagtattgcccctttttgc

SEQ ID NO: 610 - protein, 214 aa, Arabidopsis thaliana
  misc_feature (24)..(209): Pfam Name: EMP24_GP25L Pfam Description: emp24/gp25L/p24 family/GOLD
  misc_feature (1)..(214): Ceres Clone ID no. 117183
  misc_feature (1)..(214): Bit score of 537.4 for HMM based on sequences of Figure 12
  misc_feature (1)..(214): Functional Homolog Of SEQ ID NO. 580
MFLRSLNLCTILLFLAISSQVSQSLHFELQSGRTKCISEDIKSNSMTVGKYTVVNPNEAHPSPQSHKISIRVTSSYGNTYHHAEDVESGQFAFTAVESGDYMACYTAVDQKPEVTLSIDFDWRTGVQSKSWSSVAKKSQVEVMEFDVKRLIETVNSIHEEMFYLREREEEMQNLNRATNSKMAWLSFLSLFVCLGVAGMQFVHLKTFFEKKKVI

SEQ ID NO: 611 - protein, 202 aa, Vitis vinifera
  misc_feature (18)..(197): Pfam Name: EMP24_GP25L Pfam Description: emp24/gp25L/p24 family/GOLD
  misc_feature (1)..(202): Public GI ID no. 147853846
  misc_feature (1)..(202): Bit score of 489.9 for HMM based on sequences of Figure 12
  misc_feature (1)..(202): Functional Homolog Of SEQ ID NO. 580
MIMNKKMMIGFLLGGVQSIRFELQSAHTKCIAEDIKADSMTVGKYSVVNPNDGYPIPDSHKVTVRVTSAYGNNYHYADRVDSGQFAFPAAEAGDYMACFWVLDHKPPLTLTIDLDWKTGVAAKDWSNVAKKGQVDVMELELKKLYDTVTSIHEEMEEEMQELNQATNSRMAWLSFLSLFVCLSVAGLQLWHLKNFFERKKLL

SEQ ID NO: 612 - DNA, 1009 bp, Glycine max
  misc_feature (1)..(1009): Ceres Clone ID no. 646035
  misc_feature (1)..(1009): Encodes the peptide sequence at SEQ ID NO. 613
ggttacttttcgcatcttttcgttttgagctcaccgtggctcttctccattgtcgttttgcttctcccttcttccttcccattcaaaccctaatctgtccctcggatcccaaaattgccccaaattgagaacacgccatggcggcaacgttcgatttggttcgttccctcgcacttctcactcttgcatttgtgtgtagcgtcgcgaattcgatgcggttcgagcttcaatcgggtaacaccaagtgcatttcagaagacattaagaccaacgcgatgagtgtgggaaagtacagtgttgttaatccccgagaagggtacccacttcccgattcccacaggatcgttgtcaaggtgacgtcgcctcatgcgaacatgtatcactttggagatcatgtggattctggtaattttgcatttacggcatctgagtctggtgactactcagcttgcttttgggttcaggataccagagataccccgtcggtggtgactattgaatttgagtggagaactggggttgctgccaaagactggtccaaggttgccaagaaagggcagattgaagtaatggaatttgagttgaagaagctatatgatactatcctatccatccatgacgagatgttttatcttcgagaaagggaggaagagatgcaagatcttaacaaagcaacaaacagcaagatgtttaccttcagtttcctttcgattgtggtttgcttgtctgtggctggtttgcaactatggcatttgaagacattctttgagaggaagaagctcctctaagttcatcacacgaattttgttcatttttgcttcagaattttttttattttctgttcctggttgttccttatgtatccaaatgtatgattagttcatctttcacttttacattttatggcaactagaaattgctgctgatcgcaagtcatgttaaatgtatgttacaattatgaaccggtattaactttagaaactatagttaaatttcttaacaggccctt

SEQ ID NO: 613 - protein, 216 aa, Glycine max
  misc_feature (25)..(211): Pfam Name: EMP24_GP25L Pfam Description: emp24/gp25L/p24 family/GOLD
  misc_feature (1)..(216): Ceres Clone ID no. 646035
  misc_feature (1)..(216): Bit score of 494.1 for HMM based on sequences of Figure 12
  misc_feature (1)..(216): Functional Homolog Of SEQ ID NO. 580
MAATFDLVRSLALLTLAFVCSVANSMRFELQSGNTKCISEDIKTNAMSVGKYSVVNPREGYPLPDSHRIVVKVTSPHANMYHFGDHVDSGNFAFTASESGDYSACFWVQDTRDTPSVVTIEFEWRTGVAAKDWSKVAKKGQIEVMEFELKKLYDTILSIHDEMFYLREREEEMQDLNKATNSKMFTFSFLSIVVCLSVAGLQLWHLKTFFERKKLL

SEQ ID NO: 614 - DNA, 636 bp, Populus balsamifera subsp. trichocarpa
  misc_feature (1)..(636): Ceres Annot ID no. 1476847
  misc_feature (1)..(636): Encodes the peptide sequence at SEQ ID NO. 615
atgtcaaaatcaaatctcttaatgataacaactcttgggttgtttttgacaattgcagaatcgatgaggtttgatctgcaatcaggacacacaaaatgcgtatcagaggatataaataacagcgcaattactgttggaaagtacaatgttgtcaatcctaatgaaggttatcctcttcctgatacccacaagcttaatgtcagggtgacatcgccatatgggaacaattatcaccatggggatcaggtggattcaggtaattttgcatttactgcagctgaggctggtgattacactacttgctttacggcccctgatcacaaaccagaaaccactgtagctattgaatttgaatggaaaactggtgttgctgctaaggattggtctaagattgctaagaaggaacaagttgaagttatggaaattgagttgaagaaattactggatactgtcacatctattaatgaagagatgtttcatcttcgtgtgagggaggaagaaatgcaacaacttaatcaatcaacaaactccaaaatggctggccttagtttcctttcacttgtggtttgcttctctgtggctggtttacagctctggcatctgaagtcacattttgagaggaagaagctgctgtag

SEQ ID NO: 615 - protein, 211 aa, Populus balsamifera subsp. trichocarpa
  misc_feature (21)..(206): Pfam Name: EMP24_GP25L Pfam Description: emp24/gp25L/p24 family/GOLD
  misc_feature (1)..(211): Ceres Annot ID no. 1476847
  misc_feature (1)..(211): Bit score of 483.9 for HMM based on sequences of Figure 12
  misc_feature (1)..(211): Functional Homolog Of SEQ ID NO. 580
MSKSNLLMITTLGLFLTIAESMRFDLQSGHTKCVSEDINNSAITVGKYNVVNPNEGYPLPDTHKLNVRVTSPYGNNYHHGDQVDSGNFAFTAAEAGDYTTCFTAPDHKPETTVAIEFEWKTGVAAKDWSKIAKKEQVEVMEIELKKLLDTVTSINEEMFHLRVREEEMQQLNQSTNSKMAGLSFLSLVVCFSVAGLQLWHLKSHFERKKLL

SEQ ID NO: 616 - DNA, 777 bp, Arabidopsis thaliana
  misc_feature (1)..(777): Ceres Annot ID no. 864422
  misc_feature (1)..(777): Encodes the peptide sequence at SEQ ID NO. 617
tcagatcgatttctctctatatcggagccgtcatgaatcatcgtcggagctcgatcgtactattgatcctctcaattttatctcccgtgacactctctatacgatacgagctactttctgggcacacgaaatgcatctcagaggagattcacgcaaacgcaatgaccatcggaaaatacagcattataaaccctcacgaggatcatcctcttccttcttcccataaagtcaccgtcagggtcacatcgccacaagggacggcttatcacgaatcggacggagtagaatcgggacaattctcgtttgtagctgtggaaacaggggattacataagttgcttctccgccgtcgatcacaaaccagagacgacgctgatcattgactttgattggaggacgggtattcataccaaggattggtcgaatgtggcaaagaagagccaagtcgaaacgatggagtttgaggttaagaagttatttgaaaccgtgaatggaatccacgatgagatgttctatctccgcgacagggaagaagaaatgcacaatctgaacatagcgacaaattcgaagatggcatggttgagtttcgtgtcgcttgcagtttgtttatcggtcgcaggtcttcagttttggcacttgaagactttcttccagaaaaagaagcttatctgaaaaccattaccatctcctgagggcagagattgtattgaaaaccctatgactatagctttatatacactactgaactcatttttcattttgttactgaatttttcgg

SEQ ID NO: 617 - protein, 212 aa, Arabidopsis thaliana
  misc_feature (22)..(207): Pfam Name: EMP24_GP25L Pfam Description: emp24/gp25L/p24 family/GOLD
  misc_feature (1)..(212): Ceres Annot ID no. 864422
  misc_feature (1)..(212): Bit score of 453.0 for HMM based on sequences of Figure 12
  misc_feature (1)..(212): Functional Homolog Of SEQ ID NO. 580
MNHRRSSIVLLILSILSPVTLSIRYELLSGHTKCISEEIHANAMTIGKYSIINPHEDHPLPSSHKVTVRVTSPQGTAYHESDGVESGQFSFVAVETGDYISCFSAVDHKPETTLIIDFDWRTGIHTKDWSNVAKKSQVETMEFEVKKLFETVNGIHDEMFYLRDREEEMHNLNIATNSKMAWLSFVSLAVCLSVAGLQFWHLKTFFQKKKLI

SEQ ID NO: 618 - DNA, 744 bp, Populus balsamifera subsp. trichocarpa
  misc_feature (1)..(744): Ceres Annot ID no. 1517733
  misc_feature (1)..(744): Encodes the peptide sequence at SEQ ID NO. 619
atgtcaagattcaacctttatctcctcctaataacaactgtgattgcgattttatcctctacatcaaaatcaattcgtttcgagctagaatcaggaaacacgaaatgcatagcagaagacatcaaaagcaattctatgactgttgggaagtacagtattgttaatccccatgatggccagcccttgcccgactcgtataaactcactgtcagggtgacatcgagttctgggaataattatcatcattcagagcttgtggaatcagggcagtttgctttcacggcgtcggaggcaggggattacatggcgtgtttttgggcggcggatcataagccagcagtgactttgaatattgattttgattggaagactggtgtggctgctaaggattggactaatgttgccaagaaaggctctgttgatgttccttctccttcttctataacccaagctctcgcttattgtagctatccttcctgcctaacagctgactttcaagcagcctttcatctctttgctgaggttatggaattggagctgaagaaaatgtatgacacagttatttccgttcaagaggaaatgaattatcttcgtgaaagagaagaagaaatgcaagatctgaacatatctactaatgtaaaaatggcctggttgagttttctttcgatcgtcgtgtgtttatctgtggcaggcttgcaagtgtggcacttgaagacttttttccagaaaaagaagctcatttag

SEQ ID NO: 619 - protein, 247 aa, Populus balsamifera subsp. trichocarpa
  misc_feature (24)..(242): Pfam Name: EMP24_GP25L Pfam Description: emp24/gp25L/p24 family/GOLD
  misc_feature (1)..(247): Ceres Annot ID no. 1517733
  misc_feature (1)..(247): Bit score of 477.1 for HMM based on sequences of Figure 12
  misc_feature (1)..(247): Functional Homolog Of SEQ ID NO. 580
MSRFNLYLLLITTVIAILSSTSKSIRFELESGNTKCIAEDIKSNSMTVGKYSIVNPHDGQPLPDSYKLTVRVTSSSGNNYHHSELVESGQFAFTASEAGDYMACFWAADHKPAVTLNIDFDWKTGVAAKDWTNVAKKGSVDVPSPSSITQALAYCSYPSCLTADFQAAFHLFAEVMELELKKMYDTVISVQEEMNYLREREEEMQDLNISTNVKMAWLSFLSIVVCLSVAGLQVWHLKTFFQKKKLI

SEQ ID NO: 620 - DNA, 997 bp, Arabidopsis thaliana
  misc_feature (1)..(997): Ceres Clone ID no. 125621
  misc_feature (1)..(997): Encodes the peptide sequence at SEQ ID NO. 621
acaatcgaggaagaagcaaaaggaagacgaagagagattcgatttctctggatttttcaaaaatgattctccaatcgcaaaagctatggacgatgtttctaattctagcgatttggtccccaatttcatactcgcttcactttgatctacactcaggtcgcacaaagtgtatcgccgaagacatcaaaagcaattcaatgactgttggtaaatacaacatcgataatcctcacgaaggtcaagctttgccacaaactcacaaaatttccgtcaaggtgacgtctaattccggtaacaattaccatcacgcggaacaagtagattcaggacaattcgcattctcggctgttgaagcaggtgattacatggcttgtttcactgctgttgatcataagcctgaggtttcgttgagtattgactttgagtggaagactggtgttcaatctaaaagctgggctaatgttgctaagaagagccaagtcgaagttatggaatttgaagtaaagagtcttcttgatactgttaactcgattcatgaagagatgtattatcttagagatagggaagaagagatgcaagatctgaacaggtccactaacacgaaaatggcgtggttgagtgtgctctcgtttttcgtctgcataggagtggcagggatgcagtttttgcacttgaagacgtttttcgagaagaagaaggttatctaaaactctctactacggggttggttacgctctttctgttttcttagcccaaacaatcaatcttctcttattttgggtgttgtatattagatcaatggctatgactctgttctctgagacttgggaattttatttgtgtggctttatttgctttttttccaaagataagtttagtttttgtttagatttgttggtcctttaggatactttgatggtttaaagtcaaataaattgtgtttgtctgaggttttagtttatacagcttatctcaatcagaaccaattattagactc

SEQ ID NO: 621 - protein, 214 aa, Arabidopsis thaliana
  misc_feature (24)..(209): Pfam Name: EMP24_GP25L Pfam Description: emp24/gp25L/p24 family/GOLD
  misc_feature (1)..(214): Ceres Clone ID no. 125621
  misc_feature (1)..(214): Bit score of 466.6 for HMM based on sequences of Figure 12
  misc_feature (1)..(214): Functional Homolog Of SEQ ID NO. 580
MILQSQKLWTMFLILAIWSPISYSLHFDLHSGRTKCIAEDIKSNSMTVGKYNIDNPHEGQALPQTHKISVKVTSNSGNNYHHAEQVDSGQFAFSAVEAGDYMACFTAVDHKPEVSLSIDFEWKTGVQSKSWANVAKKSQVEVMEFEVKSLLDTVNSIHEEMYYLRDREEEMQDLNRSTNTKMAWLSVLSFFVCIGVAGMQFLHLKTFFEKKKVI

SEQ ID NO: 622 - DNA, 996 bp, Arabidopsis thaliana
  misc_feature (1)..(996): Ceres Annot ID no. 868892
  misc_feature (1)..(996): Encodes the peptide sequence at SEQ ID NO. 623
acaatcgaggaagaagcaaaaggaagacgaagagagattcgatttctctggatttttcaaaaatgtttctccaatcgcaaaaactatggacgatgcttctaattctagcgatttggtcaccaatttcacactcgcttcacttcgatctacactcaggtcgcacaaagtgtatcgccgaagacatcaaaagcaattcaatgactgttggtaaatacaacatcgataatcctcacgaaggtcaagctttaccacaaactcacaaaatttccgtcaaggtgacgtctaattccggtaacaattaccatcacgcggaacaagtagattcaggacaattcgcattctcggctgttgaagcaggtgattacatggcttgtttcactgctgttgatcataagcctgaggtttcgttgagtattgactttgagtggaagactggtgttcaatctaaaagctgggctaatgttgctaagaagagtcaagtcgaagttatggaatttgaagtaaagagtcttcttgatactgttaactcgattcatgaagagatgtattatcttagagatagggaagaagagatgcaagacttgaaccggtccactaacacaaaaatggcgtggttgagtgttctctcgtttttcgtctgcataggagttgcagggatgcagtttttgcacttgaagacgtttttcgagaagaagaaggttatctgaaactctctactacggggttggttacgctctttctgttttcttagcccaaacaatcaatcttctcttcttttgggtgttgtacattagatcaatggctatgactctgttctctgagacttgggaattttatttgtgtggctttatttgcttttttccaagataagtttagtttttgtttagatttgttggtcctttaggatactttgatggtttaaagtcaaataaattgtgtttgtctgaggttttagattatacagcttatctcaatcagaaccaattattggactca

SEQ ID NO: 623 - protein, 214 aa, Arabidopsis thaliana
  misc_feature (24)..(209): Pfam Name: EMP24_GP25L Pfam Description: emp24/gp25L/p24 family/GOLD
  misc_feature (1)..(214): Ceres Annot ID no. 868892
  misc_feature (1)..(214): Bit score of 468.7 for HMM based on sequences of Figure 12
  misc_feature (1)..(214): Functional Homolog Of SEQ ID NO. 580
MFLQSQKLWTMLLILAIWSPISHSLHFDLHSGRTKCIAEDIKSNSMTVGKYNIDNPHEGQALPQTHKISVKVTSNSGNNYHHAEQVDSGQFAFSAVEAGDYMACFTAVDHKPEVSLSIDFEWKTGVQSKSWANVAKKSQVEVMEFEVKSLLDTVNSIHEEMYYLRDREEEMQDLNRSTNTKMAWLSVLSFFVCIGVAGMQFLHLKTFFEKKKVI

SEQ ID NO: 624 - DNA, 682 bp, Arabidopsis thaliana
  misc_feature (1)..(682): Ceres Clone ID no. 1363654
  misc_feature (1)..(682): Encodes the peptide sequence at SEQ ID NO. 625
  misc_feature (588)..(588): n is a, c, t, g, unknown, or other
gaagaaaaatagctaaactttgaaatccgtcagatcgatttctctctatatcggagccgtcatgaatcatcgtcggagctcgatcgtactattgatcctctcaattttatctcccgtgacactctctatacgatacgagctactttctgggcacacgaaatgcatctcagaggagattcacgcaaacgcaatgaccatcggaaaatacagcattataaaccctcacgaggatcatcctcttccttcttcccataaagtcaccgtcagggtcacatcgccacaaggggcggcttatcacgaatcggacggagtagaatcgggacaattctcgtttgtagctgtggaaacaggggattacataagttgcttctccgccgtcgatcacaaaccagagacgacgctgatcattgactttgattggaggacgggtattcataccaaggattggtcgaatgtggcaaagaagagccaagtcgaaacgatggagtttgaggttaagaagttatttgaaaccgtgaatggaatccacgacgagatgttctatctccgcgacagggaagaagaaatgcacaatctggacatagcgancaattcgaagatggcatggttgagtttcgtgtcgcttgcagtttgtttatcggtcgcaggtcttcagttttggcacttgaagactttcttccag

SEQ ID NO: 625 - protein, 207 aa, Arabidopsis thaliana
  misc_feature (22)..(207): Pfam Name: EMP24_GP25L Pfam Description: emp24/gp25L/p24 family/GOLD
  misc_feature (1)..(207): Ceres Clone ID no. 1363654
  misc_feature (1)..(207): Bit score of 416.1 for HMM based on sequences of Figure 12
  misc_feature (1)..(207): Functional Homolog Of SEQ ID NO. 580
  misc_feature (176)..(176): Xaa is any aa, unknown, or other
MNHRRSSIVLLILSILSPVTLSIRYELLSGHTKCISEEIHANAMTIGKYSIINPHEDHPLPSSHKVTVRVTSPQGAAYHESDGVESGQFSFVAVETGDYISCFSAVDHKPETTLIIDFDWRTGIHTKDWSNVAKKSQVETMEFEVKKLFETVNGIHDEMFYLRDREEEMHNLDIAXNSKMAWLSFVSLAVCLSVAGLQFWHLKTFFQ

SEQ ID NO: 626 - protein, 210 aa, Physcomitrella patens subsp. patens
  misc_feature (26)..(205): Pfam Name: EMP24_GP25L Pfam Description: emp24/gp25L/p24 family/GOLD
  misc_feature (1)..(210): Public GI ID no. 168026300
  misc_feature (1)..(210): Bit score of 381.9 for HMM based on sequences of Figure 12
  misc_feature (1)..(210): Functional Homolog Of SEQ ID NO. 580
MGGVWSFRSCVVVVALVLVWGSVAQAVQFEVSARTTKCIAEEIQNHVVVVGDYKIVHSDESHKITVKVTSPYGNQLHYQENVQSGQFAFTTSETGNFMACFWMLNAPSTATVNVALDWKTGVAAKDWASIAKKDKLDGMELELRKLEEAVGSIHSEMLYLREREAEMRDLNELTNSRVAWFGIMSLFVCLGVAGWQLWHLKTFFERKKLL

SEQ ID NO: 627 - DNA, 890 bp, Arabidopsis thaliana
  misc_feature (1)..(890): Ceres Annot ID no. 873900
  misc_feature (1)..(890): Encodes the peptide sequence at SEQ ID NO. 628
gtcttttttcttttaacaaatcccaactttttccttgttgtttgttgttgctgaaactagaagatggatttgctaccatcaagatataagattcacaagacaaagttaagatggatcttaacaatgatgacgatgatgatgatgatggtgatgagaagaggagaatcaatgagattagatatggaatcaggtaacacaaaatgtatctccgatgacatcaaaacaaattacatgaccgttgggacttattccatcgtcaatcccaacgaaggccaccatcttcctccttctcacaaactcttcgtcactgtgtcatctcctaaagggaaaagccatcatcatgcagagaatgtagagtccgggaaattcgtgttcacggcagaagaaaccggcgattacatgacgtgttttgtggctccaggttatagacctaccgcaaaattcgcggttgatttcgagtggaaaagcggtgtagaggctaaagattggaccactatagccaagagaggccaaataaccatgctagaggtggaggtgaggaaactactcgacgtgacagaaactatacatgaagaaatgtttcagctcatagagagggaaagggaaatgcaagagttaaaccgatcaacgaattcaagaatggcagctctcagtttactgtcgttcgtggtaacaatgtcggtcgcgggtttacaactacggcacctcaagtcattcttggagaggaagaagctcctctgatcaagcttgttgctgcggttacatttaacagattttgatgttttctgtttagcttcttatacttacttaaccaatcaatagtcttcatcttgaattttgagaaacttaaatagcaaattttgctttagaccaaactcaagatcatatat

SEQ ID NO: 628 - protein, 225 aa, Arabidopsis thaliana
  misc_feature (35)..(220): Pfam Name: EMP24_GP25L Pfam Description: emp24/gp25L/p24 family/GOLD
  misc_feature (1)..(225): Ceres Annot ID no. 873900
  misc_feature (1)..(225): Bit score of 376.4 for HMM based on sequences of Figure 12
  misc_feature (1)..(225): Functional Homolog Of SEQ ID NO. 580
MDLLPSRYKIHKTKLRWILTMMTMMMMMVMRRGESMRLDMESGNTKCISDDIKTNYMTVGTYSIVNPNEGHHLPPSHKLFVTVSSPKGKSHHHAENVESGKFVFTAEETGDYMTCFVAPGYRPTAKFAVDFEWKSGVEAKDWTTIAKRGQITMLEVEVRKLLDVTETIHEEMFQLIEREREMQELNRSTNSRMAALSLLSFVVTMSVAGLQLRHLKSFLERKKLL

SEQ ID NO: 629 - protein, 210 aa, Physcomitrella patens subsp. patens
  misc_feature (26)..(205): Pfam Name: EMP24_GP25L Pfam Description: emp24/gp25L/p24 family/GOLD
  misc_feature (1)..(210): Public GI ID no. 168059834
  misc_feature (1)..(210): Bit score of 364.0 for HMM based on sequences of Figure 12
  misc_feature (1)..(210): Functional Homolog Of SEQ ID NO. 580
MGGTLALRSCLAVVGLVLLWGCGAQAVQFEVSARTTKCIAEEIQNNVVVIADYKIVHSDESHTITVKVTSPYGNQLHYQENVKSGQFAFTTSETGNFMACFWMLNAPATAVANVALDWKTGVHAKDWASIAKKDKLDGMELELRKLEEAVNSIHSEMLYLREREAEMRNLNELTNSRVAWFGIMSLLVCLGVAGWQLWHLKSFFERKKLL

SEQ ID NO: 630 - protein, 229 aa, Zea mays
  misc_feature (36)..(224): Pfam Name: EMP24_GP25L Pfam Description: emp24/gp25L/p24 family/GOLD
  misc_feature (1)..(229): Bit score of 586.6 for HMM based on sequences of Figure 12
  misc_feature (1)..(229): Functional Homolog Of SEQ ID NO. 580
MVARRLGSPACRWLRPSALLLLVASALLSAPSPARALRFDLESGHTKCISDEIKVNAMAVGKYHIVSPDPNFPDAQLPESHRISLRVTSPYGNSMHYAENVQSGHFAFTAAEAGDYLACFWAPDHKPPVTIGFEFDWRSGVSAKDYPSVAKKGKVDMMELELKKLEETIKNIHEEMFYLREREEEMQDLNRRTNSRMAWLGFLSLGVCLSVAGLQLWHLKTFFERKKLL

SEQ ID NO: 631 - protein, 228 aa, Triticum aestivum
  misc_feature (35)..(223): Pfam Name: EMP24_GP25L Pfam Description: emp24/gp25L/p24 family/GOLD
  misc_feature (1)..(228): Bit score of 586.5 for HMM based on sequences of Figure 12
  misc_feature (1)..(228): Functional Homolog Of SEQ ID NO. 580
MAAARPGSPAPRRLPPSTLLLLAAVLLAASPPARALRFDLESGHTKCISDEIKVDSMAVGKYSVVAPDPSYPDAQLPESHRVSLRVTSPYGNSMHYSENVQSGHFAFTAVEAGDYLACFWAPDHKPPVTVTFEFDWKSGVTAKDWSNVAKKGKVDMMELELKKLEDTIKSIHEEMFYLREREEEMQNINRQTNSRMGWLSFLSLGICLSVAGLQLWHLKTFFERKKLL

SEQ ID NO: 632 - protein, 232 aa, Oryza sativa
  misc_feature (28)..(227): Pfam Name: EMP24_GP25L Pfam Description: emp24/gp25L/p24 family/GOLD
  misc_feature (1)..(232): Bit score of 518.0 for HMM based on sequences of Figure 12
  misc_feature (1)..(232): Functional Homolog Of SEQ ID NO. 580
MAARSLHHLLLLLFLAGFHSLSLSPAAALRFDLQSGHTKCISDDIKVGAMAVGKYHVVVPEGGGSTSSSSSSSSSAQPLLPESHRVSLRVTSPYGNSLHYSENVQSGNFAFTTSEAGDYLACFWAPDHRPTATVGFEFDWRSGVSARDWTNVAKKGQVDMMEVELKKLEDTINSIHEEMFYLRAREEEMQELNRRTNSRMAWLGFFSLAICLSVAGLQLWHLKNFFERKKLL

SEQ ID NO: 633 - DNA, 1038 bp, Gossypium hirsutum
  misc_feature (1)..(1038): Ceres Clone ID no. 1841236
  misc_feature (1)..(1038): Encodes the peptide sequence at SEQ ID NO. 634
attgccagaccttgaaaaagcttacaattttttttttatatataatttctgctggaaaaaaacccagttcccttttcagttcttggtaccttggctgaccatttttgtgttaccagggtttagccattacttttcatttgaagctgtcctccccattgtttttaaggtcatatattatatattatcagcacaaaaagaaaaaaatgggtctctcaagtcttccagctccatcagaaggagtgttatgtatactcttggtaaacacagctttatctatatctatagttaaaggcataatccgatcgatccttcacgttgtcggtatccatctcccacaaccaccatcggattacactgaaaatccctcggaagcgaatgatttccaccttaatactcctgaaagttacatcgaggaattccggagtaggaccccaacaattcatttcggtgctgttttatgtagctgcaaacggcctcagcacgactgtcgggtttgtctgactcagtttgagccaaaatccgagattaaccacttgtcgtgtggtcatctctttcacaaggtgtgtttggaaaaatggttggattattggaatattacatgccctctttgcaggactcctttgttgactgaagaagaagcttcttgcttttggtaagaagattattaccaagtatattattatgcagagttgaggaattcccgtgtacagcgcggtatataaaaatatactgttatctttatcattctgggttttgtgataggcaagcgagtgttgtcgttacccgcaagtttgtaccttgctgtggtgatttgtgttatttgaatcaatgcacatattgttgtctgggttaatgatatgttattatatgcagtctcacacttgtttcttgatcatccacatatatatagttcatggagattttgtttaattttttgcctttttatgcaatgggaaagattgaaaattgagttaggaagttgctgggactaaaatctgtttgacaggatctgccttgtaatgaacttagctgttctat

SEQ ID NO: 634 - protein, 150 aa, Gossypium hirsutum
  misc_feature (95)..(136): Pfam Name: zf-C3HC4 Pfam Description: Zinc finger, C3HC4 type (RING finger)
  misc_feature (1)..(150): Ceres Clone ID no. 1841236
  misc_feature (1)..(150): Ceres SEED LINE ID no. CW00741
  misc_feature (1)..(150): Bit score of 328.8 for HMM based on sequences of Figure 15
  misc_feature (1)..(150): in Figure 15
MGLSSLPAPSEGVLCILLVNTALSISIVKGIIRSILHVVGIHLPQPPSDYTENPSEANDFHLNTPESYIEEFRSRTPTIHFGAVLCSCKRPQHDCRVCLTQFEPKSEINHLSCGHLFHKVCLEKWLDYWNITCPLCRTPLLTEEEASCFW

SEQ ID NO: 635 - DNA, 462 bp, Populus balsamifera subsp. trichocarpa
  misc_feature (1)..(462): Ceres Annot ID no. 1525600
  misc_feature (1)..(462): Encodes the peptide sequence at SEQ ID NO. 636
atgggtctatcaagtctgccagctccatctgaaggagtattatgtgtgcttttagtaaacactgccttgtcaatttccattgtcaaaggaatagtccgttcaatccttcatattgttggcatccgtttgtcaccatctgcatcactcccatcgtcagataatgctgaagacaccagagagtcgcttgaatttcgtttaagtcccccagagaattacattgaggagttccgaagcaggatgccatcaatccgattcaacacggtgtgcagctgtgaacagcctgaacatgactgctcggtttgcctgacccaatttgagccagaatcggagataaatagcctgtcatgtggccatatctttcataaaatgtgcttggagaagtggttggactattggaacattacatgccctctttgcaggactcctttgctgcctgaagaggatgcatcttgcttttggtga

SEQ ID NO: 636 - protein, 153 aa, Populus balsamifera subsp. trichocarpa
  misc_feature (98)..(139): Pfam Name: zf-C3HC4 Pfam Description: Zinc finger, C3HC4 type (RING finger)
  misc_feature (1)..(153): Ceres Annot ID no. 1525600
  misc_feature (1)..(153): Bit score of 349.5 for HMM based on sequences of Figure 15
  misc_feature (1)..(153): Functional Homolog Of SEQ ID NO. 634
  misc_feature (1)..(153): in Figure 15
MGLSSLPAPSEGVLCVLLVNTALSISIVKGIVRSILHIVGIRLSPSASLPSSDNAEDTRESLEFRLSPPENYIEEFRSRMPSIRFNTVCSCEQPEHDCSVCLTQFEPESEINSLSCGHIFHKMCLEKWLDYWNITCPLCRTPLLPEEDASCFW

SEQ ID NO: 637 - DNA, 1225 bp, Glycine max
  misc_feature (1)..(1225): Ceres Clone ID no. 473509
  misc_feature (1)..(1225): Encodes the peptide sequence at SEQ ID NO. 638
gccttcgttttcaggtttcttcttttggtcatctaggaattttgtgtttatgttcaaaattgctagatcgtgtgttggggttggggtggtgttctgtggacatgtcagatattaaagaagaaaccaacagagtttccattctcggtatctcttctctgatcaggttgacaacttgacatagcaatcctgctttcttggttccccatttccatgtttgtggattcttcctgattcaaaggcaatccattgtgtcttcttagctcagttttgagcttcaaaagttacaacttgcaacacaaatttttatctgtaactttggtaatcctaaaggactcagcattgatcaaaatgggcctttcaagtctcccagcaccatctgaaggagtattatgtgtccttctggtgaacactgtattgtcaatttcaatattcaaaggcattgttaggacaatcctacacattgttggcatccatctttcatcatcatcctccacttcaccctcttcaccggatccctcgctaaccgcacctgagtcatttgaattccatcttagtccctctgagagttacattgaagagttcagaagccggacgccaacacttcggttcgacagtgtgtgctgctgtaaacaacctgagcatgactgctctgtatgcctcactcagtttgaaccggaatcggagataaaccgcttatcgtgcggccatctcttccacaaagtgtgcttagagaagtggctggactactggaacattacatgccctctttgcaggactcccttgatgcctgaagatgacacaccttgctttcagtaagcaaaaacaagggagcatggcaataagagagagtttcatgtacagtgtagtgtacatattcttgagggtttttgatgttcatgcatctgagttctgccacctttataagtttttaacctttttccttttatggtctgagtttgtggaggattttgtttttccctttttctgtctgtgctctttagcacacatgaggggtatactttttgcttgcatgttatgtttgttcacaatgcccacctggtttagacctccttaaattctatatttgggcattttgatcctaatttggaagcatggattgtagaatccatttgttttgcctttcaaactctcatcaccatgtgtatatatagtgtatgtgtgtaaatagctgtggtcggcaataaaattcagtcatcactaaacg

SEQ ID NO: 638 - protein, 155 aa, Glycine max
  misc_feature (100)..(141): Pfam Name: zf-C3HC4 Pfam Description: Zinc finger, C3HC4 type (RING finger)
  misc_feature (1)..(155): Ceres Clone ID no. 473509
  misc_feature (1)..(155): Bit score of 342.1 for HMM based on sequences of Figure 15
  misc_feature (1)..(155): Functional Homolog Of SEQ ID NO. 634
  misc_feature (1)..(155): in Figure 15
MGLSSLPAPSEGVLCVLLVNTVLSISIFKGIVRTILHIVGIHLSSSSSTSPSSPDPSLTAPESFEFHLSPSESYIEEFRSRTPTLRFDSVCCCKQPEHDCSVCLTQFEPESEINRLSCGHLFHKVCLEKWLDYWNITCPLCRTPLMPEDDTPCFQ

SEQ ID NO: 639 - DNA, 489 bp, Arabidopsis thaliana
  misc_feature (1)..(489): Ceres Annot ID no. 550729
  misc_feature (1)..(489): Encodes the peptide sequence at SEQ ID NO. 640
atgggtctatcaagtcttcctggtccatcagaaggaatgttatgtgtgatattagttaatacagcattatcgatctccattgtcaaaggcattgtaagatcattccttggcatagtaggaatcagtctctcgccgtcttcatcctcgccttcttcggtgacggtatcttcagagaattcatcaacttcagagtcatttgatttccgggtctgccaaccagagagttaccttgaggagttcaggaaccggactccgacactgaggtttgagagcttgtgcaggtgcaagaaacaggcagacaatgagtgttctgtgtgtttgtcgaaattccaaggggattcagagatcaacaagctcaagtgcggccatttgtttcacaaaacatgcttggagaaatggatagactattggaacatcacttgcccattgtgtaggactcctcttgttgttgtgccagaagaccatcagctttcttctaatgtttggtga

SEQ ID NO: 640 - protein, 162 aa, Arabidopsis thaliana
  misc_feature (103)..(144): Pfam Name: zf-C3HC4 Pfam Description: Zinc finger, C3HC4 type (RING finger)
  misc_feature (1)..(162): Ceres Annot ID no. 550729
  misc_feature (1)..(162): Bit score of 330.2 for HMM based on sequences of Figure 15
  misc_feature (1)..(162): Functional Homolog Of SEQ ID NO. 634
  misc_feature (1)..(162): in Figure 15
MGLSSLPGPSEGMLCVILVNTALSISIVKGIVRSFLGIVGISLSPSSSSPSSVTVSSENSSTSESFDFRVCQPESYLEEFRNRTPTLRFESLCRCKKQADNECSVCLSKFQGDSEINKLKCGHLFHKTCLEKWIDYWNITCPLCRTPLVVVPEDHQLSSNVW

SEQ ID NO: 641 - DNA, 971 bp, Triticum aestivum
  misc_feature (1)..(971): Ceres Clone ID no. 633470
  misc_feature (1)..(971): Encodes the peptide sequence at SEQ ID NO. 642
ctcactgtatccatcccaccacacccacaccgcaccgctccctcgcccagaccaccccgaaagaaggcgcaaattgcagacgggtccccggatcgatccccattcctcctccaggccgccgcgatgggcatctccagcatgccggcgcccaaggagagcctcctgatctacctgctctaccacgccgtcgtctcgatcgccgccctggcgggcctcctccgcgccgcgctcgtcttcctcggcctgcccgcgccgccctcgctgctggccggggaggacgccgacggcgccgaccagctcacggccgccaccccggcgggccccagcctggccgagaggttcaggagcaggttccgccccgcgcggttcggccggaggcggggcgcggcggcctcgccgacgcccgactgccgcgtctgccttgttcgcttcgaggcggacgccgtggtgaaccgcctgccctgtggccacctcttccaccgcgcctgcctcgagacctggctggactacgaccacgccacctgcccgctctgccgctcccggctcctcccggccgccaccaccgccgccgacgagtcgtggtcgccgccggcccccaccctgacggcctggatttagggacgagtggagggaagagaagagagagattcgccccgtcgcgtcgcccccggctatgtgctagctccgtgtgtggcctctccgtgtgcgcgtaggaatttagatggatcctagcagagggctcttatgcccctcgcctttcgcatttgccttttggtttcgttttctgtacgcctcgtgccatcgctgtaccctgtaaatatttttcagcagagagcgctcccaccgggtgtagcgctttgtgtgatgagaaatctgtgtacggctctcggctttttttacgagaaacggaaaattgatggaacaaggattgtgtgtcttatgaacaccagagggccggtgttcttgcttgc

SEQ ID NO: 642 - protein, 164 aa, Triticum aestivum
  misc_feature (96)..(137): Pfam Name: zf-C3HC4 Pfam Description: Zinc finger, C3HC4 type (RING finger)
  misc_feature (1)..(164): Ceres Clone ID no. 633470
  misc_feature (1)..(164): Bit score of 343.2 for HMM based on sequences of Figure 15
  misc_feature (1)..(164): Functional Homolog Of SEQ ID NO. 634
  misc_feature (1)..(164): in Figure 15
MGISSMPAPKESLLIYLLYHAVVSIAALAGLLRAALVFLGLPAPPSLLAGEDADGADQLTAATPAGPSLAERFRSRFRPARFGRRRGAAASPTPDCRVCLVRFEADAVVNRLPCGHLFHRACLETWLDYDHATCPLCRSRLLPAATTAADESWSPPAPTLTAWI

SEQ ID NO: 643 - protein, 167 aa, Oryza sativa subsp. japonica
  misc_feature (100)..(141): Pfam Name: zf-C3HC4 Pfam Description: Zinc finger, C3HC4 type (RING finger)
  misc_feature (1)..(167): Public GI ID no. 115477050
  misc_feature (1)..(167): Bit score of 359.3 for HMM based on sequences of Figure 15
  misc_feature (1)..(167): Functional Homolog Of SEQ ID NO. 634
  misc_feature (1)..(167): in Figure 15
MGISSMPAPKDSVVAYLLYNTAVSIAILADMVRAALVFLGLPVPPSAWEDGDDQLAAIAAAAAAAAAAAGGPSLADRFRSRFRPARFGRRRGGGAGAADCRVCLARFEPESVVNRLPCGHLFHRACLEKWLDYDHATCPLCRHRLLPATTESPSPSPATATPHFARI

SEQ ID NO: 644 - DNA, 1031 bp, Panicum virgatum
  misc_feature (1)..(1031): Ceres Clone ID no. 1790901
  misc_feature (1)..(1031): Encodes the peptide sequence at SEQ ID NO. 645
aatccaccactatcatcccaatctttctcctcccgcatcgcacccacctcccctacccgaaaaacccccaaattgcaatcaggtcccaggcgggctcctccccaaatccgcaacccagctcgacgaaattggcgaattcatcgagggagcctgacggatcgggcggcgaggatgggcatctcgagcatgccgacgcccaaggacagcctgatggggttcgtgctgtacaacacggcggtgtcggtggcgatcctggcggggctggtgcgcgcggcgttggtgttcctgggcctggcggcgccgtcgccgtgggagggcctcgccgctgacgagcaccaccaccaccgccaggtggtgtcgtcgacctcgcccctggggccgagcctcgcggatcggttccggagccgggtccgcccgtcgcggttcgggcggcggcgcggcggcgccggcgccggcgcagactgccgcgtgtgcctggcccggttcgagccggagtcggtggtgaaccggctcccctgcgggcacctcttccaccgggcctgcctcgagacctggctggactacgaccacgccacctgcccgctctgccgcctccgcctcctcccccccgccgccgacgacgactacgcggccgtggcggcgggcctggccgcccggttttaggagggatctccaggaggccaccgggggccgcggccgggtcggtgcggccctgccgcgtgcgcgtaggaattcgagaggcaggcagaggctccgttagctctagtgctccgctcccaattagtagcgcctttccttttttttttttcatgtgtttttcctctccccccaccatttcgtgctcctttttttttccttctttcgttttcgtcgctcgcgcttgcagctgtaccgtttgtaaatattcgcagcgtgctccgatggtgttgcacttgcagtactgtgtacaggcttttcgaaagcgaagagatgagaagaagaaaaaaaatgggaaaaaattgatcaagaaaaagccgatccccttttgcttt

SEQ ID NO: 645 - protein, 163 aa, Panicum virgatum
  misc_feature (98)..(139): Pfam Name: zf-C3HC4 Pfam Description: Zinc finger, C3HC4 type (RING finger)
  misc_feature (1)..(163): Ceres Clone ID no. 1790901
  misc_feature (1)..(163): Bit score of 349.7 for HMM based on sequences of Figure 15
  misc_feature (1)..(163): Functional Homolog Of SEQ ID NO. 634
  misc_feature (1)..(163): in Figure 15
MGISSMPTPKDSLMGFVLYNTAVSVAILAGLVRAALVFLGLAAPSPWEGLAADEHHHHRQVVSSTSPLGPSLADRFRSRVRPSRFGRRRGGAGAGADCRVCLARFEPESVVNRLPCGHLFHRACLETWLDYDHATCPLCRLRLLPPAADDDYAAVAAGLAARF

SEQ ID NO: 646 - DNA, 504 bp, Sorghum bicolor
  misc_feature (1)..(504): Ceres Annot ID no. 8714668
  misc_feature (1)..(504): Encodes the peptide sequence at SEQ ID NO. 647
atgggcatctcgagcatgccggcgcccaaggacagcctgctggggttcgtgctgtacaacgcggcggcgtccgtcgcgatcctgtcgggtctggtgcgcgccgcgctgctcttcctgggcgtggcggcggcgccgtcgtcgtccccgtgggaagcgccggaggaggagcggcggcagcagcagcagggggcggtgagggtcacgcccgtggggcccaccctcgcggaccggttccggagcaggttccgtccgtcgcgcttcgggcggcgccgcggctgcggcggttcgggggactgccgcgtgtgcctggtgcggttcgagccggagtcggtggtcaaccggctcccctgcggccacctcttccaccgcgcatgcctcgagacctggctcgactacgaccacgccacctgcccgctctgccgtcaccgcctcctgccccccgccgcagacgacgacgagctcccccggatcgtcgcggcgccccgccgcctcgtccggttctag

SEQ ID NO: 647 - protein, 167 aa, Sorghum bicolor
  misc_feature (99)..(140): Pfam Name: zf-C3HC4 Pfam Description: Zinc finger, C3HC4 type (RING finger)
  misc_feature (1)..(167): Ceres Annot ID no. 8714668
  misc_feature (1)..(167): Bit score of 348.9 for HMM based on sequences of Figure 15
  misc_feature (1)..(167): Functional Homolog Of SEQ ID NO. 634
  misc_feature (1)..(167): in Figure 15
MGISSMPAPKDSLLGFVLYNAAASVAILSGLVRAALLFLGVAAAPSSSPWEAPEEERRQQQQGAVRVTPVGPTLADRFRSRFRPSRFGRRRGCGGSGDCRVCLVRFEPESVVNRLPCGHLFHRACLETWLDYDHATCPLCRHRLLPPAADDDELPRIVAAPRRLVRF

SEQ ID NO: 648 - DNA, 863 bp, Gossypium hirsutum
  misc_feature (1)..(863): Ceres Clone ID no. 1808334
  misc_feature (1)..(863): Encodes the peptide sequence at SEQ ID NO. 649
attgccagaccttgaaaaatcttacaattttttttatataatttctgttagaaaaaaacccagttcacttttcagttcttggtaccttggctgaccatttttgtttgaattgcaggttaccagggtttagccattgcttttcatttgaagctctcctccccattgtttttaaggtcatatatttattatatattatcagcacaaaaagaaaaaaatgggtctctcaagtcttccagctccatcagaaggagtgttatgtatactcttggtaaacacagctttatctatatctatagttaaaggcataatccgatcgatccttcacgttgtcggtatccatctcccaccaccatcatcggattacactgaaaatctctcggaatcattcgatttccaccttaatactcctgaaagttacattgaggaattccggagtaggaccccaacaattcatttcggtgctgttgtatgtagctgcaaacggcctcagcacgactgtcaggtttgtctgactcagtttgagccaaaatccgagattaaccacttgtcgtgtggccatctctttcacaaggtgtgtttggaaaaatggttggattattggaatattacatgccctctttgcaggactcccttgttgcctgaagaagaagcttcttgctttttgtaagaagattattatcaagtatattattatgcagagttgaggaattcccgtgtacagcgcggtatataaaagtatactgttatctttatcgagtgttgtcgttacccgcaagtttgtaccttgctgtggtgatttgtgttatttgaatcaatgcacatattgttgtctgggttaatgatatgttattatatgcagtctc

SEQ ID NO: 649 - protein, 150 aa, Gossypium hirsutum
  misc_feature (95)..(136): Pfam Name: zf-C3HC4 Pfam Description: Zinc finger, C3HC4 type (RING finger)
  misc_feature (1)..(150): Ceres Clone ID no. 1808334
  misc_feature (1)..(150): Bit score of 324.5 for HMM based on sequences of Figure 15
  misc_feature (1)..(150): Functional Homolog Of SEQ ID NO. 634
MGLSSLPAPSEGVLCILLVNTALSISIVKGIIRSILHVVGIHLPPPSSDYTENLSESFDFHLNTPESYIEEFRSRTPTIHFGAVVCSCKRPQHDCQVCLTQFEPKSEINHLSCGHLFHKVCLEKWLDYWNITCPLCRTPLLPEEEASCFL

SEQ ID NO: 650 - DNA, 717 bp, Populus balsamifera subsp. trichocarpa
  misc_feature (1)..(717): Ceres Annot ID no. 1472192
  misc_feature (1)..(717): Encodes the peptide sequence at SEQ ID NO. 651
atgggtctatcaagtctgccagctccatctgaaggagtattatgtgtgcttttagtaaacactgccttgtcaatttccattgtcaaaggaatagtccgttcaatccttcatattgttggcatccgtttgtcaccatctgcatcactcccatcgtcagataatgctgaagacaccagagagtcgcttgaatttcgtttaagtcccccagagaattacattgaggagttccgaagcaggatgccatcaatccgattcaacacggtgtgcagctgtgaacagcctgaacatgactgctcggtttgcctgacccaatttgagccagaatcggagataaatagcctgtcatgtggccatatctttcataaaatgtgcttggagaagtggttggactattggaacattacatgccctctttgcaggactcctttgctgcctgaagaggatgcatcttgcttttgcgtgtacatgtatttacgtgagtgcatcgggcagggcatagtggcaatgccagataaccagggttctttctactttatggcatggagtcaaaaacatcaatttagggccgtttcatctcccaataaaaactgggtctcatcttgtttcatcgagctgcttcccgacactgctcgtgctaatggagaacctggctggacttcccttcacaagaactgcgaagtaaggcatgacatcagaagatgtggaagctggtcctga

SEQ ID NO: 651 - protein, 238 aa, Populus balsamifera subsp. trichocarpa
  misc_feature (98)..(139): Pfam Name: zf-C3HC4 Pfam Description: Zinc finger, C3HC4 type (RING finger)
  misc_feature (1)..(238): Ceres Annot ID no. 1472192
  misc_feature (1)..(238): Bit score of 344.9 for HMM based on sequences of Figure 15
  misc_feature (1)..(238): Functional Homolog Of SEQ ID NO. 634
MGLSSLPAPSEGVLCVLLVNTALSISIVKGIVRSILHIVGIRLSPSASLPSSDNAEDTRESLEFRLSPPENYIEEFRSRMPSIRFNTVCSCEQPEHDCSVCLTQFEPESEINSLSCGHIFHKMCLEKWLDYWNITCPLCRTPLLPEEDASCFCVYMYLRECIGQGIVAMPDNQGSFYFMAWSQKHQFRAVSSPNKNWVSSCFIELLPDTARANGEPGWTSLHKNCEVRHDIRRCGSWS

SEQ ID NO: 652 - DNA, 1569 bp, Glycine max
  misc_feature (1)..(1569): Ceres Clone ID no. 1662527
  misc_feature (1)..(1569): Encodes the peptide sequence at SEQ ID NO. 653
atgagtcatgagatacacttttcagttcatgaaacacaacagtaatcctcaaattctctctctgtaagttccaaaacaacattctttttcttttattttcttcagtgtgtttaatgtttttctcctgtctcaacatccaacatgacgattccatgaaatggtagattctaaattagcatcatgctctgtggatatgtctttttttatgattcttttttattttcattttaccttgatcagaagtattatggaccattttcttatgttcataaagttttgtttttggcagttcttgttcatgaaatccaatgcttctaatttaatccagattgctcaatttgcaaaatggaccctttggcttcaaatttaaacagtcttctttgatcctgttttcgatgttctttctattagttaatttgattatggggacgcagactttctttcaatttttctttctttgtagctgtttttctcccctagtaaaatatgactactttttagtctgaaccatcaaattcaatggtcccttttgtgtttaataagattgtaatcctatttccttatccaaacagaaatttaaactactaaatgaagaatctaaagaaaaccagttgtttagtctggattgaagcctaccctatttgtacaatcaattcccttgtcttgtttcaattttggtaagagtaccctttgatgtttctgcaggtaaataagagtttccattgatgaagttgacatagcaatttgttcattctgctggtttcagattcaaagagaaaaaatcatcatccacttgcaaccaacacaatttggtatcaaaatgggcctgtcaagtctcccagcaccatctgaaggagtgttatgtgtgcttcttgtaaacactgccttgtctatatccatattcaaaggcattgttaggacaattctacaaattgtcggtatccgcgtttcgtcgttgtctccttcaccagacatctcccgaaacccacctgagccattagaattcaacctcagcccctcggagggtttcattgaagagttcagaagcaggacaccaacacttaggtttggcagcatgtgtggcagtaaacaacctcaacatgaatgttgttgtgtgtgtctcacaaagtttgaaccagaatctgagataaactgtttatcatgtggccatatttttcacaaagtgtgcatggagaagtggttggactattggaacattacatgcccactttgcaggacttccttgatgcctgaagatgatgcatcttgcttttggtaaaaaaaacatgtacatataaaagaaaagagatatattcatgtacagtatatattgtatgtacatagttgtggcagtgttgatgttcccttggtcttggctctaacttttttaaccctttacttttttatgattgttaaagtgtgtggagggtcttgttttcctttgtttctctgtatctggtgttgccacatatgagtcgagggatctacttttttgggataattgtgtttgtccataatatcctcttgatatgtaaacagacatcatatacagacccttttgcttttgcc

SEQ ID NO: 653 - protein, 152 aa, Glycine max
  misc_feature (97)..(138): Pfam Name: zf-C3HC4 Pfam Description: Zinc finger, C3HC4 type (RING finger)
  misc_feature (1)..(152): Ceres Clone ID no. 1662527
  misc_feature (1)..(152): Bit score of 293.8 for HMM based on sequences of Figure 15
  misc_feature (1)..(152): Functional Homolog Of SEQ ID NO. 634
MGLSSLPAPSEGVLCVLLVNTALSISIFKGIVRTILQIVGIRVSSLSPSPDISRNPPEPLEFNLSPSEGFIEEFRSRTPTLRFGSMCGSKQPQHECCCVCLTKFEPESEINCLSCGHIFHKVCMEKWLDYWNITCPLCRTSLMPEDDASCFW

SEQ ID NO: 654 - DNA, 884 bp, Brassica napus
  misc_feature (1)..(884): Ceres Clone ID no. 952050
  misc_feature (1)..(884): Encodes the peptide sequence at SEQ ID NO. 655
atccatctctcacttctcagattcccatcactattttcaacagaaactcaaaactttataataaagattcaatctttcgtttaattggtgatcatcgcctctcatacttgtctccagatcacatctctctgagaagaacaaagatctgatcggcttccgagaattacatattgtttgaaacatccaaaagagttgaaagatgggtctatcaagccttcctggtccatcagaaggaatgctatgcgtgatattagttaacacagcattgtcaatctccatcttcaaaggcattctcaggtcagtgcttcagctaataggaatccgcctctctccttcttcagcagcagcagcagctgcatcttcagagaatcaaacttcagattcttttgatttccgggtctgccagcctgagagtttccttgaggaattcaggaacaggacccccacagtgaagtttgagagcttgtgcaagtgcaagaaacaggcggacaacgagtgttctgtatgcctgtcgaaattcgaagaggattcagagatcaacaagctaaaatgtggccatttgtttcacaaaacatgcttggagaaatggatagactactggaacatcacttgcccactctgtaggactcctcttgttgttgtcgcagcagacgaccagctggtttcctctaatgtttggtgactacttttctttgtatagagttttccttggggttgggtgtgtttgttgttgtgtacagctactactactttttactatgaaattaggctgcgtcacggttgattctttatcagattcagaccggagatgggggtattctgatgtacatattctgtgagctgtttatgtatgtagacccatgtgtaatggaagctcttgtttg

SEQ ID NO: 655 - protein, 160 aa, Brassica napus
  misc_feature (100)..(141): Pfam Name: zf-C3HC4 Pfam Description: Zinc finger, C3HC4 type (RING finger)
  misc_feature (1)..(160): Ceres Clone ID no. 952050
  misc_feature (1)..(160): Bit score of 313.0 for HMM based on sequences of Figure 15
  misc_feature (1)..(160): Functional Homolog Of SEQ ID NO. 634
MGLSSLPGPSEGMLCVILVNTALSISIFKGILRSVLQLIGIRLSPSSAAAAAASSENQTSDSFDFRVCQPESFLEEFRNRTPTVKFESLCKCKKQADNECSVCLSKFEEDSEINKLKCGHLFHKTCLEKWIDYWNITCPLCRTPLVVVAADDQLVSSNVW

SEQ ID NO: 656 - DNA, 902 bp, Triticum aestivum
  misc_feature (1)..(902): Ceres Clone ID no. 1460088
  misc_feature (1)..(902): Encodes the peptide sequence at SEQ ID NO. 657
actgtatccatcccaccacaccagcaccacagccgctcagaccaaaccgcccctgaaagaaggcgcaaattgcagacgggtccacggatcgatccccaatcctccaggccgccgcgatgggcatctccagcatgccggcgcccaaggagagcctcctgatctacctgctctaccacgccgtcgtctcgatcgccgccctggcgggcctcctccgcgccgcgctcgtcttcctcggcctgcccgcgccgccgtcgctgctggccggcgaggacgccgacggtgccgaccagctcacggcggccaccccggcgggccccagcctggccgagaggttcaggagcaggttccgccccgcgcggttcggccgcaggcggggcgcggcggcggtgcctgactgccgcgtctgcctggtgcgcttcgaggcggacgccgtggtgaaccgcctcccctgtggccacctcttccaccgtgcctgcctcgagacctggctggactacgaccacgccacctgcccgctctgccgctcccgcctcctcccggccgccgcggccgccgacgagtcgtggtcgccgccggcccccaccctgacggcctggatttagggacgagtgaagagaagagaagagaagagagattcgccccgtcgcgtcgcccccggctatgtgctagctccgtgtgtggcctctccgtgtgcgcgtaggaatttagatggatcctagcagagggctctgctcctcgcctttcgcatttgccttttggtttcgttttctgtacgcctcgtgccatcgctgtaccgtgtaaatatttttcagcagagagcgctcctacgggtgtagcgctttgtgtgatgagaaatttgtgtacggccttcggctttttttacgagaaacggaaaattgatg

SEQ ID NO: 657 - protein, 161 aa, Triticum aestivum
  misc_feature (94)..(135): Pfam Name: zf-C3HC4 Pfam Description: Zinc finger, C3HC4 type (RING finger)
  misc_feature (1)..(161): Ceres Clone ID no. 1460088
  misc_feature (1)..(161): Bit score of 338.7 for HMM based on sequences of Figure 15
  misc_feature (1)..(161): Functional Homolog Of SEQ ID NO. 634
MGISSMPAPKESLLIYLLYHAVVSIAALAGLLRAALVFLGLPAPPSLLAGEDADGADQLTAATPAGPSLAERFRSRFRPARFGRRRGAAAVPDCRVCLVRFEADAVVNRLPCGHLFHRACLETWLDYDHATCPLCRSRLLPAAAAADESWSPPAPTLTAWI

SEQ ID NO: 658 - DNA, 1010 bp, Panicum virgatum
  misc_feature (1)..(1010): Ceres Clone ID no. 1816723
  misc_feature (1)..(1010): Encodes the peptide sequence at SEQ ID NO. 659
accactaccatcccaatctctctcctcccgcatcgcatcgcatcgcacccacctcccctatccggaaaacccccaaattgcaatcaggtcccaagcgggctcctcccccaaatccgcaacccaggcacccagctcgaggaaattcgagaattcatcgacggagcctgacggatcgggcggcgaggatgggcatctcgagcatgccgacgcccaaagacagcctgatggggttcgtcctgtacaacacggcggtgtcggtggcgatcctggctgggctggtgcgcgcggcgctggtgttcctgggcctggcggcgccgtctccgtgggagggcctcgccgccggcgagcaccaccaccgccgccaggtggtgtcgtcgatctcgcccctggggccgagcctcgcggaccggttccggagccggttccgcccgtcgcggttcgggcggcggcgcggcggcgccggcgcggactgccgcgtgtgcctggcccggttcgagccggagtcggtggtgaaccggctcccctgcgggcacctcttccaccgggcctgcctcgagacctggctggactacgaccacgccacctgcccgctctgccgcctccgcctcctcccccccgccgccgacgacgactacgcggccgtggcggcggcggcggccgtccggttttaggagagatctccaggaggccaccgggggccgggccggatcggcgcggccccgccgcgtgcgcgtaggaattcgagaggcaggcagaggctccattagctctagtgctccgctcccaattagtagctccttcctttttttttcatgtgttcttcctttttttttttcgtgctccctttttcccttctttcgttttcgtcgctctcgcttgctgctgtaccgtttgtaaatattcgcagcgtgctccgatggtgtagcacttgcagtactgtgtacaggcttttcgaaagcgaagagatgagaagaacaagtggtgtgtatagatcccacaaattttccatc

SEQ ID NO: 659 - protein, 161 aa, Panicum virgatum
  misc_feature (96)..(137): Pfam Name: zf-C3HC4 Pfam Description: Zinc finger, C3HC4 type (RING finger)
  misc_feature (1)..(161): Ceres Clone ID no. 1816723
  misc_feature (1)..(161): Bit score of 335.9 for HMM based on sequences of Figure 15
  misc_feature (1)..(161): Functional Homolog Of SEQ ID NO. 634
MGISSMPTPKDSLMGFVLYNTAVSVAILAGLVRAALVFLGLAAPSPWEGLAAGEHHHRRQVVSSISPLGPSLADRFRSRFRPSRFGRRRGGAGADCRVCLARFEPESVVNRLPCGHLFHRACLETWLDYDHATCPLCRLRLLPPAADDDYAAVAAAAAVRF

SEQ ID NO: 660 - DNA, 837 bp, Zea mays
  misc_feature (1)..(837): Ceres Clone ID no. 374439
  misc_feature (1)..(837): Encodes the peptide sequence at SEQ ID NO. 661
cttccactgcaggttcctaacccccacccacctcgcccaaattgcaaccttccccgagtgctccaggtcccgtggccggcccccagatcctctccaatcccaatccaagtatcgaacggatcccatcggtggcgctcgagcgagcgagtgcggccggaaccgagcgaagatgggcatctcgagcatgccggcgcccgaggacagcctgctggggttcgtgctgtacaacacggcggcgtcggtggcgatcctggcggggctggtgcgcgccgcgctgctgttcctgggcctggcggcggcggaggacgaggagccgcggcagcaggcggaggccgtgacggtcacggccgtggggcccagcctcgcggaccggttccggagcaggttccggccgtcgcgctacgggcggcgccggggcggggactgccgcgtgtgcctggtgcggttcgagacggagtcggtggtgcagcggctcccctgcggccacctcttccaccgcgcctgcctcgagacctggatcgactacgaccacgccacctgcccgctgtgccgccaccgcctcctgccccccgccgctgccgccgacgaggtgccccggattgcctgattagcgccctaggaattgagagtaggcgtagcactctgcacctcgcagcagcagtgtctctgtacaggtttttttttcttttcctttttgttcgggggagagagaggacagaacggagattgaaggaagaaaatggtggcaacaaagctgttccccctttcgtttctccgaagctctctgttgtctttattcattccaaaagtataatctactcgtatgaaccaagtacc

SEQ ID NO: 661 - protein, 145 aa, Zea mays
  misc_feature (86)..(127): Pfam Name: zf-C3HC4 Pfam Description: Zinc finger, C3HC4 type (RING finger)
  misc_feature (1)..(145): Ceres Clone ID no. 374439
  misc_feature (1)..(145): Bit score of 283.4 for HMM based on sequences of Figure 15
  misc_feature (1)..(145): Functional Homolog Of SEQ ID NO. 634
MGISSMPAPEDSLLGFVLYNTAASVAILAGLVRAALLFLGLAAAEDEEPRQQAEAVTVTAVGPSLADRFRSRFRPSRYGRRRGGDCRVCLVRFETESVVQRLPCGHLFHRACLETWIDYDHATCPLCRHRLLPPAAAADEVPRIA

SEQ ID NO: 662 - DNA, 1752 bp, Panicum virgatum
  misc_feature (1)..(1752): Ceres Clone ID no. 1791384
  misc_feature (1)..(1752): Encodes the peptide sequence at SEQ ID NO. 663
aaaacctcctccgcctccgcctccgcctcatcctcctgctccgccacttccaagccccgcgggcgccgcattgctcgccgccgccgccgccttggttcctcttgcgcccccttctgtatttggtggtttggtctgggtttggttgcgaggagttgtttgatcggaggaggggaaaatgtgggtggagcgggtggtcggggagcgccggatgcgggagatccagcgcttcgcgcggaacgctaagctcaccgccgtctgcctcctcctcaccatcgtcgtgctccgcggctacgtcggcgccggccgctacggcacgccgcagcaggacctcatcgagctccgccagcacttcgtctcccacccgcaccgggcgctcgccgagcaccacgacgccaggtccaggggctccgccacaaccacctcgtcgtcctcctccggacgcggcgacgacgagcctgacccgccgccgaggacgctcagggacccgccctacacgctgggccccaagatctccgactgggacgagcagcgcgccgcctggcaccgccgccacccggagacgccgcccttcctcaacgacgtcaagccgcgggtgctgctcgtcaccggctcctcccccaagccctgcgagaaccccgtcggtgaccactacctcctcaagtccatcaagaacaagatcgactactgccgcgtccacggcatcgagatcttctacaacatggcgctgctcgacgccgagatggccggattctgggccaagctcccgctcatccgggcgctgctcctggcgcacccggaggtcgagttcctctggtggatggactccgacgccatgttcaccgacatggcattcgagctcccttgggagcgctacgggccgtacaacctcgtcatgcacggctgggacgagatggtctacgacgacaagaattggattgggctcaacacaggcagcttcttgctgcgcaattgccagtggtcgcttgatatgctggatacctgggcgccaatggggccaaagggccctgtccgcattgaggctggcaaggtgctgaccaagtccttgaaggatcggccagtatttgaggctgatgatcagtcggccatggtgtacatcctcgccactcagcgtgagaaatggggtgacaaggtgtaccttgagaatgggtactacctccacggctactggggcatcttggttgataggtatgaggagatgcttgagaattacaagccagggcttggggatcaccggtggccgctcgtcactcactttgtcggttgcaagccttgcggcaaatttggggactaccctgttgagcgttgtctcaaacagatggaccgtgcattcaattttggggataaccagatcttgcagatgtatgggttcacgcacaagtcgcttgcaagcaggagagtgaagaggatcaggaatgagactagtaacccactcgagatgaaggatgagcttgggttgctccaccccgcattcaaggctgtgaagacttccacatgataattagagtaccaattccacttgttattttgtttcttcgttctagatcctgttgggtctgaatctgaagtgttctttttgtagaatctggtgacaatgggagggttgggatcatgggatggatatgttataatgtaatgaaatgttaggataatgatgttatgtttatttgttggcataagttatgtcttacactcctagaaattgagttaatgaatgaactcaagttattggtc

SEQ ID NO: 663 - protein, 446 aa, Panicum virgatum
  misc_feature (136)..(380): Pfam Name: Glyco_transf_34 Pfam Description: galactosyl transferase GMA12/MNN10 fa
  misc_feature (1)..(446): Ceres Clone ID no. 1791384
  misc_feature (1)..(446): Bit score of 1221.1 for HMM based on sequences of Figure 7
  misc_feature (1)..(446): in Figure 7
MWVERVVGERRMREIQRFARNAKLTAVCLLLTIVVLRGYVGAGRYGTPQQDLIELRQHFVSHPHRALAEHHDARSRGSATTTSSSSSGRGDDEPDPPPRTLRDPPYTLGPKISDWDEQRAAWHRRHPETPPFLNDVKPRVLLVTGSSPKPCENPVGDHYLLKSIKNKIDYCRVHGIEIFYNMALLDAEMAGFWAKLPLIRALLLAHPEVEFLWWMDSDAMFTDMAFELPWERYGPYNLVMHGWDEMVYDDKNWIGLNTGSFLLRNCQWSLDMLDTWAPMGPKGPVRIEAGKVLTKSLKDRPVFEADDQSAMVYILATQREKWGDKVYLENGYYLHGYWGILVDRYEEMLENYKPGLGDHRWPLVTHFVGCKPCGKFGDYPVERCLKQMDRAFNFGDNQILQMYGFTHKSLASRRVKRIRNETSNPLEMKDELGLLHPAFKAVKTST

SEQ ID NO: 664 - DNA, 1341 bp, Sorghum bicolor
  misc_feature (1)..(1341): Ceres Annot ID no. 8641619
  misc_feature (1)..(1341): Encodes the peptide sequence at SEQ ID NO. 665
atgtgggcggagcgggtggtcggggagcgccggatgcggcagatccagcgcttcgcgcggaacgccaagctcaccgtcgtttgcctcctcctcaccgtcgtcgtgctccgcggcaccgtcggcgccggccgcttcggcacgccgcagcaggacctcatcgagctccgccagcacttcgtctcccacccgcaccgggcgctcgccgagcaccacgacgccaggtccagggcctccaccaccaccacgtcgtcctcctcctccgtccgccgcgacgacgagcccgacccgccgccgaggacgctcagggacccgccctacacgctgggccccaagatctccgactgggacgagcagcgcgccgcctggcaccgccgccacccggagacgccgcccttcctcaacgacatcaagccgcgggtgctgctcgtcacgggttcctcgcccaagccctgcgagaaccccgtcggggaccactacctcctcaagtccatcaagaacaagatggattactgccgcgtccacggcatcgaggtcttctacaacatggcgctgctcgacgccgagatggccggcttctgggccaaactcccgctcctgcgggcgctgctcctcgcgcacccggagttcgagttcatctggtggatggactctgacgccatgttcaccgacatggcattcgagctcccttgggagcgctacgggccatacaatctgatcatgcacggctgggacgagatggtctacgacgacaagaattggattgggctaaacaccggcagcttcttgctgcgcaactgccagtggtcacttgacatgctggatacctgggcgccaatggggccaaagggccctgtccgcattgaggctggcaaagtgctgaccaagtccttgaaggatcggccagtattcgaggccgatgatcagtcggccatggtgtacatcctcgcaacgcagcgcgagaagtggggtgataaggtttaccttgagaatgggtactaccttcatggctactgggggatcttggtcgacaggtatgaggagatgcttgagaattacaagccagggctcggcgatcaccggtggccgctcgtcacacactttgtcgggtgcaagccatgtggcaaatttggagactaccctgtcgagcgatgcctcaagaatatggatcgtgcgttcaattttggtgataaccagatcttgcagatgtatggattcactcacaagtcacttgcaagcaggagagtgaagaggatcaggaatgagaccagcaacccgcttgagacaaaggatgagcttgggttgcttcatccggcattcaaggctgtgaagacttccacatga

SEQ ID NO: 665 - protein, 446 aa, Sorghum bicolor
  misc_feature (136)..(380): Pfam Name: Glyco_transf_34 Pfam Description: galactosyl transferase GMA12/MNN10 fa
  misc_feature (1)..(446): Ceres Annot ID no. 8641619
  misc_feature (1)..(446): Bit score of 1220.3 for HMM based on sequences of Figure 7
  misc_feature (1)..(446): Functional Homolog Of SEQ ID NO. 663
  misc_feature (1)..(446): in Figure 7
MWAERVVGERRMRQIQRFARNAKLTVVCLLLTVVVLRGTVGAGRFGTPQQDLIELRQHFVSHPHRALAEHHDARSRASTTTTSSSSSVRRDDEPDPPPRTLRDPPYTLGPKISDWDEQRAAWHRRHPETPPFLNDIKPRVLLVTGSSPKPCENPVGDHYLLKSIKNKMDYCRVHGIEVFYNMALLDAEMAGFWAKLPLLRALLLAHPEFEFIWWMDSDAMFTDMAFELPWERYGPYNLIMHGWDEMVYDDKNWIGLNTGSFLLRNCQWSLDMLDTWAPMGPKGPVRIEAGKVLTKSLKDRPVFEADDQSAMVYILATQREKWGDKVYLENGYYLHGYWGILVDRYEEMLENYKPGLGDHRWPLVTHFVGCKPCGKFGDYPVERCLKNMDRAFNFGDNQILQMYGFTHKSLASRRVKRIRNETSNPLETKDELGLLHPAFKAVKTST

SEQ ID NO: 666 - DNA, 2075 bp, Zea mays
  misc_feature (1)..(2075): Ceres Clone ID no. 351171
  misc_feature (1)..(2075): Encodes the peptide sequence at SEQ ID NO. 667
attccaccgccttcctctctctctctcgcctcttcttcttcttcctcccctccccttctccccccatctgcggcggggttgattcgatttcgattcccttccccatccatcgcccacctcccctacagacagccaacgcaatccgctccccgaggcgcctccctgaccctgactccctccaccccacaacgtgcgcgctcactcgcgggcggggccgggccgggccggcaggcacactcaccgtcaccacccttattaattcctcttccgcgtccgcgcttcaaaacctcctcccgtcctccgcctcgtcccccctctaccactctccccagcaccccggcggccgcattgctcgccgcagcaccgtgtccgggtagggcccctctgggctcctgcatttcgattgcctcccctgcctgtgctttggtctgggccggttgcaaggagggggaagggagggaggatttaatttgatcggagggcgaaaatgtgggcggagcgggtggtcggggagcgacggatgcggcagatccagcgcttcgcgcggaacgccaagctcaccgtcgtatgcctcctcctcaccgtcgtcgtgctccgcggcaccgtcggcgccggccgcttcggcacgccgcagcaggacctcatcgagctacgccagcacttcgtgtcccacccgcaccgggcgctcgccgagcaccacgacgccaggtccagggcctccaccaccaccacatcgtcctcgtcctcctccgcccgccgcgacgacgaccccgacccgccgccgaggtcgctcagggacccgccctacacgctgggccccaagatcttcgactgggacgagcagcgcgccgcctggcaccgccgccacccggagacgccgcccttcctcaacgacatcaagccacgggtgctgctcgtcacggggtcctcgcccaagccctgcgagaaccccgtcggggaccactacctcctcaagtccatcaagaacaagatggactactgccgcgtccacggcatcgaggtcttctacaacatggcgctgctcgacgccgagatggcaggcttctgggccaagctcccgctcatgcgggcgctgctcctcgcgcacccggaggtcgagttcctctggtggatggactctgacgccatgttcactgacatggcattcgagctcccgtgggagcgctacgggccgtacaacctcatcatgcacggctgggacgagatggtctacgacgacaagaattggatcgggctcaacaccggcagcttcttgctgcgcaactgccagtggtcgcttgacatgctggatacctgggcgccaatggggccaaagggccctgtccgcattgaagccggcaaggtgctgaccaagtccttgaaggatcggccagtattcgaggccgacgatcagtcggccatggtgtacatcctcgcgacgcagcgcgagaaatggggtgataaggtttaccttgagaatgggtactacctccatggctactgggggatcttggtcgacaggtacgaggagatgcttgagaattacaagccagggctcggcgatcaccggtggccactcgtcacacactttgtcgggtgcaagccgtgtggcaaatttggagactaccctgtcgagcgatgcctcaagaatatggaccgtgcattcaattttggggataaccagatcttgcagatgtatgggttcacacacaagtcactagcaagcaggagagtgaagaggatcaggaacgagaccagcaacccacttgagacaaaggatgagcttgggttgcttcatccagcattcaaggctgtgaagacttccacatgataattagagtacaattcaacttgttattttcttggttcgttctagatcctgttgggtctaaatccaaagtgttctttttgtagaatcgggtgacaacagaagtttgggttggggttatgggatggatatctttgttgtaatgtgaggtgttaggagaattatgttatgtttatttattggcataagttatgtcttacgctcgtagaaacgagttaatggatgaactcaagttactggttgcatg

SEQ ID NO: 667 - protein, 447 aa, Zea mays
  misc_feature (137)..(381): Pfam Name: Glyco_transf_34 Pfam Description: galactosyl transferase GMA12/MNN10 fa
  misc_feature (1)..(447): Ceres Clone ID no. 351171
  misc_feature (1)..(447): Bit score of 1219.5 for HMM based on sequences of Figure 7
  misc_feature (1)..(447): Functional Homolog Of SEQ ID NO. 663
  misc_feature (1)..(447): in Figure 7
MWAERVVGERRMRQIQRFARNAKLTVVCLLLTVVVLRGTVGAGRFGTPQQDLIELRQHFVSHPHRALAEHHDARSRASTTTTSSSSSSARRDDDPDPPPRSLRDPPYTLGPKIFDWDEQRAAWHRRHPETPPFLNDIKPRVLLVTGSSPKPCENPVGDHYLLKSIKNKMDYCRVHGIEVFYNMALLDAEMAGFWAKLPLMRALLLAHPEVEFLWWMDSDAMFTDMAFELPWERYGPYNLIMHGWDEMVYDDKNWIGLNTGSFLLRNCQWSLDMLDTWAPMGPKGPVRIEAGKVLTKSLKDRPVFEADDQSAMVYILATQREKWGDKVYLENGYYLHGYWGILVDRYEEMLENYKPGLGDHRWPLVTHFVGCKPCGKFGDYPVERCLKNMDRAFNFGDNQILQMYGFTHKSLASRRVKRIRNETSNPLETKDELGLLHPAFKAVKTST

SEQ ID NO: 668 - protein, 448 aa, Oryza sativa subsp. japonica
  misc_feature (137)..(381): Pfam Name: Glyco_transf_34 Pfam Description: galactosyl transferase GMA12/MNN10 fa
  misc_feature (1)..(448): Public GI ID no. 108707680
  misc_feature (1)..(448): Bit score of 1208.3 for HMM based on sequences of Figure 7
  misc_feature (1)..(448): Functional Homolog Of SEQ ID NO. 663
  misc_feature (1)..(448): in Figure 7
MWVAERVVGERRMREIQRFARNAKLTVVCLLLTVVVLRGTVGAGKFGTPQQDLIELRHRFISHPHRALAEHHDALSRGGGSSSSSGRAAQRDDEPDPPPRTLRDPPYTLGPKISDWDEQRAAWHRRHPETPPFVNDVKPRVLLVTGSSPKPCENPVGDHYLLKSIKNKMDYCRVHGLEIFYNMALLDAEMAGFWAKLPLLRALLLAHPEIEFLWWMDSDAMFSDMAFELPWERYGPYNLIMHGWDEMVYDDKNWIGLNTGSFLLRNCQWSLDFLDTWAPMGPKGPVRIEAGKVLTKYLKDRPVFEADDQSAMVYILATEREKWGDKVYLENGYYLHGYWGILVDRYEEMLENYHPGLGDHRWPLVTHFVGCKPCGKFGDYPVERCLKQMERAFNFGDNQILQMYGFTHKSLGSRKVKRIRNETSNPLDVKDELGLLHPAFKAMKTTST

SEQ ID NO: 669 - protein, 461 aa, Arabidopsis thaliana
  misc_feature (148)..(392): Pfam Name: Glyco_transf_34 Pfam Description: galactosyl transferase GMA12/MNN10 fa
  misc_feature (1)..(461): Public GI ID no. 18411962
  misc_feature (1)..(461): Bit score of 1280.3 for HMM based on sequences of Figure 7
  misc_feature (1)..(461): Functional Homolog Of SEQ ID NO. 663
  misc_feature (1)..(461): in Figure 7
MIERCLGAYRCRRIQRALRQLKVTILCLLLTVVVLRSTIGAGKFGTPEQDLDEIRQHFHARKRGEPHRVLEEIQTGGDSSSGDGGGNSGGSNNYETFDINKIFVDEGEEEKPDPNKPYTLGPKISDWDEQRSDWLAKNPSFPNFIGPNKPRVLLVTGSAPKPCENPVGDHYLLKSIKNKIDYCRLHGIEIFYNMALLDAEMAGFWAKLPLIRKLLLSHPEIEFLWWMDSDAMFTDMAFELPWERYKDYNLVMHGWNEMVYDQKNWIGLNTGSFLLRNNQWALDLLDTWAPMGPKGKIREEAGKVLTRELKDRPVFEADDQSAMVYLLATQRDAWGNKVYLESGYYLHGYWGILVDRYEEMIENYHPGLGDHRWPLVTHFVGCKPCGKFGDYPVERCLKQMDRAFNFGDNQILQIYGFTHKSLASRKVKRVRNETSNPLEMKDELGLLHPAFKAVKVQTNQV

SEQ ID NO: 670 - protein, 452 aa, Vitis vinifera
  misc_feature (141)..(385): Pfam Name: Glyco_transf_34 Pfam Description: galactosyl transferase GMA12/MNN10 fa
  misc_feature (1)..(452): Public GI ID no. 225437312
  misc_feature (1)..(452): Bit score of 1279.8 for HMM based on sequences of Figure 7
  misc_feature (1)..(452): Functional Homolog Of SEQ ID NO. 663
  misc_feature (1)..(452): in Figure 7
MIERCLGARRARQIHRALRHFKVTILCLVMTIVVLRGTIGAGKFGTPEQDFVEIRDHFSPRKRAEPHRVLEEVQTTSSSSSELNNYATFDLNKLLVDEEDDSEKPDPKKPYSLGPKISDWDEQRSTWLEQNPNFPNFIGPNKPRVLLVTGSSPKPCENPVGDHYLLKSIKNKIDYCRLHGIEIFYNMALLDAEMAGFWAKLPLIRKLLLSHPEVEFLWWMDSDAMFTDMAFELPWERYKDYNFVMHGWNEMVYDQKNWIGLNTGSFLLRNCQWSLDILDAWAPMGPKGKIRTEAGKILTRELKDRPVFEADDQSAMVYLLATQKDTWGGKVYLESAYYLHGYWGILVDRYEEMIENYHPGLGDHRWPLVTHFVGCKPCGKFGDYPVERCLKQMDRAFNFGDNQVLQIYGFTHKSLGSRRVKRTRNDTNNPLEVKDELGLLHPAFKAVKVSSS

SEQ ID NO: 671 - DNA, 1821 bp, Gossypium hirsutum
  misc_feature (1)..(1821): Ceres Clone ID no. 1928792
  misc_feature (1)..(1821): Encodes the peptide sequence at SEQ ID NO. 672
atcagagaaatctaaatatctccccccccccccaaattcctagggttctctctcaaatcctttctttccaattccgtattgttagggatttgaagctagtccggatcgggtaacgaactggaagatgatagacaattgcttgggagctcaaagatctagaaagatccagagagctctccgtcattgcaaggtcaccatcctctgcctcgtcctcaccctcgtcgtcctacgtggcactatcggagccggtaaattcgggactccaggccaggacttcgtcgagatccgggaccacctctattaccggaaacaaggcgaaccgcatcgcgtcctcaaagaagtccaaacgacgtcgtcagataaccacgacggcgccgacaccaacgccggcaccaataactacaacgagttcgacatcaataagatcttaatcgacgaggaaccagacgtcccgaaacgcgatcccaacgcgccctattcgctcgggcccagaatctccgattgggacgagcaacgctctagatggctgcaagaaaaccctaagtacccaaatttcatcggtccaaacaaaccgagggttctcttagtcactggttcatctcccaaaccttgtgagaaccctgtcggtgatcattacttattgaaatcgatcaagaacaagatcgattattgtagattacacgggatcgagatattttacaacatggcgctgttggatgctgaaatggcagggttttgggcgaaattgccgttgattcgaaagcttttgctctcgcatccggaggtggaattcttgtggtggatggatagtgacgccatgtttactgacatggcatttgaggttccttgggaaaggtataaagactccaactttgttatgcacggttggaatgaaatggtttacgatcagaagaattggattgggctaaacactgggagttttttgttgaggaatgggcaatgggcacttgacattcttgatgcttgggctccaatgggtcctaaaggcaagattagggaagaagcagggaaggttttgacccgggagcttaagaatagacccgttttcgaagccgatgatcagtctgcaatggtgtatttgttggctactcaaagggagaagtggggtgataaggtttacttagagaattcttattatttgcacggttattgggggatcttggttgatagatatgaggaaatgattgagaattatcacccaggtttaggggatcatcgttggccgttggtgacccactttgtggggtgcaaaccttgtggtaagtttggggattactcggtggagaggtgcttgaagcaaatggatagagcattcaattttggggataatcagattcttcagatttatgggttcactcacaagtcattggccagtagaagggttaagagagtacgaaacgagaccagtaatccgcttgaggtgaaagatgagcttggactgcttcatccggcttttaaagccgttaaggtatcctcttcttgaggatataggctttgtatgatatcttatgctgctaaattataggttacagtattcaaatgttgtgtatgcagtgggaattttgtgcttacggtctggataaatagtattcttttgttcctcgtctttaaattatgagttctttatatgctttccgaatgaaaacttagctcattgttctttccacagctattcattttttgttgcttataagcaaacttgattctgtcaatgttttaacatggtgatatatgttactgcatttgtaattcaatcattagtctgcaatgtttatcgatgttgggagctggtatactttc

SEQ ID NO: 672 - protein, 459 aa, Gossypium hirsutum
  misc_feature (148)..(392): Pfam Name: Glyco_transf_34 Pfam Description: galactosyl transferase GMA12/MNN10 fa
  misc_feature (1)..(459): Ceres Clone ID no. 1928792
  misc_feature (1)..(459): Bit score of 1289.9 for HMM based on sequences of Figure 7
  misc_feature (1)..(459): Functional Homolog Of SEQ ID NO. 663
  misc_feature (1)..(459): in Figure 7
MIDNCLGAQRSRKIQRALRHCKVTILCLVLTLVVLRGTIGAGKFGTPGQDFVEIRDHLYYRKQGEPHRVLKEVQTTSSDNHDGADTNAGTNNYNEFDINKILIDEEPDVPKRDPNAPYSLGPRISDWDEQRSRWLQENPKYPNFIGPNKPRVLLVTGSSPKPCENPVGDHYLLKSIKNKIDYCRLHGIEIFYNMALLDAEMAGFWAKLPLIRKLLLSHPEVEFLWWMDSDAMFTDMAFEVPWERYKDSNFVMHGWNEMVYDQKNWIGLNTGSFLLRNGQWALDILDAWAPMGPKGKIREEAGKVLTRELKNRPVFEADDQSAMVYLLATQREKWGDKVYLENSYYLHGYWGILVDRYEEMIENYHPGLGDHRWPLVTHFVGCKPCGKFGDYSVERCLKQMDRAFNFGDNQILQIYGFTHKSLASRRVKRVRNETSNPLEVKDELGLLHPAFKAVKVSSS

SEQ ID NO: 673 - DNA, 1380 bp, Populus balsamifera subsp. trichocarpa
  misc_feature (1)..(1380): Ceres Annot ID no. 1481731
  misc_feature (1)..(1380): Encodes the peptide sequence at SEQ ID NO. 674
atgctggaccggtgcctcgggactcatcgagtccgccagatccaaagagcaacccgccacggaaaaatcacacttctttgcctcttcatgaccgtagtcgtcctacgtggcacaatcggcgccggcaagtccggtacgccagaacaagacttcaacgacctcagaaaccacatctacgcctctcgcaaacacgctgagccacaccgagtcctcaccgagtcgaatcagtccaacaacaacaagaacgacgaagggagtaatgcaaatgatgcgaataattatgccgcatttgacatcaacaagatcttggtcgatgaaggagaggacgagaaaccggatccgaataaaccgtactttctgggtccgaaaatatcagattgggatgaacagcgggcgaaatggttgagtgaaaaccctaattttagcaattttatcggggcaaacaaaccgcgtgttttgttagtaactggatcttcgccgaagccgtgtgagaatccggtaggggatcattacttgttaaaatctataaaaaataagattgattattgcaggcttcatggaattgagatattttataatatggcattgctggatgcggaaatggcagggttttgggcgaaattgcctttgattaggaagctattgatttcgcacccggagattgagtttttgtggtggatggatagtgatgctatgtttacggatatggctttcgaggtgccgtgggagaggtataaggattcgaattttgtcatgcacggatggaatgaaatggtttatgatcaaaagaattggattggattgaatactgggagttttttgctgaggaattgtcaatggtcgttggatcttttggatgcgtggtcaccaatggggccaaaagggaagattagagatgaagcagggaaggtgcttaccagggaactcaagaataggccggttttcgaagcggatgatcagtctgcgatggtttatttattggctacacaaagggataagtggggtgataaggtgtatttagagaatgcttattatttgcatggttattgggggattttggttgataggtatgaggaaatgattgagaattatcacccaggtcttggtgatcatcgttggccgcttgttactcactttgtggggtgcaagccttgtgggaagtttggagattattcagtggagaggtgtttgaagcagatggatcgcgcatttaattttggggataatcaaattttgcagatttatggatttactcataaatcgctggctagtcggagagttaagagagtgagaaatgagacaggcaatccacttgaagcgaaggatgagcttggcttgcttcaccctgcatttaaagctgtcaaggtatcagcatcttga

SEQ ID NO: 674 - protein, 459 aa, Populus balsamifera subsp. trichocarpa
  misc_feature (148)..(392): Pfam Name: Glyco_transf_34 Pfam Description: galactosyl transferase GMA12/MNN10 fa
  misc_feature (1)..(459): Ceres Annot ID no. 1481731
  misc_feature (1)..(459): Bit score of 1283.3 for HMM based on sequences of Figure 7
  misc_feature (1)..(459): Functional Homolog Of SEQ ID NO. 663
  misc_feature (1)..(459): in Figure 7
MLDRCLGTHRVRQIQRATRHGKITLLCLFMTVVVLRGTIGAGKSGTPEQDFNDLRNHIYASRKHAEPHRVLTESNQSNNNKNDEGSNANDANNYAAFDINKILVDEGEDEKPDPNKPYFLGPKISDWDEQRAKWLSENPNFSNFIGANKPRVLLVTGSSPKPCENPVGDHYLLKSIKNKIDYCRLHGIEIFYNMALLDAEMAGFWAKLPLIRKLLISHPEIEFLWWMDSDAMFTDMAFEVPWERYKDSNFVMHGWNEMVYDQKNWIGLNTGSFLLRNCQWSLDLLDAWSPMGPKGKIRDEAGKVLTRELKNRPVFEADDQSAMVYLLATQRDKWGDKVYLENAYYLHGYWGILVDRYEEMIENYHPGLGDHRWPLVTHFVGCKPCGKFGDYSVERCLKQMDRAFNFGDNQILQIYGFTHKSLASRRVKRVRNETGNPLEAKDELGLLHPAFKAVKVSAS

SEQ ID NO: 675 - protein, 460 aa, Coffea canephora
  misc_feature (149)..(393): Pfam Name: Glyco_transf_34 Pfam Description: galactosyl transferase GMA12/MNN10 fa
  misc_feature (1)..(460): Public GI ID no. 190887122
  misc_feature (1)..(460): Bit score of 1252.1 for HMM based on sequences of Figure 7
  misc_feature (1)..(460): Functional Homolog Of SEQ ID NO. 663
  misc_feature (1)..(460): in Figure 7
MLERCLSPRRARQMQRLLRNGKLTLLCLFLTVIVLRANLGAGKFGTPEQDLNDIRETFSYIRRRAEPRRVLEEARQTFTATDNGASDTNSYADFDIKRIIADEDDGDEVVYKRDPNQPYSLGPKISNWDQQRAEWLKKNPNFRNFVAPNKPRVLLVTGSSPKPCENPVGDHYLLKSIKNKIDYCRLHGIEIFYNFALLDAEMSGFWAKLPLIRKLLLSHPEVEFLWWMDSDAMFTDMAFELPWERYKDHNFVMHGWNEMVYDQRNWIGLNTGSFLLRNCQWSLDILDTWAPMGPKGKIRDEAGELLTRELKDRPVFEADDQSAMVYILTTQREKWAGKVYLESAYYLHGYWGILVDRYEEMIENYHPGLGDHRWPLVTHFVGCKPCGKFGDYSVERCLKQMDRAHNFADNQILQMYGFTHKSLASRKVKRTRNETSNPLEVQDELGLLHPAFKAVKVSAS

SEQ ID NO: 676 - DNA, 1764 bp, Panicum virgatum
  misc_feature (1)..(1764): Ceres Clone ID no. 1909588
  misc_feature (1)..(1764): Encodes the peptide sequence at SEQ ID NO. 677
aaacctcctcgtccgcctccgcctcgtcctcctcccctgccactctcaagccccgcgggcgccgcattgctcgccgccgcctcggttcctcctgcgtccccttctgtatttggtggtttggtctgggtttggttgcgaggaggagagaggcggagtttgatcggaggaggggaaaatgtgggcggcgcggttggtcggggagcgccggatgcggcagatccagcgcttcgcgcggaacgccaagctcaccgtcgtctgcctcttcctcaccgtcctcgtgctccgcggcaccgtcggcgccggccgcttcggcacgccgcagcaggacctcatcgagctccgccagcacttcgtctcccacccgcatcgggcgctcgccgagcaccacgacgccaggtccaggggctccgccacgaccaccaccaccaccacgtcctcctcctcctccggacgcggcgacgacgagcccgacccgccgccgaggacgctcagggacccgccctacacgctgggccccaagatcaccgactgggacgagcagcgcgccgcctggcaccgccgccacccggagacgccgcccttcctcaacgacgtgaagccgcgggtgctgctcgtcaccggttcctcccccaagccctgcgagaaccccgtcggtgaccactacctcctcaagtctatcaagaacaagatcgactactgccgcgtccacggcatcgagatcttctacaacatggcgctgctcgacgccgagatggccggattctgggccaagctcccgctcatccgggcgctgctcctggcgcacccggaggtcgagttcctctggtggatggactccgacgccatgttcaccgacatggcattcgagctcccatgggagcgctacgggccgtacaacctcgtcatgcacggctgggacgagatggtctacgacgacaaaaattggattgggctcaacactggcagcttcttgctgcgcaactgccagtggtcgcttgagatgctggatacctgggcgccaatggggccaaagggccctgtccgcattgaggctggcaaggtgctgaccaagtccttgaaggatcgaccagtatttgaggctgatgatcagtcggccatggtgtacatcctcgccactcagcgcgagaaatggggtgacaaggtgtacctggagaatgggtactacctccacggctactggggcatcttggttgataggtatgaggagatgcttgagaattataagccagggcttggggatcaccggtggccgctcgtcactcactttgtcggttgcaagccttgcggcaaatttggggactaccctgttgagcgttgtctcaaacagatggaccgtgcattcaattttggggataaccagatcttgcagatgtatgggttcacgcacaagtcgcttgcaagcaggagagtgaagaggatcaggaatgagactagtaacccactcaagatgaagggtgagcttgggttgctccaccccgcattcaaggctgtgaagacttccacatgataattagagtacaattccacttgttattttgtttcttcgttctagatcctgttgggtctgaatctgaagtgttctttttgtagaatcgggtgacagcaggagtttgggttgggatcatgggatggatatgttgtaatgtgagatgttaggaaaatgatgttatgtttatttgttggcataagttatgtcttacactgctagaaattgagttaatgaatgaactcaagttattggtc

SEQ ID NO: 677 - protein, 450 aa, Panicum virgatum
  misc_feature (140)..(384): Pfam Name: Glyco_transf_34 Pfam Description: galactosyl transferase GMA12/MNN10 fa
  misc_feature (1)..(450): Ceres Clone ID no. 1909588
  misc_feature (1)..(450): Bit score of 1204.1 for HMM based on sequences of Figure 7
  misc_feature (1)..(450): Functional Homolog Of SEQ ID NO. 663
MWAARLVGERRMRQIQRFARNAKLTVVCLFLTVLVLRGTVGAGRFGTPQQDLIELRQHFVSHPHRALAEHHDARSRGSATTTTTTTSSSSSGRGDDEPDPPPRTLRDPPYTLGPKITDWDEQRAAWHRRHPETPPFLNDVKPRVLLVTGSSPKPCENPVGDHYLLKSIKNKIDYCRVHGIEIFYNMALLDAEMAGFWAKLPLIRALLLAHPEVEFLWWMDSDAMFTDMAFELPWERYGPYNLVMHGWDEMVYDDKNWIGLNTGSFLLRNCQWSLEMLDTWAPMGPKGPVRIEAGKVLTKSLKDRPVFEADDQSAMVYILATQREKWGDKVYLENGYYLHGYWGILVDRYEEMLENYKPGLGDHRWPLVTHFVGCKPCGKFGDYPVERCLKQMDRAFNFGDNQILQMYGFTHKSLASRRVKRIRNETSNPLKMKGELGLLHPAFKAVKTST

SEQ ID NO: 678 - DNA, 1722 bp, Zea mays
  misc_feature (1)..(1722): Ceres Clone ID no. 287316
  misc_feature (1)..(1722): Encodes the peptide sequence at SEQ ID NO. 679
aaaacctcctccggctcgtcccccctctaaccagtccccagtcccgcggcggccgcattgcccgccgccgcaccgtgtcttgctaggactaggaccccctgtttgggctcttgcgtttcgattcctgggtcgtctgcaaggagtgtggccgacggagggggccaaaatgtgggcggagaaggtggtcggcgagcgccggatgcggcagatccagcgcttcgcgcggaacgccaagctcaccgtcgtctgcctcctcctcaccgtagttgtgctccgcggcaccgtcggcgccggccgcttcggcacgccgcagcaggacctaatcaagctccgccagcacttcgtctcccacccgcaccgggcgctcgccgagcaccacgacgccaggtccagggcctccaccaccaccacatcgtcgtcgtcgtcgtcgtcctcctcctccggccgccgcgacgagcccgacccaccgccgaggtcgctcagggacccgccctacacgctggggcccaagatctccgactgggacgagcagcgcgccgcctggcaccgccgccacccggagacgccgcctttcctcaacgacatcaagccacgggtgctgctcgtcacggggtcctcgcccaagccctgcgagaaccccgtcggggaccactacctcctcaagtccatcaagaacaagatggactactgccgcgtccacggcatcgaggtcttctacaacatggcgctgctcgacgccgagatggccggcttctgggccaaactcccgctcatgcgggcgctgctcctcgcgcacccggaggtcgagttcctctggtggatggactctgacgccatgttcaccgacatggcgttcgagctcccgtgggagcgctacgggccatacaacctgatcatgcacggctgggacgagatggtctacgacgacaagaactggattgggctcaacaccggcagcttcttgctgcgcaactgccagtggtcgcttgatatgctggatacctgggcgccaatggggccaaagggccctgtccgcatcgaggccggcaaggtgctgaccaagtccttgaaggatcggccagtattcgaggccgatgatcagtcggccatggtgtacatcctcgcgacacagcgcgagaaatggggtgataaggtttaccttgagaatgggtactacctccacggctactgggggatcttggtcgacaggtatgaggagatgcttgagaactacaagccagggctaggtgatcaccggtggccgctcgtcacacattttgtcgggtgcaagccatgcggcaaatttggagactaccctgtcgagcgatgcctcaagaacatggaccgtgcattcaattttggggataaccagatcttgcagatgtatgggttcacacacaagtcactggcaagcaggagagtgaagaggatcaggaacgagaccagcaacccgcttgagacgaaggatgagcttgggctgcttcatccagcattcaaggctgtgaagacttccacatgataattagagtacagttccacttgtttattttgttggctcgttctagatcctgttgggtctataatccaaagtgttcttttttgtagaatcgggtaacgacagaagtttgggttggggtcatgggatggatatctttgttgtaatgtgaggtgttaggagaattatgttatgtttatttattggcataagttatgtcttacacg

SEQ ID NO: 679 - protein, 450 aa, Zea mays
  misc_feature (140)..(384): Pfam Name: Glyco_transf_34 Pfam Description: galactosyl transferase GMA12/MNN10 fa
  misc_feature (1)..(450): Ceres Clone ID no. 287316
  misc_feature (1)..(450): Bit score of 1214.1 for HMM based on sequences of Figure 7
  misc_feature (1)..(450): Functional Homolog Of SEQ ID NO. 663
MWAEKVVGERRMRQIQRFARNAKLTVVCLLLTVVVLRGTVGAGRFGTPQQDLIKLRQHFVSHPHRALAEHHDARSRASTTTTSSSSSSSSSSGRRDEPDPPPRSLRDPPYTLGPKISDWDEQRAAWHRRHPETPPFLNDIKPRVLLVTGSSPKPCENPVGDHYLLKSIKNKMDYCRVHGIEVFYNMALLDAEMAGFWAKLPLMRALLLAHPEVEFLWWMDSDAMFTDMAFELPWERYGPYNLIMHGWDEMVYDDKNWIGLNTGSFLLRNCQWSLDMLDTWAPMGPKGPVRIEAGKVLTKSLKDRPVFEADDQSAMVYILATQREKWGDKVYLENGYYLHGYWGILVDRYEEMLENYKPGLGDHRWPLVTHFVGCKPCGKFGDYPVERCLKNMDRAFNFGDNQILQMYGFTHKSLASRRVKRIRNETSNPLETKDELGLLHPAFKAVKTST

SEQ ID NO: 680 - protein, 436 aa, Oryza sativa subsp. indica
  misc_feature (125)..(369): Pfam Name: Glyco_transf_34 Pfam Description: galactosyl transferase GMA12/MNN10 fa
  misc_feature (1)..(436): Public GI ID no. 125543514
  misc_feature (1)..(436): Bit score of 1173.8 for HMM based on sequences of Figure 7
  misc_feature (1)..(436): Functional Homolog Of SEQ ID NO. 663
MREIQRFARNAKLTVVCLLLTVVVLRGTVGAGKFGTPQQDLIELRHRFISHPHRALAEHHDALSRGGGSSSSSGRAAQRDDEPDPPPRTLRDPPYTLGPKISDWDEQRAAWHRRHPETPPFVNDVKPRVLLVTGSSPKPCENPVGDHYLLKSIKNKMDYCRVHGLEIFYNMALLDAEMAGFWAKLPLLRALLLAHPEIEFLWWMDSDAMFSDMAFELPWERYGPYNLIMHGWDEMVYDDKNWIGLNTGSFLLRNCQWSLDFLDTWAPMGPKGPVRIEAGKVLTKYLKDRPVFEADDQSAMVYILATEREKWGDKVYLENGYYLHGYWGILVDRYEEMLENYHPGLGDHRWPLVTHFVGCKPCGKFGDYPVERCLKQMERAFNFGDNQILQMYGFTHKSLGSRKVKRIRNETSNPLDVKDELGLLHPAFKAMKTTST

SEQ ID NO: 681 - protein, 459 aa, Arabidopsis thaliana
  misc_feature (148)..(392): Pfam Name: Glyco_transf_34 Pfam Description: galactosyl transferase GMA12/MNN10 fa
  misc_feature (1)..(459): Public GI ID no. 3892054
  misc_feature (1)..(459): Bit score of 1275.9 for HMM based on sequences of Figure 7
  misc_feature (1)..(459): Functional Homolog Of SEQ ID NO. 663
MIERCLGAYRCRRIQRALRQLKVTILCLLLTVVVLRSTIGAGKFGTPEQDLDEIRQHFHARKRGEPHRVLEEIQTGGDSSSGDGGGNSGGSNNYETFDINKIFVDEGEEEKPDPNKPYTLGPKISDWDEQRSDWLAKNPSFPNFIGPNKPRVLLVTGSAPKPCENPVGDHYLLKSIKNKIDYCRLHGIEIFYNMALLDAEMAGFWAKLPLIRKLLLSHPEIEFLWWMDSDAMFTDMAFELPWERYKDYNLVMHGWNEMVYDQKNWIGLNTGSFLLRNNQWALDLLDTWAPMGPKGKIREEAGKVLTRELKDRPVFEADDQSAMVYLLATQRDAWGNKVYLESGYYLHGYWGILVDRYEEMIENYHPGLGDHRWPLVTHFVGCKPCGKFGDYPVERCLKQMDRAFNFGDNQILQIYGFTHKSLASRKVKRVRNETSNPLEMKDELGLLHPAFKAVKGEAL

SEQ ID NO: 682 - protein, 450 aa, Vitis vinifera
  misc_feature (139)..(383): Pfam Name: Glyco_transf_34 Pfam Description: galactosyl transferase GMA12/MNN10 fa
  misc_feature (1)..(450): Public GI ID no. 147836354
  misc_feature (1)..(450): Bit score of 1237.3 for HMM based on sequences of Figure 7
  misc_feature (1)..(450): Functional Homolog Of SEQ ID NO. 663
  misc_feature (179)..(179): Xaa is any aa, unknown, or other
MLDWCFGARRVRQMQRAFRHGKITLMCLLMTVVVLRGTIGAGKFGTPEQDFNEIREHFHNRKRVEPHRVLEEAEVSTESSESNNYATFDISKLTVDEGEDEKPDPNKPYSLGPKISDWDEQRAEWLRKNPNFPNFIGPNKPRVLLVTGSSPKPCENPVGDHYLLKAIKNKIDYCRLHGXEIFYNMALLDAEMAGFWAKLPLIRKLLLSHPEIEFLWWMDSDAMFTDMAFEVPWERYKDHNFVMHGWNEMVYDQKNWIGLNTGSFLLRNCQWALDILDAWAPMGPKGKIRTEAGKILTRELKDRPVFEADDQSAMVYLLATQRDNWGDKVYLESAYYLHGYWGILVDRYEEMIENHHPGLGDHRWPLVTHFVGCKPCGKFGDYPVERCLKQMDRAFNFGDNQILQIYGFTHKSLASRRVKRTRNDTSNPLEVKDDLGLLHPAFKAVKVLSS

SEQ ID NO: 683 - DNA, 1770 bp, Gossypium hirsutum
  misc_feature (1)..(1770): Ceres Clone ID no. 1948406
  misc_feature (1)..(1770): Encodes the peptide sequence at SEQ ID NO. 684
aaatcttccaaatttcatttcctagggttctctctcgattccctattttccaaatcggtattgttagggatttgacgctaatccggatcgggtaacgagccggaagatgatagacaattgcttgggagctcaaagatctagaaagatccagagaactctccgtcattgcaaggtcaccatcctctgcctcgtcctcaccctcgtcgtcctacgtggcactatcggagccggtaaattcgggactccaggccaggacttcgtcgagatccgggaccacctctattaccggaaacaaggcgaaccgcatcgcgtcctcaaagaagtccaaacgacgtcgtcagataaccacgacggcgccgacaccaacgccggcaccaataactacaacgagttcgacatcaataagatcttaatcgacgaggaaccagacgtcccgaaacgcgatcccaacgcgccctattcgctcgggcccggaatctccgattgggacgagcaacgctctagatggctgcaagaaaaccctaattacccaaatttcatcggtccaaacaaaccgagggttctcttagtcactggttcatctcccaaaccttgtgagaaccctgtcggtgatcattacttattgaaatcgatcaagaacaagatcgattattgtagattacacgggatcgagatattttacaacatggcgctgttggatgctgaaatggcagggttttgggcgaaattgccgttgattcgaaagcttttgctctcgcatccggaggtggaattcttgtggtggatggatagtgacgccatgtttactgacatggcatttgaggttccttgggaaaggtataaagactccaactttgttatgcacggttggaatgaaatggtttacgatcagaagaattggattgggctaaacactgggagttttttgttgaggaatgggcaatgggcacttgacattcttgatgcttgggctccaatgggtcctaaaggcaagattagggaagaagcagggaaggttttgacccgggagcttaagaatagacccgttttcgaagccgatgatcagtctgcaatggtgtatttgttggctactcaaagggagaagtggggtgataaggtttacttagagaattcttattatttgcacggttattgggggatcttggttgatagatatgaggaaatgattgagaattatcacccaggtttaggggatcatcgttggccgttggtgacccactttgtggggtgcaaaccttgtggtaagtttggggattactcggtggagaggtgcttgaagcaaatggatagagcattcaattttggggataatcagattcttcagatttatgggttcactcacaagtcattggccagtagaagggttaagagagtacgaaacgagaccagtaatccgctcgaggtgaaagatgagcttggattgcttcatccggcttttaaagccgttaaggtatccgcttcttgatgatataggctttgtatgagatcttatgcctactaaatgataggttacaatattcaaatgttgtgtatggagagggaattttatgatttaggtctcgataaatagcattcttttgttcattgcctttaaattatgagttgttaatgctttccgtaggagaacttagctcattgttttgtcttccgctagtcattttttttggtagcttataagcaaaatcgattctgtcaatgtttaaacacagtgataccttatcgctcgaatatgttgctgcatttgtaatt

SEQ ID NO: 684 - protein, 459 aa, Gossypium hirsutum
  misc_feature (148)..(392): Pfam Name: Glyco_transf_34 Pfam Description: galactosyl transferase GMA12/MNN10 fa
  misc_feature (1)..(459): Ceres Clone ID no. 1948406
  misc_feature (1)..(459): Bit score of 1285.9 for HMM based on sequences of Figure 7
  misc_feature (1)..(459): Functional Homolog Of SEQ ID NO. 663
MIDNCLGAQRSRKIQRTLRHCKVTILCLVLTLVVLRGTIGAGKFGTPGQDFVEIRDHLYYRKQGEPHRVLKEVQTTSSDNHDGADTNAGTNNYNEFDINKILIDEEPDVPKRDPNAPYSLGPGISDWDEQRSRWLQENPNYPNFIGPNKPRVLLVTGSSPKPCENPVGDHYLLKSIKNKIDYCRLHGIEIFYNMALLDAEMAGFWAKLPLIRKLLLSHPEVEFLWWMDSDAMFTDMAFEVPWERYKDSNFVMHGWNEMVYDQKNWIGLNTGSFLLRNGQWALDILDAWAPMGPKGKIREEAGKVLTRELKNRPVFEADDQSAMVYLLATQREKWGDKVYLENSYYLHGYWGILVDRYEEMIENYHPGLGDHRWPLVTHFVGCKPCGKFGDYSVERCLKQMDRAFNFGDNQILQIYGFTHKSLASRRVKRVRNETSNPLEVKDELGLLHPAFKAVKVSAS

SEQ ID NO: 685 - protein, 431 aa, Vitis vinifera
  misc_feature (120)..(364): Pfam Name: Glyco_transf_34 Pfam Description: galactosyl transferase GMA12/MNN10 fa
  misc_feature (1)..(431): Public GI ID no. 157350046
  misc_feature (1)..(431): Bit score of 1212.0 for HMM based on sequences of Figure 7
  misc_feature (1)..(431): Functional Homolog Of SEQ ID NO. 663
MIERCLGARRARQIHRALRHFKVTILCLVMTIVVLRGTIGAGKFGTPEQDFVEIRDHFSPRKRAEPHRVLEELLVDEEDDSEKPDPKKPYSLGPKISDWDEQRSTWLEQNPNFPNFIGPNKPRVLLVTGSSPKPCENPVGDHYLLKSIKNKIDYCRLHGIEIFYNMALLDAEMAGFWAKLPLIRKLLLSHPEVEFLWWMDSDAMFTDMAFELPWERYKDYNFVMHGWNEMVYDQKNWIGLNTGSFLLRNCQWSLDILDAWAPMGPKGKIRTEAGKILTRELKDRPVFEADDQSAMVYLLATQKDTWGGKVYLESAYYLHGYWGILVDRYEEMIENYHPGLGDHRWPLVTHFVGCKPCGKFGDYPVERCLKQMDRAFNFGDNQVLQIYGFTHKSLGSRRVKRTRNDTNNPLEVKDELGLLHPAFKAVKVSSS

SEQ ID NO: 686 - DNA, 1574 bp, Arabidopsis thaliana
  misc_feature (1)..(1574): Ceres Clone ID no. 111543
  misc_feature (1)..(1574): Encodes the peptide sequence at SEQ ID NO. 687
aatcgagaccagatctgcgtgaagatgatagagaagtgtataggagcgcatcggtttcggagattacagagattcatgcgtcaagggaaagtgacgattctttgtctcgttctcaccgtcatcgtcttacgtggcacaatcggagccggtaagtttggtacgccggagaaagatatcgaggagatccgtgagcatttcttctacacgcgtaaacgcggcgagcctcaccgtgtcctcgtcgaggtctcttccaaaacgacgtcgtccgaagatggaggaaatggtggtaacagctacgagaccttcgacatcaacaagctattcgttgatgaaggagacgaagagaaatctcgagaccggactaataaaccttattctcttggtcccaagatctctgattgggatgagcagagacgtgattggctcaaacaaaaccctagcttccctaatttcgtggcgccaaacaagcctagggttcttcttgtcacaggttcagctcctaaaccgtgtgagaatcctgtaggagaccattacctcttgaaatcgattaagaacaaaatcgattactgtagaatacacggaatcgagatcttctacaacatggcgttgctcgatgctgagatggctggattctgggctaagcttccgttgattaggaagttactcttgtcacatcctgagattgagtttctatggtggatggatagtgatgccatgttcacggacatggtgttcgagcttccatgggagaggtacaaagattacaacttggtgatgcatggttggaacgagatggtttatgaccagaagaattggattggtctcaacacgggaagtttcttgctcaggaactcacagtggtcgcttgatcttcttgacgcttgggctcctatgggcccaaaagggaagatccgagaagaagcgggtaaagtcttgacccgggaacttaaagaccgacccgctttcgaagctgacgatcaatcggcgatggtttacctgctggcgacggagagagagaaatggggaggcaaagtttatctagagagtggttattacttgcacggttattgggggattttggtagaccggtacgaggagatgattgagaatcataaaccgggttttggagaccatcggtggccattggttacgcatttcgtcgggtgtaaaccgtgcgggaaatttggagattatccggtggaacggtgtctacggcagatggatagagcgtttaatttcggagacaatcagatccttcaaatgtatggtttcacgcataaatcgcttgggagccggcgcgtgaaacccacgcgcaatcagacggataggccgctcgatgccaaggacgagtttgggctgcttcatccgccgttcaaagcggccaagcttagtacgacgacgacgtgagtgagtgagaggatatattgttttgtatcttttaattttgcgtttagggacacatttatttgttttattcaattttatttgtttgtagtttacttaattgttttgatctcccattcatggtggagtcgtgtatggagtatttaatgatttattgtagacgttatttc

SEQ ID NO: 687 - protein, 460 aa, Arabidopsis thaliana
  misc_feature (147)..(391): Pfam Name: Glyco_transf_34 Pfam Description: galactosyl transferase GMA12/MNN10 fa
  misc_feature (1)..(460): Ceres Clone ID no. 111543
  misc_feature (1)..(460): Bit score of 1187.9 for HMM based on sequences of Figure 7
  misc_feature (1)..(460): Functional Homolog Of SEQ ID NO. 663
MIEKCIGAHRFRRLQRFMRQGKVTILCLVLTVIVLRGTIGAGKFGTPEKDIEEIREHFFYTRKRGEPHRVLVEVSSKTTSSEDGGNGGNSYETFDINKLFVDEGDEEKSRDRTNKPYSLGPKISDWDEQRRDWLKQNPSFPNFVAPNKPRVLLVTGSAPKPCENPVGDHYLLKSIKNKIDYCRIHGIEIFYNMALLDAEMAGFWAKLPLIRKLLLSHPEIEFLWWMDSDAMFTDMVFELPWERYKDYNLVMHGWNEMVYDQKNWIGLNTGSFLLRNSQWSLDLLDAWAPMGPKGKIREEAGKVLTRELKDRPAFEADDQSAMVYLLATEREKWGGKVYLESGYYLHGYWGILVDRYEEMIENHKPGFGDHRWPLVTHFVGCKPCGKFGDYPVERCLRQMDRAFNFGDNQILQMYGFTHKSLGSRRVKPTRNQTDRPLDAKDEFGLLHPPFKAAKLSTTTT

SEQ ID NO: 688 - DNA, 1383 bp, Populus balsamifera subsp. trichocarpa
  misc_feature (1)..(1383): Ceres Annot ID no. 1462791
  misc_feature (1)..(1383): Encodes the peptide sequence at SEQ ID NO. 689
atgctggaccggtgcatcgggactcaccgagtccgccagatccaaagagctatccgccacggaaaaatcacacttctctgcctctgcatgaccgtggtcgtcctacgtggaacaatcggcgccggcaagttcggtacgccagaacaagacttcaacgacctcaaaaaccacttctacgcagctcgcaaacacggcgagccacaccgagttctcaccgagtctaaccagcccaacaacaacaagaacgacgaagcaagtaatgctgatggtgggaataattatgccacatttgatatcaacaagattttggtcgatgaaggggaagatgagaagccggatccgaatagaccgtacagtttgggtccgaaaatatccgattggaatcaactgcgagagaaatggttgagtgaaaaccctagttttagcaattttattaagcctaacaaaccgcgtgttttgttagttacaggatcgtcgccgaaaccttgtgagaatccggtaggggatcattacttgttaaaatctataaaaaataagatagattattgtagactccatggaatagagatattttataacatggcattgcttgatgcggaaatggctgggttttgggcgaaattgcctttgattaggaagttattgctttcgcatccggaggttgagttcttgtggtggatggatagtgatgctatgtttacagatatggcttttgaggtgccgtgggagaggtataaggattcgaattttgtaatgcacgggtggaatgagatggtttatgatgaaaagaattggattggattgaatactgggagttttttgctgaggaattgtcaatggtctttggatcttttggatgcgtggtcaccaatgggaccgaaagggaagattagagatgaagcagggaaggtgcttaccagggaacttaagaataggccggttttcgaagcggatgatcagtctgcaatggtttatttattggctacacaaagggataagtggggtgataaagtgtatttagagaatgcttattatttgcatggttattgggggatcttggttgatagatatgaggaaatgattgagaattatcacccaggtctgggtgatcatcgttggccgcttgtcactcactttgtggggtgcaaaccttgtgggaagttcggagattattcagtggagaggtgtttgaagcagatggatcgggcgtttaattttggggataatcaaattctgcagatttatgggtttactcataaatcgctggctagtcggagagttagtcgagtgagaaatgagactaccaatccacttgaagtgaaggatgagcttggcttgcttcaccctgcatttaaagctgtcagggtatcaacaacatcttga

SEQ ID NO: 689 - protein, 460 aa, Populus balsamifera subsp. trichocarpa
  misc_feature (148)..(392): Pfam Name: Glyco_transf_34 Pfam Description: galactosyl transferase GMA12/MNN10 fa
  misc_feature (1)..(460): Ceres Annot ID no. 1462791
  misc_feature (1)..(460): Bit score of 1251.5 for HMM based on sequences of Figure 7
  misc_feature (1)..(460): Functional Homolog Of SEQ ID NO. 663
MLDRCIGTHRVRQIQRAIRHGKITLLCLCMTVVVLRGTIGAGKFGTPEQDFNDLKNHFYAARKHGEPHRVLTESNQPNNNKNDEASNADGGNNYATFDINKILVDEGEDEKPDPNRPYSLGPKISDWNQLREKWLSENPSFSNFIKPNKPRVLLVTGSSPKPCENPVGDHYLLKSIKNKIDYCRLHGIEIFYNMALLDAEMAGFWAKLPLIRKLLLSHPEVEFLWWMDSDAMFTDMAFEVPWERYKDSNFVMHGWNEMVYDEKNWIGLNTGSFLLRNCQWSLDLLDAWSPMGPKGKIRDEAGKVLTRELKNRPVFEADDQSAMVYLLATQRDKWGDKVYLENAYYLHGYWGILVDRYEEMIENYHPGLGDHRWPLVTHFVGCKPCGKFGDYSVERCLKQMDRAFNFGDNQILQIYGFTHKSLASRRVSRVRNETTNPLEVKDELGLLHPAFKAVRVSTTS

SEQ ID NO: 690 - protein, 444 aa, Picea sitchensis
  misc_feature (136)..(380): Pfam Name: Glyco_transf_34 Pfam Description: galactosyl transferase GMA12/MNN10 fa
  misc_feature (1)..(444): Public GI ID no. 116786926
  misc_feature (1)..(444): Bit score of 1043.6 for HMM based on sequences of Figure 7
  misc_feature (1)..(444): Functional Homolog Of SEQ ID NO. 663
MQAQGFLSLGARRVRQIQKAMQNAKVTLLCLFVTVLVLRGTIGAGKFGTPEQDFAEIREHLIVGRRGEPHRVLTEVVAENSSNKSPPVVEEEVEEPEVERDPNVPYSFGPKISDWDDQRREWLAENPAFPNFLPGGRPRILLVTGSAPAPCENPVGDHFLLKSIKNKIDYCRLHGIEIFYNMAHLDREMSGFWAKLPLIRKLMLAHPEVEFIWWMDSDAMFTDMVFELPFERYKNHNFIMHGWEELVYNRKNWIGLNTGSFLLRNCQWSLDILDAWAPMGPKGKIRLDAGKLLTRSLVGRPEFEADDQSALVYLLITQREKWGDKVYLESAYYLHGYWGILVDKYEEMMEKYQPGLGDHRWPLVTHFVGCKPCGKFGDYPVAQCLKQMERAFNFGDNQILQIYGFTHKSLSSRGVKRTRNDTDKPLEVKDELGLLHPAFKAVKL

SEQ ID NO: 691 - protein, 444 aa, Pinus taeda
  misc_feature (136)..(380): Pfam Name: Glyco_transf_34 Pfam Description: galactosyl transferase GMA12/MNN10 fa
  misc_feature (1)..(444): Public GI ID no. 55956972
  misc_feature (1)..(444): Bit score of 1039.0 for HMM based on sequences of Figure 7
  misc_feature (1)..(444): Functional Homolog Of SEQ ID NO. 663
MQVPGFLALGGRRIRQIQRAMQNAKVTLLCLFVTVLVLRGTIGAGKFGTPEQDFNEIREHLIVGRRGEPHRVLTEVVAESSNNKTPPVVEEEVEEPDVERDPSVPYSFGPKISDWDDQRSEWLAENPAFPNFLPGGRPRILLVTGSAPAPCESPVGDHLLLKSIKNKIDYCRLHGIEIFYNMAHLDHEMSGFWAKLPLIRKLMLTHPEVEFIWWMDSDAMFTDMVFELPFERYKNHNFIMHGWEELVYNRKNWIGLNTGSFLLRNCQWSLDILDAWAPMGPKGKIRTEAGKLLTRSLVGRPEFEADDQSALVYLLITQREKWGDKVYLESAYYLHGYWGILVDKYEEMMEKHHPGLGDHRWPLVTHFVGCKPCGKVGDYPVAQCLRQMERAFNFGDNQILQIYGFTHKSLSSRGVKRTRNDTDKPLEVKDELGLLHPAFKAVKV

SEQ ID NO: 692 - protein, 450 aa, Vitis vinifera
  misc_feature (142)..(386): Pfam Name: Glyco_transf_34 Pfam Description: galactosyl transferase GMA12/MNN10 fa
  misc_feature (1)..(450): Public GI ID no. 225457345
  misc_feature (1)..(450): Bit score of 767.9 for HMM based on sequences of Figure 7
  misc_feature (1)..(450): Functional Homolog Of SEQ ID NO. 663
MGLDNFTTQKRTGAGIPTTNGRPAGGRLSGLPRGRQIHKTFNNIKITILCGFVTILVLRGTIGVGNLGGSGGEVENQNLIEETNRILAEIRSDGDPTDPDDPAESEINPNVTYTLGPKITNWNEERKVWLDRNPEFPNFVNGKARILLVTGSPPNPCDNPIGDHYLLKSIKNKIDYCRIHGIEIVYNMAHLDKELAGYWAKLPLIRRLMLSHPEVEWIWWMDSDALFTDMVFEIPLSKYDNYNLVVHGYPDLMFNQKSWIALNTGSFLFRNCQWSLDLLDAWAPMGPKGPIRDEAGKILTANLKGRPAFEADDQSALIYLLISKKDEWMDKVFLENSYYLHGYWAGLVDRYEEMIEKYHPGLGDERWPFVTHFVGCKPCGSYGDYPVERCLRSMERAFNFADNQVLKLYGFRHRGLLSPKIKRIRNETATPLEFVDQFDIRRPEHGGHSL

SEQ ID NO: 693 - DNA, 1795 bp, Gossypium hirsutum
  misc_feature (1)..(1795): Ceres Clone ID no. 1883805
  misc_feature (1)..(1795): Encodes the peptide sequence at SEQ ID NO. 694
atccctcttcgtctccttcaattcaattctttagtttaaaattctcactcatctctctctctctctccactttaaaatctcaaaaaatccaaaaacaaacgaagatataggagtatcccggtttcagtgcaaacgccattgatgagagcttagcttgtagagaaagagattcagttcgagagatttatgtttgtagaaaaacgacgcttgggatttctttccttgctctgtttttacttattttgagggtctaacctttatgggtcaagacagtttcactccccaaaagagatcttccaccggcggtggcttacccacgaccaacaacgccgctgctggtggcggaagatcccgtgtattagccggaatgccgcgtgggaggcagatccacaagaccttcaacaacattaaaatcacgatcctctgcggcttcgttaccatacttgttctacggggtacaatcggcgttggcaatttgggaagctccgaagccgatgctgttaaccaaaacctaatcgaagaaacgagccggatcctagctgagatccgctccgactccgaccctaccgatccggacgaacctcctgaaaccgagatcaatcccaatactacctacacgctcggacccaaaatctcggactgggaccagcaacgtaaggtttggctttcagaaaaccccgaattccctaattttgttaatggcaaagctcggatcttacttgttactgggtcgcccccaaacccttgtgataatgctataggagatcattatttgttgaaagcgataaagaataagatcgattattgtaggcttcatggggttgaaattgtttataatatggctcatttagataaggagttggctgggtattgggcgaaattgccattaattaggagattaatgttgtctcatcctgaagttgagtggatttggtggatggatagtgatgctttttttacagatatggtgtttgagattcctttgtccaagtatgataagtataatttggttgttcatggttaccccgatttaatgttcgagcagaagtcgtggattgctttgaatacggggagtttcctgtttaggaactgccagtggtcgttggatttgcttgacgcgtgggcgccaatgggacctaagggttctattcgtgaggaagccgggaaggttttgactgctaacttgaaaggaaggccggcgtttgaagccgatgaccagtcagctttgatttacttgttgctttctcaaaaggaaatgtggatggataaagtgtttctcgagaatcagtattatttgcatggttattgggcaggtttggttgataggtacgaggagatgatggagaaatatcatccaggtttgggagatgagaggtggccgtttgtgactcatttcgttggttgcaaaccctgtgggagttacggagattaccctgtcgagaggtgtttgcgcagtatgcaaagggcattcaactttgccgataaccaggtgcttaagctgtacgggtttagacatagaggattgttaggccccaatattaagaggatcaggaatgagacggtgactcctttggaaaccgttgatgagcttgatattcgacgatcaacgcacgagaaaaccgaaacacggagctagtgatgggaaacatatataatgtgccataatgtgtaggtaatggtcattccttttgttgaaaagcaatttccaattttttctttttaaggtttgagtaagttttgatgatctgttgtcattgtgatgctgttgggaacaagatagtagaattctttgatt

SEQ ID NO: 694 - protein, 458 aa, Gossypium hirsutum
  misc_feature (148)..(392): Pfam Name: Glyco_transf_34 Pfam Description: galactosyl transferase GMA12/MNN10 fa
  misc_feature (1)..(458): Ceres Clone ID no. 1883805
  misc_feature (1)..(458): Bit score of 777.9 for HMM based on sequences of Figure 7
  misc_feature (1)..(458): Functional Homolog Of SEQ ID NO. 663
MGQDSFTPQKRSSTGGGLPTTNNAAAGGGRSRVLAGMPRGRQIHKTFNNIKITILCGFVTILVLRGTIGVGNLGSSEADAVNQNLIEETSRILAEIRSDSDPTDPDEPPETEINPNTTYTLGPKISDWDQQRKVWLSENPEFPNFVNGKARILLVTGSPPNPCDNAIGDHYLLKAIKNKIDYCRLHGVEIVYNMAHLDKELAGYWAKLPLIRRLMLSHPEVEWIWWMDSDAFFTDMVFEIPLSKYDKYNLVVHGYPDLMFEQKSWIALNTGSFLFRNCQWSLDLLDAWAPMGPKGSIREEAGKVLTANLKGRPAFEADDQSALIYLLLSQKEMWMDKVFLENQYYLHGYWAGLVDRYEEMMEKYHPGLGDERWPFVTHFVGCKPCGSYGDYPVERCLRSMQRAFNFADNQVLKLYGFRHRGLLGPNIKRIRNETVTPLETVDELDIRRSTHEKTETRS

SEQ ID NO: 695 - protein, 450 aa, Vitis vinifera
  misc_feature (142)..(386): Pfam Name: Glyco_transf_34 Pfam Description: galactosyl transferase GMA12/MNN10 fa
  misc_feature (1)..(450): Public GI ID no. 147855862
  misc_feature (1)..(450): Bit score of 767.1 for HMM based on sequences of Figure 7
  misc_feature (1)..(450): Functional Homolog Of SEQ ID NO. 663
  misc_feature (97)..(97): Xaa is any aa, unknown, or other
  misc_feature (106)..(106): Xaa is any aa, unknown, or other
MGLDNFTTQKRTGAGIPTTNGRPAGGRLSGLPRGRQIHKTFNNIKITILCGFVTILVLRGTIGVGNLGGSGGEVENQNLIEETNRILAEIRSDGDPXDPDDPAESXINPNVTYTLGPKITNWNEERKVWLDRNPEFPNFVNGKARILLVTGSPPNPCDNPIGDHYLLKSIKNKIDYCRIHGIEIVYNMAHLDKELAGYWAKLPLIRRLMLSHPEVEWIWWMDSDALFTDMVFEIPLSKYDNYNLVVHGYPDLMFNQKSWIALNTGSFLFRNCQWSLDLLDAWAPMGPKGPIRDEAGKILTANLKGRPAFEADDQSALIYLLISKKDEWMDKVFLENSYYLHGYWAGLVDRYEEMIEKYHPGLGDERWPFVTHFVGCKPCGSYGDYPVERCLRSMERAFNFADNQVLKLYGFRHRGLLSPKIKRIRNETATPLEFVDQFDIRRPEHGGHSL

SEQ ID NO: 696 - protein, 474 aa, Solanum tuberosum
  misc_feature (146)..(390): Pfam Name: Glyco_transf_34 Pfam Description: galactosyl transferase GMA12/MNN10 fa
  misc_feature (1)..(474): Public GI ID no. 55956986
  misc_feature (1)..(474): Bit score of 762.0 for HMM based on sequences of Figure 7
  misc_feature (1)..(474): Functional Homolog Of SEQ ID NO. 663
MGQESTFTAQKRAGALPTTVTANGGVRGRSPNVLPRGRQINRTFNNVKITILCGFVTILVLRGTIGIGNVSSSEAEAENQNLIEETNRILSDIRSDKDPDDPVGDQPETFMSLNDTYSLGPKIANWDKDRKMWLQKNPEFPNFVNGKPRILLVTGSPPNPCDNAIGDHYLLKAIKNKIDYCRIHGIEILYNLAHLEKEMAGYWAKLPLIRRLMLSHPEVEWIWWMDSDALFTDMVFEMPLSKYNRHNLVIHGYPDLLFDQKSWIALNTGSFLFRNCQWFLDLLDAWAPMGPKGPIREEAGKILTAYLKGRPAFEADDQSALIYLLTSQKDKWMHKVSIENSYYLHGYWAGLVDRYEEMIQKYHPGLGDERWPFVTHFVGCKPCGSYGDYPAERCLKNMERAFNFADNQVLNLYGFKHKGLLSPNIKRIRNETDNPLQYVDQLDVRHAKHESTETQSLSGHTSFCTESARLRLEF

SEQ ID NO: 697 - protein, 457 aa, Arabidopsis thaliana
  misc_feature (148)..(392): Pfam Name: Glyco_transf_34 Pfam Description: galactosyl transferase GMA12/MNN10 fa
  misc_feature (1)..(457): Public GI ID no. 15221224
  misc_feature (1)..(457): Bit score of 753.6 for HMM based on sequences of Figure 7
  misc_feature (1)..(457): Functional Homolog Of SEQ ID NO. 663
MGQDGSPAHKRPSGSGGGLPTTTLTNGGGRGGRGGLLPRGRQMQKTFNNIKITILCGFVTILVLRGTIGVGNLGSSSADAVNQNIIEETNRILAEIRSDSDPTDLDEPQEGDMNPNATYVLGPKITDWDSQRKVWLNQNPEFPSTVNGKARILLLTGSPPKPCDNPIGDHYLLKSVKNKIDYCRLHGIEIVYNMAHLDKELAGYWAKLPMIRRLMLSHPEVEWIWWMDSDALFTDILFQIPLARYQKHNLVIHGYPDLLFDQKSWIALNTGSFLLRNCQWSLDLLDAWAPMGPKGPIRDEAGKVLTAYLKGRPAFEADDQSALIYLLLSQKDTWMEKVFVENQYYLHGFWEGLVDRYEEMIEKYHPGLGDERWPFVTHFVGCKPCGSYADYAVERCLKSMERAFNFADNQVLKLYGFSHRGLLSPKIKRIRNETVSPLEFVDKFDIRRTPVETKPQN

SEQ ID NO: 698 - protein, 443 aa, Lotus japonicus
  misc_feature (133)..(377): Pfam Name: Glyco_transf_34 Pfam Description: galactosyl transferase GMA12/MNN10 fa
  misc_feature (1)..(443): Public GI ID no. 55956984
  misc_feature (1)..(443): Bit score of 754.1 for HMM based on sequences of Figure 7
  misc_feature (1)..(443): Functional Homolog Of SEQ ID NO. 663
MNGSAHKRTTTGLPTTTARGGRRGRQIQKTFNNVKITILCGFVTILVLRGTIGVNLSSSDADAVNQNVIEETNRILAEIRSDADPSDPDDAAAAETFFSPNATFTLGPKITGWDLQRKAWLDQNPEYPNFVRGKARILLLTGSPPKPCDNPIGDHYLLKSIKNKIDYCRLHGIEIVYNLAHLDVELAGYWAKLPMIRRLMLSHPEVEWIWWMDSDAFFTDMVFELPLSKYDDYNLVLHGYPDLLFEQKSWIAVNTGSFLFRNCQWSLDLLDAWAPMGPKGPVREEAGKVLTANLKGRPAFEADDQSALIYLLLSKKDKWMDKTFLENSFYLHGYWAGLVDRYEEMIEKYHPGLGDERWPFVTHFVGCKPCGSYGDYPVEKCLSSMERAFNFADNQVLKLYGFRHRGLLSPKIKRIRNETVTPLEFVDQFDIRRHSSESRGSKS

SEQ ID NO: 699 - DNA, 1416 bp, Arabidopsis thaliana
  misc_feature (1)..(1416): Ceres Annot ID no. 881752
  misc_feature (1)..(1416): Encodes the peptide sequence at SEQ ID NO. 700
gatcaaactgttttatccaagttacaacaaaaatgggaaaggaggacggtttcaggactcagaagcgcgtatcaacagcttcctccgccgccgccggcgttcttccgacgacgatggcgagtggtggagtaaggagaccaccaccacgtggtagacagatccaaaagacgttcaacaacgtgaaaatgacaatcctttgtggcttcgtcaccatcctcgtcctacgtggcactatcggcattaacttcggaacttccgacgccgacgtcgtaaaccagaacattatcgaagagactaaccgacttctagctgagatccgatccgattcggatcctaccgactcaaacgagccacctgattcggatcttgacctcaacatgacgtacactctcggacccaagatcactaactgggatcaaaaacggaaactttggttaacgcaaaacccagatttccccagtttcatcaatggtaaagctaaggttttgcttttaacaggttcgcctccaaaaccttgtgacaaccctattggtgatcattacctgctgaaatcggtgaagaacaagattgattattgtaggattcatgggattgagattgtgtataacatggctcatttagacaaggagcttgctgggtattgggcaaagcttccaatgatcaggagattgatgttgtctcatcctgaaattgaatggatttggtggatggacagtgatgctttgttcactgacatggtgtttgagattcctttgtctagatatgagaaccataacttggttattcatggatatcctgatttgttgtttgatcagaagtcttggattgctttgaatactggtagcttcttgtttaggaactgtcaatggtctttggatttgttggatgcttgggctccaatgggacctaaaggacctattcgggaagaagctgggaagattctcaccgcgaatcttaaaggaagaccggctttcgaagcggatgatcagtctgcattgatctatctgctgctttcgcagaaggagacgtggatggagaaagtgtttgtggagaatcagtactatcttcatgggttttgggaaggtttagtggataagtatgaggagatgatggagaagtaccatcccggtttgggagatgaaagatggccttttattactcactttgttggatgcaaaccgtgtgggagttatgctgattacgcggttgaacgttgcttgaagagtatggagcgagcattcaactttgcggataatcaagtgctcaaactgtatgggtttggtcacaggggattgttaagtcctaagatcaagaggatcagaaacgagacaacatttccattgaaattcgtagacaggtttgatattcggagaacaacaccgctcaagattgaagcacgaagctagcagctgatga

SEQ ID NO: 700 - protein, 457 aa, Arabidopsis thaliana
  misc_feature (147)..(391): Pfam Name: Glyco_transf_34 Pfam Description: galactosyl transferase GMA12/MNN10 fa
  misc_feature (1)..(457): Ceres Annot ID no. 881752
  misc_feature (1)..(457): Bit score of 748.1 for HMM based on sequences of Figure 7
  misc_feature (1)..(457): Functional Homolog Of SEQ ID NO. 663
MGKEDGFRTQKRVSTASSAAAGVLPTTMASGGVRRPPPRGRQIQKTFNNVKMTILCGFVTILVLRGTIGINFGTSDADVVNQNIIEETNRLLAEIRSDSDPTDSNEPPDSDLDLNMTYTLGPKITNWDQKRKLWLTQNPDFPSFINGKAKVLLLTGSPPKPCDNPIGDHYLLKSVKNKIDYCRIHGIEIVYNMAHLDKELAGYWAKLPMIRRLMLSHPEIEWIWWMDSDALFTDMVFEIPLSRYENHNLVIHGYPDLLFDQKSWIALNTGSFLFRNCQWSLDLLDAWAPMGPKGPIREEAGKILTANLKGRPAFEADDQSALIYLLLSQKETWMEKVFVENQYYLHGFWEGLVDKYEEMMEKYHPGLGDERWPFITHFVGCKPCGSYADYAVERCLKSMERAFNFADNQVLKLYGFGHRGLLSPKIKRIRNETTFPLKFVDRFDIRRTTPLKIEARS

SEQ ID NO: 701 - protein, 450 aa, Nicotiana benthamiana
  misc_feature (140)..(384): Pfam Name: Glyco_transf_34 Pfam Description: galactosyl transferase GMA12/MNN10 fa
  misc_feature (1)..(450): Public GI ID no. 55956988
  misc_feature (1)..(450): Bit score of 755.2 for HMM based on sequences of Figure 7
  misc_feature (1)..(450): Functional Homolog Of SEQ ID NO. 663
MGPDSSFAAQKRGGGALPTTATPNGGRTSSVLPRGRQIQRTFNNIKITILCGFVTILVLRGTIGFGSLASSGSDAENANLIEETNRILDEIRSDTDLDDPSDTFSHLNSTYSLGPKITTWDADRKFWLQKNPDFPNFIHGKPRVLLVTGSPPNPCDNPTGDHYLLKVMKNKIDYCRIHGIEIVYNLAHLEKEMAGYWAKLPLIRKLMLSHPEVEWIWWMDSDALFTDMVFEIPFSKYNDHNLVIHGYPDLLFEQKSWIALNTGSFLIRNCQWSLDLLDAWAPMGPKGPVREEAGKVLTANLKSRPAFEADDQSALIYLLMSQKDQWMDQVFIENSYYLHGYWAGLVDRYEEMVEKYHPGLGDERWAFVTHFAGCKPCGSYGDYPVERCMKSMERAFNFADNQVLKLYGFRHKGLLSPNIKRIRNETDNPLLYVDQLDLRHAKHESTGPQS

SEQ ID NO: 702 - protein, 454 aa, Physcomitrella patens subsp. patens
  misc_feature (140)..(384): Pfam Name: Glyco_transf_34 Pfam Description: galactosyl transferase GMA12/MNN10 fa
  misc_feature (1)..(454): Public GI ID no. 168048546
  misc_feature (1)..(454): Bit score of 738.6 for HMM based on sequences of Figure 7
  misc_feature (1)..(454): Functional Homolog Of SEQ ID NO. 663
MNLKKSSAWQKLMNYPGSSASTKWSLPRGRSLQRMAHNLRVTILCGFVTVLVLRGTIGTSFGSQRKGTVEHSAQPKIFSDEKSSREPRRVLSATTEPETDIEPVLDSSLPYKLGPHISNWDEQRAMWLQKHPRMAKTSRGRDRILLVTGSQPKPCDNPAGDHLLLKSLKNKMDYCRLHDIEIFYNMAHLDQEMAGFWAKLPLLRKLMLQHPEVEWIWWMDSDAMFTDMLFELPIDKYKDHNMVLHGFDEMVYKMKSWVGLNTGSFLLRNCQWSLDLLDAWAPMGPKGVVRVEAGKQLTATLTGRPEFEADDQSALIFLLVTQARLWASKVFLENQYYLHGYWVILVERYEEMMQKNKPGTGDDRWPFVTHFVGCKPCGSYGDYSVERCLKQMERAFNFGDNQILEHYGFQHRTLETYKVRRIRNDTSNPLGLRQLPAIITKSDRIATHLTASDT

SEQ ID NO: 703 - protein, 454 aa, Physcomitrella patens
  misc_feature (140)..(384): Pfam Name: Glyco_transf_34 Pfam Description: galactosyl transferase GMA12/MNN10 fa
  misc_feature (1)..(454): Public GI ID no. 84794310
  misc_feature (1)..(454): Bit score of 736.1 for HMM based on sequences of Figure 7
  misc_feature (1)..(454): Functional Homolog Of SEQ ID NO. 663
MNLKKSSAWQKLMNYPGSSASTKWSLPRGRSLQRMAHNLRVTILCGFVTVLVLRGTIGTSFGSQRKGTVEHSAQPKIFSDEKSSREPRRVLSATTEPETDIEPVLDSSLPYKLGPHISNWDEQRAMWLQKHPRMAKTSRGRDRILLVTGSQPKPCDNPAGDHLLLKSLKNKMDYCRLHDMEIFYNMAHLDQEMAGFWAKLPLLRKLMLQHPEVEWIWWMDSDAMFTDMLFELPIDKYKDHNMVLHGFDEMVYKMKSWVGLNTGSFLLRNCQWSLDLLDAWAPMGPKGVVRVEAGKQLTATLTGRPEFEADDQSALIFLLVTQARLWASKVFLENQYYLHGYWVILVERYEEMMQKNKPGTGDDRWPFVTHFVGCKPCGSYGDYSVERCLKQMERAFNFGDNQILEHYGFQHRTLETYKVRRIRNDTSNPLGLRQLPAIITKSDRIATHLTASDT

SEQ ID NO: 704 - protein, 480 aa, Oryza sativa subsp. japonica
  misc_feature (174)..(418): Pfam Name: Glyco_transf_34 Pfam Description: galactosyl transferase GMA12/MNN10 fa
  misc_feature (1)..(480): Public GI ID no. 115446469
  misc_feature (1)..(480): Bit score of 764.5 for HMM based on sequences of Figure 7
  misc_feature (1)..(480): Functional Homolog Of SEQ ID NO. 663
MGQEGMGYNNGKGGGGGGGGLPMTAPRPRGASPLSSHGHHHRSRKIHRTFNNVKITVLCGLVTILVLRGTIGLNLSLPNQPTDADALAGAKAVEDIDRILREIRSDGGADDDAAAAGDLAGSFNATALNATEAAAAYASAVERYALGPKISDWDGQRRRWLRQNPGFPSTVAGGKPRILLVTGSQPGPCDNPLGDHYLLKTTKNKIDYCRLHGIEIVHNLAHLDTELAGYWAKLPLLRRLMLSHPEVEWIWWMDSDALFTDMAFELPLSRYQDRNLIIHGYQDLLFEKHSWIALNTGSFLFRNCQWSLDLLDAWAPMGPKGFIRDEAGKILTANLKGRPAFEADDQSALIYLLLSQKEKWMNKVFIENSYYLHGFWAGLVDKYEEMMENHHPGLGDERWPFVTHFVGCKPCGSYGDYPVERCLRSMERAFNFADNQVLRLYGFAHKGLESPKIKRVRNQTTKPIDDKENLDVKAKISTTS

SEQ ID NO: 705 - DNA, 1443 bp, Sorghum bicolor
  misc_feature (1)..(1443): Ceres Annot ID no. 8679332
  misc_feature (1)..(1443): Encodes the peptide sequence at SEQ ID NO. 706
atggggcaggaggggatggggtacagcagcaagggcggaggaggaggaggaggagggggagcgggagggctgccgatgacggcgccgcggccgcggggcgcgtcgccgctccaccaccacagccggtcgcgcaagatccaccgcactttcaacaacctcaagattaccgtgctctgcggcctcgtcaccatcctcgtcctgcggggcaccatcggcctcaacctctccctcccctcgcagccctccgacgccgacgcgctcgccgacgccaaggccgtcgaggacatcgaccgcatcctccgcgagatccgctccgactccggccccgaccccgacgacgagggcgacttcagcgccgcctccgggttcaacgcctccgcgctcagcgccaccgaggccgacgcggcgtacgcggccgcggtcggcagatacgcgctgggccccaagatctccgactgggacgcgcagcggcgacgctggctagcacggaacccgggcttcccggccaccgttgccgggggcaagcctaggattatgctcgtcaccggctcgcagccggggccctgcgacaacccgctcggtgaccattacctgctcaagactaccaagaacaagatcgattactgccgcatccatggcatccagatcgtccacaacctcgcgcaccttgacaacgagctcgcgggatactgggccaaattgccgctgctgcgacgcctcatgctctcccacccggaggtcgagtggatctggtggatggacagcgacgcgctcttcaccgacatggcgttcgagctgccactgtcgcgctacgatggtcacaacctcatcatccacggctaccaggacctcctctttgagaagcactcttggattgctctcaacaccggcagtttcctcttcaggaattgccagtggtcgcttgacctactggacgcgtgggcgcccatgggccccaagggcttcatccgcgaccaggccggcaaggtactcacggcgaacctcaagggccggccagcattcgaggccgacgaccagtcggcactgatttacctcttgctctcgcaaaaggacaagtggatggacaaggtgttcatagagaattcctactacttgcatggcttctgggctgggctggtggacaagtatgaggagatgatggagaatcaccacccaggccttggtgacgagcggtggccttttgtgactcactttgttgggtgcaagccatgtgggagctatggggactacccagtggagcgctgcctcaggagcatggagcgagcgtttaattttgccgacaaccaggtgcttcggctatatggtttctcacacaaggggctggaaagccccaagatcaagagaaccagggatcagacaaccagaccgattaatgatgtggagaacttagatatgaaggccaaaatatccacagtttcctga

SEQ ID NO: 706 - protein, 480 aa, Sorghum bicolor
  misc_feature (174)..(418): Pfam Name: Glyco_transf_34 Pfam Description: galactosyl transferase GMA12/MNN10 fa
  misc_feature (1)..(480): Ceres Annot ID no. 8679332
  misc_feature (1)..(480): Bit score of 743.3 for HMM based on sequences of Figure 7
  misc_feature (1)..(480): Functional Homolog Of SEQ ID NO. 663
MGQEGMGYSSKGGGGGGGGGAGGLPMTAPRPRGASPLHHHSRSRKIHRTFNNLKITVLCGLVTILVLRGTIGLNLSLPSQPSDADALADAKAVEDIDRILREIRSDSGPDPDDEGDFSAASGFNASALSATEADAAYAAAVGRYALGPKISDWDAQRRRWLARNPGFPATVAGGKPRIMLVTGSQPGPCDNPLGDHYLLKTTKNKIDYCRIHGIQIVHNLAHLDNELAGYWAKLPLLRRLMLSHPEVEWIWWMDSDALFTDMAFELPLSRYDGHNLIIHGYQDLLFEKHSWIALNTGSFLFRNCQWSLDLLDAWAPMGPKGFIRDQAGKVLTANLKGRPAFEADDQSALIYLLLSQKDKWMDKVFIENSYYLHGFWAGLVDKYEEMMENHHPGLGDERWPFVTHFVGCKPCGSYGDYPVERCLRSMERAFNFADNQVLRLYGFSHKGLESPKIKRTRDQTTRPINDVENLDMKAKISTVS

SEQ ID NO: 707 - protein, 478 aa, Zea mays
  misc_feature (172)..(416): Pfam Name: Glyco_transf_34 Pfam Description: galactosyl transferase GMA12/MNN10 fa
  misc_feature (1)..(478): Public GI ID no. 162464392
  misc_feature (1)..(478): Bit score of 733.1 for HMM based on sequences of Figure 7
  misc_feature (1)..(478): Functional Homolog Of SEQ ID NO. 663
MGQEGMGYNSKGGGGGGGGGGGLPMTAPRPRGASPLHHSRSRKIHRTFNNLKITVLCGLVTILVLRGTIGLNLSLPSQPSDAEALADAKAVEDIDRILREIRSDSGPDPDDEGDFGAASGFNATALSATEAAAAYAAAVGKYALGPKISDWDAQRRRWLAQNPGFPATLAGGKPRIMLVTGSQPGPCDNPLGDHYLLKTTKNKIDYCRLHGIEIVHNLAHLDNELAGYWAKLPLLRRLMLSHPEVEWIWWIDSDALFTDMSFELPLSRYDGHNLIIHGYQDLLFEKHSWIALNTGSFLFRNCQWSLDLLDAWAPMGPKGFIRDQAGKVLTANLKGRPAFEADDQSALIYLLLSQKDKWMDKVFIENSYYLHGFWAGLVDKYEEMMENHHPGLGDERWPFVTHFVGCKPCGSYGDYPVERCLRSMERAFNFADNQVLRLYGFSHKGLESPKIKRFRDQTTRPINDVENLDMKAKISTIS

SEQ ID NO: 708 - DNA, 1808 bp, Panicum virgatum
  misc_feature (1)..(1808): Ceres Clone ID no. 1814558
  misc_feature (1)..(1808): Encodes the peptide sequence at SEQ ID NO. 709
aataaaaatccgggggggagattccaccttccgccgtggcggggatggggcaggagggcatggggtacagcagcaaggggggaggcgggggcggcggggcgctcccgatgtcggcgccgcggccgcggggcgcgtcgccgctcggccacctccacagccgctcgcgcaagatccaccgcaccttcaacaacctcaagatcaccgtgctttgcggcctcgtcaccatcctcgtcctccggggcaccatcggcctcaacctctccctcccctcgcagccctccgacgccgacgcgctcgccggcgccaaggccgtcgaggacatcgaccgcatcctccgcgagatccgctccgactccggcccggaccccgacgacgacgccggcgacttcagcgccgcctccgggttcaacgcctccgcgctcagcgccgccgaggccgccgcggcgtacgcggccgccgcgggcaggtacgtgctcgggcccaagatctccgactgggacgcgcagcggcgtcgatggctcgccgagaatccggggttcccggccactgctgccggggggaagcccaggataatgctcgtcactggctcgcagccggggccctgcgacaacccgctcggcgaccactacctgctcaagtccaccaagaacaagatcgactactgccgcctccacggcatcgagatcgtccacaacctcgcgcascttgacaccgagctcgcgggatactgggccaagctgccgctgctccgccgcctcatgctctcccacccggaggtcgagtggatctggtggatggacagcgackcgctgttcaccgacatggcgttcgagctgcccctgtcgcggtacgagggtcacaacctcatcatccacgggtaccaagacctgctcttcgagaagcactcctggatcgcgctcaacacaggcagcttcctcttccggaattgccagtggtcgcttgacctcctggacgcgtgggcacccatggggcccaaggggttcatccgtgaccaggccggcaaggtactcacggcgaacctcaagggccggccagcatttgaggctgacgaccagtcggcgctgatttacctcttgctctcgcaaaaggataagtggatgggcaaggtgttcatagagaattcctactacttgcatggattctgggctgggctggtggacaagtatgaggagatgatggagaatcaccacccgggacttggtgatgagcggtggccttttgtgacacactttgttgggtgcaagccatgcgggagctatggagattacccggtggagcgctgcctcaagagcatggagcgagcgttcaattttgccgataaccaggtgcttcggctatatggtttctcacacaaggggctggaaagccccaagattaagaggatcagggatcaracmaccaagccaattaatgatgtggagaacttaratatgaaggccaaaatatcsatggcttcttgatgattcagatgagttggtggtatgatattttcatactkgctttggctatcaacaaggtcaragcatcttgtgatatgggggatattgytgtatctaktttccactctctttctctcccttttccttttgktcaccaatcgttattgttaagtgacagctacaggttgcgatctctgtttttatggaattaaacatgataggagatcaaatctgaaggatagcataacttttgtacttattgcttttcatttttggtgctaggctctagcgcgacaaatatcactaatatgtggagcttgcgcattgtagtagttataaaaaaaacag

SEQ ID NO: 709 - protein, 478 aa, Panicum virgatum
  misc_feature (172)..(416): Pfam Name: Glyco_transf_34 Pfam Description: galactosyl transferase GMA12/MNN10 fa
  misc_feature (1)..(478): Ceres Clone ID no. 1814558
  misc_feature (1)..(478): Bit score of 736.3 for HMM based on sequences of Figure 7
  misc_feature (1)..(478): Functional Homolog Of SEQ ID NO. 663
  misc_feature (220)..(220): Xaa is any aa, unknown, or other
  misc_feature (255)..(255): Xaa is any aa, unknown, or other
  misc_feature (457)..(457): Xaa is any aa, unknown, or other
  misc_feature (458)..(458): Xaa is any aa, unknown, or other
  misc_feature (469)..(469): Xaa is any aa, unknown, or other
  misc_feature (475)..(475): Xaa is any aa, unknown, or other
MGQEGMGYSSKGGGGGGGALPMSAPRPRGASPLGHLHSRSRKIHRTFNNLKITVLCGLVTILVLRGTIGLNLSLPSQPSDADALAGAKAVEDIDRILREIRSDSGPDPDDDAGDFSAASGFNASALSAAEAAAAYAAAAGRYVLGPKISDWDAQRRRWLAENPGFPATAAGGKPRIMLVTGSQPGPCDNPLGDHYLLKSTKNKIDYCRLHGIEIVHNLAXLDTELAGYWAKLPLLRRLMLSHPEVEWIWWMDSDXLFTDMAFELPLSRYEGHNLIIHGYQDLLFEKHSWIALNTGSFLFRNCQWSLDLLDAWAPMGPKGFIRDQAGKVLTANLKGRPAFEADDQSALIYLLLSQKDKWMGKVFIENSYYLHGFWAGLVDKYEEMMENHHPGLGDERWPFVTHFVGCKPCGSYGDYPVERCLKSMERAFNFADNQVLRLYGFSHKGLESPKIKRIRDXXTKPINDVENLXMKAKIXMAS

SEQ ID NO: 710 - protein, 438 aa, Physcomitrella patens subsp. patens
  misc_feature (133)..(377): Pfam Name: Glyco_transf_34 Pfam Description: galactosyl transferase GMA12/MNN10 fa
  misc_feature (1)..(438): Public GI ID no. 168049396
  misc_feature (1)..(438): Bit score of 711.4 for HMM based on sequences of Figure 7
  misc_feature (1)..(438): Functional Homolog Of SEQ ID NO. 663
MKTPGIIQRSLSTPKGRRLQKTINNMKVTVLCGLMTILVLRGTIGAGNFGTPAQDFEELRAHLRSATREYHAVRVLNQIDEETLVDGSYSDDAEESNRDPEKPYSLGPKVSDWDQQRKQWLSENSQTLPKLKRKPRILLVTGSQPSSCESAEGDNFLLKSIKNKVDYARLHNIDFFYNMAHLDQEMTGFWAKLPLLRKLMLTNPEMEWVWWMDSDALFTDMSFKVPLEKYNNYNLVLHGFDDKVYQQKLWTGLNTGSFFIRNCQWSLDLLDAWAPMGPKGVIRNRAGEMLSKSLVGRTNFEADDQSALVHLLIAQRQEWANKVLLENSYYLHGYWVDLVGKYEENMAKSHPGFGDDRWPFVTHFVGCKPCVKNGGDYPVDTCFKQMARAFTFADNQILDVLGFRHRKLGSPRVVRIREDTSHPLELQGKSLDTLTSTE

SEQ ID NO: 711 - protein, 513 aa, Arabidopsis thaliana
  misc_feature (206)..(450): Pfam Name: Glyco_transf_34 Pfam Description: galactosyl transferase GMA12/MNN10 fa
  misc_feature (1)..(513): Public GI ID no. 186478616
  misc_feature (1)..(513): Bit score of 681.9 for HMM based on sequences of Figure 7
  misc_feature (1)..(513): Functional Homolog Of SEQ ID NO. 663
MFQDGSRSSGSGRGLSTTAVSNGGWRTRGFLRGWQIQNTLFNNIKFMILCCFVTILILLGTIRVGNLGSSNADSVNQSFIKETIPILAEIPSDSHSTDLAEPPKADVSPNATYTLEPRIAEIPSDVHSTDLVELPKADISPNATYTLGPRIAEIPSDSHLTDLLEPPKADISPNATYTLGPKITNWDSQRKVWLNQNPEFPNIVNGKARILLLTGSSPGPCDKPIGNYYLLKAVKNKIDYCRLHGIEIVYNMANLDEELSGYWTKLPMIRTLMLSHPEVEWIWWMDSDALFTDILFEIPLPRYENHNLVIHGYPDLLFNQKSWVALNTGIFLLRNCQWSLDLLDAWAPMGPKGKIRDETGKILTAYLKGRPAFEADDQSALIYLLLSQKEKWIEKVYVENQYYLHGFWEGLVDRYEEMIEKYHPGLGDERWPFVTHFVGCKPCGSYADYAVDRCFKSMERAFNFADNQVLKLYGFSHRGLLSPKIKRIRNETVSPLESVDKFDIRRMHMETKP

SEQ ID NO: 712 - protein, 463 aa, Oryza sativa subsp. indica
  misc_feature (158)..(402): Pfam Name: Glyco_transf_34 Pfam Description: galactosyl transferase GMA12/MNN10 fa
  misc_feature (1)..(463): Public GI ID no. 125535778
  misc_feature (1)..(463): Bit score of 705.1 for HMM based on sequences of Figure 7
  misc_feature (1)..(463): Functional Homolog Of SEQ ID NO. 663
MAVTGGGRPAARQQAARGKQMQRTFNNVKITLICGFITLLVLRGTVGINLLTYGVGGGGGSDAVAAAEEARVVEDIERILREIRSDTDDDDDDEEEEPLGVDASTTTTTNSTTTTATAARRRSSNHTYTLGPKVTRWNAKRRQWLSRNPGFPSRDARGKPRILLVTGSQPAPCDDAAGDHYLLKATKNKIDYCRIHGIEIVHSMAHLDRELAGYWAKLPLLRRLMLSHPEVEWVWWMDSDALFTDMAFELPLARYDTSNLVIHGYPELLFAKRSWIALNTGSFLLRNCQWSLELLDAWAPMGPKGRVRDEAGKVLTASLTGRPAFEADDQSALIHILLTQKERWMDKVYVEDKYFLHGFWAGLVDKYEEMMERHHPGLGDERWPFVTHFVGCKPCGGYGDYPRERCLGGMERAFNFADNQVLRLYGFRHRSLASARVRRVANRTDNPLVNKEAALKMDAKIES

SEQ ID NO: 713 - protein, 438 aa, Physcomitrella patens subsp. patens
  misc_feature (133)..(377): Pfam Name: Glyco_transf_34 Pfam Description: galactosyl transferase GMA12/MNN10 fa
  misc_feature (1)..(438): Public GI ID no. 168040071
  misc_feature (1)..(438): Bit score of 693.1 for HMM based on sequences of Figure 7
  misc_feature (1)..(438): Functional Homolog Of SEQ ID NO. 663
MKTPSIIQRSLCSAKGRRLQRSINNMKITVLCGLMTILVLRGTIGAGNFGTPAQDFEEIKAHLRSATREYHAARVLTQVDEKVSADGASSDDIEEVRSNLMTPYRLGPKISDWDDQRKQWLSENSQTSISWQGRPRVLLVTGSQPSSCENSEGDNFLLKSVKNKLDYARLHDIELFYNMAHLDQEMIGFWAKLPLLRKLMLTNPAVEWIWWMDSDALFTDMSFEVPLEKYENYNLVLHGFDDKVYQQKLWTGLNTGSFFIRNCQWALDLLDAWAPMGPKGVIRNQAGEMLSKSLTGRANFEADDQSALVYLLITQRLEWANKVMLEKSFYLHGYWVDLVGKYEENMAKSHPGFGDDRWPFITHFVGCKPCLKNGGDYSVDTCFKQMERAFTFADNQILDVLGFRHRKLGSPRIVRVRDDSSHPLKLEGKSLDRLPSVV

SEQ ID NO: 714 - protein, 463 aa, Oryza sativa subsp. japonica
  misc_feature (158)..(402): Pfam Name: Glyco_transf_34 Pfam Description: galactosyl transferase GMA12/MNN10 fa
  misc_feature (1)..(463): Public GI ID no. 115487346
  misc_feature (1)..(463): Bit score of 703.4 for HMM based on sequences of Figure 7
  misc_feature (1)..(463): Functional Homolog Of SEQ ID NO. 663
MAVTGGGRPAVRQQAARGKQMQRTFNNVKITLICGFITLLVLRGTVGINLLTYGVGGGGGSDAVAAAEEARVVEDIERILREIRSDTDDDDDDEEEEPLGVDASTTTTTNSTTTTATAARRRSSNHTYTLGPKVTRWNAKRRQWLSRNPGFPSRDARGKPRILLVTGSQPAPCDDAAGDHYLLKATKNKIDYCRIHGIEIVHSMAHLDRELAGYWAKLPLLRRLMLSHPEVEWVWWMDSDALFTDMAFELPLARYDTSNLVIHGYPELLFAKRSWIALNTGSFLLRNCQWSLELLDAWAPMGPKGRVRDEAGKVLTASLTGRPAFEADDQSALIHILLTQKERWMEKVYVEDKYFLHGFWAGLVDKYEEMMERHHPGLGDERWPFVTHFVGCKPCGGYGDYPRERCLGGMERAFNFADNQVLRLYGFRHRSLASARVRRVANRTDNPLVNKEAALKMDAKIES

SEQ ID NO: 715 - protein, 427 aa, Physcomitrella patens subsp. patens
  misc_feature (122)..(366): Pfam Name: Glyco_transf_34 Pfam Description: galactosyl transferase GMA12/MNN10 fa
  misc_feature (1)..(427): Public GI ID no. 168005537
  misc_feature (1)..(427): Bit score of 684.9 for HMM based on sequences of Figure 7
  misc_feature (1)..(427): Functional Homolog Of SEQ ID NO. 663
MATAKGRRLQRSINNMKITVLCGLMTILVLRGTIGAGNFGTPAQDFEEIRAHLRSATREFHAVRVLNQVDEKTSPDMVNNDVTEELREDPLVTYSLGPKINDWDGQREKWMSENSLSLNLKGRPRVLLVTGSQPSSCDNAEGDNFLLKSIKNKLDYARLHNMEIFYNMAHLDQEMTGFWAKLPLIRRLMLTNPETEWIWWMDSDALFTDMSFEVPLEHYENFNLVLHGFDDKVYQQKLWTGLNTGSFLIRNCQWSLDLLDAWAPMGPRGIVRNQAGEMLSKSLTGRTNFEADDQSALVYLLITQRQEWAKKVMLENSYYLHGYWVDLVGKYEENMAKSHPGFGDDRWPFITHFVGCKPCLKNGGDYPVDTCFKQMERAFTFADNQILDVLGFRHRKLGSPRVVRVRDDSSHPLKLLRKSLDRVPAIA

SEQ ID NO: 716 - protein, 448 aa, Oryza sativa subsp. indica
  misc_feature (139)..(380): Pfam Name: Glyco_transf_34 Pfam Description: galactosyl transferase GMA12/MNN10 fa
  misc_feature (1)..(448): Public GI ID no. 125543557
  misc_feature (1)..(448): Bit score of 615.3 for HMM based on sequences of Figure 7
  misc_feature (1)..(448): Functional Homolog Of SEQ ID NO. 663
MEKHGGKVTSDRRAGRRQHGQRCSASDAAPLVVVVILIVGALFLILGPTGSSSFTVPRIRVVFNEPVHVAVAAPPPPPPPAQMQAGANASSEEDSGLPPPRQLTDPPYSLGRTILGYDARRSAWLAAHPEFPARVAPAGRPRVLVVTGSAPARCPDPDGDHLLLRAFKNKVDYCRIHGLDVFYNTAFLDAEMSGFWAKLPLLRMLMVAHPEAELIWWVDSDAVFTDMLFEIPWERYAVHNLVLHGWEAKVFDEKSWIGVNTGSFLIRNCQWSLDLLDAWAPMGPRGPVRDRYGELFAEELSGRPPFEADDQSALIYLLVTQRQRWGDKVFIESSYDLNGFWEGIVDRYEELRRAGRDDGRWPFVTHFVGCKPCRRYADSYPAERCRRGMERAFNFADDQILKLYGFAHESLNTTAVRRVRNETGEPLDAGDEELGRLLHPTFRAARPT

SEQ ID NO: 717 - protein, 483 aa, Oryza sativa subsp. japonica
  misc_feature (162)..(407): Pfam Name: Glyco_transf_34 Pfam Description: galactosyl transferase GMA12/MNN10 fa
  misc_feature (1)..(483): Public GI ID no. 115452571
  misc_feature (1)..(483): Bit score of 613.0 for HMM based on sequences of Figure 7
  misc_feature (1)..(483): Functional Homolog Of SEQ ID NO. 663
MSKLQDRHGGEAAADVGRRARHQRLLLSFPVFPIVLLLLAPCTIFFFTSGDVPLPRIRIEYARRDAPTITAVAADTSPPPPSPPSSSPPPLSFPPPPPPPSSPPPPALPVVDDHSDTQRSLRRLRQLTDSPYTLGPAVTGYDARRAEWLRDHTEFPASVGRGRPRVLMVTGSAPRRCKDPEGDHLLLRALKNKVDYCRVHGFDIFYSNTVLDAEMSGFWTKLPLLRALMLAHPETELLWWVDSDVVFTDMLFEPPWGRYRRHNLVIHGWDGAVYGAKTWLGLNAGSFIIRNCQWSLDLLDAWAPMGPPGPVRDMYGKIFAETLTNRPPYEADDQSALVFLLVTQRHRWGAKVFLENSYNLHGFWADIVDRYEEMRRQWRHPGLGDDRWPLITHFVGCKPCGGDDASYDGERCRRGMDRAFNFADDQILELYGFAHESLDTMAVRRVRNDTGRPLDADNQELGRLLHPTFKARKKKTSRAARPM

SEQ ID NO: 718 - protein, 448 aa, Oryza sativa subsp. japonica
  misc_feature (139)..(380): Pfam Name: Glyco_transf_34 Pfam Description: galactosyl transferase GMA12/MNN10 fa
  misc_feature (1)..(448): Public GI ID no. 108707732
  misc_feature (1)..(448): Bit score of 611.5 for HMM based on sequences of Figure 7
  misc_feature (1)..(448): Functional Homolog Of SEQ ID NO. 663
MEKHGGKVTSDRRAGRRQHGQRCSASDAAPLVVVVILIVAALFLILGPTGSSSFTVPRIRVVFNEPVHVAVAAPPPPPPPAQMQAGANASSEEDSGLPPPRQLTDPPYSLGRTILGYDARRSAWLAAHPEFPARVAPAGRPRVLVVTGSAPARCPDPDGDHLLLRAFKNKVDYCRIHGLDVFYNTAFLDAEMSGFWAKLPLLRMLMVAHPEAELIWWVDSDAVFTDMLFEIPWERYAVHNLVLHGWEAKVFDEKSWIGVNTGSFLIRNCQWSLDLLDAWAPMGPRGPVRDRYGELFAEELSGRPPFEADDQSALIYLLVTQRQRWGDKVFIESSYDLNGFWEGIVDKYEELRRAGRDDGRWPFVTHFVGCKPCRRYADSYPAERCRRGMERAFNFADDQILKLYGFAHESLNTTAVRRVRNETGEPLDAGDEELGRLLHPTFRAARPT

SEQ ID NO: 719 - DNA, 1398 bp, Sorghum bicolor
  misc_feature (1)..(1398): Ceres Annot ID no. 8715381
  misc_feature (1)..(1398): Encodes the peptide sequence at SEQ ID NO. 720
atgggggtggccggcggcggggggcggctgcgtgcgagcagcgcgaagaagcagcggcagcggacgctgaacaacatcaagatcacgctgctgtgcggcttcatcacggtgctggtcctccgcggcacggccggcttcaacctcctgatcagcggcggcgacctggacggcgcggcggcggcggcggcggacgccaaggtggtggaggacgtggagcgcatcctggccgagatccgctccgactcggaggcggacgacgtcgtgttcgtggtcgaggacgacggctcatctctgccgtcgtcgtcgccgcggcgcaacgagacggcggcgagcttcggcaacttctcggcgtcggcgacggtggtgaaggtgcgggagtacagcctaggtcccaagctgacggactgggacgcgcagcggcgggagtggatgtcgcggcacccggagttccctccgctcgacccgcggcgtggtggccggccgcgcgtcctcctcgtctccggctcccctcctggcccctgcgacaaccccgtcggcgaccactacctcctcaaatcgaccaagaacaagatcgactactgccgtctccatggcatcgacgtggtgcacaacatggcgcacctggacccggagctgacggggtactggtccaagctgcccctggtgcggcggctcatgctggcgcacccggaggtggagtggatctggtggatggacagcgacgccatcttcacggacatggcgttcgagctcccactgtcccgctacgacggcgccaacctcgtcatccacgggtacccggacctgctgttcgagaagaggtcatggatcgcgctcaacgccggcatcttcctcctccggaactgccagtggtcgctggacctgctggacgcctgggtgcccatgggtccccgaggaccgtcgcgcgtcgaggcagggaagctgctgacggcgagcttgacgggccggccggcgttcgaggccgacgatcagtcggcgctcatccacctgctgctgatgcagaaggagaggtggatggacaaggtgcacgtggagacggagttctacctccatggattctggacggggctggtggacaggtacgaggagatgatggaggagcaccacccggggctcggcgacgaccggtggccattcatcacgcacttcgtcggctgcaagacctgcggcaggtacgaggattacccgctggaccggtgcgtcggcggcatggagcgcgccttcaacttcgccgacaaccaggtgctccggctgtacggattccggcaccgctcgctcaccaccgccaaggtcaggagggtcaccgacccggccaccaacccgctcatggcaaaggaggcggcgctcaagatggacgccaagttctccagcaactag

SEQ ID NO: 720 - protein, 465 aa, Sorghum bicolor
  misc_feature (159)..(403): Pfam Name: Glyco_transf_34 Pfam Description: galactosyl transferase GMA12/MNN10 fa
  misc_feature (1)..(465): Ceres Annot ID no. 8715381
  misc_feature (1)..(465): Bit score of 646.5 for HMM based on sequences of Figure 7
  misc_feature (1)..(465): Functional Homolog Of SEQ ID NO. 663
MGVAGGGGRLRASSAKKQRQRTLNNIKITLLCGFITVLVLRGTAGFNLLISGGDLDGAAAAAADAKVVEDVERILAEIRSDSEADDVVFVVEDDGSSLPSSSPRRNETAASFGNFSASATVVKVREYSLGPKLTDWDAQRREWMSRHPEFPPLDPRRGGRPRVLLVSGSPPGPCDNPVGDHYLLKSTKNKIDYCRLHGIDVVHNMAHLDPELTGYWSKLPLVRRLMLAHPEVEWIWWMDSDAIFTDMAFELPLSRYDGANLVIHGYPDLLFEKRSWIALNAGIFLLRNCQWSLDLLDAWVPMGPRGPSRVEAGKLLTASLTGRPAFEADDQSALIHLLLMQKERWMDKVHVETEFYLHGFWTGLVDRYEEMMEEHHPGLGDDRWPFITHFVGCKTCGRYEDYPLDRCVGGMERAFNFADNQVLRLYGFRHRSLTTAKVRRVTDPATNPLMAKEAALKMDAKFSSN

SEQ ID NO: 721 - DNA, 1362 bp, Sorghum bicolor
  misc_feature (1)..(1362): Ceres Annot ID no. 8658448
  misc_feature (1)..(1362): Encodes the peptide sequence at SEQ ID NO. 722
atgagggagcagtacagctacagcagcaagccggccggcatccggcggcactatcgccgctgcgcgccggcagcggcccacatcgccgtggccttcctcctcgtcgcgctcggcgtgctttacctcatcttcggcccgaccaactccgacctcaacctcgtcctcgccatgccgcgcgtccacgtcgtgttcaataacaaacccgccgtcgtcccagcggcgcctgctgcggccgcgccttccctgggcagcaacgccaccgacgacgacgtggacagcggcctcccgccgccgcggcagctgacggacccgccctactcgctgggccgggtcatcctggactacgacgcgcgacggtccgcgtggctcgcggcgcacccggagttccagccggcggcggcggggcggccgcggccgcgggtgctggtggtgacgggttcggcgcccgcccggtgccccgaccccgacggcgaccacctgctgctgcgggcgttcaagaacaaggcggactactgccgcgtgcacggcctcgacgtgttctacaacgcggcgttcctggacgccgagatgtccgggttctgggcgaagctgccgctgctgcgtgcgctgatgctggcgcacccggaggtggagctcctctggtgggtggactccgacgccgtcttcacggacatggcgttcgagccgccgtgggggaggtacgagcgccacaacctggtgctccatggctggtccgccaaggtgttcgaggagaggagctgggtcggcgtcaacaccggcagcttcctcatccggaactgccagtggtcgctcgacctcctcgacgcgtgggcgcccatggggtcgcgcggccccgtccgcgacagctacggcgagctcttcgcgcgggagctcaccgggcgcccgccgttcgaggcggacgaccagtcggcgctcgtgtacctgctcgtcacgcagcggagcaggtggggggacaagacgttcatcgagagcgcctacgagctcaacggcttctgggaagggatagtggacaggtacgaggagctgcggcggaaggggcgacccgccgggggcctcggcgacggcgacgaccggtggccgttcgtcacgcacttcgtcgggtgcaagccgtgccggcggtacgcggacagctacccggcggaccggtgccggcgggggatggagcgcgcgttcaacttcgccgacgaccagataatgaggctgtacgggttccagcacgagtcgctcaacaccaccgccgtgcagcgcgtcggaaacgagaccggcggcccgctggacgcggacgacgaggagctggcccggctattgcaccccacgttcagggctgccaggcccgcatag

SEQ ID NO: 722 - protein, 453 aa, Sorghum bicolor
  misc_feature (137)..(385): Pfam Name: Glyco_transf_34 Pfam Description: galactosyl transferase GMA12/MNN10 fa
  misc_feature (1)..(453): Ceres Annot ID no. 8658448
  misc_feature (1)..(453): Bit score of 594.4 for HMM based on sequences of Figure 7
  misc_feature (1)..(453): Functional Homolog Of SEQ ID NO. 663
MREQYSYSSKPAGIRRHYRRCAPAAAHIAVAFLLVALGVLYLIFGPTNSDLNLVLAMPRVHVVFNNKPAVVPAAPAAAAPSLGSNATDDDVDSGLPPPRQLTDPPYSLGRVILDYDARRSAWLAAHPEFQPAAAGRPRPRVLVVTGSAPARCPDPDGDHLLLRAFKNKADYCRVHGLDVFYNAAFLDAEMSGFWAKLPLLRALMLAHPEVELLWWVDSDAVFTDMAFEPPWGRYERHNLVLHGWSAKVFEERSWVGVNTGSFLIRNCQWSLDLLDAWAPMGSRGPVRDSYGELFARELTGRPPFEADDQSALVYLLVTQRSRWGDKTFIESAYELNGFWEGIVDRYEELRRKGRPAGGLGDGDDRWPFVTHFVGCKPCRRYADSYPADRCRRGMERAFNFADDQIMRLYGFQHESLNTTAVQRVGNETGGPLDADDEELARLLHPTFRAARPA

SEQ ID NO: 723 - DNA, 1341 bp, Sorghum bicolor
  misc_feature (1)..(1341): Ceres Annot ID no. 8641531
  misc_feature (1)..(1341): Encodes the peptide sequence at SEQ ID NO. 724
atgtcgtctgaggacgacgaccggcgaccgcggcagcaacggctgctccccgtcccgatcatccccttcgtcctcttcctcgtcgcaccgttcgccctcttcatgctcacgtcgcccgacctgcagtggcagctcccacgcatccgcatcgagtacgacgacgacgagccctccagcgcgcccacgcacgagcgcacttcgtcgacgccaccaaggtctccggttcttgccggtgccaaaagcgacgaagagcaacggcggctcccgctgccgccgccgcgccagctgactgacccgccgtacacgctcggcgcagccgtgtcggactacgacgcgcgcagggccaggtggctccacgacaacccgcggttcccggccttcgtcgcgccggggaggccccgggtgctcgtggtcaccgggtcgtcgccgcgccggtgcgggaacgcggacggcgaccacgtcctcctccgcgcgttcaagaacaaggtggactactgccgcgtccacggcttcgacgtcttctacagcaacgccgtgctcgacgccgagctgtcggggttctggaccaagctgcccatcctgcgcgcgctgatgctcgcgcacccagagacggagctcctgtggtgggtggactccgacgtcgtgttcaccgacatgctgttcgagccgccgtgggggaaatacgcgggccacaacctcgtcgttccgggctgggacgacaaggtgtacgccgccaagagctggctcggcatcaacgccggcagcttcatcatccgcaactgccagtggtcgctcgacctgctcgacgcgtgggcgcggatggggccgcgcggccccgtgcggtacgagtacgggaaggtcctcggcaaggcgctgtcggaccggccgtcgtacgaggccgacgaccagtcggcgctcgtctacctgctcgtcacggagcgcggcaggtggggcgacaagacgttcctggagggctcgtacagtctgcacggcttctggctggcgatcgtggacagatacgaagacatgcggcgggacgcgacggcgacgccggggggcggcggtggcgagcggtggccgctggtgacgcacttcgtcgggtgcaagccgtgcggggggcagtacgcgagctacgaggcatcgcggtgccggcgcggcatggagcgcgcgctcaacttcgccgacgaccagattctgaggctgtacgggttcgagcacgagtcgctcaacaccaccgccgtgcggcgcgtgcggaacgataccggaggaccgctggacgcggacgacgtggagatcggccggctcttgcacccgacgttcagggcggctaggccctggtga

SEQ ID NO: 724 - protein, 446 aa, Sorghum bicolor
  misc_feature (131)..(378): Pfam Name: Glyco_transf_34 Pfam Description: galactosyl transferase GMA12/MNN10 fa
  misc_feature (1)..(446): Ceres Annot ID no. 8641531
  misc_feature (1)..(446): Bit score of 569.4 for HMM based on sequences of Figure 7
  misc_feature (1)..(446): Functional Homolog Of SEQ ID NO. 663
MSSEDDDRRPRQQRLLPVPIIPFVLFLVAPFALFMLTSPDLQWQLPRIRIEYDDDEPSSAPTHERTSSTPPRSPVLAGAKSDEEQRRLPLPPPRQLTDPPYTLGAAVSDYDARRARWLHDNPRFPAFVAPGRPRVLVVTGSSPRRCGNADGDHVLLRAFKNKVDYCRVHGFDVFYSNAVLDAELSGFWTKLPILRALMLAHPETELLWWVDSDVVFTDMLFEPPWGKYAGHNLVVPGWDDKVYAAKSWLGINAGSFIIRNCQWSLDLLDAWARMGPRGPVRYEYGKVLGKALSDRPSYEADDQSALVYLLVTERGRWGDKTFLEGSYSLHGFWLAIVDRYEDMRRDATATPGGGGGERWPLVTHFVGCKPCGGQYASYEASRCRRGMERALNFADDQILRLYGFEHESLNTTAVRRVRNDTGGPLDADDVEIGRLLHPTFRAARPW

SEQ ID NO: 725 - DNA, 1707 bp, Triticum aestivum
  misc_feature (1)..(1707): Ceres Clone ID no. 793770
  misc_feature (1)..(1707): Encodes the peptide sequence at SEQ ID NO. 726
aatcgtgatccccattcttacttggttcgtagtgggaagtgggaacaagagcgtgccatgcaccactcgagctcgactcccctctcccgttgacgacgttcgccacatgatggttaaaccatcgccgatggaaggtgcgtgcaacgcgcggcgccggacagcttctgtggctagcgacagcatagcagtgatggcggagcagcacgacggcaagccggccaacggcgtgcgctggcggccgcactacggctgcccggcagcgggaagcaccaccatccccctcgtgttccttctcttgctcaccggcgcgctgctcctcatcctcggcccgaccgactccatcctcaccctccccagcctccgcgtcgtgttcagcaaccccatccacattgccaccgcagctccgccagcggtgccgcccgcagccgccaacgtgagcgacgaagacatcggcctcccgccgccccggcagctcacggacccgccctactcgctgggccgcaccatcctggactacgacgcgcgccggtccgcgtggctcgccgcgcacccggagttccccgcgcgcgtgccgcccgcgggccggccgcgggtgctggtggtgaccgggtccgcgccggcacggtgccccgacccggacggcgaccacctgctgctgcgcgcgttcaagaacaaggcggactactgccgcgtccacggcctggaggtgtactacaacacggcgttcctggacgcggagatgaccgggttctgggcgaagctgccgctgctgcggtcgctgatgatggcgcacccggaggtggagctcctgtggtgggtggactcggacgcggtgttcacggacatgcggttcgagctgccgtgggagcgctacgcggcgcacaacctggtgctccacggctgggaggccaaggtgtacgaggagaagagctgggtgggcgtcaacaccggcagcatcctcatccgcaactgccagtggtcgctcgacctcctccacgcgatggcacccatggggccccgcggccccgtgcgcgacagctacggcgagctcttcgccagggagctctccggccgcccgccgttcgaggccgacgaccagtcggcgctcatctacctgctcgtcacgcagcgggagaggtggggggacaaggtcttcttcgagaactcgtacgagctcaacggcttctgggagctcatcgtggacaggtacgaggagctgcggcgggagggcgcctggccgctcgtgacgcacttcgtcgggtgcaagccgtgccggcggtacgccgacagctatccggcggaccgctgccgcctcgggatggagcgcgccttcaacttcgccgacgaccagatactgaggctgtacgggttcggccacgagtcgctcaacggcaccgccgtgcagcgcgtcaggaatgagaccggcgggccgctggacgcggaagacgaggagctcggtcggctgttgcaccccacgttcagggcaacttagacgacgacttagcctggaatcgactcttgttttgtcgtggctggcttcttcttttcccatgttgttttcagtctgatgtttagtttataatagagaactcaatagtactaggactcgagtcgagtccagggattttgccttctctttatcgatgatttacccggtctactatacaaacccagtgatctggtagggcatttcctttaccataattc

SEQ ID NO: 726 - protein, 461 aa, Triticum aestivum
  misc_feature (159)..(396): Pfam Name: Glyco_transf_34 Pfam Description: galactosyl transferase GMA12/MNN10 fa
  misc_feature (1)..(461): Ceres Clone ID no. 793770
  misc_feature (1)..(461): Bit score of 564.0 for HMM based on sequences of Figure 7
  misc_feature (1)..(461): Functional Homolog Of SEQ ID NO. 663
MMVKPSPMEGACNARRRTASVASDSIAVMAEQHDGKPANGVRWRPHYGCPAAGSTTIPLVFLLLLTGALLLILGPTDSILTLPSLRVVFSNPIHIATAAPPAVPPAAANVSDEDIGLPPPRQLTDPPYSLGRTILDYDARRSAWLAAHPEFPARVPPAGRPRVLVVTGSAPARCPDPDGDHLLLRAFKNKADYCRVHGLEVYYNTAFLDAEMTGFWAKLPLLRSLMMAHPEVELLWWVDSDAVFTDMRFELPWERYAAHNLVLHGWEAKVYEEKSWVGVNTGSILIRNCQWSLDLLHAMAPMGPRGPVRDSYGELFARELSGRPPFEADDQSALIYLLVTQRERWGDKVFFENSYELNGFWELIVDRYEELRREGAWPLVTHFVGCKPCRRYADSYPADRCRLGMERAFNFADDQILRLYGFGHESLNGTAVQRVRNETGGPLDAEDEELGRLLHPTFRAT

SEQ ID NO: 727 - protein, 404 aa, Physcomitrella patens subsp. patens
  misc_feature (103)..(349): Pfam Name: Glyco_transf_34 Pfam Description: galactosyl transferase GMA12/MNN10 fa
  misc_feature (1)..(404): Public GI ID no. 168038797
  misc_feature (1)..(404): Bit score of 596.5 for HMM based on sequences of Figure 7
  misc_feature (1)..(404): Functional Homolog Of SEQ ID NO. 663
MKGRTMHKTMYNSRLTILCGLVTILVLRGTIGSSGVDKSPQFLRTNMNVNVDLVRKTVVVEEEKEVEWDPSIPFSLGPKITSWDEQRVLWNKKNPGAAKTLDGKDRMLLVTGSQPTKCDNPMGSFQLLKALKNKMDYCRLHDIEIFYNMAHLDVELAGFWAKLPLLRKLMLGHPEVEWIWWMDSDALFTDMTFEIPIEKYKGYNMVLHGNEKDVYEKKSWLGLNTGSFLMRNCQWSLDLLEIWAIMGPKGAVRMEAGKLLTASLSERPAFEADDQSALVYLLATQRKQWSPKVYLENNYCLHGYWVMITERYEELMARGRPGAVGGEFQWPFVTHFVGCKPCGKGGSSSYGTDRCLAHMERAFNFADNQILNKYGFRHKTLNTYNVRRVRNDTADPLGLKHLVL

SEQ ID NO: 728 - protein, 399 aa, Physcomitrella patens subsp. patens
  misc_feature (98)..(344): Pfam Name: Glyco_transf_34 Pfam Description: galactosyl transferase GMA12/MNN10 fa
  misc_feature (1)..(399): Public GI ID no. 168034676
  misc_feature (1)..(399): Bit score of 577.0 for HMM based on sequences of Figure 7
  misc_feature (1)..(399): Functional Homolog Of SEQ ID NO. 663
MTYFTGRAKQKTMNNSKITILCVLVTILVLRGTIGSGVDKSADFERAVARAENSKVDPEDVEWDPSIPFRLGPKILNWDQQRVLWKKKHPGADKNLDGKDRVLLVTGSQPKKCDIAMGNFQLLKALKNKIDYCRLHNIEIFYNMAHLDVELAGFWAKLPLLRKLMLAHPEVEWIWWMDSDALFTDMTFEIPIEKYKGYNMVLHGSEDDVYVRKSWLGLNTGSFLFRNCQWSLELLDIWAIMGPKGAVRMEAGRLLTATLSGRPEFEADDQSALVYLLATQKSRWARKVYLENSYSLHGYWVMLTERYEEFMAKGSAGGGGGEYRWPFVTHFVGCKPCGKGGSSSYGTERCLLHMERAFNFADNQILSKFGYQHATLSTSNVRRIRNDSNDPLRFIELLT

SEQ ID NO: 729 - DNA, 1341 bp, Sorghum bicolor
  misc_feature (1)..(1341): Ceres Annot ID no. 8641532
  misc_feature (1)..(1341): Encodes the peptide sequence at SEQ ID NO. 730
atgacgacggagcaacccgtcacggccgaccgacgagctcggcagcatcgtctgctcccccttctggtcctccccgtcttcttcctcgtcgcgccgtgcgctctcttcttcttcagatcgtccgacttggccctcatcccccgcatccgcatcgagttcgaccgcccacctaaaaatgagccgccgccagcagagccagtgccactgacgtcgccaccaccaccaccgcctccggctccgggtgcgaacgatgacgaggagcaacgacggctaccgcctccgcgccagctgacggacccaccgtactcgctcggcccgaccgccgactacgacgcgcgcagggcccagtggctccgcgacaacccgcggttcccggccttcgtcgcgccggggaggccccgggtgctcgtggtcaccgggtcgtcgccgcgccggtgcagcgacccggacggcgagcacttgctgctccgggcgttcaagaacaaggcggactactgccgcgtccacggcttcgacatcttctacagcaccgcggtgctcgacgccgagctgccggggttctggtccaagctgccgctgctgcggacgctgatgctggcgcacccggaggcggagctcctgtggtgggtggactccgacgtgatcttcaccgacatgctcttcgagccgccgtgggacaagtacgccggccacaacctcgtgctcccgggctcggaggagaaggtgtacaccgccaagagctggatcggcatcaacgccggcagcttcatcatccgcaactgccagtggtcgctggacctgctcgacgcgcttgcccggatggggccgcgcggccccgtgcgcgagatgtacggcagggtcatcgccgggacgctctccgaccggcagccgtacgaggcctgcgaccagtcggcgctcgtctacctgctcgtgacggagcggcgcaggtggggcgacaagacgttcctcgagagctcctactgcctcagcggcttctgggtctacatcgtggacaagctcgaggagatgcggcggcgggattcgacgacgaccccgccggagcccggccacgaacggtggccgctgacgacgcacttcatggggtgcaagccgtgcggcggggacgactccacctacgacgccgcctggtgccggcgctcgatggagcgtgctctcaacttcggcgacgaccagatactcaacctttacgggttcgagcacaagacgctcaacaccaccgccgtgcggcgcgtccggaacgacactggcgggccgctggacgcggccgacgaggagctcggacggctcttgcatcccacgttcagggctgccaacttgtga

SEQ ID NO: 730 - protein, 446 aa, Sorghum bicolor
  misc_feature (131)..(379): Pfam Name: Glyco_transf_34 Pfam Description: galactosyl transferase GMA12/MNN10 fa
  misc_feature (1)..(446): Ceres Annot ID no. 8641532
  misc_feature (1)..(446): Bit score of 512.1 for HMM based on sequences of Figure 7
  misc_feature (1)..(446): Functional Homolog Of SEQ ID NO. 663
MTTEQPVTADRRARQHRLLPLLVLPVFFLVAPCALFFFRSSDLALIPRIRIEFDRPPKNEPPPAEPVPLTSPPPPPPPAPGANDDEEQRRLPPPRQLTDPPYSLGPTADYDARRAQWLRDNPRFPAFVAPGRPRVLVVTGSSPRRCSDPDGEHLLLRAFKNKADYCRVHGFDIFYSTAVLDAELPGFWSKLPLLRTLMLAHPEAELLWWVDSDVIFTDMLFEPPWDKYAGHNLVLPGSEEKVYTAKSWIGINAGSFIIRNCQWSLDLLDALARMGPRGPVREMYGRVIAGTLSDRQPYEACDQSALVYLLVTERRRWGDKTFLESSYCLSGFWVYIVDKLEEMRRRDSTTTPPEPGHERWPLTTHFMGCKPCGGDDSTYDAAWCRRSMERALNFGDDQILNLYGFEHKTLNTTAVRRVRNDTGGPLDAADEELGRLLHPTFRAANL

SEQ ID NO: 731 - protein, 452 aa, Physcomitrella patens subsp. patens
  misc_feature (122)..(366): Pfam Name: Glyco_transf_34 Pfam Description: galactosyl transferase GMA12/MNN10 fa
  misc_feature (1)..(452): Public GI ID no. 168006484
  misc_feature (1)..(452): Bit score of 569.5 for HMM based on sequences of Figure 7
  misc_feature (1)..(452): Functional Homolog Of SEQ ID NO. 663
MTPTTRKMMQVLNSCKATLFCVLVTILVLRSTAMVSDHHIGDIEGTTEWAHVGQNRHGRKLAQADEVNISEKPDPVTASKFVEEEKWDPSTPYTLGPKISNWDQQRVIWNNLNPGKNKTRNGKPKILLVSGSQPGPCANPMGDFYHLKFVKNRLDYARLHGLEFFYNMATFSKEMTSFWAKLPLLRKLMVSHPEVEWIWWMDSDAIFTDMAFEMPMEKYEGKNLVVHGFHNLLFEQHRWIGLNTGIFLIRNCQWSLDLLDAWAPFGPEGETRVNAGKMLTAKLVERPTFEADDQSALVYLMLFDDPKWKLKTHIEWEFYLHGYWKYLVYRYEELMAKSHPGFGDERWPFVTHFVGCKPCQLSVTPEVDECFLQMERAFNFADNQVLEKYGYAHRALASFKTQRIRKDTADPLGLLEERKPKPEDATASLNFQEKEFLRNKELAEQEAINQRT

SEQ ID NO: 732 - DNA, 1548 bp, Sorghum bicolor
  misc_feature (1)..(1548): Ceres Annot ID no. 8715380
  misc_feature (1)..(1548): Encodes the peptide sequence at SEQ ID NO. 733
atgcgtacgccggcggccggcgtgtggcggctgcacccgcggggcagcggcagcggcggcggcggcggcagcaagctaaccaggcggataatcagcaacgtcaagatcaccctcctgtgcgccttcgtcacgctcctcgtcctccgcggcaccgtcggcgtcaaccgccgcctcgtctacatcgccggcacctccgacgacaaccgcgcggcggccacggccagcaccagacccgtcgacgacatcgagcgcatcctccgtgagatccgcgccgactccgaccccgacgcggcggcgaagcccagcttctcggcggagcactacgaccgcggcgccgcgtggacgacggcgaactacagcctgggtccccgggtgacgcggtggaacgccaagcggcggcggtggctgcaccagaacccggggttcccttcccgcgacgcgcggggcggtccgagggtgcttctcgtcacggcgtcgccgccggggccctgcagcagccccgccggcgaccgattcctgctccgggccaccaagaacaggctcgactactgccgcctccacggcgtcgagatggtgcacgtcacggcgcggctggaggaccccgagctgtcgtcgtcgtcgtcgtcgggcggtgccggcgggtgggccaagctcgcgctgctgcggcgcctcatgctggcgcacccggaggtggagtggctgtggtggctggacgcgggcgcgctcgtcaccgacatggggttcgagctcccgctggcgcgctacgagggcgcgcacctcgtcgtgcacggcaactcgtacctcctcttccagcgccggtcatgggacgccgccagcaccgccagcttcctgctccggaactgccagtggtctctggacctgctcgacgcctgggccgtcatggcgcccaggggccgcgcccgcgacgacgccgggaggctgctcaccgcgacgctggcagggcggccggagggagaagccgacgaccagtccgcgctcgtccacctgctcatcaccgagaaggagcggtggatggacagggtgtacctcgagaaccagttctacctccacggcgtctggacggggctcgtcggcaagttcgaggaggccatggagaagcaccacccggggtacggcgacgaccgctggccgttcgtcacgcacttcgccggctgcaagatttgcgacggcaggtccaacaggtccgcgtccgccggcgacggtggcggcggcaagaatcgcagtgatgagtacccgctggaccggtgcgtcggcggcatggagcgcgccttcaacttcgccgacaaccaggtgctcaggctctacgggttccggcaccagtcgctggcgaccgccgaggtcaggcgggtggccaaccggtcggcgaacccgctggaggccaaggaggaggcgctcgctttcttgaagaaacccaatgagccggatccatggagtagtgatgtgcgcaagtatctaaagcgaaaaggaaagggagattctgttcttgcaagaatcctgaggagactaggatggcgatccaagatttga

SEQ ID NO: 733 - protein, 515 aa, Sorghum bicolor
  misc_feature (149)..(402): Pfam Name: Glyco_transf_34 Pfam Description: galactosyl transferase GMA12/MNN10 fa
  misc_feature (1)..(515): Ceres Annot ID no. 8715380
  misc_feature (1)..(515): Bit score of 490.2 for HMM based on sequences of Figure 7
  misc_feature (1)..(515): Functional Homolog Of SEQ ID NO. 663
MRTPAAGVWRLHPRGSGSGGGGGSKLTRRIISNVKITLLCAFVTLLVLRGTVGVNRRLVYIAGTSDDNRAAATASTRPVDDIERILREIRADSDPDAAAKPSFSAEHYDRGAAWTTANYSLGPRVTRWNAKRRRWLHQNPGFPSRDARGGPRVLLVTASPPGPCSSPAGDRFLLRATKNRLDYCRLHGVEMVHVTARLEDPELSSSSSSGGAGGWAKLALLRRLMLAHPEVEWLWWLDAGALVTDMGFELPLARYEGAHLVVHGNSYLLFQRRSWDAASTASFLLRNCQWSLDLLDAWAVMAPRGRARDDAGRLLTATLAGRPEGEADDQSALVHLLITEKERWMDRVYLENQFYLHGVWTGLVGKFEEAMEKHHPGYGDDRWPFVTHFAGCKICDGRSNRSASAGDGGGGKNRSDEYPLDRCVGGMERAFNFADNQVLRLYGFRHQSLATAEVRRVANRSANPLEAKEEALAFLKKPNEPDPWSSDVRKYLKRKGKGDSVLARILRRLGWRSKI

SEQ ID NO: 734 - protein, 448 aa, Zea mays
  misc_feature (138)..(382): Pfam Name: Glyco_transf_34 Pfam Description: galactosyl transferase GMA12/MNN10 fa
  misc_feature (1)..(448): Bit score of 1217.8 for HMM based on sequences of Figure 7
  misc_feature (1)..(448): Functional Homolog Of SEQ ID NO. 663
MWAERVVGERRMRQIQRFARNAKLTVVCLLLTVVVLRGTVGAGRFGTPQQDLIELRQHFVSHPHRALAEHHDARSRASTTTTSSSSSSSSGRRDEPDPPPRSLRDPPYTLGPKISDWDEQRAAWHRRHPETPPFLNDIKPRVLLVTGSSPKPCENPVGDHYLLKSIKNKMDYCRVHGIEVFYNMALLDAEMAGFWAKLPLMRALLLAHPEVEFLWWMDSDAMFTDMAFELPWERYGPYNLIMHGWDEMVYDDKNWIGLNTGSFLLRNCQWSLDMLDTWAPMGPKGPVRIEAGKVLTKSLKDRPVFEADDQSAMVYILATQREKWGDKVYLENGYYLHGYWGILVDRYEEMLENYKPGLGDHRWPLVTHFVGCKPCGKFGDYPVERCLKNMDRAFNFGDNQILQMYGFTHKSLASRRVKRIRNETSNPLETKDELGLLHPAFKAVKTST

SEQ ID NO: 735 - protein, 447 aa, Zea mays
  misc_feature (137)..(381): Pfam Name: Glyco_transf_34 Pfam Description: galactosyl transferase GMA12/MNN10 fa
  misc_feature (1)..(447): Bit score of 1221.9 for HMM based on sequences of Figure 7
  misc_feature (1)..(447): Functional Homolog Of SEQ ID NO. 663
MWAERVVGERRMRQIQRFARNAKLTVVCLLLTVVVLRGTVGAGRFGTPQQDLIELRQHFVSHPHRALAEHHDARSRASTTTTSSSSSSARRDDDPDPPPRTLRDPPYTLGPKISDWDEQRAAWHRRHPETPPFLNDIKPRVLLVTGSSPKPCENPVGDHYLLKSIKNKMDYCRVHGIEVFYNMALLDAEMAGFWAKLPLMRALLLAHPEVEFLWWMDSDAMFTDMAFELPWERYGPYNLIMHGWDEMVYDDKNWIGLNTGSFLLRNCQWSLDMLDTWAPMGPKGPVRIEAGKVLTKSLKDRPVFEADDQSAMVYILATQREKWGDKVYLENGYYLHGYWGILVDRYEEMLENYKPGLGDHRWPLVTHFVGCKPCGKFGDYPVERCLKNMDRAFNFGDNQILQMYGFTHKSLASRRVKRTRNETSNPLETKDELGLLHPAFKAVKTST

SEQ ID NO: 736 - protein, 448 aa, Zea mays
  misc_feature (137)..(382): Pfam Name: Glyco_transf_34 Pfam Description: galactosyl transferase GMA12/MNN10 fa
  misc_feature (1)..(448): Bit score of 1170.4 for HMM based on sequences of Figure 7
  misc_feature (1)..(448): Functional Homolog Of SEQ ID NO. 663
  misc_feature (60)..(60): Xaa is any aa, unknown, or other
  misc_feature (83)..(83): Xaa is any aa, unknown, or other
  misc_feature (366)..(366): Xaa is any aa, unknown, or other
MWAERVVGERRMRQIQRFARNAKLTVVCLLLTVVVLRGTVGAGRFRTPQQDLIELRQHFXHWRPRRRPGSSHASSNKNPDETXKSPPNARRDDDPDPPPRTLRDPPYTLGPKISDWDEQRAAWHRRHPETPPFLNDIKPRVLLVTGSSPKPCENPVGDHYLLKSIKNKMDYCRVHGIEVFYNMALLDAEMAGFWAKLPLMRALLLAHPEVEFLWWMDSDAMFTDMAFELPWERYGPYNLIMHGWDEMVYDDKNWIGLNIGSFLLRNCQWSLDMLDTWAPMGPKGPVRIEAGKVLTKSLKDRPVFEADDQSAMVYILATQREKWGDKVYLENGYYLHGYWGILVDRYEEMLENYKPGLGDHRWPLVXTHFVGCKPCGKFGDYPVERCLKNMDRAFNFGDNQILQMYGFTHKSLASRRVKRIRNETSNPLETKDELGLLHPAFKAVKTST

SEQ ID NO: 737 - protein, 450 aa, Vitis vinifera
  misc_feature (139)..(383): Pfam Name: Glyco_transf_34 Pfam Description: galactosyl transferase GMA12/MNN10 fa
  misc_feature (1)..(450): Bit score of 1241.1 for HMM based on sequences of Figure 7
  misc_feature (1)..(450): Functional Homolog Of SEQ ID NO. 663
MLDWCFGARRVRQMQRAFRHGKITLMCLLMTVVVLRGTIGAGKFGTPEQDFNEIREHFHNRKRVEPHRVLEEAEVSTESSESNNYATFDISKLTVDEGEDEKPDPNKPYSLGPKISDWDEQRAEWLRKNPNFPNFIGPNKPRVLLVTGSSPKPCENPVGDHYLLKAIKNKIDYCRLHGIEIFYNMALLDAEMAGFWAKLPLIRKLLLSHPEIEFLWWMDSDAMFTDMAFEVPWERYKDHNFVMHGWNEMVYDQKNWIGLNTGSFLLRNCQWALDILDAWAPMGPKGKIRTEAGKILTRELKDRPVFEADDQSAMVYLLATQRDNWGDKVYLESAYYLHGYWGILVDRYEEMIKNHHPGLGDHRWPLVTHFVGCKPCGKFGDYPVERCLKQMDRAFNFGDNQILQIYGFTHKSLASRRVKRTRNDTSNPLEVKDDLGLLHPAFKAVKVSSS

SEQ ID NO: 738 - protein, 450 aa, Vitis vinifera
  misc_feature (139)..(383): Pfam Name: Glyco_transf_34 Pfam Description: galactosyl transferase GMA12/MNN10 fa
  misc_feature (1)..(450): Bit score of 1223.5 for HMM based on sequences of Figure 7
  misc_feature (1)..(450): Functional Homolog Of SEQ ID NO. 663
MLDWCFGARRVRQMQRAFRHGKITLMCLLMTVVVLRGTIGAGKFGTPGQDFNEIREHFHNRKRVEPHRVLEEAEVSTESSESNNYATFDISKLTVDEGEDEKPDPNRPYSLGPKISDWDEQRAEWLRKNPNFPNFIGPNKPRVLLVTGSSPKPCENPGGDHYLLKAIKNKIDYCRLHGVEIFYNMALLDAEMAGFWAKLPLIRKLLLSHPEIEFLWWMDSDAMFTDMAFEVPWERYKDHNFVMHGWNEMVYDQKNWIGLNTGSFLLRNCQWALDILDAWAPMGPKGKIRTEAGKILTRELKDRPVFEADDQSAMVYLLATQRDNWGDKVYLESAYYLHGYWGILVDRYEEMIENHHPGLGDHRWPLVTHFVGCKPCGKFGDYPVERCLKQMDRAFNFGDNQILQIYGFTHKSLASRRVKRTRNDPSNPLEVKDDLGLLHPAFKAVKVLFS

SEQ ID NO: 739 - protein, 461 aa, Ricinus communis
  misc_feature (149)..(393): Pfam Name: Glyco_transf_34 Pfam Description: galactosyl transferase GMA12/MNN10 fa
  misc_feature (1)..(461): Bit score of 1244.8 for HMM based on sequences of Figure 7
  misc_feature (1)..(461): Functional Homolog Of SEQ ID NO. 663
MLERCLGTHRVVRIQRAIRHGKVTLFCLFMTVIVLRGTIGAGKFGTPEQDFNDLRERFYASRKHAEPHRVLVEAQLSTESTQNNNNNDNTDPKNYATFDINTILVDEGQDEKPDPNKPYSLGPRISDWDEQRAEWLKKNPNFPNFIGPNKPRVLLVTGSSPKPCENPVGDHYLLKSIKNKIDYCRLHGIEIFYNMALLDAEMAGFWAKLPLIRKLLLSHPEIEFLWWMDSDAMFTDMAFEVPWERYKDSNFVMHGWNEMIYDQKNWIGLNTGSFLLRNCQWALDILDAWAPMGPKGKIREEAGKVLTRELKDRPVFEADDQSAMVYLLATQRDKWGDKVYLESAYYLHGYWGILVDRYEEMIENYHPGLGDHRWPLVTHFVGCKPCGKFGDYPVERCLKQMDRAFNFGDNQILQMYGFTHKSLASRRVKRVRNESSIPLEVKDELGLLHPAFKAVKLPISS

SEQ ID NO: 740 - DNA, 632 bp, Zea mays
  misc_feature (1)..(632): Ceres Clone ID no. 896483
  misc_feature (1)..(632): Encodes the peptide sequence at SEQ ID NO. 741
aaaccataagagcttctgagtctagacactagatacagtaagccttagcaccaacagaggttagtatctcaacaaggatacttcaaatatgtccgcctcacgcagctcctctcccaactccatctcacagtggagccagaaagagaacaagatgtttgaagaggcactcgcatactacggcgagggcacatccaaccggtgggacaaggtgtccagagccatgggaggcatcaagtctgctgaggaggtgcgctgccactatgaagatcttgactatgacgtcaagatgattgaatcaggccacgtgccgtaccccaagtacaagacacatggattctggacctgaggttgaaatgttggagggctcaaggaggcagaaaacaaagctctatgaatctaagatggacctaggttctagaaggaagcaaagaaatccagccatggttggaaaataaaatgatgaaacagtgtgcatatgtatagtataggttatgagcaagtttatgtttacctgtggttgtaggatctagtgtaccttcacaaactgcatgatttcattattcccttgaactaagttatggaggatgtaaactcatgtatttatgaaaactaaaaaaatattgccttgtagc

SEQ ID NO: 741 - protein, 85 aa, Zea mays
  misc_feature (1)..(85): Ceres SEED LINE ID no. CW00787
  misc_feature (14)..(59): Pfam Name: Myb_DNA-binding Pfam Description: Myb-like DNA-binding domain
  misc_feature (1)..(85): Ceres Clone ID no. 896483
  misc_feature (1)..(85): Bit score of 214.4 for HMM based on sequences of Figure 20
  misc_feature (1)..(85): in Figure 20
MSASRSSSPNSISQWSQKENKMFEEALAYYGEGTSNRWDKVSRAMGGIKSAEEVRCHYEDLDYDVKMIESGHVPYPKYKTHGFWT

SEQ ID NO: 742 - DNA, 644 bp, Zea mays
  misc_feature (1)..(644): Ceres Clone ID no. 1515957
  misc_feature (1)..(644): Encodes the peptide sequence at SEQ ID NO. 743
ccataagagcttctgaagagcgaaatacttcagtctagacactagatacagtaagccttagcgcaccaacagaggatacttcaaatatgtctgcctcgcggagctcctctcccaactccatgtcacagtggagccagaaagagaacaagatgtttgaagaggcactcgcctactatggcgagggcacacccaaccggtgggacaaggtgtccagcgccatgggaggcatcaagtctgccgaggaggtgcgctgccactatgaaaatcttgattacgacgtcaagatgattgagtcaggcaatgtgccgtaccccaagtacaagacacagggattctggacccgaggttaaaaaaatgttggaggctcaaagaggcagaaaacaaagctctacggatccaagaaggaaccaaaggaaatccagctctggttggagaataaaatgatgaaccagtgtgtatatgtcaatatgtgtatagtatagtttatgatcaagtttatgtctgtctacctgtggttgtaggatcctagtgtacataagattgataaccacatgtattcattgtccccttgaactaaagttatggagggtgtaaagtctaaaagtcatgtatttatgcaaactaaaaaaacaatgcctcgtagc

SEQ ID NO: 743 - protein, 87 aa, Zea mays
  misc_feature (1)..(87): Ceres Clone ID no. 1515957
  misc_feature (14)..(61): Pfam Name: Myb_DNA-binding Pfam Description: Myb-like DNA-binding domain
  misc_feature (1)..(87): Bit score of 226.7 for HMM based on sequences of Figure 20
  misc_feature (1)..(87): Functional Homolog Of SEQ ID NO. 741
  misc_feature (1)..(87): in Figure 20
MSASRSSSPNSMSQWSQKENKMFEEALAYYGEGTPNRWDKVSSAMGGIKSAEEVRCHYENLDYDVKMIESGNVPYPKYKTQGFWTRG

SEQ ID NO: 744 - DNA, 330 bp, Sorghum bicolor
  misc_feature (1)..(330): Ceres Annot ID no. 8734086
  misc_feature (1)..(330): Encodes the peptide sequence at SEQ ID NO. 745
atgtctgcctcgcggagctcctctcccaactccatgtcaaagtggagccccaaagagaacaagatgtttgaacaggcactcgcctactatggcgagggcacacccaaccggtgggacaaggtgtccagcgccatgggaggcatcaagtctgctgaggaggtgcgctgccactatgaagatcttgactatgacgtcaagatgattgagtcaggccatgtaccgtacccccagtacaagacacagggattctggacccgaggctcactaatgcccactaattatgtgggctccaatcctagtattatgacaaaaatctcctacttccaatag

SEQ ID NO: 745 - protein, 109 aa, Sorghum bicolor
  misc_feature (1)..(109): Ceres Annot ID no. 8734086
  misc_feature (13)..(59): Pfam Name: Myb_DNA-binding Pfam Description: Myb-like DNA-binding domain
  misc_feature (1)..(109): Bit score of 247.2 for HMM based on sequences of Figure 20
  misc_feature (1)..(109): Functional Homolog Of SEQ ID NO. 741
  misc_feature (1)..(109): in Figure 20
MSASRSSSPNSMSKWSPKENKMFEQALAYYGEGTPNRWDKVSSAMGGIKSAEEVRCHYEDLDYDVKMIESGHVPYPQYKTQGFWTRGSLMPTNYVGSNPSIMTKISYFQ

SEQ ID NO: 746 - protein, 85 aa, Oryza sativa subsp. indica
  misc_feature (1)..(85): Public GI ID no. 125553354
  misc_feature (12)..(60): Pfam Name: Myb_DNA-binding Pfam Description: Myb-like DNA-binding domain
  misc_feature (1)..(85): Bit score of 215.2 for HMM based on sequences of Figure 20
  misc_feature (1)..(85): Functional Homolog Of SEQ ID NO. 741
  misc_feature (1)..(85): in Figure 20
MSGSRSSSPNSKSEWSRKENKMFEEALAYYGEDTPNRWDKVASAMGGIKSAEEIRCHYEDLTDDVKTIESGRVQFPKYKTQGYWT

SEQ ID NO: 747 - DNA, 662 bp, Panicum virgatum
  misc_feature (1)..(662): Ceres Clone ID no. 1785379
  misc_feature (1)..(662): Encodes the peptide sequence at SEQ ID NO. 748
aaaaccgtaagagcttctgaggagcaaaagacttcagtctagacactagacacagtaaaccttagcaccaacccaggttcagtatcttaccaaggatactccaaatatggctggatcacagagctcctctcccaattccaactcaacgtggagcctgaaagagaacaagatgtttgaagaggcactcgcctactatggtgagggcacacccaacctgtgggacaaagtgtccagcgccataggaggcatcaagtctgctgaggaggtgcgctgccactatgaagatcttgttgacgacgtcaagatgattgagtcagggcgggttacgtaccccaagtacaagacgcagggattctggacccgaggttgaagcatcagaagctcaagtgggccgaaacaaaagttccaagaatctatgattcacttaggttctagaaggaagcgaagtaatccaattctggttggagaataaaatgatgaaacattgtgtatatgtatatagtagataattagcaatgttaagtctctttgttgttgtaggatctagtttacattcataaaccccctgtatacattatccccttaaactaagttatgaagatgtaaaatcatgtatttatgttaattaaaaaagttgtgcctggtagcattctgttgcctcg

SEQ ID NO: 748 - protein, 87 aa, Panicum virgatum
  misc_feature (1)..(87): Ceres Clone ID no. 1785379
  misc_feature (14)..(60): Pfam Name: Myb_DNA-binding Pfam Description: Myb-like DNA-binding domain
  misc_feature (1)..(87): Bit score of 220.4 for HMM based on sequences of Figure 20
  misc_feature (1)..(87): Functional Homolog Of SEQ ID NO. 741
  misc_feature (1)..(87): in Figure 20
MAGSQSSSPNSNSTWSLKENKMFEEALAYYGEGTPNLWDKVSSAIGGIKSAEEVRCHYEDLVDDVKMIESGRVTYPKYKTQGFWTRG

SEQ ID NO: 749 - DNA, 375 bp, Populus balsamifera subsp. trichocarpa
  misc_feature (1)..(375): Ceres Annot ID no. 1460824
  misc_feature (1)..(375): Encodes the peptide sequence at SEQ ID NO. 750
atgtcttcaagctatcaagcttccagaaattctagatccgcttggacaccaagggaaaacaaactgtttgaaaaggcactagccttgtttgataaggacacaccggacaggtggcaaaatatagccaaagctgttggtggtgtgaaatctgccgaggaagtgaagaaacactatgaaatccttattgaagatcttcaacatatcgagtctggccgcattcctattcctaagtacaagtctagtggaagctgcaacaacacaaacgaagaggaaagtgaagttaataagaacaaactgcagatggcaactggcaatctccatattgactcattgagagtcctccaggatttcatggcagggtgtaatcaacattaa

SEQ ID NO: 750 - protein, 124 aa, Populus balsamifera subsp. trichocarpa
  misc_feature (12)..(62): Pfam Name: Myb_DNA-binding Pfam Description: Myb-like DNA-binding domain
  misc_feature (1)..(124): Ceres Annot ID no. 1460824
  misc_feature (1)..(124): Bit score of 247.1 for HMM based on sequences of Figure 20
  misc_feature (1)..(124): Functional Homolog Of SEQ ID NO. 741
  misc_feature (1)..(124): in Figure 20
MSSSYQASRNSRSAWTPRENKLFEKALALFDKDTPDRWQNIAKAVGGVKSAEEVKKHYEILIEDLQHIESGRIPIPKYKSSGSCNNTNEEESEVNKNKLQMATGNLHIDSLRVLQDFMAGCNQH

SEQ ID NO: 751 - DNA, 458 bp, Glycine max
  misc_feature (1)..(458): Ceres Clone ID no. 638126
  misc_feature (1)..(458): Encodes the peptide sequence at SEQ ID NO. 752
tttatcagtcatggcgtcaagctctctcagcaaacaaaaggcttctgactcctcttggacaccaaaacagaacaagctgtttgaaaaagcacttgcaaaatatgacaaggatacccctgaccgatggcagaatgtagccaaagcagtaggtggaaaatctgcagatgaagttaagagacactatgaaatcctcttggaggatctgagacacattgagtctggtcatgttcctcttcccaagtacaagtccacaggaagcagcaccaatgttgaggaagaagagaggcttctgaagtatcttaaactgaattgatggaagcaatgtttatgttatcctcagctattggcagaatttatgtggccatccttgaatctgcggaaatatcttccctctctgttctatttcctgccattgtaatttagattgtttcaaatttcaatgaattatcctattctag

SEQ ID NO: 752 - protein, 100 aa, Glycine max
  misc_feature (13)..(62): Pfam Name: Myb_DNA-binding Pfam Description: Myb-like DNA-binding domain
  misc_feature (1)..(100): Ceres Clone ID no. 638126
  misc_feature (1)..(100): Bit score of 245.4 for HMM based on sequences of Figure 20
  misc_feature (1)..(100): Functional Homolog Of SEQ ID NO. 741
  misc_feature (1)..(100): in Figure 20
MASSSLSKQKASDSSWTPKQNKLFEKALAKYDKDTPDRWQNVAKAVGGKSADEVKRHYEILLEDLRHIESGHVPLPKYKSTGSSTNVEEEERLLKYLKLN

SEQ ID NO: 753 - DNA, 294 bp, Arabidopsis thaliana
  misc_feature (1)..(294): Ceres Annot ID no. 850366
  misc_feature (1)..(294): Encodes the peptide sequence at SEQ ID NO. 754
atggcatcaagctcaatgtcttctcagagctctggctcgtggactgctaagcagaacaaagcctttgagcaggctctagcaacctatgaccaggacactcctaaccgttggcaaaatgttgccaaagtcgtgggtggaaaaacaacagaggaggtaaagagacactacgaactcttagtgcaagacatcaacagcatagagaacggtcatgttccattcccaaactacaggactagtggaggctgcactaatggcaggcttagtcaggaggaaaaaaggtatgtattgtcctaa

SEQ ID NO: 754 - protein, 97 aa, Arabidopsis thaliana
  misc_feature (11)..(60): Pfam Name: Myb_DNA-binding Pfam Description: Myb-like DNA-binding domain
  misc_feature (1)..(97): Ceres Annot ID no. 850366
  misc_feature (1)..(97): Bit score of 235.4 for HMM based on sequences of Figure 20
  misc_feature (1)..(97): Functional Homolog Of SEQ ID NO. 741
  misc_feature (1)..(97): in Figure 20
MASSSMSSQSSGSWTAKQNKAFEQALATYDQDTPNRWQNVAKVVGGKTTEEVKRHYELLVQDINSIENGHVPFPNYRTSGGCTNGRLSQEEKRYVLS

SEQ ID NO: 755 - DNA, 734 bp, Panicum virgatum
  misc_feature (1)..(734): Ceres Clone ID no. 2034321
  misc_feature (1)..(734): Encodes the peptide sequence at SEQ ID NO. 756
aaaaacatcgagcattggaagagctaaaactccagtccagctatccaacaagtgtctacacataagacatcagcactagttgggttcccaagaaacaaagtccagtccaaagatgtctgggtcgaggagctcttcttcccgcagcgttaacgtggactccacgtggagcaagaaagagaacaagctgtttgaagaggccctcgcccactacggcgaggacacacccgaccgctggcacaaggtgtcccgcgccattggaggcagcaagacggccgacgaggtgcgccgccattatgagttactcgatgatgacatcaagctcattttgtccggcaatgttccgttccccaagtacaacacacagggagcttggaactaagagtgaagcatgtgaagaaccaccgacgacagacactgctgctacataaacagatacagatatcttagctattcaaggaaacatgctgatatattgttgttttcttatgaagttaatgatcgcttggtcaaaaataaaaggagccagtaaccatacgtatgtgtgttaatgtgtgtgtatataacgataggttgtacgcaaatcagctgttatgctacagaatttagggtacactatctgcccatagtgtgtagttatggtcccctagcagggactacttgtgcagtaaacagtattgtaaataaataaaactcatgtaccggtttgctaattatatataaattgtgcttggttg

SEQ ID NO: 756 - protein, 88 aa, Panicum virgatum
  misc_feature (15)..(65): Pfam Name: Myb_DNA-binding Pfam Description: Myb-like DNA-binding domain
  misc_feature (1)..(88): Ceres Clone ID no. 2034321
  misc_feature (1)..(88): Bit score of 181.2 for HMM based on sequences of Figure 20
  misc_feature (1)..(88): Functional Homolog Of SEQ ID NO. 741
MSGSRSSSSRSVNVDSTWSKKENKLFEEALAHYGEDTPDRWHKVSRAIGGSKTADEVRRHYELLDDDIKLILSGNVPFPKYNTQGAWN

SEQ ID NO: 757 - DNA, 264 bp, Sorghum bicolor
  misc_feature (1)..(264): Ceres Annot ID no. 8667941
  misc_feature (1)..(264): Encodes the peptide sequence at SEQ ID NO. 758
atgtctgggtccaggaactcttcccgcaacgttaacattgattccaactggagcaaaaaggagaacaagctgttcgaggaggccctagcctgctatggtgagggcacacctgaccgctggcacaaggtggcccgtgccatgggtggcatcaagacagccgatgaagttcgccgccattatgagatccttaatgatgatgtcacgctcattgaatccggcggagttccattccccaactacaacacacagggagcttggaactaa

SEQ ID NO: 758 - protein, 87 aa, Sorghum bicolor
  misc_feature (14)..(64): Pfam Name: Myb_DNA-binding Pfam Description: Myb-like DNA-binding domain
  misc_feature (1)..(87): Ceres Annot ID no. 8667941
  misc_feature (1)..(87): Bit score of 202.4 for HMM based on sequences of Figure 20
  misc_feature (1)..(87): Functional Homolog Of SEQ ID NO. 741
MSGSRNSSRNVNIDSNWSKKENKLFEEALACYGEGTPDRWHKVARAMGGIKTADEVRRHYEILNDDVTLIESGGVPFPNYNTQGAWN

SEQ ID NO: 759 - DNA, 748 bp, Zea mays
  misc_feature (1)..(748): Ceres Clone ID no. 100965215
  misc_feature (1)..(748): Encodes the peptide sequence at SEQ ID NO. 760
acgtgaacagcaagcagttcacgtttgccaagtgcctataaatagtagccaccctatagcagcaacgagatcaaaacagcagagcttgcaagagctaaaaacgacttcagtccagccatccaacaagaagatcagtctacacataaaaccagagatgtctgggtccaggagctcttcgtctcacaacgttaccattgattccgagtggagcaaaaaggagaacaagctgttcgaggaggccctagcctgctacggcgcgggcacacccgaccgctggcacaaggtggcccgtgccatgggtggcatcaagacagccgacgaggttygccgccatcacgagatccttaatgaggatgtcacgctcatcgaatccggcagagttccattccccaactacaacacgcagggagcttggaactaaggagtgaaggatgatgtgaagaaccmccagacaggaactactgctacgcatgaaatagatatyttagccattgaagtaaatgtgctgatatattgtgttaagaagtttatgattgctcaggtaataaataagaggagctagagaatacacataagtgtgttatgtgtaaatagctatatataggctgtgagcaaatcatcagttatgctatagaaaccagggaaccctatctgcccatagtgtgtactgtgaagttatagtcccctcccctatggatgaatacttgtatagtaaagtgtggtgtaaaactcttgtaccagtttgtta

SEQ ID NO: 760 - protein, 88 aa, Zea mays
  misc_feature (16)..(65): Pfam Name: Myb_DNA-binding Pfam Description: Myb-like DNA-binding domain
  misc_feature (1)..(88): Ceres Clone ID no. 100965215
  misc_feature (1)..(88): Bit score of 185.9 for HMM based on sequences of Figure 20
  misc_feature (1)..(88): Functional Homolog Of SEQ ID NO. 741
  misc_feature (58)..(58): Xaa is any aa, unknown, or other
MSGSRSSSSHNVTIDSEWSKKENKLFEEALACYGAGTPDRWHKVARAMGGIKTADEVXRHHEILNEDVTLIESGRVPFPNYNTQGAWN

SEQ ID NO: 761 - protein, 91 aa, Oryza sativa subsp. indica
  misc_feature (18)..(68): Pfam Name: Myb_DNA-binding Pfam Description: Myb-like DNA-binding domain
  misc_feature (1)..(91): Public GI ID no. 125527154
  misc_feature (1)..(91): Bit score of 166.4 for HMM based on sequences of Figure 20
  misc_feature (1)..(91): Functional Homolog Of SEQ ID NO. 741
MSSRSSSSSRNSNSVNMDSEWSKKENKLFEEALAYYGEGAPDLFHKVSRAMGGTKTADEVRRHYEILEDDLKLIEARRVPFPKYNTQGAWN

SEQ ID NO: 762 - protein, 75 aa, Oryza sativa subsp. japonica
  misc_feature (2)..(52): Pfam Name: Myb_DNA-binding Pfam Description: Myb-like DNA-binding domain
  misc_feature (1)..(75): Public GI ID no. 115471859
  misc_feature (1)..(75): Bit score of 131.7 for HMM based on sequences of Figure 20
  misc_feature (1)..(75): Functional Homolog Of SEQ ID NO. 741
MASEWSKEENKLFEQAIAYYGEGAPDLWHKVSRAMGGTKTADEVRLHFEILVDDIKLIEARRVPFPKYNTQGAWN

SEQ ID NO: 763 - protein, 75 aa, Oryza sativa subsp. indica
  misc_feature (2)..(52): Pfam Name: Myb_DNA-binding Pfam Description: Myb-like DNA-binding domain
  misc_feature (1)..(75): Public GI ID no. 125558161
  misc_feature (1)..(75): Bit score of 136.5 for HMM based on sequences of Figure 20
  misc_feature (1)..(75): Functional Homolog Of SEQ ID NO. 741
MASEWSKEENKLFEQAIAYYGEGAPDLWHKVSRAMGGTKTADEVRRHFEILVDDIKLIEARRVPFPKYNTQGAWN

SEQ ID NO: 764 - protein, 87 aa, Oryza sativa subsp. japonica
  misc_feature (18)..(68): Pfam Name: Myb_DNA-binding Pfam Description: Myb-like DNA-binding domain
  misc_feature (1)..(87): Public GI ID no. 55773837
  misc_feature (1)..(87): Bit score of 134.2 for HMM based on sequences of Figure 20
  misc_feature (1)..(87): Functional Homolog Of SEQ ID NO. 741
MSSRSSSSSRNSNSVNMDSEWSKKENKLFEEALAYYGEGAPDLFHKVSRAMGGTKTADEVRRHYEILEDDLKLIEARRVPFPKGGSI

SEQ ID NO: 765 - DNA, 776 bp, Panicum virgatum
  misc_feature (1)..(776): Ceres Clone ID no. 1722230
  misc_feature (1)..(776): Encodes the peptide sequence at SEQ ID NO. 766
atcagctcatcacaactcttgatctctagctagctaaagagataagcttcctctcttcctctcggtcgaaggagtgatcctctctcactctcaccaggagctcagctcgggtagctcaaggaggccagaagaagaaatggcgtcgctgtcgatgaccagcagctcggtgcgggcgcagtggacgaagaagcagaacaagctcttcgagcaggcgttggccgtgtacgacaaggacacccccgaccggtggcacaacatcgcccgcgccgtcggcggcaagtccgccgaggaggtcaggcgctactacgagctgctggaggaggatgtcaagcacatcgagtccggcaaggtgcccttccccgcctaccgctgccccggcggcgccggcgccggcgccctcggctacgaggccgacaggatgaagcatctgaagatctaggcgaacttcagagtatggtcgagaagaggctgcgcaggcacgtgtattagtgtatatatgattgggacagcatgcatgtccatgctactcctacgcaagtggtctggaagaagcaagaagaatcagatgagatgcatgcatgtcataattaattaattaattaattaattaataattagtatgggatgatcgagtagtatcctagcctgtcacgcgagatcgaccgacccatcgatctcccagcatgtgtccttcgtacccacgcgcgtatgtgtattatatcctagctgcatctgtgtaccataccaatcaagaaacatgaacttgatattgatgc

SEQ ID NO: 766 - protein, 100 aa, Panicum virgatum
  misc_feature (12)..(61): Pfam Name: Myb_DNA-binding Pfam Description: Myb-like DNA-binding domain
  misc_feature (1)..(100): Ceres Clone ID no. 1722230
  misc_feature (1)..(100): Bit score of 179.6 for HMM based on sequences of Figure 20
  misc_feature (1)..(100): Functional Homolog Of SEQ ID NO. 741
MASLSMTSSSVRAQWTKKQNKLFEQALAVYDKDTPDRWHNIARAVGGKSAEEVRRYYELLEEDVKHIESGKVPFPAYRCPGGAGAGALGYEADRMKHLKI

SEQ ID NO: 767 - DNA, 258 bp, Populus balsamifera subsp. trichocarpa
  misc_feature (1)..(258): Ceres Annot ID no. 1487827
  misc_feature (1)..(258): Encodes the peptide sequence at SEQ ID NO. 768
atggcatccaattctctcaactcttcacgtaactgtagttcctcttggacccccaagcaaaacaaactattcgaaaaggccctggctttgtatgacaaggacacccctgaccgctggcataatgttgccaaagctgtgggtgggaaatctgcagaggaagtggagaggcactatgaaattctcatcaaggatgtcagggaaattgagtctggtcgggttccattccctaattacaggtcaagtggaaacagcaactaa

SEQ ID NO: 768 - protein, 85 aa, Populus balsamifera subsp. trichocarpa
  misc_feature (13)..(62): Pfam Name: Myb_DNA-binding Pfam Description: Myb-like DNA-binding domain
  misc_feature (1)..(85): Ceres Annot ID no. 1487827
  misc_feature (1)..(85): Bit score of 180.4 for HMM based on sequences of Figure 20
  misc_feature (1)..(85): Functional Homolog Of SEQ ID NO. 741
MASNSLNSSRNCSSSWTPKQNKLFEKALALYDKDTPDRWHNVAKAVGGKSAEEVERHYEILIKDVREIESGRVPFPNYRSSGNSN

SEQ ID NO: 769 - DNA, 749 bp, Panicum virgatum
  misc_feature (1)..(749): Ceres Clone ID no. 1910072
  misc_feature (1)..(749): Encodes the peptide sequence at SEQ ID NO. 770
atcagctcatcagctcttgatctctagctagctagagagataagcttcctctcttcctctcggtcgagggagtgatcctctctcactctcaccaggagctcagctcgggtagctcaaggaggccagaagaagaaatggcgtcgctgtcgatgaccagcagctcggtgcgggcgcagtggacgaagaagcagaacaagctcttcgagcaggcgttggccgtgtacgacaaggacacccccgaccggtggcacaacatcgcccgcgccgtcggcggcaagtcagccgaggaggtcaggcgctactacgagatgctggaggaggatgtcaagcacatcgagtccggcaaggtgcccctccccgcctaccgctgccccggcggcgccggcgccggcgccctcggctacgaggccgacaggatgaagcatctgaagatctaggcgaacttcagaggatggtcaagaagaggctgcgcaggcacacgtgtatatatgattgggatagcatgcatgtccatgctactcctacgcaagtggtctggaagaagcaagaagaatcagatgagatgcatgcatgtcataattaattaattaattaattaataattagtatggggatgatcgagtagtatcctagcctgtcacgcgagatcgaccgacccatcgatctcccagcatgtgtccttcgtacccacgcgcgtatgtgtattatatcctagctgcatctgtgtaccataccaatcagaaacatga

SEQ ID NO: 770 - protein, 100 aa, Panicum virgatum
  misc_feature (12)..(61): Pfam Name: Myb_DNA-binding Pfam Description: Myb-like DNA-binding domain
  misc_feature (1)..(100): Ceres Clone ID no. 1910072
  misc_feature (1)..(100): Bit score of 177.1 for HMM based on sequences of Figure 20
  misc_feature (1)..(100): Functional Homolog Of SEQ ID NO. 741
MASLSMTSSSVRAQWTKKQNKLFEQALAVYDKDTPDRWHNIARAVGGKSAEEVRRYYEMLEEDVKHIESGKVPLPAYRCPGGAGAGALGYEADRMKHLKI

SEQ ID NO: 771 - DNA, 508 bp, Arabidopsis thaliana
  misc_feature (1)..(508): Ceres Clone ID no. 143475
  misc_feature (1)..(508): Encodes the peptide sequence at SEQ ID NO. 772
aaaatcaagtcctttttcatcaagtcatacatacatcttccttcttctttttttctccctcccaagaagcagatcttgtactctcgatatacaaacttattcgtgatatggcttccaactcaatgagctctagcgcttcttggacacgtaaggagaacaaattatttgaaagggcgttggctacatatgaccaggacactcctgaccgttggcataacgttgcaagagccgttggcggcaaatcagctgaagaagtaaggcgacactacgagctcctcattagggatgtcaatgacattgagtcagggcgttatccacatcccaattaccgttcaaatggaaacaatcactgaaagcattgaaggaactccaaaaggctctactgaagtggacatggttccaaaaccattcacaaagcacatctaagcaaagatatctaaatgtatttacttgtttttgtgttacgaatatgtaagaattatctaaatcaatcaatgtggtttcatat

SEQ ID NO: 772 - protein, 81 aa, Arabidopsis thaliana
  misc_feature (9)..(58): Pfam Name: Myb_DNA-binding Pfam Description: Myb-like DNA-binding domain
  misc_feature (1)..(81): Ceres Clone ID no. 143475
  misc_feature (1)..(81): Bit score of 164.6 for HMM based on sequences of Figure 20
  misc_feature (1)..(81): Functional Homolog Of SEQ ID NO. 741
MASNSMSSSASWTRKENKLFERALATYDQDTPDRWHNVARAVGGKSAEEVRRHYELLIRDVNDIESGRYPHPNYRSNGNNH

SEQ ID NO: 773 - DNA, 273 bp, Populus balsamifera subsp. trichocarpa
  misc_feature (1)..(273): Ceres Annot ID no. 1514100
  misc_feature (1)..(273): Encodes the peptide sequence at SEQ ID NO. 774
atggcatcaagctcaatgtcctctcgcggttcgggctcgtggactgttcagcagaacaaagcctttgaaagggctttggctgtgtatgacagagacacgcccgatcgctggtacaatgtagccagggcagtcggtggaaaaaccgcagaagaagtgaaaaggcactatgaactgcttgtggaggatgtgaagcatattgagtcgggccatgttcccttccctaattacaggactaccggggcaaatggccacgcaagagacgggattgtttag

SEQ ID NO: 774 - protein, 90 aa, Populus balsamifera subsp. trichocarpa
  misc_feature (11)..(60): Pfam Name: Myb_DNA-binding Pfam Description: Myb-like DNA-binding domain
  misc_feature (1)..(90): Ceres Annot ID no. 1514100
  misc_feature (1)..(90): Bit score of 180.1 for HMM based on sequences of Figure 20
  misc_feature (1)..(90): Functional Homolog Of SEQ ID NO. 741
MASSSMSSRGSGSWTVQQNKAFERALAVYDRDTPDRWYNVARAVGGKTAEEVKRHYELLVEDVKHIESGHVPFPNYRTTGANGHARDGIV

SEQ ID NO: 775 - DNA, 517 bp, Brassica napus
  misc_feature (1)..(517): Ceres Clone ID no. 1069222
  misc_feature (1)..(517): Encodes the peptide sequence at SEQ ID NO. 776
aaaatcaactcatacatacatctttcttcttttactccctccaaagaaaccagatttccattttcaaaacactcttttcgatcttttactaaatggcttccaactccatgagttctaacacttcttggacgcgtaaggagaacaaactatttgaaagggctttggctatatatgagcaggacactcctgaccgatggcataacgttgctagagcagttggtgggaaatcggctgaagaagtaaggagacactacgagctcctcgtaagggatgtcaatgacattgagtcagggcgttatccgcatcctacttaccgttcaaatggaaactgaaagcatttaagctactcaaaaaggttcctctgaaaccaacatgattcgaaaaccagaaacaaacagagaggatctaaacaaagatatatcaaatgtatttacgtctattgtgttatatgtatacgactatgtaagaattttatgctttcatgctaatattaatgaatcaacgtgagtttcacatg

SEQ ID NO: 776 - protein, 79 aa, Brassica napus
  misc_feature (9)..(58): Pfam Name: Myb_DNA-binding Pfam Description: Myb-like DNA-binding domain
  misc_feature (1)..(79): Ceres Clone ID no. 1069222
  misc_feature (1)..(79): Bit score of 150.9 for HMM based on sequences of Figure 20
  misc_feature (1)..(79): Functional Homolog Of SEQ ID NO. 741
MASNSMSSNTSWTRKENKLFERALAIYEQDTPDRWHNVARAVGGKSAEEVRRHYELLVRDVNDIESGRYPHPTYRSNGN

SEQ ID NO: 777 - DNA, 237 bp, Populus balsamifera subsp. trichocarpa
  misc_feature (1)..(237): Ceres Annot ID no. 1510450
  misc_feature (1)..(237): Encodes the peptide sequence at SEQ ID NO. 778
atgtcttccaattctctcacctcttggacacctaagcaaaacaaactattcgaaaaggccctggctttacatgacaaggacacccctgaccgctggcataatgttgccaaagctgtgggtgggaaatctgcagaggaagtgaagaggcactatgagattctcatcaaggatgtcagggaaattgagtctggcagagttccattccctaattacaggtcaagtggaaacggcaactaa

SEQ ID NO: 778 - protein, 78 aa, Populus balsamifera subsp. trichocarpa
  misc_feature (6)..(55): Pfam Name: Myb_DNA-binding Pfam Description: Myb-like DNA-binding domain
  misc_feature (1)..(78): Ceres Annot ID no. 1510450
  misc_feature (1)..(78): Bit score of 161.4 for HMM based on sequences of Figure 20
  misc_feature (1)..(78): Functional Homolog Of SEQ ID NO. 741
MSSNSLTSWTPKQNKLFEKALALHDKDTPDRWHNVAKAVGGKSAEEVKRHYEILIKDVREIESGRVPFPNYRSSGNGN

SEQ ID NO: 779 - DNA, 489 bp, Gossypium hirsutum
  misc_feature (1)..(489): Ceres Clone ID no. 100068619
  misc_feature (1)..(489): Encodes the peptide sequence at SEQ ID NO. 780
ctctttttcttttcttctcttttctttggcctcagacccttaatttcgattgttaattatcactgttctgcaatggcgtcaggttcgaactggacgccaaagcaaaacaagttgttcgagaacgctttagctatctacgacaaggatacaccagaccggtggcacaagctagccagggctgtcggggggaagaccgtggaggaagtgaagttgcattaccagaaccttgtggatgacatcaagcagatagagtctgggcacgtgcctttgcccccttataagaaagctggagggaaccaaggatacaacaatttcatggacgatgaagaaccaaggatgaggaatctcaggctttagtgaagtatgaaccagaaatagctgtagaatatcaacctttcaataaaaggaaatgcaaagcagcaaacatataaattatctcttaatttcgtttacatttcctgctcatatatatgttttttgtgtgcttga

SEQ ID NO: 780 - protein, 94 aa, Gossypium hirsutum
  misc_feature (4)..(53): Pfam Name: Myb_DNA-binding Pfam Description: Myb-like DNA-binding domain
  misc_feature (1)..(94): Ceres Clone ID no. 100068619
  misc_feature (1)..(94): Bit score of 144.5 for HMM based on sequences of Figure 20
  misc_feature (1)..(94): Functional Homolog Of SEQ ID NO. 741
MASGSNWTPKQNKLFENALAIYDKDTPDRWHKLARAVGGKTVEEVKLHYQNLVDDIKQIESGHVPLPPYKKAGGNQGYNNFMDDEEPRMRNLRL

SEQ ID NO: 781 - DNA, 312 bp, Sorghum bicolor
  misc_feature (1)..(312): Ceres Annot ID no. 8734211
  misc_feature (1)..(312): Encodes the peptide sequence at SEQ ID NO. 782
atggcttccggcgggtcgtcgtcgtcgtcgtcccgggcgtggacgcagcggcagaacaagcagttcgagtgcgcgctggcggtgtatgaccgggagacaccggaccggtggcacaacatcgcccgctacatgggcggcaccaagtccgccgacgaggtgcgccgccacttcgagcagctcgtccacgacgtcacccagatcgaggccggccgcgtccccttcccccgctacggctacggcagcgcgccgcccgccggcggcggcggccttgacgacaccagtgatgagctttattattggaaaggtagctag

SEQ ID NO: 782 - protein, 103 aa, Sorghum bicolor
  misc_feature (11)..(61): Pfam Name: Myb_DNA-binding Pfam Description: Myb-like DNA-binding domain
  misc_feature (1)..(103): Ceres Annot ID no. 8734211
  misc_feature (1)..(103): Bit score of 140.6 for HMM based on sequences of Figure 20
  misc_feature (1)..(103): Functional Homolog Of SEQ ID NO. 741
MASGGSSSSSSRAWTQRQNKQFECALAVYDRETPDRWHNIARYMGGTKSADEVRRHFEQLVHDVTQIEAGRVPFPRYGYGSAPPAGGGGLDDTSDELYYWKGS

SEQ ID NO: 783 - DNA, 237 bp, Solanum lycopersicum
  misc_feature (1)..(237): Ceres Annot ID no. 8456508
  misc_feature (1)..(237): Encodes the peptide sequence at SEQ ID NO. 784
atggcatcaaattcactcactgcttggactccaagagaaaacaagaaattcgagcaggcactcgcggtctacgataaggacacatctgatcgatggcaaaacattgctagatacgttggtgggaaatcagttgaagaagttaaacatcactatgctatacttgtagaggatcttaagcacattgaatctggtgacgtcccattcccaaaatacaagtcaggtggaaagtctcgttaa

SEQ ID NO: 784 - protein, 78 aa, Solanum lycopersicum
  misc_feature (6)..(55): Pfam Name: Myb_DNA-binding Pfam Description: Myb-like DNA-binding domain
  misc_feature (1)..(78): Ceres Annot ID no. 8456508
  misc_feature (1)..(78): Bit score of 135.5 for HMM based on sequences of Figure 20
  misc_feature (1)..(78): Functional Homolog Of SEQ ID NO. 741
MASNSLTAWTPRENKKFEQALAVYDKDTSDRWQNIARYVGGKSVEEVKHHYAILVEDLKHIESGDVPFPKYKSGGKSR

SEQ ID NO: 785 - protein, 96 aa, Vitis vinifera
  misc_feature (9)..(58): Pfam Name: Myb_DNA-binding Pfam Description: Myb-like DNA-binding domain
  misc_feature (1)..(96): Public GI ID no. 225428460
  misc_feature (1)..(96): Bit score of 202.0 for HMM based on sequences of Figure 20
  misc_feature (1)..(96): Functional Homolog Of SEQ ID NO. 741
MASGSRMGSGLWTSKQNKLFEKALALYDKDTPDRWQNVAKAVGGKSAEEVKRHYEILIEDLKHIESGHVPIPNYKSTGSNSIGDQEQRLLKCIKLQ

SEQ ID NO: 786 - DNA, 565 bp, Gossypium hirsutum
  misc_feature (1)..(565): Ceres Clone ID no. 100067803
  misc_feature (1)..(565): Encodes the peptide sequence at SEQ ID NO. 787
cggacgcgtgggtttttggcctcagaccctgaatttcgattgttaattatcactgttctgcaatggcgtcaggttcgaactggacgccaaagcaaaacaagttgttcgagaactctttagctatctacgacaaggatacaccagaccggtggcacaagctagccagggctgttggggggaagaccgtggaggaagtgaagttgcattaccagaaccttgtggatgacatcaagcagatagagtctgggcacgtgcctttgcccccttacaagaaagctggaggaacaaaggatacaacaatttcatggacgatgaagaaccaaggatgaggaatctcaggctttagtgaagtatgaaccagaaatagcctgtagaatatcaacctttcaataaaaggaaatgcaaagcagcaaacatataaattattgctcttaatttcgtttacatttcccgctcatatatatatatatgttttttgtgtgcttgaatgtaacaagcagccacaacgttcctatacttgcatgtatcaagtatgaaattatagcattggtgccttgtttttatt

SEQ ID NO: 787 - protein, 88 aa, Gossypium hirsutum
  misc_feature (4)..(53): Pfam Name: Myb_DNA-binding Pfam Description: Myb-like DNA-binding domain
  misc_feature (1)..(88): Ceres Clone ID no. 100067803
  misc_feature (1)..(88): Bit score of 141.6 for HMM based on sequences of Figure 20
  misc_feature (1)..(88): Functional Homolog Of SEQ ID NO. 741
MASGSNWTPKQNKLFENSLAIYDKDTPDRWHKLARAVGGKTVEEVKLHYQNLVDDIKQIESGHVPLPPYKKAGGTKDTTISWTMKNQG

SEQ ID NO: 788 - DNA, 297 bp, Populus balsamifera subsp. trichocarpa
  misc_feature (1)..(297): Ceres Annot ID no. 1450327
  misc_feature (1)..(297): Encodes the peptide sequence at SEQ ID NO. 789
atggcatcaagctccgtgtcctctcgcggttcgggctcgtggactgctcagcagaacaaagcctttgaaagggctttggctgtttatgacagggacacacccgaccgttggcataatgtagccagggcagttggtggaaaaactgctgaagaagtgaaaaggcattacgaaatcctcgtggaggatgtcaagcatattgagtcaggccgagttcccttccctaattacaggactaccggggcaaatggccactcaaagactggtgaggaaaagatgtatatatatagcagtttataa

SEQ ID NO: 789 - protein, 98 aa, Populus balsamifera subsp. trichocarpa
  misc_feature (11)..(60): Pfam Name: Myb_DNA-binding Pfam Description: Myb-like DNA-binding domain
  misc_feature (1)..(98): Ceres Annot ID no. 1450327
  misc_feature (1)..(98): Bit score of 196.8 for HMM based on sequences of Figure 20
  misc_feature (1)..(98): Functional Homolog Of SEQ ID NO. 741
MASSSVSSRGSGSWTAQQNKAFERALAVYDRDTPDRWHNVARAVGGKTAEEVKRHYEILVEDVKHIESGRVPFPNYRTTGANGHSKTGEEKMYIYSSL

SEQ ID NO: 790 - DNA, 655 bp, Panicum virgatum
  misc_feature (1)..(655): Ceres Clone ID no. 1787372
  misc_feature (1)..(655): Encodes the peptide sequence at SEQ ID NO. 791
atagctagatcgatcggtctcaacagaccccggccgatcagtgctccagatcgaacgacgacgacaatggcttccggcggcgggtcgtcgtcgtctaacagcagcaggggctcgtcgtcgtcccgcgggtggacgcagcggcagaacaagcagttcgagtgcgcgctggcggtgtacgacagggagaccccggaccggtggcacaacgtcgcccgctacatgggcggcgccaagtccgccgacgaggtgcgccgccacttcgagcagctcgtcgccgacgtcgcccagatcgaggccggccgcgtccccttcccacgctacgccgccgacgacgacgcggcggcggccaccagcagcaggaccaagtatctcaagttccagtgatgatcaagacaaaatgacggcgccagatcgagaccatgtccccgagtctccgagatgacacgacgcatgcatatatagtgatagattataggtgtgtagggtgtaataatcactgtgtggctggatatattggatccaaatatggatgtaatttagggaagaaaagtacttttcaacctcatgttgtgtaaattagctaattattaagctggttttcatcggtactatatgctcgttatatcacaagaagcaatgtaaaatgtttcggggg

SEQ ID NO: 791 - protein, 105 aa, Panicum virgatum
  misc_feature (19)..(69): Pfam Name: Myb_DNA-binding Pfam Description: Myb-like DNA-binding domain
  misc_feature (1)..(105): Ceres Clone ID no. 1787372
  misc_feature (1)..(105): Bit score of 149.1 for HMM based on sequences of Figure 20
  misc_feature (1)..(105): Functional Homolog Of SEQ ID NO. 741
MASGGGSSSSNSSRGSSSSRGWTQRQNKQFECALAVYDRETPDRWHNVARYMGGAKSADEVRRHFEQLVADVAQIEAGRVPFPRYAADDDAAAATSSRTKYLKFQ

SEQ ID NO: 792 - DNA, 339 bp, Populus balsamifera subsp. trichocarpa
  misc_feature (1)..(339): Ceres Annot ID no. 1457249
  misc_feature (1)..(339): Encodes the peptide sequence at SEQ ID NO. 793
atgtcttccaattctctcacctcttggacacctaagcaaaacaaactattcgaaaaggccctggctttacatgacaaggacacccctgaccgctggcataatgttgccaaagctgtgggtgggaaatctgcagaggaagtgaagaggcactatgagattctcatcaaggatgtcagggaaattgagtctggcagagttccattccctaattacagattaatgtcatatacaagtattaaagcatcatttaagccaggatacaggcaacgtagatttctgatctttcaggacaaattccatgggaatggtcaatcaaattctgcaccgtcattcgcctaa

SEQ ID NO: 793 - protein, 112 aa, Populus balsamifera subsp. trichocarpa
  misc_feature (6)..(55): Pfam Name: Myb_DNA-binding Pfam Description: Myb-like DNA-binding domain
  misc_feature (1)..(112): Ceres Annot ID no. 1457249
  misc_feature (1)..(112): Bit score of 164.3 for HMM based on sequences of Figure 20
  misc_feature (1)..(112): Functional Homolog Of SEQ ID NO. 741
MSSNSLTSWTPKQNKLFEKALALHDKDTPDRWHNVAKAVGGKSAEEVKRHYEILIKDVREIESGRVPFPNYRLMSYTSIKASFKPGYRQRRFLIFQDKFHGNGQSNSAPSFA

SEQ ID NO: 794 - protein, 88 aa, Solanum lycopersicum
  misc_feature (11)..(60): Pfam Name: Myb_DNA-binding Pfam Description: Myb-like DNA-binding domain
  misc_feature (1)..(88): Public GI ID no. 7981380
  misc_feature (1)..(88): Bit score of 161.3 for HMM based on sequences of Figure 20
  misc_feature (1)..(88): Functional Homolog Of SEQ ID NO. 741
MSSMSSQHGSSGSWTAKQNKAFEKALAVYDKETRDRWSNVAKAVGGKTAEEVKRHYEILLRDVFFIDNGMVPFPKYKTTGGSHNSTSD

SEQ ID NO: 795 - protein, 96 aa, Vitis vinifera
  misc_feature (7)..(56): Pfam Name: Myb_DNA-binding Pfam Description: Myb-like DNA-binding domain
  misc_feature (1)..(96): Public GI ID no. 147767321
  misc_feature (1)..(96): Bit score of 185.6 for HMM based on sequences of Figure 20
  misc_feature (1)..(96): Functional Homolog Of SEQ ID NO. 741
MSSRSSGSSWTAKQNKAFEEALAVYDKDTPDRWYNVARAVGGKTVEEVKRHYEILVEDIKSIDSDKVPFPNYKTTGASSRSNMSDQEKRMMNLKLR

SEQ ID NO: 796 - DNA, 665 bp, Gossypium hirsutum
  misc_feature (1)..(665): Ceres Clone ID no. 1916884
  misc_feature (1)..(665): Encodes the peptide sequence at SEQ ID NO. 797
acacaccgcaccttgacttgaagtaaccttttgagagaaaaagtccatctattcccttccatcatcgtttcaatttattcaacctttctctcaaattcagtcacaggcatatttattttaagttttagcctgccattcacccgagcttgtcgataaatcctctgttttcaatagttgcatttggattttcatcaaatggcatcccattctctcagttcttcacgtagctctaactcctcctggacacctaagcaaaacaaaatgttcgagaaggctctggctgaatttgaccaggacactcctgagcgctggattaatattgctaaagctgtgggtggaaagtcagctgaggaagtcaagcagcactatgagatcctagtcagggatgtcaaagagatcgagtctggacggtacccttatccatatccaagtgggagcagcaactaaagcagtgagttatcagcttaccgtatccaaagggttctctgaagggtcaaagatcatagtgaaagaacattatattatgcaaccagagacctcaattgcaggaagactattatagaatattccccaggaaaatattattatttgctttatttatctttttgtatttttctttgaccttgtctagttagattaaatgttaaatatattttattgatatt

SEQ ID NO: 797 - protein, 83 aa, Gossypium hirsutum
  misc_feature (13)..(62): Pfam Name: Myb_DNA-binding Pfam Description: Myb-like DNA-binding domain
  misc_feature (1)..(83): Ceres Clone ID no. 1916884
  misc_feature (1)..(83): Bit score of 145.0 for HMM based on sequences of Figure 20
  misc_feature (1)..(83): Functional Homolog Of SEQ ID NO. 741
MASHSLSSSRSSNSSWTPKQNKMFEKALAEFDQDTPERWINIAKAVGGKSAEEVKQHYEILVRDVKEIESGRYPYPYPSGSSN

SEQ ID NO: 798 - DNA, 663 bp, Panicum virgatum
  misc_feature (1)..(663): Ceres Clone ID no. 1775942
  misc_feature (1)..(663): Encodes the peptide sequence at SEQ ID NO. 799
acaagccacacaggccaagcgagcgatcaagagccagccatcagctctcgcgcgctcagtttagctagctgcttcttctgagagaaattaaagatacatatagctagtaggagatagatggcgtcgatgtcaatgagatcgtcgagggcgcagtggacgaagaagcaggacaagctgttcgagcaggcgctggcggtgtacgacaaggacacgccggaccggtggcacaacatcgcgcgcgccgtggggggcaagtcggcggaggaggtcaggcgctactacgagctgctggaagaggacgtcaagcgcatcgaggccggcaaggtgcccttccccgtctataggtgcccgccggcgccgcccccaattactagctaggcccacaggctgaagcaccagaagatctacgtacgtacttcggcaacaatcatgacatacagtgggtttggctacaaaacagtaactcaaccaagtggccggagcatccgtgcacatatatgaataactaccgctacctctagttaccgcagatcaatcgatctcccatgtatgtagtagtatacgtgttcatctggattctcaatttctcatgtaagatcatctctgtatttgtattatgtatcttgagaaaaagtgaagtaaaaaagtccttcatttcccctt

SEQ ID NO: 799 - protein, 86 aa, Panicum virgatum
  misc_feature (10)..(59): Pfam Name: Myb_DNA-binding Pfam Description: Myb-like DNA-binding domain
  misc_feature (1)..(86): Ceres Clone ID no. 1775942
  misc_feature (1)..(86): Bit score of 142.2 for HMM based on sequences of Figure 20
  misc_feature (1)..(86): Functional Homolog Of SEQ ID NO. 741
MASMSMRSSRAQWTKKQDKLFEQALAVYDKDTPDRWHNIARAVGGKSAEEVRRYYELLEEDVKRIEAGKVPFPVYRCPPAPPPITS

SEQ ID NO: 800 - DNA, 752 bp, Panicum virgatum
  misc_feature (1)..(752): Ceres Clone ID no. 1761808
  misc_feature (1)..(752): Encodes the peptide sequence at SEQ ID NO. 801
atcagctcatcacagctcttgatctctagctagctagagagataagcttcctctcttcctctcggtcgagggagtgatcctctctcactctcaccaggagctcagctcgggtagctcaaggaggccagaagaagaaatggcgtcgctgtcgatgaccagcagctcggtgcgggcgcagaggacgaagaagcagaacaagctcttcgagcaggcgttggccgtgtacgacaaggacacccccgaccggtggcacaacatcgcccgcgccgtcggcggcaagtccgccgaggaggtcaggcgctactacgagctgctggaggaggatgtcaagcacatcgagtccggcaaggtgcccctccccgcctaccgctgccccggcggcgccggcgccggcgccctcggctacgaggccgacaggatgaagcatctgaagatctaggcgaacttcaaaggatggtcgagaagaggctgcgcaggcacgtgtatatatgattgggatagcatgcatgtccatgctactcctacgcaagtggtctggaagaagcaagaagaatcagatgagatgcatgcatgtcataattaattaataattagtatgggatgatcgagtagtatcctagcctgtcacgcgagatcgaccgacccatcgatctcccagcatgtgtccttcgtacccacgcgcgtatgtgtattatatcctagctgcatctgtgtaccataccaatcaagaaacatgaacttgatattgatgc

SEQ ID NO: 801 - protein, 100 aa, Panicum virgatum
  misc_feature (12)..(61): Pfam Name: Myb_DNA-binding Pfam Description: Myb-like DNA-binding domain
  misc_feature (1)..(100): Ceres Clone ID no. 1761808
  misc_feature (1)..(100): Bit score of 167.7 for HMM based on sequences of Figure 20
  misc_feature (1)..(100): Functional Homolog Of SEQ ID NO. 741
MASLSMTSSSVRAQRTKKQNKLFEQALAVYDKDTPDRWHNIARAVGGKSAEEVRRYYELLEEDVKHIESGKVPLPAYRCPGGAGAGALGYEADRMKHLKI

SEQ ID NO: 802 - DNA, 735 bp, Gossypium hirsutum
  misc_feature (1)..(735): Ceres Clone ID no. 1914387
  misc_feature (1)..(735): Encodes the peptide sequence at SEQ ID NO. 803
accatcatccccttgacttcagtcttctcccttgacgggggcggcaatctcttcttcttcttcttccttcttagctactttctcttttgtcggttactcttcctttaagatctcatcttgaaagtcttacattcccttttttattcacccccaacgtaaaaaatggcatcctctattacgctttcacgtgattctaactcctactggactccaaagcaaaacaagctatttgaaagggcacttgctgtatatgacaaggacactccagaccgctggcaaaaggtggctgcagctgtgggggagaaatcagtcgaggaagtaagaaggcattatgagatcctagtgagggatctcatgtatatagaatctggtcaaatccctatacccaattacaaaagcactgggagtaacagaagatgaattgctggggtgcaaaggtttatgaagaatctaaggctccaatgaagcacaagtttcagctgcactgtcagagaatctgtaaaaactaaaataaaaagaataaattataaagaactggagaatttgcatcgtgattctccctgtcttattttacattgagtgatcgagtcagtttggttttttctttttgtgtgtgtgtgtcagtttgttaatatgacaacaaaagttgaactctacaattattaaatttgtgagtattgtactgaagttaccagttttaaattaaaaaaaaaaggtattactactaaatgctgg

SEQ ID NO: 803 - protein, 85 aa, Gossypium hirsutum
  misc_feature (12)..(61): Pfam Name: Myb_DNA-binding Pfam Description: Myb-like DNA-binding domain
  misc_feature (1)..(85): Ceres Clone ID no. 1914387
  misc_feature (1)..(85): Bit score of 164.4 for HMM based on sequences of Figure 20
  misc_feature (1)..(85): Functional Homolog Of SEQ ID NO. 741
MASSITLSRDSNSYWTPKQNKLFERALAVYDKDTPDRWQKVAAAVGEKSVEEVRRHYEILVRDLMYIESGQIPIPNYKSTGSNRR

SEQ ID NO: 804 - DNA, 267 bp, Sorghum bicolor
  misc_feature (1)..(267): Ceres Annot ID no. 8734209
  misc_feature (1)..(267): Encodes the peptide sequence at SEQ ID NO. 805
atggcgtcgatgcagtcgatgacgagcgcagcggcgcgcgcgcagtggacgccgaagcagaacaagctgttcgagcaggcgctggccgtttacgacaaggacacgccggaccggtggcacaacatcgcccgcgccgtcggcggcggcaagtccgccgaggacgtcaggcgctactacgacctgctggaggaggacgtcggccacatcgagtccggcaaggtgcccttcccggcctaccgctgcgccaccggctacggggccgcctga

SEQ ID NO: 805 - protein, 88 aa, Sorghum bicolor
  misc_feature (13)..(63): Pfam Name: Myb_DNA-binding Pfam Description: Myb-like DNA-binding domain
  misc_feature (1)..(88): Ceres Annot ID no. 8734209
  misc_feature (1)..(88): Bit score of 141.4 for HMM based on sequences of Figure 20
  misc_feature (1)..(88): Functional Homolog Of SEQ ID NO. 741
MASMQSMTSAAARAQWTPKQNKLFEQALAVYDKDTPDRWHNIARAVGGGKSAEDVRRYYDLLEEDVGHIESGKVPFPAYRCATGYGAA

SEQ ID NO: 806 - protein, 75 aa, Vitis vinifera
  misc_feature (9)..(58): Pfam Name: Myb_DNA-binding Pfam Description: Myb-like DNA-binding domain
  misc_feature (1)..(75): Public GI ID no. 225428458
  misc_feature (1)..(75): Bit score of 151.9 for HMM based on sequences of Figure 20
  misc_feature (1)..(75): Functional Homolog Of SEQ ID NO. 741
MASTSLKSSGSWTPKQNKLFEKALALYDRDTPDRWQNVANAVGGKSAEEVKQHYEILIRDLKHIESGRVPIPNYK

SEQ ID NO: 807 - DNA, 1123 bp, Gossypium hirsutum
  misc_feature (1)..(1123): Ceres Clone ID no. 1847251
  misc_feature (1)..(1123): Encodes the peptide sequence at SEQ ID NO. 808
ataccactcccttaacttcaaacaaaatcttcttttaagagtcccttccatcaccttgctttcacattcaggcacctgcatacttcttttaacttttcagccctataattctctcacttaagattttcaccaatggcatctaattctctcacttcctcacgtacctctggctcgtcctggacggcaaagcaaaacaaactgttcgagaaggctctggctaaatatgacaaagacactcctgaccgctggcataacattgccaaggctgtgggtggaaagtcagttgaggaagtcaagctgcactatgagatcctagtcagggatctcaaagacattgagtctggccgctacccttatccatatccaaccaactaaagcgctatgagtttactacttactattcactacctatccacaatcactatagataaccaagaagtgaaggccactttcatatgcatgaatcacattcctaaaaatgcagctgtcatgcttttttgttgatgtagttgtggatttaaagaaaacgtggttcttagaattatcatacatgcgcatatccatgacgtccttgtccttccagctccacacacccacaaccccaaagtccttaagcattgaaaactctcaagtacccaagtgggtccataaaagaaaatccagaaaagtagggaatcttcatgtgcctcccccccccccccccaaatttctttctgtggtctatcactttaaatttttttcctttttccactgagcatatacagttcatttgcatttaatgttcttatagacctaattccttacaattactcaatcctaatctcaaatctttcgactctttttgtctttttggattttggacaacatgccgatggtacttttgtcatttccaacatattttatcttaattatctgcatttgtttttctcacaggagcaaatcaataaattccgtttctagagacttaacttgtcctacttgtctttcaggttagctgaagactatgaatatatatatgcatctagagacctcagttgctgagagactagcctagttccccacctaaagaaatccatacaaaactaattatcccattggtgtaatactaaatgctgttactacc

SEQ ID NO: 808 - protein, 80 aa, Gossypium hirsutum
  misc_feature (13)..(62): Pfam Name: Myb_DNA-binding Pfam Description: Myb-like DNA-binding domain
  misc_feature (1)..(80): Ceres Clone ID no. 1847251
  misc_feature (1)..(80): Bit score of 141.9 for HMM based on sequences of Figure 20
  misc_feature (1)..(80): Functional Homolog Of SEQ ID NO. 741
MASNSLTSSRTSGSSWTAKQNKLFEKALAKYDKDTPDRWHNIAKAVGGKSVEEVKLHYEILVRDLKDIESGRYPYPYPTN

SEQ ID NO: 809 - DNA, 729 bp, Glycine max
  misc_feature (1)..(729): Ceres Clone ID no. 477814
  misc_feature (1)..(729): Encodes the peptide sequence at SEQ ID NO. 810
atcaactcttccttgagtctgatcactatatacacactactcttcagccttttcatatttcataacacccctttgctaccaaaccaattcagtgatctttttgctttgctctttcctgagtttgaaaaccttagaaccatttcagtacacaacactttctgttccttaatggcatccagttcaatctcagcctctggctcatggagtgttaaggacaacaaggcctttgaaaaggctttagctgtttatgacaaggacactcctgaccgttggtacaatgttgctcatgctgttggtggcaaaactccagaggaagtgaaaaggcactacgaactccttgttcaggatgttaagcatattgagtctggacgtgtgccattcccaaattacaagaaaactacttcagggtcaactgatcaggaggaaaaaaggctgaggaatttgaatttgaacctccagtgacccccctcaagaacaacaaattgattttctaattttcatatcaaccaacatcattaatttccagcatccctggtagtactacgtggtgttatgtcacacataattgctagtgcaatagcatcttaggctatattagtcatcataagaatcatatgtcccgtgattccatctggtactttcttgtcgttgaagcttcctcttgaaagggtcaacgaccgtttcagttcctcatcgtcctaaataaatttataattttataatatgctg

SEQ ID NO: 810 - protein, 97 aa, Glycine max
  misc_feature (9)..(58): Pfam Name: Myb_DNA-binding Pfam Description: Myb-like DNA-binding domain
  misc_feature (1)..(97): Ceres Clone ID no. 477814
  misc_feature (1)..(97): Bit score of 182.5 for HMM based on sequences of Figure 20
  misc_feature (1)..(97): Functional Homolog Of SEQ ID NO. 741
MASSSISASGSWSVKDNKAFEKALAVYDKDTPDRWYNVAHAVGGKTPEEVKRHYELLVQDVKHIESGRVPFPNYKKTTSGSTDQEEKRLRNLNLNLQ

SEQ ID NO: 811 - DNA, 303 bp, Arabidopsis thaliana
  misc_feature (1)..(303): Ceres Annot ID no. 543794
  misc_feature (1)..(303): Encodes the peptide sequence at SEQ ID NO. 812
atggcctctagttctatgagctcgagctcttcttggacgtctaagcaaaacaagatgttcgagagggctttagccgtttacgataaagacactcccgaccgttggcaaaacgtggctaaagcagttggaagtaaatctgcagaggaagttaaacgtcactacgacatcctcgttgaagatctcatgaacatcgaacaagacttagtacctttgcctaaatacaaaaccgtcgatgttggaagtaaatctagaggcatcgatgattttgatttgaggttaatgaagaatatgagaatccagtga

SEQ ID NO: 812 - protein, 100 aa, Arabidopsis thaliana
  misc_feature (9)..(58): Pfam Name: Myb_DNA-binding Pfam Description: Myb-like DNA-binding domain
  misc_feature (1)..(100): Ceres Annot ID no. 543794
  misc_feature (1)..(100): Bit score of 162.9 for HMM based on sequences of Figure 20
  misc_feature (1)..(100): Functional Homolog Of SEQ ID NO. 741
MASSSMSSSSSWTSKQNKMFERALAVYDKDTPDRWQNVAKAVGSKSAEEVKRHYDILVEDLMNIEQDLVPLPKYKTVDVGSKSRGIDDFDLRLMKNMRIQ

SEQ ID NO: 813 - DNA, 282 bp, Oryza sativa
  misc_feature (1)..(282): Ceres Annot ID no. 1679467
  misc_feature (1)..(282): Encodes the peptide sequence at SEQ ID NO. 814
atggcatccagctccaaggcctcgtcctcgtcgtcggcgtcggcggcgtcgtcggagtggacgaagcagcagaacaagcagttcgagcgcgccctggcggtgtacgacaccgacgccccggaccggtggcacaacgtcgcccgctacatgggcggcgccaagtccgccgaggaggtgcgccgccactacgagcggctccaggcggatgtcgagcagattgaggccggcggcgtgccgttctccttgggctacggcgccacgccacaggccggccgccgctag

SEQ ID NO: 814 - protein, 93 aa, Oryza sativa
  misc_feature (17)..(67): Pfam Name: Myb_DNA-binding Pfam Description: Myb-like DNA-binding domain
  misc_feature (1)..(93): Ceres Annot ID no. 1679467
  misc_feature (1)..(93): Bit score of 126.8 for HMM based on sequences of Figure 20
  misc_feature (1)..(93): Functional Homolog Of SEQ ID NO. 741
MASSSKASSSSSASAASSEWTKQQNKQFERALAVYDTDAPDRWHNVARYMGGAKSAEEVRRHYERLQADVEQIEAGGVPFSLGYGATPQAGRR

SEQ ID NO: 815 - DNA, 747 bp, Zea mays
  misc_feature (1)..(747): Ceres Clone ID no. 1523182
  misc_feature (1)..(747): Encodes the peptide sequence at SEQ ID NO. 816
gctcagcatacacaacatcatcatcatcatcttctcgctagtcgagcgagcccttatagttaattaagctagtcgatcgatccaagagaagaagaagcagcagacaggaatggcgtcgctctcgatgacgacgagcgcagcggcccgcgcgcagtggacgcctaggcagaacaagctgttcgagcaggcgctggcggtgtacgacaaggacacgcccgaccgctggcacaacatcgcctgcgccgtcggcggcgggaagtccgcggacgacgtcaggcgctactacgagctgctggaggaggacgtcggccacatcgagtccggcaaggtgcccttccccgcctaccgctaccccgccggctacggggccgccgacaggctgaaacagctgaagatctaggaggtcaattgaacatataggacgaacgatcgatgatccagaagatgcaaacatgtgtgtatataggattaatgggacagtatcagtatgcatgcaatggtccatgctgcaagtgcatgcaagtggtgtgtgaaagcaagaatcagattagatgcatgcatatgcatgtgttaatttagtagtaataattgtagtatgggatgagtcctatactagccagtcacgcgcgatcgaccgaccgacccatcgatctccaatgcttctgttccctctccctcctacttgtccacttgtgtgtatatataaatattatgtatttttattattatatatactctacctgttct

SEQ ID NO: 816 - protein, 96 aa, Zea mays
  misc_feature (13)..(63): Pfam Name: Myb_DNA-binding Pfam Description: Myb-like DNA-binding domain
  misc_feature (1)..(96): Ceres Clone ID no. 1523182
  misc_feature (1)..(96): Bit score of 148.9 for HMM based on sequences of Figure 20
  misc_feature (1)..(96): Functional Homolog Of SEQ ID NO. 741
MASLSMTTSAAARAQWTPRQNKLFEQALAVYDKDTPDRWHNIACAVGGGKSADDVRRYYELLEEDVGHIESGKVPFPAYRYPAGYGAADRLKQLKI

SEQ ID NO: 817 - DNA, 327 bp, Populus balsamifera subsp. trichocarpa
  misc_feature (1)..(327): Ceres Annot ID no. 1495620
  misc_feature (1)..(327): Encodes the peptide sequence at SEQ ID NO. 818
atgtcttatttcacatcttcaaatggctccggctcctcttggacagccaaacaaaataagctattcgagaaggccctggctgtatacgacaaagacaccccagaccgctggcaaaatgtggccaaggccgtgggtggcaagtctcctgaagaagttaagaggcactatgatcgtctcgtggaagatctcgtgtacatagaatccggccaagcccctctgccgaattacaagccctctggcagcaatggtaggggacttgttgaagagcaaagaccatttaatccaactccaaaaagttttgaatttgtacgatccctgtttgcctag

SEQ ID NO: 818 - protein, 108 aa, Populus balsamifera subsp. trichocarpa
  misc_feature (11)..(60): Pfam Name: Myb_DNA-binding Pfam Description: Myb-like DNA-binding domain
  misc_feature (1)..(108): Ceres Annot ID no. 1495620
  misc_feature (1)..(108): Bit score of 165.5 for HMM based on sequences of Figure 20
  misc_feature (1)..(108): Functional Homolog Of SEQ ID NO. 741
MSYFTSSNGSGSSWTAKQNKLFEKALAVYDKDTPDRWQNVAKAVGGKSPEEVKRHYDRLVEDLVYIESGQAPLPNYKPSGSNGRGLVEEQRPFNPTPKSFEFVRSLFA

SEQ ID NO: 819 - protein, 93 aa, Antirrhinum majus
  misc_feature (8)..(57): Pfam Name: Myb_DNA-binding Pfam Description: Myb-like DNA-binding domain
  misc_feature (1)..(93): Public GI ID no. 118137433
  misc_feature (1)..(93): Bit score of 156.9 for HMM based on sequences of Figure 20
  misc_feature (1)..(93): Functional Homolog Of SEQ ID NO. 741
MASTRGSGRPWSAKENKAFERALAVYDKDTPDRWANVARAVEGRTPEEVKKHYEILVEDIKYIESGKVPFPNYRTTGGNMKTDEKRFRNLKIR

SEQ ID NO: 820 - protein, 126 aa, Oryza sativa subsp. japonica
  misc_feature (24)..(74): Pfam Name: Myb_DNA-binding Pfam Description: Myb-like DNA-binding domain
  misc_feature (1)..(126): Public GI ID no. 5091605
  misc_feature (1)..(126): Bit score of 144.4 for HMM based on sequences of Figure 20
  misc_feature (1)..(126): Functional Homolog Of SEQ ID NO. 741
MASAAGSKQQQAMMSLPSSRGGGGGGWTQRQNKQFECALAVYDKETPDRWHNIARYMGGAKSADEVRRHFDHLVEDVSRIESGRVPFPRYSSSSSSRGADDGNRLLTVFHLSSVPRTRNANHKFNT

SEQ ID NO: 821 - DNA, 381 bp, Arabidopsis thaliana
  misc_feature (1)..(381): Ceres Annot ID no. 838426
  misc_feature (1)..(381): Encodes the peptide sequence at SEQ ID NO. 822
atggcgtcaaactcaagaagttcaatctcaccatggacgtttagtcaaaacaagatgttcgagagggccttggcagtttacgacaaggacacacccgaccgatggcacaatgtggcaaaagctgtcggagggaaaactgtagaagaagtgaagcgccactatgacattctcgtcgaggatctcatcaacatcgagactggtcgtgtccctttgcccaattacaagaccttcgaatctaactcaagaagcatcaatgactttgacacaaggtatataactaaatatctatatatgatgctctcgatatattttgataatcattctagtgattttgagaaattctctcaaaaagttcttgtaagttatatttctttggtttaa

SEQ ID NO: 822 - protein, 126 aa, Arabidopsis thaliana
  misc_feature (9)..(58): Pfam Name: Myb_DNA-binding Pfam Description: Myb-like DNA-binding domain
  misc_feature (1)..(126): Ceres Annot ID no. 838426
  misc_feature (1)..(126): Bit score of 156.0 for HMM based on sequences of Figure 20
  misc_feature (1)..(126): Functional Homolog Of SEQ ID NO. 741
MASNSRSSISPWTFSQNKMFERALAVYDKDTPDRWHNVAKAVGGKTVEEVKRHYDILVEDLINIETGRVPLPNYKTFESNSRSINDFDTRYITKYLYMMLSIYFDNHSSDFEKFSQKVLVSYISLV

SEQ ID NO: 823 - protein, 97 aa, Glycine max
  misc_feature (9)..(58): Pfam Name: Myb_DNA-binding Pfam Description: Myb-like DNA-binding domain
  misc_feature (1)..(97): Public GI ID no. 110931736
  misc_feature (1)..(97): Bit score of 173.5 for HMM based on sequences of Figure 20
  misc_feature (1)..(97): Functional Homolog Of SEQ ID NO. 741
  misc_feature (94)..(94): Xaa is any aa, unknown, or other
MASCSISASGSWSVKDNKAFEKALAVYDKDTPDRWYNVAHAVGGKTPEEVKRHYELLVQDVKHIESGRVPFPNYKKTTSESTDQEEKRLRNLNXNLQ

SEQ ID NO: 824 - protein, 111 aa, Oryza sativa subsp. indica
  misc_feature (24)..(74): Pfam Name: Myb_DNA-binding Pfam Description: Myb-like DNA-binding domain
  misc_feature (1)..(111): Public GI ID no. 125553458
  misc_feature (1)..(111): Bit score of 144.1 for HMM based on sequences of Figure 20
  misc_feature (1)..(111): Functional Homolog Of SEQ ID NO. 741
MASAAGSKQQQAMMSLPSSRGGGGGGWTQRQNKQFECALAVYDKETPDRWHNIARYMGGAKSADEVRRHFDHLVEDVARIESGRVPFPRYSSSSSSRGADDGNRSRYLKYQ

SEQ ID NO: 825 - DNA, 518 bp, Glycine max
  misc_feature (1)..(518): Ceres Clone ID no. 1113584
  misc_feature (1)..(518): Encodes the peptide sequence at SEQ ID NO. 826
aatcacacctctttaattagtaacacttaattttcattaccgtcgttttattaagtgtgtgttgctacaacaatggcctcaagtcagggttggactccgaagcagaacaagagatttgagaatgcccttgccatcttcgacaaggacaccccagacaggtggcacacggtggccagggccgtcggaggaaaaacggtggaggaagtgaaaaggcattatgagaagctcgtggaagatgtgaaggagattgaggaaggtcacgtgcccctccccaattaccgaagtgctgcaagaggccacggttacatggatgaagaaaacaggatgaaggttctgagtctgcagtgaagtgtgatttatcaataatatatataatatatgctggatgcttggcttagaactactataaaatattttatttgctttttcgttttttctttccatatatatatatattcaaagcatcgatgccttgtatttctgtttctataaatgtaaagatgaaatgaaattgtccc

SEQ ID NO: 826 - protein, 91 aa, Glycine max
  misc_feature (4)..(53): Pfam Name: Myb_DNA-binding Pfam Description: Myb-like DNA-binding domain
  misc_feature (1)..(91): Ceres Clone ID no. 1113584
  misc_feature (1)..(91): Bit score of 150.4 for HMM based on sequences of Figure 20
  misc_feature (1)..(91): Functional Homolog Of SEQ ID NO. 741
MASSQGWTPKQNKRFENALAIFDKDTPDRWHTVARAVGGKTVEEVKRHYEKLVEDVKEIEEGHVPLPNYRSAARGHGYMDEENRMKVLSLQ

SEQ ID NO: 827 - DNA, 551 bp, Glycine max
  misc_feature (1)..(551): Ceres Clone ID no. 857342
  misc_feature (1)..(551): Encodes the peptide sequence at SEQ ID NO. 828
aaaatcacagctctttaatttgtaacacttaattttcattgattgagtgtgtgttgctacaacaatggcctcaagccagggttggactccgaagcagaacaagagatttgagaatgcccttgccatcttcgacaaggacaccccagataggtggcacacggtggccagggccgtcggaggaaaaacggtggaggaagtgaaaaggcattatgagaagctcgtggaagatgtgaagaagatagaggaaggtcacgtgcccctccccaattaccgaagtgctgcaagaggctacggttacatggatgaagaaaccaggatgaaggctctgagtctgcagtgaagtgtgatttaccaataaataatatatgttggatgcttggcttagtaccataagatattttattcacttttttgttttttctttccatataatatataggcaaagcatcgttgccttgtgtttctgtttctataaatgtaaagatgaaattgtcccaaagacgggcccactagttaatagtaaaaacagccattgaatatcatattttcac

SEQ ID NO: 828 - protein, 91 aa, Glycine max
  misc_feature (4)..(53): Pfam Name: Myb_DNA-binding Pfam Description: Myb-like DNA-binding domain
  misc_feature (1)..(91): Ceres Clone ID no. 857342
  misc_feature (1)..(91): Bit score of 149.5 for HMM based on sequences of Figure 20
  misc_feature (1)..(91): Functional Homolog Of SEQ ID NO. 741
MASSQGWTPKQNKRFENALAIFDKDTPDRWHTVARAVGGKTVEEVKRHYEKLVEDVKKIEEGHVPLPNYRSAARGYGYMDEETRMKALSLQ

SEQ ID NO: 829 - DNA, 306 bp, Arabidopsis thaliana
  misc_feature (1)..(306): Ceres Annot ID no. 827713
  misc_feature (1)..(306): Encodes the peptide sequence at SEQ ID NO. 830
atggcatcaggctcaatgtcttcttatggctctggctcatggactgttaagcagaacaaagcctttgagcgtgctctagcagtctatgaccaagacactccggaccgttggcacaatgttgctagagctgttggtggtaaaacaccagaagaagctaagagacagtatgaccttctagttcgtgacatcgaaagcatcgagaatggtcacgtgccattccctgactacaagactactacaggaaacagcaacagaggcaggctgcgtgatgaggaaaagaggatgagaagcatgaagctgcagtga

SEQ ID NO: 830 - protein, 101 aa, Arabidopsis thaliana
  misc_feature (11)..(60): Pfam Name: Myb_DNA-binding Pfam Description: Myb-like DNA-binding domain
  misc_feature (1)..(101): Ceres Annot ID no. 827713
  misc_feature (1)..(101): Bit score of 172.1 for HMM based on sequences of Figure 20
  misc_feature (1)..(101): Functional Homolog Of SEQ ID NO. 741
MASGSMSSYGSGSWTVKQNKAFERALAVYDQDTPDRWHNVARAVGGKTPEEAKRQYDLLVRDIESIENGHVPFPDYKTTTGNSNRGRLRDEEKRMRSMKLQ

SEQ ID NO: 831 - DNA, 675 bp, Zea mays
  misc_feature (1)..(675): Ceres Clone ID no. 331755
  misc_feature (1)..(675): Encodes the peptide sequence at SEQ ID NO. 832
agaatgcaaaccacaaaacaaagtcaaaccagctgcaacgatcaagagcgaggcttccttgtccagctctccgctcagccgacacacacagattgacagatggcgtctatgtcgctgagctcgtcgagggcgcagtggacggcgaagcagaacaagctgttcgagcaggcgttggcggtgtacgacagggacacgccggaccgctggcacaacatcgcgcgcgccgtgggtggcaagtcggcggacgaggtcaggcgctactacgagctgctggtgaaggacttggagcacatcgaggccggcaaggtggccttccccgcgtacaggtgccccggcggctacgacgacgccgacagcgacaggctgaagcacctgacctgaagatctaggcggcaggcaagcatcatgagaaccactgaacaagtacgtcctacatacgtacacttcgcgccatgtgagtgtagcacgtgtggctacaaaagaagcaagccaagcgagtgggtcggacggattatctgttcaagcacgcatgtgaattagaattactactagcaatagctataggatgttgatcaatcgatctccgttccccccgtgttgcgatgtaaaatctcagcatctgtagcatatatattctgaggagtgaaataaaatacattcactagtttgtggacc

SEQ ID NO: 832 - protein, 93 aa, Zea mays
  misc_feature (10)..(59): Pfam Name: Myb_DNA-binding Pfam Description: Myb-like DNA-binding domain
  misc_feature (1)..(93): Ceres Clone ID no. 331755
  misc_feature (1)..(93): Bit score of 166.0 for HMM based on sequences of Figure 20
  misc_feature (1)..(93): Functional Homolog Of SEQ ID NO. 741
MASMSLSSSRAQWTAKQNKLFEQALAVYDRDTPDRWHNIARAVGGKSADEVRRYYELLVKDLEHIEAGKVAFPAYRCPGGYDDADSDRLKHLT

SEQ ID NO: 833 - DNA, 563 bp, Musa acuminata
  misc_feature (1)..(563): Ceres Clone ID no. 1723374
  misc_feature (1)..(563): Encodes the peptide sequence at SEQ ID NO. 834
acacagatcagctagctccaccagagaagcaaagcaaacccttcttccctgagatggcatccggttcgatgagctcctcctggaccgcgaaggagaacaagatgttcgagaaggcactggcggtgtacgacagggacacccccgaccgctggcacaagatcgcccgggccatcggcgggaagacggcggacgaagtgaagcgctactacgacctgctcgtggaggacgtgcgccgcatcgaggctggccaaatgccgtacgccaattaccggtcctctaatggcagaggttgagagtgtttggagctcaaccggagaacgaacaagaagcaaggagcatttcactgttctggatatcagttaccacaatcttaattataggactatatgaactctacatgtctgtggacttacaagtagtttcttctatgcagtcttctttctcccttctatcgtgtactcccagatatatcgaagactgccatcataaacatatatatggctagtcttcttgtaatcggttatcttgcttgctaatgaacgcttagtattgttctattctag

SEQ ID NO: 834 - protein, 79 aa, Musa acuminata
  misc_feature (7)..(56): Pfam Name: Myb_DNA-binding Pfam Description: Myb-like DNA-binding domain
  misc_feature (1)..(79): Ceres Clone ID no. 1723374
  misc_feature (1)..(79): Bit score of 135.9 for HMM based on sequences of Figure 20
  misc_feature (1)..(79): Functional Homolog Of SEQ ID NO. 741
MASGSMSSSWTAKENKMFEKALAVYDRDTPDRWHKIARAIGGKTADEVKRYYDLLVEDVRRIEAGQMPYANYRSSNGRG

SEQ ID NO: 835 - DNA, 602 bp, Panicum virgatum
  misc_feature (1)..(602): Ceres Clone ID no. 1785685
  misc_feature (1)..(602): Encodes the peptide sequence at SEQ ID NO. 836
atcgcaaccatttcaaaacttcctttccctccaccagttacatcactagctagactagacgcacacacctccgagggagacaatcaaggaccctgctgccatggcgtccaactcgaccaagctgggctcttcgtcgtcgtccgagtggacgcggggggaggacaagatgttcgagcgcgccctggcggtgtacgacacggacaccccggaccggtggcacaacgtggcgcgctacatgggcggcaccaagtccgtcgaggaggtgcgccgccactaccagctgctcgtccgcgacgtcgcgcagatcgagtccggcagggtgccgttccactggtacgccgccgcgccgccgccgcggacactgcagcgaggttgaaggcttgaagtatatatctgagcttcaatgaagaaggggacggattgcacagtggctagctgtgctcctcgaagaaaaagatttataaattttgcatgtatatgtgcatgtgtgcgcgttgaatggaaatggcaaagctagctaggacatcgagattaatgtccggtctgctgctctttaatcttgtgtaccaagtccagcttttgatctatatggatcgaattat

SEQ ID NO: 836 - protein, 91 aa, Panicum virgatum
  misc_feature (13)..(63): Pfam Name: Myb_DNA-binding Pfam Description: Myb-like DNA-binding domain
  misc_feature (1)..(91): Ceres Clone ID no. 1785685
  misc_feature (1)..(91): Bit score of 118.8 for HMM based on sequences of Figure 20
  misc_feature (1)..(91): Functional Homolog Of SEQ ID NO. 741
MASNSTKLGSSSSSEWTRGEDKMFERALAVYDTDTPDRWHNVARYMGGTKSVEEVRRHYQLLVRDVAQIESGRVPFHWYAAAPPPRTLQRG

SEQ ID NO: 837 - DNA, 656 bp, Gossypium hirsutum
  misc_feature (1)..(656): Ceres Clone ID no. 1927753
  misc_feature (1)..(656): Encodes the peptide sequence at SEQ ID NO. 838
aagtaattttctttgagagaaataaccccatcttttccctttatacaagtttcaatttattcactctttcaaattcaggaactgacatagttctctaaatttttagcctgtcattctgatccgaagcttgttaaaaagaccctctgttttcagttgtacttattttcacttatgtcatccaattttctcaataattcacgctgctctagctcttcctggacacctaaacaaaacaaaacgttcgagaaggctctggctaaatatgaccaggacactcctgaccgctggcacaatgttgccaaggctgtgggtggaaagtctgctgaggaagtcaagctgcactatgatgccctagtcagggatctcaaagacattgagtctggccgctacccttatccatatccaagtggaagcaacagctaaagtggttcccaaagagtcaagtactaaaatgaaaaagaacatgatactcacaaaaccagagacctcagtcgcacagtcgcagaaatctagcattggatgatattcccccagaaaaaaagaaaatccctactgtaattgtacatgctgctattactattttctgtattatcactttgtattttcctttgaccttgtctagttaaattaaaatattaaatatttatatagtaatt

SEQ ID NO: 838 - protein, 83 aa, Gossypium hirsutum
  misc_feature (13)..(62): Pfam Name: Myb_DNA-binding Pfam Description: Myb-like DNA-binding domain
  misc_feature (1)..(83): Ceres Clone ID no. 1927753
  misc_feature (1)..(83): Bit score of 133.2 for HMM based on sequences of Figure 20
  misc_feature (1)..(83): Functional Homolog Of SEQ ID NO. 741
MSSNFLNNSRCSSSSWTPKQNKTFEKALAKYDQDTPDRWHNVAKAVGGKSAEEVKLHYDALVRDLKDIESGRYPYPYPSGSNS

SEQ ID NO: 839 - protein, 90 aa, Antirrhinum majus
  misc_feature (8)..(57): Pfam Name: Myb_DNA-binding Pfam Description: Myb-like DNA-binding domain
  misc_feature (1)..(90): Public GI ID no. 112292438
  misc_feature (1)..(90): Bit score of 136.3 for HMM based on sequences of Figure 20
  misc_feature (1)..(90): Functional Homolog Of SEQ ID NO. 741
MASSSMTSSSWTQKQNKQFEEALAMYGNDTPDCWQNIARKVGGKSAEEIRRHYEVLVKEIMKIETDQVPIPNYNKVKGSNSRGYGNYRGF

SEQ ID NO: 840 - protein, 78 aa, Arabidopsis thaliana
  misc_feature (8)..(57): Pfam Name: Myb_DNA-binding Pfam Description: Myb-like DNA-binding domain
  misc_feature (1)..(78): Public GI ID no. 116830269
  misc_feature (1)..(78): Bit score of 137.7 for HMM based on sequences of Figure 20
  misc_feature (1)..(78): Functional Homolog Of SEQ ID NO. 741
MASSSMSTSSWTAREDKQFEMALAKFDKDTPDRWQKIARAVGGKSTEEVKRHYELLLRDVNDIESGRYPQPRYRNTNG

SEQ ID NO: 841 - DNA, 505 bp, Gossypium hirsutum
  misc_feature (1)..(505): Ceres Clone ID no. 100002959
  misc_feature (1)..(505): Encodes the peptide sequence at SEQ ID NO. 842
  misc_feature (24)..(24): n is a, c, t, g, unknown, or other
cattccaaattttgattattttcnttcttttttattttttttatttaaaatttgaaactgctaacattattacattttcattagcctcaagagaagaaaaaaaaatgtcatcgaattcaatgtctgcttcatggacagccaagcaaaacaaagatttcgaaagggctttagctgtttacgacaaggacacaccagatcgttggtacaatgttgctaaagctgtgggagggaaaactgttgaggaagtgaagaagcactatgagcttcttctggaagatgttagacacatcgagtcgggtcgggttcctttccccgactattggaccgttaccgggaatcgtcaagcatgaaagattccgaagctcaaatgaagaagaaaaaatggtggacttgcatggatctcacccttatatgtgtgtgtgtgtgtgtggcagtaattgtagtacttaagaatagccataaatgtatttaggaagaggaagaagagcttaatgggtgatcattg

SEQ ID NO: 842 - protein, 81 aa, Gossypium hirsutum
  misc_feature (7)..(56): Pfam Name: Myb_DNA-binding Pfam Description: Myb-like DNA-binding domain
  misc_feature (1)..(81): Ceres Clone ID no. 100002959
  misc_feature (1)..(81): Bit score of 146.2 for HMM based on sequences of Figure 20
  misc_feature (1)..(81): Functional Homolog Of SEQ ID NO. 741
MSSNSMSASWTAKQNKDFERALAVYDKDTPDRWYNVAKAVGGKTVEEVKKHYELLLEDVRHIESGRVPFPDYWTVTGNRQA

SEQ ID NO: 843 - protein, 83 aa, Antirrhinum majus
  misc_feature (13)..(62): Pfam Name: Myb_DNA-binding Pfam Description: Myb-like DNA-binding domain
  misc_feature (1)..(83): Public GI ID no. 112292440
  misc_feature (1)..(83): Bit score of 124.6 for HMM based on sequences of Figure 20
  misc_feature (1)..(83): Functional Homolog Of SEQ ID NO. 741
MASSSMTSSRGSSSLWTPKQNRQFEEALTMFDKDTPDRWQNIARRIDGKSAEQVRRYYEELLKDITRIENDQVPIPNYKTNNR

SEQ ID NO: 844 - DNA, 481 bp, Arabidopsis thaliana
  misc_feature (1)..(481): Ceres Clone ID no. 41695
  misc_feature (1)..(481): Encodes the peptide sequence at SEQ ID NO. 845
aattcaagtcatctctatccgtcaacaatacaaaccaaccttctcaattcctctcttttcatccacattttcactagctaatggcttctagttcaatgagcacctcatcatggacagctagagaggacaagcaattcgaaatggcgttggcgaaattcgacaaggacactcctgaccgttggcaaaaaattgcaagggcagttggtgggaaatcaactgaagaagtaaagcgacactatgaattgctccttagggatgtgaatgacattgagtcaggacgctatccacaacctaggtaccgtaacactaattgaagccattaataaaatgcctttctatcaagaagaggacatttgagagaatctataaagaactaagaatttcgatgtatttcttatattctatttgctttctttttttgttttttttttaatttctgtttggttttcagatatataataatctctctcaatatccatcc

SEQ ID NO: 845 - protein, 77 aa, Arabidopsis thaliana
  misc_feature (8)..(57): Pfam Name: Myb_DNA-binding Pfam Description: Myb-like DNA-binding domain
  misc_feature (1)..(77): Ceres Clone ID no. 41695
  misc_feature (1)..(77): Bit score of 136.1 for HMM based on sequences of Figure 20
  misc_feature (1)..(77): Functional Homolog Of SEQ ID NO. 741
MASSSMSTSSWTAREDKQFEMALAKFDKDTPDRWQKIARAVGGKSTEEVKRHYELLLRDVNDIESGRYPQPRYRNTN

SEQ ID NO: 846 - protein, 85 aa, Bournea leiophylla
  misc_feature (5)..(54): Pfam Name: Myb_DNA-binding Pfam Description: Myb-like DNA-binding domain
  misc_feature (1)..(85): Public GI ID no. 124264312
  misc_feature (1)..(85): Bit score of 142.7 for HMM based on sequences of Figure 20
  misc_feature (1)..(85): Functional Homolog Of SEQ ID NO. 741
MSSRSRNWTAKENKAFEQALAVYDKDTPDRWVNVAKAVPGRTVEEVKRHYEILVEDVKSIESGKVPFPNYRTIRESGSMKNDEQR

SEQ ID NO: 847 - protein, 85 aa, Oryza sativa subsp. japonica
  misc_feature (11)..(60): Pfam Name: Myb_DNA-binding Pfam Description: Myb-like DNA-binding domain
  misc_feature (1)..(85): Public GI ID no. 115438765
  misc_feature (1)..(85): Bit score of 111.4 for HMM based on sequences of Figure 20
  misc_feature (1)..(85): Functional Homolog Of SEQ ID NO. 741
MASMSVSSSRAPQWTARQNEQFERALAVYDRDTPERWHNIARAVAGKSADEVKLYYDLLVEDVKRIETGKVPFPAYRCPQPAIAG

SEQ ID NO: 848 - DNA, 291 bp, Populus balsamifera subsp. trichocarpa
  misc_feature (1)..(291): Ceres Annot ID no. 1445878
  misc_feature (1)..(291): Encodes the peptide sequence at SEQ ID NO. 849
atggcttcaggttctagtaattggacttcaaagcaaaacaaactgttcgaaaatgccttggccatctatgatcaagaatctcctgatcgctggcacaatcttgccagggctgttggaaaaacagtggaggaagtgaagaagcattatcagatgcttgttgaagacgtccagcagattgaagctggtgaaatccctttgcccaactacactagaagatctggagctagcaacaagagctaccattgcaatgatgatcaagcacaaagggtgaagaatcttaatctcaactga

SEQ ID NO: 849 - protein, 96 aa, Populus balsamifera subsp. trichocarpa
  misc_feature (5)..(53): Pfam Name: Myb_DNA-binding Pfam Description: Myb-like DNA-binding domain
  misc_feature (1)..(96): Ceres Annot ID no. 1445878
  misc_feature (1)..(96): Bit score of 124.8 for HMM based on sequences of Figure 20
  misc_feature (1)..(96): Functional Homolog Of SEQ ID NO. 741
MASGSSNWTSKQNKLFENALAIYDQESPDRWHNLARAVGKTVEEVKKHYQMLVEDVQQIEAGEIPLPNYTRRSGASNKSYHCNDDQAQRVKNLNLN

SEQ ID NO: 850 - DNA, 1473 bp, Arabidopsis thaliana
  misc_feature (1)..(1473): Ceres Annot ID no. 838049
  misc_feature (1)..(1473): Encodes the peptide sequence at SEQ ID NO. 851
atggctgaagaacctactactaccactctcgttacaccggaaaagctaccttctccgagcctcacgccttctgaagtatctgaatctactcaagatgccctaccgacagagacagaaactctggagaaagtgactgagactaatccaccggaaactgcagataccaccaccaagccagaagaagaaaccgcggcagagcatcatccaccgacagtgacggaaacagaaactgcatcgacggagaaacaagaggttaaagacgaagcatcgcagaaagaagtagctgaagagaaaaagagtatgattccacagaatcttggttcattcaaagaagaaagcagcaaactttctgatctatctaattccgagaagaaatcactcgatgaactaaaacatctagttcgagaagctctagacaatcaccaattcaccaacacaccagaagaagtcaagatttgggggattccattacttgaagacgatagaagcgacgtcgttttgttaaaattcctaagagctagggagttcaaggtgaaagattcgtttgctatgctcaagaacacaatcaagtggagaaaggagttcaagatcgatgaattggtcgaggaagatcttgtggatgatcttgacaaggttgtgtttatgcatggacatgaccgagaaggtcaccctgtttgttacaatgtctatggtgagtttcagaacaaggagctttataataagacgttttctgatgaggaaaagaggaaacatttcttgaggactaggattcagttcttggagaggagtataaggaagctagattttagctctggtggggtttctactatttttcaggttaatgatatgaagaattctccggggttagggaagaaagagcttagatcagctactaagcaagctgttgagttgcttcaggacaattaccctgagtttgtcttcaaacaggcttttatcaatgttccttggtggtaccttgtgttttatactgtgattggtccgttcatgacaccaagatcaaagagcaagcttgtgtttgctggtccttcgcgttcagctgaaaccctattcaaatacatatcacccgagcaagttccagtacaatatggtggattgagtgttgatccttgcgactgcaatccagacttttcgttggaagattcagcctctgagatcactgttaagcccggaacaaaacaaactgttgagatcataatctatgagaaatgtgaacttgtgtgggagataagggtaactggatgggaagtgagctacaaggctgaatttgtgccggaagagaaagatgcttacacggtggttatacaaaaaccgaggaagatgagaccatccgatgaaccggtgttaacccatagcttcaaagtgaatgagcttggcaaggttttactcacagtagacaacccaacctctaagaagaagaagctcgtttacaggttcaatgtcaaacctctctaa

SEQ ID NO: 851 - protein, 490 aa, Arabidopsis thaliana
  misc_feature (1)..(490): Ceres SEED LINE ID no. CW00759
  misc_feature (212)..(391): Pfam Name: CRAL_TRIO Pfam Description: CRAL/TRIO domain
  misc_feature (114)..(200): Pfam Name: CRAL_TRIO_N Pfam Description: CRAL/TRIO, N-terminus
  misc_feature (1)..(490): Ceres Annot ID no. 838049
  misc_feature (1)..(490): Bit score of 981.8 for HMM based on sequences of Figure 24
  misc_feature (1)..(490): in Figure 24
MAEEPTTTTLVTPEKLPSPSLTPSEVSESTQDALPTETETLEKVTETNPPETADTTTKPEEETAAEHHPPTVTETETASTEKQEVKDEASQKEVAEEKKSMIPQNLGSFKEESSKLSDLSNSEKKSLDELKHLVREALDNHQFTNTPEEVKIWGIPLLEDDRSDVVLLKFLRAREFKVKDSFAMLKNTIKWRKEFKIDELVEEDLVDDLDKVVFMHGHDREGHPVCYNVYGEFQNKELYNKTFSDEEKRKHFLRTRIQFLERSIRKLDFSSGGVSTIFQVNDMKNSPGLGKKELRSATKQAVELLQDNYPEFVFKQAFINVPWWYLVFYTVIGPFMTPRSKSKLVFAGPSRSAETLFKYISPEQVPVQYGGLSVDPCDCNPDFSLEDSASEITVKPGTKQTVEIIIYEKCELVWEIRVTGWEVSYKAEFVPEEKDAYTVVIQKPRKMRPSDEPVLTHSFKVNELGKVLLTVDNPTSKKKKLVYRFNVKPL

SEQ ID NO: 852 - DNA, 1710 bp, Populus balsamifera subsp. trichocarpa
  misc_feature (1)..(1710): Ceres Annot ID no. 1486825
  misc_feature (1)..(1710): Encodes the peptide sequence at SEQ ID NO. 853
atggccgaagaatcctctccaccaccaccagtacttgagcaagctccaccttctccagccatagagaaagataaagaagacttgccacccccagcaccagttgaggaagctgaatcacaagctgtacaggagaaggaagaggtgccaccacaaccagctgcagcagaacaaaaggagtctagatcatcatccttggcggcgatgattgagaaagaagagtcattttcaccaccaccacaaccacttttttctcctgaggagaaaaccgaggtaactgaaaaatcagtagctactaaagaagaggttgctgttgttcctgacactgggaaagagaaaaaagttcctctaactttggtttctttcaaggaagagagtaacgcactggctgatctctctcatattgagagaagggctttagaagaactgaaacagttagttcaagaagctctcagctctcaccagtttagcagtgctccaccaaaaaaagaagagaaacaaagtgtcagtgttattcaagaaacttcaaaaactgaagcacccgttccagattctgatgttggtactgatatgaaaccatcagcagagaatcaagaatcgaaagttgaaaaaaccccagaaaaagaatcgcaagaagtggcgaaagaagagcaaaaggttgcatcttcttcaccagaggaagtccctatatgggggattcctctcttgaaagatgatagaagtgatgtggttctcttgaaattcttgagggcaagggattttaaggtaagagatgcatttgtaatgatcaagaacacaattcaatggaggagggacttcaaaattgatgagcttgttgatgaagatctaggtgatgatttggagaaagttgtgtttatgcatggttatgatagggaagggcatcctgtgtgttacaacgtatatggtgagtttcaaaataaagaattgtatcagaagacattctccgatgaggagaaaagattgaagtttctgaggtggcggattcagttcttggagaggagtattaggaagcttgatttcagtcctggtggtatttctaccatctttcaggttaatgatctgaagaactctccaggacctggaaagagagagcttaggttggctactaaacaggctctcctttcgcttcaggacaattaccctgagtttgttgccaaacaggtgtttatcaatgtcccttggtggtatcttgcattttatacagtgatgagtccattcatgacgcaaaggaccaaaagcaaatttgtttttgcaggcccatcaaattctgctgagacacttttcaaatatatatctcctgagcaagtgcctattcagtatggtggcttgtgcgtggatttctgtgactgcaaccctgaatttactattgctgatcctgctactgatataactgtaaaaccagcaaccaagcaaactgtggaaattataatttacgagaaatgtatccttgtttgggagttgcgagttgtcggatgggaggtgagttacagcgctgagttcatgcccgaagctaaagatgcatacacgattataataacgaaacccacaaaaatgtccccaactgatgagccagtggtgtctaacagcttcaaagttggtgaactggggaaaatattgctcacagttgacaaccccacctcaaagaagaagaaacttctttacaggttcaagatcaaccccttctcagattga

SEQ ID NO: 853 - protein, 569 aa, Populus balsamifera subsp. trichocarpa
  misc_feature (289)..(475): Pfam Name: CRAL_TRIO Pfam Description: CRAL/TRIO domain
  misc_feature (198)..(277): Pfam Name: CRAL_TRIO_N Pfam Description: CRAL/TRIO, N-terminus
  misc_feature (1)..(569): Ceres Annot ID no. 1486825
  misc_feature (1)..(569): Bit score of 1060.9 for HMM based on sequences of Figure 24
  misc_feature (1)..(569): Functional Homolog Of SEQ ID NO. 851
  misc_feature (1)..(569): in Figure 24
MAEESSPPPPVLEQAPPSPAIEKDKEDLPPPAPVEEAESQAVQEKEEVPPQPAAAEQKESRSSSLAAMIEKEESFSPPPQPLFSPEEKTEVTEKSVATKEEVAVVPDTGKEKKVPLTLVSFKEESNALADLSHIERRALEELKQLVQEALSSHQFSSAPPKKEEKQSVSVIQETSKTEAPVPDSDVGTDMKPSAENQESKVEKTPEKESQEVAKEEQKVASSSPEEVPIWGIPLLKDDRSDVVLLKFLRARDFKVRDAFVMIKNTIQWRRDFKIDELVDEDLGDDLEKVVFMHGYDREGHPVCYNVYGEFQNKELYQKTFSDEEKRLKFLRWRIQFLERSIRKLDFSPGGISTIFQVNDLKNSPGPGKRELRLATKQALLSLQDNYPEFVAKQVFINVPWWYLAFYTVMSPFMTQRTKSKFVFAGPSNSAETLFKYISPEQVPIQYGGLCVDFCDCNPEFTIADPATDITVKPATKQTVEIIIYEKCILVWELRVVGWEVSYSAEFMPEAKDAYTIIITKPTKMSPTDEPVVSNSFKVGELGKILLTVDNPTSKKKKLLYRFKINPFSD

SEQ ID NO: 854 - protein, 591 aa, Vitis vinifera
  misc_feature (250)..(436): Pfam Name: CRAL_TRIO Pfam Description: CRAL/TRIO domain
  misc_feature (151)..(238): Pfam Name: CRAL_TRIO_N Pfam Description: CRAL/TRIO, N-terminus
  misc_feature (1)..(591): Public GI ID no. 147859031
  misc_feature (1)..(591): Bit score of 1050.5 for HMM based on sequences of Figure 24
  misc_feature (1)..(591): Functional Homolog Of SEQ ID NO. 851
  misc_feature (1)..(591): in Figure 24
MADETDAAPPPTLLAAASVVPPETAAPPETAASEEVLTVLDVAPPVTEKEVSPQKPPPPPEEVVAVVDSEKKVPQNLVSFKEESNRLADLSESERRALEELKQSVQEALRNGIFTSQPQPPPPPPPPQSAEKPPEKIEEASEKREPNPVAESEISTQEESAKDENVKPTPNPTIESILKHESPTQEDVSIWGIPLLKDERSDMILLKFLRAREFKVKEAFAMLKNTIFWRKEFGIDALVDDDLGEHLEKVVFMHGFDRDGHPVCYNVYGEFQNKELYQKTFSDEEKRMKFLRWRIQFLERSIRKLDFTPGGVNTIFQVNDLKNSPGPGKWELRQATKQALQLLQDNYPEFVAKQVFINVPWWYLAFYMMISPFLTQRTKSKFVFASPAKSAKTLFKYISPEQVPIQYGGLSVDYCDCNPDFGIADPVTEITVKPSTKQTVEILVSEQCVIVWEVRVVGWEVAYGAEFIPDAEDEYTVVVQKATKMAPTDDPVMCNSFKIKELGKIVITIDNPTSKKKKLLYRFKTPECHIEVQFNIQSAEDYTTHSNRVYATRLASLHSSGDISKIRRRLTAGGDRDLTYSHSGPRIACWE

SEQ ID NO: 855 - DNA, 1510 bp, Glycine max
  misc_feature (1)..(1510): Ceres Clone ID no. 524404
  misc_feature (1)..(1510): Encodes the peptide sequence at SEQ ID NO. 856
tctctagctagctttcttctccactctctcaaatggcccaaaatgattccaaccctactccgcctccggaaccccatgtagcggcggaacccattactgaggatttggtccaagacaaagaagaagaggatgatagtagtaagattgttattccagtcccagagagcgagtccttgtcattgaaggaggatagcaatagggtttctgattccgagaaaaatgccattgatgagctgaagaagctcctgaaagaggaattagaggacgaggaggtttccatctggggcgtccctctctttaaggatgacaggactgacgtcattctcctcaagtttctcagagctcgtgagctcaaagtgaaggacgcccttgtcatgtttcaaaacactctccgatggaggaaggacttcaacatcgacgcccttctggatgaagatctgggcgaccacttggagaaggttgtcttcatgcacggacacggcagagagggccatcccgtctgttacaacgtctacggcgagttccagaacaaggacctctaccacaaggccttctcctctcaggataatcgaaacaagtttctccgatggcgtattcagttgttggagcgcagtattcggcacctcgacttcactccttcctccggcatcaacaccattttccaagtcaatgacctcaaaaactcccctggccctgctaaacgtgagcttcgccttgccaccaaacaagctttgcagttgcttcaggacaactatcccgaatttgttgccaaacaggtttttatcaacgtcccatggtggtatcttgctttctataccatgatcaatcccttcttgacttcgaggaccaaaagcaaatttgtctttgctggaccatccaagtcccccgatactcttttcaagtatatttttcctgagcaagtgcccgttcagtatggtggcctcagtgtagatttctgtgactgcaaccccgatttcactatgtctgatcctgtcaccgaaattcctataaagcctaccactaagcaaactgtggaaattgctatttatgagaagtgcattattgtttgggagctgcgcgtggtgggctgggaggttagctacaatgctgaattcaagcctgatgttgaagatgcatatacggttatcatacagaaggccacaaagatgtcccccaccgatgaaccagttgtttccaatagctttaaagttgttgaactgggaaaattgttgctcaccatagacaatcctaccttgaaaaaaaagaggcttctttacaggttcaagatcaaaccctactctgattgagagaaaataacctctggtggtggttttgggtacatgaaggaaattgaacttgaagagtaagaaatatgcatgtcatcatttgttcggtccatttttcatctatagttttggtcgtgagttgtttgcagattgtctttctctgtctttgttgtttgttgtgttgtatgtaacactttattgctagtctaaattgttcttttatt

SEQ ID NO: 856 - protein, 424 aa, Glycine max
  misc_feature (143)..(330): Pfam Name: CRAL_TRIO Pfam Description: CRAL/TRIO domain
  misc_feature (59)..(131): Pfam Name: CRAL_TRIO_N Pfam Description: CRAL/TRIO, N-terminus
  misc_feature (1)..(424): Ceres Clone ID no. 524404
  misc_feature (1)..(424): Bit score of 886.0 for HMM based on sequences of Figure 24
  misc_feature (1)..(424): Functional Homolog Of SEQ ID NO. 851
  misc_feature (1)..(424): in Figure 24
MAQNDSNPTPPPEPHVAAEPITEDLVQDKEEEDDSSKIVIPVPESESLSLKEDSNRVSDSEKNAIDELKKLLKEELEDEEVSIWGVPLFKDDRTDVILLKFLRARELKVKDALVMFQNTLRWRKDFNIDALLDEDLGDHLEKVVFMHGHGREGHPVCYNVYGEFQNKDLYHKAFSSQDNRNKFLRWRIQLLERSIRHLDFTPSSGINTIFQVNDLKNSPGPAKRELRLATKQALQLLQDNYPEFVAKQVFINVPWWYLAFYTMINPFLTSRTKSKFVFAGPSKSPDTLFKYIFPEQVPVQYGGLSVDFCDCNPDFTMSDPVTEIPIKPTTKQTVEIAIYEKCIIVWELRVVGWEVSYNAEFKPDVEDAYTVIIQKATKMSPTDEPVVSNSFKVVELGKLLLTIDNPTLKKKRLLYRFKIKPYSD

SEQ ID NO: 857 - protein, 607 aa, Trifolium pratense
  misc_feature (330)..(513): Pfam Name: CRAL_TRIO Pfam Description: CRAL/TRIO domain
  misc_feature (242)..(318): Pfam Name: CRAL_TRIO_N Pfam Description: CRAL/TRIO, N-terminus
  misc_feature (1)..(607): Public GI ID no. 84453208
  misc_feature (1)..(607): Bit score of 971.0 for HMM based on sequences of Figure 24
  misc_feature (1)..(607): Functional Homolog Of SEQ ID NO. 851
  misc_feature (1)..(607): in Figure 24
MAEEPQKPTEQVATTPATSETTIEKTPPPQAEEVVAAADADAVVVPPVVAEETEKPAEDVKPADETAAATDKKILQSVSFKEETNVVSELPESQKKALDELKQLIQEALNKHEFTAPPPPPPTKAVAEVAEEKKPEEEEKKTEEVVAEEKKVEEVVAEEKKVEEAVAEEKKVEEVEKKEEEKGSSSEEPKTEAKIEAEPEAKKEETVLEVVEKIATSTEEDGAKTVEAIQESIVSVTVTDGEQPVTETVGEAVAVAEVEVTPTTPEEVEIWGIPLLADERSDVILLKFLRARDFKVKEAYTMIKQTVIWRKEFGIEALLQEDLGTDWDKVVFTDGYDKEGHPVYYNVFGEFENKELYQNTFSDDEKRTKFIRWRIQSLEKSIRKLDFTPSGISTIVQVNDLKNSPGLGKKELRQATNKALQLLQDNYPEFVAKQVFINVPWWYLAFSRFLSAFLTQRTKSKFVFAGPSKSADTLFKYIAPEQVPVQYGGLSREGEQEFTTADPATEVTIKPATKHAVEFPISEKSTLVWEVRVVDWSVNYGAEFVPSAEDGYTVIIQKNRKVAPADETIISNTFKIGEPGKVILTIDNQSSKKKKLLYRSKTIPISE

SEQ ID NO: 858 - protein, 668 aa, Arabidopsis thaliana
  misc_feature (387)..(575): Pfam Name: CRAL_TRIO Pfam Description: CRAL/TRIO domain
  misc_feature (303)..(375): Pfam Name: CRAL_TRIO_N Pfam Description: CRAL/TRIO, N-terminus
  misc_feature (1)..(668): Public GI ID no. 30680992
  misc_feature (1)..(668): Bit score of 808.8 for HMM based on sequences of Figure 24
  misc_feature (1)..(668): Functional Homolog Of SEQ ID NO. 851
MSQDSATTTPPPPLTSDVSMPSGEEDEPKHVTSEEEAPVTSETNLKLPLMPELEESNHTAEVVSEKVTPETMTLESEGLNHAAEDSEQTHEVTPETETAKLEVLNHTAEDSEQTHEVTPEKETVKSEFLNHVAEDSEQTHEVTPETETVKSEVLNHAAEDSEQPRGVTPTPETETSEADTSLLVTSETEEPNHAAEDYSETEPSQKLMLEQRRKYMEVEDWTEPELPDEAVLEAAASVPEPKQPEPQTPPPPPSTTTSTVASRSLAEMMNREEAEVEEKQKIQIPRSLGSFKEETNKISDLSETELNALQELRHLLQVSQDSSKTSIWGVPLLKDDRTDVVLLKFLRARDFKPQEAYSMLNKTLQWRIDFNIEELLDENLGDDLDKVVFMQGQDKENHPVCYNVYGEFQNKDLYQKTFSDEEKRERFLRWRIQFLEKSIRNLDFVAGGVSTICQVNDLKNSPGPGKTELRLATKQALHLLQDNYPEFVSKQIFINVPWWYLAFYRIISPFMSQRSKSKLVFAGPSRSAETLLKYISPEHVPVQYGGLSVDNCECNSDFTHDDIATEITVKPTTKQTVEIIVYEKCTIVWEIRVVGWEVSYGAEFVPENKEGYTVIIQKPRKMTAKNELVVSHSFKVGEVGRILLTVDNPTSTKKMLIYRFKVKPLACE

SEQ ID NO: 859 - DNA, 2271 bp, Arabidopsis thaliana
  misc_feature (1)..(2271): Ceres Clone ID no. 1152744
  misc_feature (1)..(2271): Encodes the peptide sequence at SEQ ID NO. 860
agagcccaacattggattcctcttctttgaccattcctctctacctgaataacccgttaatctctctctgtccctttcttcttcttttttcaagaacaataaaaaaatgtctcaagattctgcaactactactccgccgccacctttaacctccgacgtttcaatgccttccggtgaggaagatgagccaaagcatgtaacattggaagaagaagcaccggtgacttcggagacaaatctgaagctacctttaatgccggagctagaggagtcaaatcatacggcggaggtagtttcagagaaggtgacgccggagacgatgactttggagtcagaaggtctcaaccacgcggcggaggattcaaagcagacacatgaagtaacgccggaggcagagactttgaagctagaggttctcaaccacacggcggaggattcagagcagacacatgaagtgacgccggagacagagacagtgaagtcagagtttctcaaccacgtggcggaggattcagagcagacacatgaagtgacgccggagacagagactgtgaagtcagaggttctcaaccatgcggcggaggattcagagcagccacgtggagtgacgccgacgccggagacagaaacttctgagccaaacacgtcattgcttgtaacttccgagacagaagagcctaaccatgcggcggaggattattcagagacagagccatcacagaaactaatgttggagcagaggagaaagtacatggaagtagaagattggacagagccagaactaccagatgaagcggtgttagaagctgcagcgtcagtccctgagccaaagcaaccagagcctcagacaccaccaccaccaccatctactactacttccactgttgcatctagatctttagccgaaatgatgaacagagaagaagcagaagcagaagagaaacaaaagattcagattcctcgtagtctcggttcattcaaagaagaaacaaacaaaatctccgatctttcagaaacagagttaaacgcacttcaagagcttcgtcaccttcttcaagtatcacaagattcaagcaaaacctctatatggggtgtgccatttctcaaagacgacagaaccgacgtcgttttgttaaagtttctaagagcaagagactttaaacctcaagaagcttactcaatgctaaacaagacactccaatggagaatcgacttcaacatcgaagagcttctagacgaaaacctcggtgacgatttagacaaagttgtgttcatgcaaggacaagacaaggagaatcatcctgtctgtttcaatgtctacggtgagtttcagaacaaagatctttatcagaaaacgttttcagatgaagagaagagagaacggttcttgagatggaggattcagtttcttgaaaagagtatcaggaatcttgattttgtagctggtggtgtttccacgatatgtcaagtaaatgatcttaagaattctccaggacctggtaagactgagcttaggttagctactaagcaagctcttcatcttcttcaagacaattaccctgagtttgtctctaaacagatattcatcaatgttccatggtggtaccttgcgttctataggattattagtccttttatgtcacaaagatcaaagagcaaactagttttcgcaggtccttcaagatctgcagaaacccttctcaggtacatatcacccgaacatgtcccggttcagtatggtggactaagtgtggataattgcgagtgtaactcggatttcacacacgatgatatcgctaccgagatcactattaaaccaactactaaacaaaccgtcgagattattgtttacgagaaatgtacaatcgtgtgggagataagagtagtgggatgggaggtttcgtatggagcggagtttgtgccggagaacaaagaaggttatacagtgatcattcagaaaccgaggaagatgactgcgaaaaatgaactggtggtgtctcatagcttcaaagttggagaagttggcaggattttgctaactgttgataacccgacttcaaccaagaaaatgcttatctacaggttcaaggttaagcctttagcttgtgagtaacaaaagtgcgcatctttcttcgagtgtttcttagtttagaacttgatcatatgattgttgattgtgttttgtttttctctcttttaccgacttatatgtttgtgtggttctgtttgctaaattcttttgttttatattgtattttgctcttatttttt

SEQ ID NO: 860 - protein, 668 aa, Arabidopsis thaliana
  misc_feature (387)..(569): Pfam Name: CRAL_TRIO Pfam Description: CRAL/TRIO domain
  misc_feature (303)..(375): Pfam Name: CRAL_TRIO_N Pfam Description: CRAL/TRIO, N-terminus
  misc_feature (1)..(668): Ceres Clone ID no. 1152744
  misc_feature (1)..(668): Bit score of 800.9 for HMM based on sequences of Figure 24
  misc_feature (1)..(668): Functional Homolog Of SEQ ID NO. 851
MSQDSATTTPPPPLTSDVSMPSGEEDEPKHVTLEEEAPVTSETNLKLPLMPELEESNHTAEVVSEKVTPETMTLESEGLNHAAEDSKQTHEVTPEAETLKLEVLNHTAEDSEQTHEVTPETETVKSEFLNHVAEDSEQTHEVTPETETVKSEVLNHAAEDSEQPRGVTPTPETETSEPNTSLLVTSETEEPNHAAEDYSETEPSQKLMLEQRRKYMEVEDWTEPELPDEAVLEAAASVPEPKQPEPQTPPPPPSTTTSTVASRSLAEMMNREEAEAEEKQKIQIPRSLGSFKEETNKISDLSETELNALQELRHLLQVSQDSSKTSIWGVPFLKDDRTDVVLLKFLRARDFKPQEAYSMLNKTLQWRIDFNIEELLDENLGDDLDKVVFMQGQDKENHPVCFNVYGEFQNKDLYQKTFSDEEKRERFLRWRIQFLEKSIRNLDFVAGGVSTICQVNDLKNSPGPGKTELRLATKQALHLLQDNYPEFVSKQIFINVPWWYLAFYRIISPFMSQRSKSKLVFAGPSRSAETLLRYISPEHVPVQYGGLSVDNCECNSDFTHDDIATEITIKPTTKQTVEIIVYEKCTIVWEIRVVGWEVSYGAEFVPENKEGYTVIIQKPRKMTAKNELVVSHSFKVGEVGRILLTVDNPTSTKKMLIYRFKVKPLACE

SEQ ID NO: 861 - DNA, 1788 bp, Populus balsamifera subsp. trichocarpa
  misc_feature (1)..(1788): Ceres Annot ID no. 1479687
  misc_feature (1)..(1788): Encodes the peptide sequence at SEQ ID NO. 862
atggcccaagaatctactccaccgcccgtaacaccgccgccgccgccatcacttgagcaagctccaccttctccagccatggtgaaagataaaggagacttgccaccagcaccagcaccagcaccagcaccagcaccggaaccagctgatgaagctgaatcaccgggagcaaaggggaaggagttacaggggccaacactaccaccgccaccggaaggtgagcaaaaggactctagatcatcatcattggcggcgatgatggggaaagaagaatcagtttcatcaccacaaccacctcctgaggagaaaactgaggtaactgaaaagtcagcagctactaaagaagaggttgttgctgttgccgttgccgacactgggaaggagaagcaagtacaagagcataaagttcctcaaactttagtttcttttaaggaagagagtaacctagtgtctgatctctctggtattgagagaaaagctttagaagaactgaagcagttggttcaagaagctctcaatactcaccagtttagcactgcaccaaaaaaagacgagagacaaagtgttattgtcacccaagaagcacaaacaactcaagaaacctccaaaaatgaagcatcagcatcagaatctgatgttagtactgagattaaaccaccagcagagactcaggaatcaaaagttgaagaaaccccagaaaaagaatcacaagaagtggcaaaagaagagcaaaaggctgcaccttcaccagaggagatcactatatgggggatccctcttctgaaagatgatagaagtgatgtggttctcttgaagttcttgagggcaagggattttaaggtaagcgatgcatttgtaatgatcaagaacacaattcaatggaggagagactttaaaattgatgagcttgttgatgaagatctaggtgatgatttggagaaagttgtgtttatgcatggttatgacagggaagggcatcctgtgtgttataatgtgtatggggagtttcaaaataaagagttgtatcagaagacattctctgatgaggagaaaagattgaagtttttgaggtggcggattcagttcttggagaggagtattaggaagcttgattttagtcctagtggtatttccaccgtcttccaggttaatgatctcaagaactctccaggacccggaaagagagagcttaggttggctactaaacaggctctcctattgcttcaggacaattaccctgagtttgtggccaaacaggtgttcatcaatgtcccttggtggtatcttgcattttatacaatgatcagtccatttatgacacaaagaaccaaaagcaaatttgtattcgcaggcccatcaaaatctgctgagacacttttcaaatatgtatctcctgagcaagttcctattcagtatggtggcttgagcgtggatttctgcgactgcaaccccgaatttacttttgctgatcctgctacggagataactgtaaaaccagcaaccaagcaaactgtggaaattataatttatgagaaatgtttcattgtttgggagttgcgagttgttggatgggaggtgagttatagtgctgaattcgtgcccgattctaaagatgcatacacaattataatgacaaaacccacaaaaatgaccccaaccaatgagccagtggtgtctaacagcttcaaagttggtgagctgggaaaaatattgctcacagttgacaactctacctcaaagaagaagaaacttctctacaggttcaagataaaccccttctcagattga

SEQ ID NO: 862 - protein, 569 aa, Populus balsamifera subsp. trichocarpa
  misc_feature (289)..(475): Pfam Name: CRAL_TRIO Pfam Description: CRAL/TRIO domain
  misc_feature (199)..(277): Pfam Name: CRAL_TRIO_N Pfam Description: CRAL/TRIO, N-terminus
  misc_feature (1)..(569): Ceres Annot ID no. 1479687
  misc_feature (1)..(569): Bit score of 986.4 for HMM based on sequences of Figure 24
  misc_feature (1)..(569): Functional Homolog Of SEQ ID NO. 851
MVKDKGDLPPAPAPAPAPAPEPADEAESPGAKGKELQGPTLPPPPEGEQKDSRSSSLAAMMGKEESVSSPQPPPEEKTEVTEKSAATKEEVVAVAVADTGKEKQVQEHKVPQTLVSFKEESNLVSDLSGIERKALEELKQLVQEALNTHQFSTAPKKDERQSVIVTQEAQTTQETSKNEASASESDVSTEIKPPAETQESKVEETPEKESQEVAKEEQKAAPSPEEITIWGIPLLKDDRSDVVLLKFLRARDFKVSDAFVMIKNTIQWRRDFKIDELVDEDLGDDLEKVVFMHGYDREGHPVCYNVYGEFQNKELYQKTFSDEEKRLKFLRWRIQFLERSIRKLDFSPSGISTVFQVNDLKNSPGPGKRELRLATKQALLLLQDNYPEFVAKQVFINVPWWYLAFYTMISPFMTQRTKSKFVFAGPSKSAETLFKYVSPEQVPIQYGGLSVDFCDCNPEFTFADPATEITVKPATKQTVEIIIYEKCFIVWELRVVGWEVSYSAEFVPDSKDAYTIIMTKPTKMTPTNEPVVSNSFKVGELGKILLTVDNSTSKKKKLLYRFKINPFSD

SEQ ID NO: 863 - protein, 723 aa, Arabidopsis thaliana
  misc_feature (387)..(575): Pfam Name: CRAL_TRIO Pfam Description: CRAL/TRIO domain
  misc_feature (303)..(375): Pfam Name: CRAL_TRIO_N Pfam Description: CRAL/TRIO, N-terminus
  misc_feature (1)..(723): Public GI ID no. 7267559
  misc_feature (1)..(723): Bit score of 738.4 for HMM based on sequences of Figure 24
  misc_feature (1)..(723): Functional Homolog Of SEQ ID NO. 851
MSQDSATTTPPPPLTSDVSMPSGEEDEPKHVTSEEEAPVTSETNLKLPLMPELEESNHTAEVVSEKVTPETMTLESEGLNHAAEDSEQTHEVTPETETAKLEVLNHTAEDSEQTHEVTPEKETVKSEFLNHVAEDSEQTHEVTPETETVKSEVLNHAAEDSEQPRGVTPTPETETSEADTSLLVTSETEEPNHAAEDYSETEPSQKLMLEQRRKYMEVEDWTEPELPDEAVLEAAASVPEPKQPEPQTPPPPPSTTTSTVASRSLAEMMNREEAEVEEKQKIQIPRSLGSFKEETNKISDLSETELNALQELRHLLQVSQDSSKTSIWGVPLLKDDRTDVVLLKFLRARDFKPQEAYSMLNKTLQWRIDFNIEELLDENLGDDLDKVVFMQGQDKENHPVCYNVYGEFQNKDLYQKTFSDEEKRERFLRWRIQFLEKSIRNLDFVAGGVSTICQVNDLKNSPGPGKTELRLATKQALHLLQDNYPEFVSKQIFINVPWWYLAFYRIISPFMSQRSKSKLVFAGPSRSAETLLKYISPEHVPVQYGGLSVDNCECNSDFTHDDIATEITVKPTTKQTVEIIVYEVRPFCIKTFYTTFSNAHFCVCVWKITNCGFNTKYLRFSYVLKSSYICASKHFFLQKCTIVWEIRVVGWEVSYGAEFVPENKEGYTVIIQKPRKMTAKNELVVSHSFKVGEVGRILLTVDNPTSTKKMLIYRFKVKPLACE

SEQ ID NO: 864 - DNA, 1386 bp, Populus balsamifera subsp. trichocarpa
  misc_feature (1)..(1386): Ceres Annot ID no. 1532284
  misc_feature (1)..(1386): Encodes the peptide sequence at SEQ ID NO. 865
atggcagaggtggcacaaaacgtgagtcaagaacaagtggtggtggtaactgatgttccacaagctgagaaaacaacaccagtgccaccaacaatgccagtggtggggaaagagctaccattgcccgtgcctgagactgaggaggtgccaatgaagccaaagcaggttgaggaggctgttgtggagactgaggatttgaaagctagtggaggtgatgatgagaagatgcctcagttggtttcttttaaggaagaaagtactaaagttgctgatcttcttgagtctgagaagaaagcacttcaagaatttaagaaacttgttcaggaagcacttaacaagcatgaatttatgacaccagaggaagtatcaatctggggcataacgcttcttgctgatgacagaagtgatgtgattctattgaaatttctcagagccagggatttcaaggtgaaagatgccttcaccatgctcaagaacacaattcgctggagaaaggagctcggcattgatgaattgcttgaacaagatttgggctgtgatgatttggggaaggtggtatttatgcatggtcttgacaaagagggacacccagtttgctacaatgtctacggggagttccaaaacaaggagctttacaagaattcattttctgatgaagagaagaggcagagattcttgaggtggagaattcaattcctggaaaggagtattaggaaattggatttcagtcctggtggagtctctaccattgttcaggttaatgacttgaaaaattctcctggaccagctaagagagagcttagacaagctactagacaggcacttcaattgcttcaagacaactatccagaatttgtggccaaacagatcttcatcaatgtgccctggtggtacctcacagtcaatagaatgataagtccatttttaactcagagaaccagaagcaagtttgtctttgctggtccttccaaatctgcagaaaccctcaccaggtacataactgctgagcaaataccagtgaagtatggaggactaagcaaagatggtgaattttgcacagctgatgctgttactgagattacagtgaaggcatcagcaaagcacactgtagaattcccagttactgagacatgccttctgacttgggaaatgagagttgtgggatgggatgtgagctatggcgccgaattcgtaccaaatgctgaggatagctacacagtgatcatccaaaaggctagaaaggttgctataactgaagaaccagtggttagcaacagttttaaagttggtgaacctggtaaagttgttctcaccattgacaataccacttccaagaagaagaagaagctcctctatcgcttgaaaaccaaaccttgctctgattaa

SEQ ID NO: 865 - protein, 461 aa, Populus balsamifera subsp. trichocarpa
  misc_feature (185)..(368): Pfam Name: CRAL_TRIO Pfam Description: CRAL/TRIO domain
  misc_feature (94)..(172): Pfam Name: CRAL_TRIO_N Pfam Description: CRAL/TRIO, N-terminus
  misc_feature (1)..(461): Ceres Annot ID no. 1532284
  misc_feature (1)..(461): Bit score of 832.7 for HMM based on sequences of Figure 24
  misc_feature (1)..(461): Functional Homolog Of SEQ ID NO. 851
MAEVAQNVSQEQVVVVTDVPQAEKTTPVPPTMPVVGKELPLPVPETEEVPMKPKQVEEAVVETEDLKASGGDDEKMPQLVSFKEESTKVADLLESEKKALQEFKKLVQEALNKHEFMTPEEVSIWGITLLADDRSDVILLKFLRARDFKVKDAFTMLKNTIRWRKELGIDELLEQDLGCDDLGKVVFMHGLDKEGHPVCYNVYGEFQNKELYKNSFSDEEKRQRFLRWRIQFLERSIRKLDFSPGGVSTIVQVNDLKNSPGPAKRELRQATRQALQLLQDNYPEFVAKQIFINVPWWYLTVNRMISPFLTQRTRSKFVFAGPSKSAETLTRYITAEQIPVKYGGLSKDGEFCTADAVTEITVKASAKHTVEFPVTETCLLTWEMRVVGWDVSYGAEFVPNAEDSYTVIIQKARKVAITEEPVVSNSFKVGEPGKVVLTIDNTTSKKKKKLLYRLKTKPCSD

SEQ ID NO: 866 - protein, 440 aa, Vitis vinifera
  misc_feature (84)..(163): Pfam Name: CRAL_TRIO_N Pfam Description: CRAL/TRIO, N-terminus
  misc_feature (169)..(346): Pfam Name: CRAL_TRIO Pfam Description: CRAL/TRIO domain
  misc_feature (1)..(440): Public GI ID no. 157357696
  misc_feature (1)..(440): Bit score of 848.2 for HMM based on sequences of Figure 24
  misc_feature (1)..(440): Functional Homolog Of SEQ ID NO. 851
MADETDAAPPPTLLAAASVVPPETAAPPETAASEEVLTVLDVAPPVTEKEVSPQKPPPPPEEVVAVVDSEKKVPQNLVSFKEESNRLADLSESERRALEELKQSHESPTQEDVSIWGIPLLKDERSDMILLKFLRAREFKVKEAFAMLKNTIFWRKEFGIDALVDDDLGEHLEKVVWPPSVLQFSEQRITFSDEEKRMKFLRWRIQFLERSIRKLDFTPGGVNTIFQVNDLKNSPGPGKWELRQATKQALQLLQDNYPEFVAKQVFINVPWWYLAFYMMISPFLTQRTKSKFVFASPAKSAKTLFKYISPEQVPIQYGGLSVDYCDCNPDFGIADPVTEITVKPSTKQTVEILVSEQCVIVWEVRVVGWEVAYGAEFIPDAEDEYTVVVQKATKMAPTDDPVMCNSFKIKELGKIVITIDNPTSKKKKLLYRFKVKPYSN

SEQ ID NO: 867 - DNA, 1806 bp, Populus balsamifera subsp. trichocarpa
  misc_feature (1)..(1806): Ceres Annot ID no. 1480239
  misc_feature (1)..(1806): Encodes the peptide sequence at SEQ ID NO. 868
atgagtcaagaacaagatgttgtggtggtaactgatgttccacaagctgagaaaacagctccagtgccaccaacaatgccagtggtggtggagaaagagccaccagtgccagtccctgagactgaagaggagccaatgaagccaaagcaggttgaggagggtgctgtagagactcaggtgttgaaacctagtggaggtgacgatgaaaagatgcctcagttggtttcttttaaggaggaaagtactaaagttgctgatcttcttgattctgagaagaaagcacttcaagaatttaagcagcttgttcaagaagcacttaacaagcatgaatttagtgctttgactacaccaccagcatcagctaaaaaagaggagaagaaagaagatgtggtggtggtagccgaggaggagaaaaagccagcccaagaagaggaaacatcagcagtaacagaagacaaggaaaaagtagagactgaagctgcagcagaaaaagaagagaagaatgaagtggtggaaagtgaggttcttgatgatcaaggaaaggtggctactgctgttgctagtgatactactgctggtacttctgtggatgatgatggtgctaagacggtggaagccattgaagagaccatcgtagctgtctcctcttcagtggcttcacaagaggagactcaagctcaggctacaaaagagcccgagggagagacaaaggctgcctcatcattggatgaggaagctaaagaagttgaatctgagaccgtggaagtgacaccagaagaagtatcaatctggggaataccacttcttgctgatgacagaagtgatgtgattctcttgaaatttctcagagccagagatttcaaggtgaaagatgcattcaccatgctcaagagcacaattcgctggagaaaggagtttggcattgatgaattgcttgaacaagatttaggctttgatgatttggggaaggtggtatttatgcatggtcttgataaagagggacacccagtgtgctataatgtctatggagaattccaaaacaaggaactttacaagaattcattttctgatgaggagaagaggcagagattcttaaggtggaggattcaattcctggaaaaaagtatcaggacattggatttcagtcccggtggaatttccacaattgttcaggttaatgacttgaaaaattctcctggaccagctaagagagagcttagacaagctactagacaggcacttcaattgcttcaagacaactatccagaatttgtggccaaacagatcttcatcaatgttccctggtggtacctaacagtaaatagaatgataagtccatttttaacccagaggaccagaagcaagtttgtctttgttggtccttccaaatctgccgaaacccttatcaggtacatagccgctgagcaaataccagtgaagtacggaggactaagcaaagatggtgaatttggctcagctgatgctgttactgagattaccgtgaagccagcagcaaagcacactgtagaattcccagttactgagacatgccttttaacatgggaagtgagagttgcgggatgggatgtgagctatagtgcagaatttgtaccaagtgctgaagatagctacacagtgatcatccaaaaggctagaaaggttgctgcaactgaagaaccagtggtttgcaacagtttcaaaattggtgaacctggtaaagttgttctcaccattgacaactccacatccaagaagaagaagaagctcctctatcgcttgaaaaccaagcccgcttcttctgattaa

SEQ ID NO: 868 - protein, 601 aa, Populus balsamifera subsp. trichocarpa
  misc_feature (324)..(508): Pfam Name: CRAL_TRIO Pfam Description: CRAL/TRIO domain
  misc_feature (231)..(311): Pfam Name: CRAL_TRIO_N Pfam Description: CRAL/TRIO, N-terminus
  misc_feature (1)..(601): Ceres Annot ID no. 1480239
  misc_feature (1)..(601): Bit score of 875.8 for HMM based on sequences of Figure 24
  misc_feature (1)..(601): Functional Homolog Of SEQ ID NO. 851
MSQEQDVVVVTDVPQAEKTAPVPPTMPVVVEKEPPVPVPETEEEPMKPKQVEEGAVETQVLKPSGGDDEKMPQLVSFKEESTKVADLLDSEKKALQEFKQLVQEALNKHEFSALTTPPASAKKEEKKEDVVVVAEEEKKPAQEEETSAVTEDKEKVETEAAAEKEEKNEVVESEVLDDQGKVATAVASDTTAGTSVDDDGAKTVEAIEETIVAVSSSVASQEETQAQATKEPEGETKAASSLDEEAKEVESETVEVTPEEVSIWGIPLLADDRSDVILLKFLRARDFKVKDAFTMLKSTIRWRKEFGIDELLEQDLGFDDLGKVVFMHGLDKEGHPVCYNVYGEFQNKELYKNSFSDEEKRQRFLRWRIQFLEKSIRTLDFSPGGISTIVQVNDLKNSPGPAKRELRQATRQALQLLQDNYPEFVAKQIFINVPWWYLTVNRMISPFLTQRTRSKFVFVGPSKSAETLIRYIAAEQIPVKYGGLSKDGEFGSADAVTEITVKPAAKHTVEFPVTETCLLTWEVRVAGWDVSYSAEFVPSAEDSYTVIIQKARKVAATEEPVVCNSFKIGEPGKVVLTIDNSTSKKKKKLLYRLKTKPASSD

SEQ ID NO: 869 - DNA, 1725 bp, Populus balsamifera subsp. trichocarpa
  misc_feature (1)..(1725): Ceres Annot ID no. 1486823
  misc_feature (1)..(1725): Encodes the peptide sequence at SEQ ID NO. 870
atggtgaagcctgctgtgatcgagaaagaaacaccagcacctgttcctgaaccagagcctgtggcgccagaaaagccagcagtggttgaagacgctgttgccgtcgttgaaggtgctgttgaagaggagaaaccaaaggaggaaacgacaggggaggtgaaaataacacaatctgtttcttttaaggaagagaccaatgttgttgcacgagttcaccacaccaccatcacaccagcagcagcagccaaggaggaggagaagccagctgagactgagaaggtagaagtcaaggaggcggagaaaactgaggctccttctactagcgaagagcccaaaactgaagaggagcctaaagctactgaggcttccactccacctccaccaccaccggcggtggaggagaaggttgaggtgaaagaggaaaaagtggaagagaaggtagaagtaaaagaagaagaaaagaaggccgagccatccgctgcggcggagacggtggtcgtttctgctacagaggtggagaaggtagctgctgtggatgaggatggagccaagacagttgaggcaattgaggagacaatagtatctgtctctgcccctgcaacggaagaggctgccccagctgcagaacccgaggcagctcctgcagagggggagcctaaaaaagaagaggaagcgaccccagatgttcctccgcccaccccggaggaagttttcatctggggaatcccccttcttggcgatgagaggagtgatgtgatcctcttgaagttcttgagagctagagattttaaagtgaaggatgcgtttactatgatcaagaacactgtcaagtggaggaaggaatttggaattgatgctcttcttgaagaagaccttggaactgaattggaaaaagtggtctttacccatggagttgataaagaaggtcaccctgtgtgttacaatgcttatggtgctttccaggataaggagctttatcagaattgttttgctgatgaagagaagagggcgaaattcctgaaatggaggattcagttcctggagaagagtatcaggaagttagactttagtcccagtggtatttgcaccattgttcaggtcagtgatctcaagaattcccctggacctgccaagactggactcaggcaagccaccaaccaggcgcttagtttgctacaagataattatcctgaatttgtggcaaaaaatgtgttcataaatgttccatggtggtacctaacattcagtaagatgatcagtcctttcctgacacaaaggacaaagagcaagtttgtatttgctggtccatccaaatctgctgaaacacttttcaaatacatagctcctgaagatgtgccagttcagtatggtggactgagcagggatggtgaattcacagttgctgactctgtcacagatgttactattaagccaacatcaaagcacactgttgaattcccagtttctgaggcatgtattcttgcttgggagcttcgagttttgggttgggacgttagctatgaagctgaattcatgcctagcgctgaggatggttacactgttatcgtatcaaagactaggaaggttacctcaaccgacgagcctgtgatctcagacacattcaaaattggtgaacctggcaaggttgtgcttaccattgataaccaaacctccaagaagaagaagctcctctatagatcgaagaccaaacccatttctgaatga

SEQ ID NO: 870 - protein, 574 aa, Populus balsamifera subsp. trichocarpa
  misc_feature (299)..(483): Pfam Name: CRAL_TRIO Pfam Description: CRAL/TRIO domain
  misc_feature (218)..(287): Pfam Name: CRAL_TRIO_N Pfam Description: CRAL/TRIO, N-terminus
  misc_feature (1)..(574): Ceres Annot ID no. 1486823
  misc_feature (1)..(574): Bit score of 818.9 for HMM based on sequences of Figure 24
  misc_feature (1)..(574): Functional Homolog Of SEQ ID NO. 851
MVKPAVIEKETPAPVPEPEPVAPEKPAVVEDAVAVVEGAVEEEKPKEETTGEVKITQSVSFKEETNVVARVHHTTITPAAAAKEEEKPAETEKVEVKEAEKTEAPSTSEEPKTEEEPKATEASTPPPPPPAVEEKVEVKEEKVEEKVEVKEEEKKAEPSAAAETVVVSATEVEKVAAVDEDGAKTVEAIEETIVSVSAPATEEAAPAAEPEAAPAEGEPKKEEEATPDVPPPTPEEVFIWGIPLLGDERSDVILLKFLRARDFKVKDAFTMIKNTVKWRKEFGIDALLEEDLGTELEKVVFTHGVDKEGHPVCYNAYGAFQDKELYQNCFADEEKRAKFLKWRIQFLEKSIRKLDFSPSGICTIVQVSDLKNSPGPAKTGLRQATNQALSLLQDNYPEFVAKNVFINVPWWYLTFSKMISPFLTQRTKSKFVFAGPSKSAETLFKYIAPEDVPVQYGGLSRDGEFTVADSVTDVTIKPTSKHTVEFPVSEACILAWELRVLGWDVSYEAEFMPSAEDGYTVIVSKTRKVTSTDEPVISDTFKIGEPGKVVLTIDNQTSKKKKLLYRSKTKPISE

SEQ ID NO: 871 - protein, 604 aa, Cucurbita pepo
  misc_feature (326)..(509): Pfam Name: CRAL_TRIO Pfam Description: CRAL/TRIO domain
  misc_feature (234)..(314): Pfam Name: CRAL_TRIO_N Pfam Description: CRAL/TRIO, N-terminus
  misc_feature (1)..(604): Public GI ID no. 82469976
  misc_feature (1)..(604): Bit score of 866.5 for HMM based on sequences of Figure 24
  misc_feature (1)..(604): Functional Homolog Of SEQ ID NO. 851
MAEETQKPAAAEAPTSTQPVPEEPAVVPPPVPAAEIQLPDSAPAPPQPEASPAKPDSVAEVAEDEKPKASEEFEKISQSVSFKEESNVVGELPESQRKALADLKVLIQEALNKHEFTAPPAPLPPKEEEKPAEEKKEDTEKPAEQPQIDEPAKEPVIEEPPKTEAEPEPVTETVTVKVEETITPHPAPETSLAPEADEKAAEPSTVVEKVAVIDEDGAKTVEAIEESVVAVSTPPPEESAPSKEEAEVEVEAAEAVPPPPPEEVFIWGIPLLGDERSDVILLKFLRARDFKVKDAFTMIKNTVRWRKQFDIEALLDEDLGNQWDKVVFSHGVDREGHPVCYNVFGEFENKDLYQITFSDDEKSLKFLRWRVQFLEKSIRKLDFSPNGISTIVQVNDLKNSPGLTKWELRNATKRALQLFQDNYPEFAAKQVFINVPWWYLAVNRMISPFFTQRTKSKFVFAGPSKTAETLFKYVTPEQVPVQYGGLSREGEQEFSIDDPVTEVAIKAATKHTVEFPISEPSLLVWELRVVGWDVSYGAEFLPSAEGGYTVIVQKTAKLGPADEPVISNSYRVGEAGKIVLTIDNLSSKKKKILLYRSKTKPISD

SEQ ID NO: 872 - protein, 606 aa, Vitis vinifera
  misc_feature (330)..(502): Pfam Name: CRAL_TRIO Pfam Description: CRAL/TRIO domain
  misc_feature (258)..(318): Pfam Name: CRAL_TRIO_N Pfam Description: CRAL/TRIO, N-terminus
  misc_feature (1)..(606): Public GI ID no. 225460394
  misc_feature (1)..(606): Bit score of 857.9 for HMM based on sequences of Figure 24
  misc_feature (1)..(606): Functional Homolog Of SEQ ID NO. 851
MAEDGKKPVSEEAQKPVAEASVVEEVVAVAEVTAPPPAVPEAEEAAEKLKEEEEVVEKLEEEVAAAEEEKPKVVEEGEKMTESVSFKEESNVVGDLPESQRKALEELKVLVREALEKHEFTAPPPPPPPPAKEEEKAPATEEEPKTEAPAEPAPEVVCPPPVEESEKKEEKEEEKKEEEKKEEEKKEEEKVAPPEPAEPVVVAAVVETVTAVVVDEDGTKTVEAIEETIVVAPPAPPAEEAAAVVEEVTPPPPAEEVPPPPPPPPEEVEIWGIKLFDDDRTDVVLLKFLRARDFKPKEALTMLKNTVLWRKSFGIETLLGDDLGTHLESVVFMEGSGKEGHPVCYNAYGKFLNKELYQNTFSDEEKRQNFLRWRIQFLEKSIRKLDFSPNGINTIIQVNDLKNSPGPFKRELRQSTNQALHLLQDNYPEFVAKQIFINVPWWYLAFNRMISPFLTQRTKSKFVFAGPSKSAETLFKYIAPEQVPVQYGGLKRDGDTEFSICDPVTLVTIKPGCKHVIEFPYSEPCQLIWELRVIGWDVTYGAEFVPTVEGGYTVIVQKARKIAPTDEPVISNSFKIGEPGKVILTIDNQTSKKKKLLYRSKTQPCD

SEQ ID NO: 873 - protein, 620 aa, Zea mays
  misc_feature (343)..(529): Pfam Name: CRAL_TRIO Pfam Description: CRAL/TRIO domain
  misc_feature (259)..(329): Pfam Name: CRAL_TRIO_N Pfam Description: CRAL/TRIO, N-terminus
  misc_feature (1)..(620): Public GI ID no. 212275574
  misc_feature (1)..(620): Bit score of 696.7 for HMM based on sequences of Figure 24
  misc_feature (1)..(620): Functional Homolog Of SEQ ID NO. 851
MADETKQEAAAPAAEVVVTEEEKKAEETAPVAEEKAVEAAVEKAAEAEAGAEEKAAEADSEEEKKAEEAEEAAAGDEAAVIDGTGSFKEESNLVSELPDPERTALAQLKELVATALANGEFNLPPPPAKEEAKKEEPAKEEAPADKEDEPKAEEAAAQEPVKEEAKPEEPKTEAPAEAAPEEVKDETPVPEETKTEAPAPEEPKAEEPAKEELKAEAATEAVAEETKPAEPVPEEEEKTVVVAEEEATKTVEAIEETVAVAVAAAASEEPEAGEPKEELIWGVPLAGDDERTDTVLLKFLRAREFKVKEAMAMLKSAVLWRKRFGIDELLLDADLGLRELEGVVFYRGADREGHPVCYNVYGEFQDKELYERAFGDEEKRERFLKWRIQLLERGIREQLDFSPSGICSMVQVTDLKNSPPMLGKHRAVTRQALALLQDNYPEFVAKKVFINVPWWYLAANKVMSPFLTQRTKSKIVFCSPGKSAETLFRYIAPEQVPVQFGGLYKEDDTEFSTSDAVTELTVKPSSKETVEIPATENSTVVWELRVLGWEVSYGAEFTPDAEGGYTVIVQKTRKVPAHEEPIMKGSFKATEPGKLVLGVNNPASRKKKLLCRFKVRSAAA

SEQ ID NO: 874 - DNA, 2166 bp, Triticum aestivum
  misc_feature (1)..(2166): Ceres Clone ID no. 846541
  misc_feature (1)..(2166): Encodes the peptide sequence at SEQ ID NO. 875
aacaccccaagctttctctctctacctccctcccgtgctctctccccctctccctcctgctctatctttctcaccgcaaaagcttgaaacaccccgcggagatggcagaggagccgcagccacaggccgccgccgcccccgccgccgcggccacggaggtggtcgtcgccgagaaggcgccggcggaggtggagaagaaggccgaggagcccgcggcggaggcggaggccgaggagacggccgccgttgccgacgacgggggcgccgtcgaggccaccggctctttcaaggaggagagcaacctcgtcgccgacctgcctgacccggagaagaaggcgctcgacgagttcaaggagctgatcgtcgccgcgctcgccgccggtgagttcaatctgccccctcccccgccgccgccgaaggccaagactgaggccgccgcagaggagaccaagacggaggcgccggccaaggaggaggccaagaccgaggagccggccaaggcggaagaaccagccaaggaggagcccaaggctgaagagccggccaaggccgaggcggcagcggcggagccagcagccgaggagcccaaggccgtggtcgctgccgaggcagcagccgaggagccggccaaggaggaacccaaggccgaggaggccaagccggccgagccaaagaaggaggaggaagcagtcgtggtcgccgaggagggcaccaagacggcggaaccggtcgaggaggccgccgccgccgccaccaccacagagcaggcagcggcgccggaaccggaggcggaggcagccgcgcccgagccggtgttcatctggggcgtgccgctggtgggcgacgacgagcgcacggacgcggtgctgctcaagttcctgcgcgcgcgggagttcaaggtgaaggaggcgatggcgatgctccggtccgccgtgctgtggcggaagcgcttcggcatcgagtcgctcctggaggccgacctggccttcccggagctggagaaggtggtgttctaccgcggcgccgaccgggagggccacccggtgtgctacaacgtgtacggcgagttccaggacaaggaggtgtacgagaaggcgttcggcgacgaggagaagcgcgagcggttcctcaagtggcgcatccagctgctggagcgcggcatcctgtcgcagctggacttcgcgcccagcggcatctgctccatggtgcaggtcaccgacctcaagaactcgccgcccatgctcggcaagcaccgcgccgtcacccgccaggccgtcgccctgctccaggacaactaccccgagttcatcgccaagaaggtgttcatcaacgtgccatggtggtatctcgctgccaacaaaatgatgagccctttcctcacccagcgcaccaagagcaagttcgtgttcgccagccaggccaagtcccctgagacccttttcagatacatcgcgccggagcaagtccccgtccaattcggaggcctcttcaaggaagatgaccctgatttcacaacctctgactctgtcaccgagctcaccatcaaagcttcttccaaagaaaccattgagatccctgtcaccgagaactcaacgattgtatgggagctccgggtgctcggctgggaggtcagccacggcgcggagttcacccccgacgctgagggcgcgtacacggtcatcgtgcagaagacaaggaaggtccccgcgaatgaggagcccatcatgaagggcagcttcaaggccggcgaggccggcaagatcgtgctcacggtcagcaacgccgcgtcgaagaagaagaagctcctctacagatccaaggtgaagtgcagcaccggcgagtccgttgaggccgacattccatgaccaccattggagtcagtccctgatgatgatagaagaagaagaagaagaagaagataaaccgcctttttggtttttgttctttgattccattggttttgtggtttttggttcgcattcccgcatttgtttaattattaaaattaaaaacccaaagtgagcttgattttgtgacggtacagtagttgggagaggaaggttggtatggatgggatgatataatggcatcgtgatggttgttgagggtagggcaagaggagaaaaatggatgatacaatctgctgctgctctgtaaatttgtctg

SEQ ID NO: 875 - protein, 587 aa, Triticum aestivum
  misc_feature (302)..(488): Pfam Name: CRAL_TRIO Pfam Description: CRAL/TRIO domain
  misc_feature (227)..(289): Pfam Name: CRAL_TRIO_N Pfam Description: CRAL/TRIO, N-terminus
  misc_feature (1)..(587): Ceres Clone ID no. 846541
  misc_feature (1)..(587): Bit score of 694.3 for HMM based on sequences of Figure 24
  misc_feature (1)..(587): Functional Homolog Of SEQ ID NO. 851
MAEEPQPQAAAAPAAAATEVVVAEKAPAEVEKKAEEPAAEAEAEETAAVADDGGAVEATGSFKEESNLVADLPDPEKKALDEFKELIVAALAAGEFNLPPPPPPPKAKTEAAAEETKTEAPAKEEAKTEEPAKAEEPAKEEPKAEEPAKAEAAAAEPAAEEPKAVVAAEAAAEEPAKEEPKAEEAKPAEPKKEEEAVVVAEEGTKTAEPVEEAAAAATTTEQAAAPEPEAEAAAPEPVFIWGVPLVGDDERTDAVLLKFLRAREFKVKEAMAMLRSAVLWRKRFGIESLLEADLAFPELEKVVFYRGADREGHPVCYNVYGEFQDKEVYEKAFGDEEKRERFLKWRIQLLERGILSQLDFAPSGICSMVQVTDLKNSPPMLGKHRAVTRQAVALLQDNYPEFIAKKVFINVPWWYLAANKMMSPFLTQRTKSKFVFASQAKSPETLFRYIAPEQVPVQFGGLFKEDDPDFTTSDSVTELTIKASSKETIEIPVTENSTIVWELRVLGWEVSHGAEFTPDAEGAYTVIVQKTRKVPANEEPIMKGSFKAGEAGKIVLTVSNAASKKKKLLYRSKVKCSTGESVEADIP

SEQ ID NO: 876 - protein, 595 aa, Vitis vinifera
  misc_feature (315)..(504): Pfam Name: CRAL_TRIO Pfam Description: CRAL/TRIO domain
  misc_feature (258)..(318): Pfam Name: CRAL_TRIO_N Pfam Description: CRAL/TRIO, N-terminus
  misc_feature (1)..(595): Public GI ID no. 147859032
  misc_feature (1)..(595): Bit score of 783.6 for HMM based on sequences of Figure 24
  misc_feature (1)..(595): Functional Homolog Of SEQ ID NO. 851
  misc_feature (483)..(483): Xaa is any aa, unknown, or other
  misc_feature (522)..(522): Xaa is any aa, unknown, or other
MAEDGKKPVSEEAQKPVAEASVVEEVVAVAEVTAPPPAVPEAEEAAEKLKEEEEVVEKLEEEVAAAEEEKPKVVEEGEKMTESVSFKEESNVVGDLPESQRKALEELKVLVREALEKHEFTAPPPPPPPPAKEEEKAPATEEEPKTEAPAEPAPEVVCPPPVEESEKKEEKEEEKKEEEKKEEEKKEEEKVAPPEPAEPVVVAAVVETVTAVVVDEDGTKTVEAIEETIVVAPPAPPAEEAAAVVEEVTPPPPAEEVPPPPPPPPEEVEIWGIKLFDDDRTDVVLLKFLRARDFKPKEALTMLKNTVLWRKSFGIETLLGDDLGNPPGRAWLCYNAYGKFLNKELYQNTFSDEEKRQNFLRWRIQFLEKSIRKLDFSPNGINTIIQVNDLKNSPGPFKRELRQSTNQALHLLQDNYPEFVAKQIFINVPWWYLAFNRMISPFLTQRTKSKFVFAGPSKSAETLFKYIAPEQVPVQYGGLKRDXDTEFSICDPVTLVTIKPGCKHVIEFPYSEPCQLIWELRXIGWDVTYGAEFVPTVEGGYTVIVQKARKIAPTDEPVISNSFKIGEPGKVILTIDNQTSKKKKLLYRSKTQPCD

SEQ ID NO: 877 - protein, 610 aa, Oryza sativa subsp. indica
  misc_feature (331)..(518): Pfam Name: CRAL_TRIO Pfam Description: CRAL/TRIO domain
  misc_feature (250)..(318): Pfam Name: CRAL_TRIO_N Pfam Description: CRAL/TRIO, N-terminus
  misc_feature (1)..(610): Public GI ID no. 125528559
  misc_feature (1)..(610): Bit score of 732.6 for HMM based on sequences of Figure 24
  misc_feature (1)..(610): Functional Homolog Of SEQ ID NO. 851
MAEEPQPEAAPAAVAATTEVAVAEKAPVEAEKEKKVEEETPAVEAEAKEEKKDEAAAAGGDEAGAIEGTGSFKEESNLVADLPDPEKKALDEFKQLIAAALAACEFNLPPPPPPPKAKVEAAVEETKAEESKAEEEPKAEEPAKEEEPKAEVAAAAAAPPEAGTEEPKAEASSEEAKTEEPKAEAAADEPAKQESKAEAAPAEEAKPAEPEPEEKTVVVTEEEAATKTVEAIEETVVPAAAAPAAAATEEAAAPEPEVQAAAAPEPVLIWGVPLVGDDERTDTVLLKFLRAREFKVKEAMAMLRSAVLWRKRFGIESLLDADLALPELDSVVFYRGADREGHPVCYNVYGEFQDKDLYEKAFGDEEKRERFLKWRIQLLERGILSQLDFSPSGICSMVQVTDLKNSPPMLGKHRAVTRQAVALLQDNYPEFIAKKVFINVPWWYLAANKMMSPFLTQRTKSKFIFASPAKSAETLFRYIAPEQVPVQFGGLFKEDDPEFTTSDAVTELTIKPSSKETVEIPVTENSTIGWELRVLGWEVSYGAEFTPDAEGGYTVIVQKTRKVPANEEPIMKGSFKVGEPGKIVLTINNPASKKKKLLYRSKVKSTSESV

SEQ ID NO: 878 - protein, 613 aa, Oryza sativa subsp. japonica
  misc_feature (334)..(521): Pfam Name: CRAL_TRIO Pfam Description: CRAL/TRIO domain
  misc_feature (253)..(321): Pfam Name: CRAL_TRIO_N Pfam Description: CRAL/TRIO, N-terminus
  misc_feature (1)..(613): Public GI ID no. 115441357
  misc_feature (1)..(613): Bit score of 734.0 for HMM based on sequences of Figure 24
  misc_feature (1)..(613): Functional Homolog Of SEQ ID NO. 851
MAEEPQPEAAPAAVAATTEVAVAEKAPVEAEKEKKVEEETPAVEAEAKEEKKDEAAAAAAAGGDEAGAIEGTGSFKEESNLVADLPDPEKKALDEFKQLIAAALAACEFNLPPPPPPPKAKVEAAVEETKAEETKAEEEPKAEEPAKEEEPKAEVAAAAAAPPEAGTEEPKAEASSEEAKTEEPKAEAAADEPAKEESKAEAAPAEEAKPAEPEPEEKTVVVTEEEAATKTVEAIEETVVPAAAAPAAAATEEAAAPEPEVQAAAAPEPVLIWGVPLVGDDERTDTVLLKFLRAREFKVKEAMAMLRSAVLWRKRFGIESLLDADLALPELDSVVFYRGADREGHPVCYNVYGEFQDKDLYEKAFGDEEKRERFLKWRIQLLERGILSQLDFSPSGICSMVQVTDLKNSPPMLGKHRAVTRQAVALLQDNYPEFIAKKVFINVPWWYLAANKMMSPFLTQRTKSKFIFASPAKSAETLFRYIAPEQVPVQFGGLFKEDDPEFTTSDAVTELTIKPSSKETVEIPVTENSTIGWELRVLGWEVSYGAEFTPDAEGGYTVIVQKTRKVPANEEPIMKGSFKVGEPGKIVLTINNPASKKKKLLYRSKVKSTSESV

SEQ ID NO: 879 - DNA, 2130 bp, Zea mays
  misc_feature (1)..(2130): Ceres Clone ID no. 325220
  misc_feature (1)..(2130): Encodes the peptide sequence at SEQ ID NO. 880
ataacacaacaatctctctcccctcactccctctctgcagcgcgcagytttcaaagcgttgggagagatggcagaggagacgcaaccagaggccgcagccgccgccgcgcccgccgcggccgaggtagtcgtgaccgaagctgcgccggcggaggcggaggtgcctgcggcggcggaagctgaagccgaggccaaggatgagaagaaaggtgacgaggcggagctcaccgccgatgacgcgggggtggggaccggctcgttcaaggaggaaagcaacctggtggaagacctgcccgacccggagaagaaggcgctcgacgagttcaagcagctgatcgctgctgccctcgccgccggtgagttcaacctgcctcccccgccgccgccgccgaaggccaaggaaacaaaggtggaggaagccaaggccgaggagcccgccaaagaagagcccscgkcckaggcggaggaagccaaggcccaggtggctgcggatgccccggttgaggaggtcaagacggaggtgccgccggccgaggaggccaaggctgagacactggctgaggaagccaagccttccgagcccgagccgcaggagaagaccgtcgtggtcactgaggaggagactgccaccaagacggtggaagcaatcgaggaaaccgtcgtgtccgcccccgccgccatcccggaggaagcagcggcgccggaggcggtggtcgaggctcaggcgaccgcgcctgaacccgtgctgatttggggcgtgccgctggtcggcgacgacgagcgcacggacacggttctgctcaagttcctgcgtgcgcgggagttcaaggtgaaggaggccatggcgatgctcaagtccgcggtgctgtggcgcaagcgcttcggcatcacctcgctcctcgacgccgaccttggcctgacggagctggagaacgtggtgttctaccgcggcacggaccgcgaaggccaccccgtgtgctacaacgtctacggcgagttccaggacaaggatctctacgagaaggccttcggcgacgatgagaagagggagcgcttcctcaagtggcgcatccagctgctggagcgcggcattctgtcgaagctggacttctcgcccagcggcatctgctccatggttcaggttaccgacctcaagaactcgccgcccatgctcggcaagcaccgcgccgtcacccgccaggctgtcacgctgctccaggacaactaccccgagttcattgccaagaaggtgttcatcaatgtgccgtggtggtatctagccgccaacaagatgatgagcccgttcctcacacagcgcaccaagagcaagttcgtctttgctagcccagccaaatcagcagcgactctattcagatacatcgcaccggaacaagttcctgtccaatttggaggcctcttcaaggaggatgatcctgagttcaccacctctgacactgtctccgagctcactatcaaaccatcctcaaaagaaaccgttgagatccctgtcaccgagaactccacaattgtatgggaactccgggtgctgagttgggaagtgagctatggcgccgagttcacccccgacgcggagggtgggtacaccgtcattgtacagaagacaaggaaggtgcctgctaacgaggaaccgatcatgaagggaagcttcaaggcaggcgagcctggaaaacttgtgctaactgtgaacaaccctgcatccaagaagaagactctactttacagatcgaaggtgaagagcgccagcgagtgagtgtgaggtcacgccgctagctgcctgggccctacagttaaaacgatctacagcatgatagaagagagaaggaaccttttggtttggttcgttaatttactgggatttgctgggttttttattttttgggttcgcattctacattttgtttggttgaaaccaaagtgagcttgtttttgtgacagtagatgggagaagtataatggcattgtgtgatggatggttgttgatgagggcagggaggacgaaaatgaggggaaggaaaggctggagaatgtctgttcctctgtagatgtgtgttctgtacattgcatctcttggattctcattgatatgttaaaatttaggagtacttggtc

SEQ ID NO: 880 - protein, 567 aa, Zea mays
  misc_feature (290)..(477): Pfam Name: CRAL_TRIO Pfam Description: CRAL/TRIO domain
  misc_feature (213)..(277): Pfam Name: CRAL_TRIO_N Pfam Description: CRAL/TRIO, N-terminus
  misc_feature (1)..(567): Ceres Clone ID no. 325220
  misc_feature (1)..(567): Bit score of 719.9 for HMM based on sequences of Figure 24
  misc_feature (1)..(567): Functional Homolog Of SEQ ID NO. 851
  misc_feature (129)..(129): Xaa is any aa, unknown, or other
  misc_feature (130)..(130): Xaa is any aa, unknown, or other
  misc_feature (131)..(131): Xaa is any aa, unknown, or other
MAEETQPEAAAAAAPAAAEVVVTEAAPAEAEVPAAAEAEAEAKDEKKGDEAELTADDAGVGTGSFKEESNLVEDLPDPEKKALDEFKQLIAAALAAGEFNLPPPPPPPKAKETKVEEAKAEEPAKEEPXXXAEEAKAQVAADAPVEEVKTEVPPAEEAKAETLAEEAKPSEPEPQEKTVVVTEEETATKTVEAIEETVVSAPAAIPEEAAAPEAVVEAQATAPEPVLIWGVPLVGDDERTDTVLLKFLRAREFKVKEAMAMLKSAVLWRKRFGITSLLDADLGLTELENVVFYRGTDREGHPVCYNVYGEFQDKDLYEKAFGDDEKRERFLKWRIQLLERGILSKLDFSPSGICSMVQVTDLKNSPPMLGKHRAVTRQAVTLLQDNYPEFIAKKVFINVPWWYLAANKMMSPFLTQRTKSKFVFASPAKSAATLFRYIAPEQVPVQFGGLFKEDDPEFTTSDTVSELTIKPSSKETVEIPVTENSTIVWELRVLSWEVSYGAEFTPDAEGGYTVIVQKTRKVPANEEPIMKGSFKAGEPGKLVLTVNNPASKKKTLLYRSKVKSASE

SEQ ID NO: 881 - protein, 585 aa, Oryza sativa subsp. japonica
  misc_feature (305)..(491): Pfam Name: CRAL_TRIO Pfam Description: CRAL/TRIO domain
  misc_feature (189)..(292): Pfam Name: CRAL_TRIO_N Pfam Description: CRAL/TRIO, N-terminus
  misc_feature (1)..(585): Public GI ID no. 115464035
  misc_feature (1)..(585): Bit score of 698.7 for HMM based on sequences of Figure 24
  misc_feature (1)..(585): Functional Homolog Of SEQ ID NO. 851
MAEEAKQETPAAAEVVVVEKADEVVAVEKAVEVEAEEKKLAEQEEEEEKKAEEAEEAAGGDEAAVIEGTGSFKEESNLVSELPDPERTALAQLKELVAAALAAGEFDLPPPPPPPPAKAEEPAKEEEPKAAEAPAAEEPKAEAEAEAEAAATEEPKTEEPKTEEPAKEEEPKAAAAAAAEEPKAEAAAEEAKPAEPETEEKTVVVTEDEGTSKTVEAIEETVVVAAPAAAAEAEAAAPKEELIWGVPLTGDDERTDTVLLKFLRAREFKVKEAMAMLKAAVLWRKRFGIDAVLAADLGLPELENVVFYRGADREGHPVCYNVYGEFQDKDLYEKAFGDEEKRERFLKWRIQLLERGILDQLDFSPSGICSMVQVTDLKNSPPMLGKHRTVTRQALALLQDNYPEFIAKKIFINVPWWYIAANKMVSPFLTQRTKSKIIFCTAAKSAETLFRYIAPEQVPVQFGGLYKEDDTEFSTSDAVTELPIKPSSKETVEIPATENSTVVWELRVLGWEVSYGAEFTPDAEGGYTVIVQKTRKVPANEEPIMKGSFKVGEPGKIVLTVDNAASKKKKQLLYRFKVKSSSESA

SEQ ID NO: 882 - protein, 493 aa, Vitis vinifera
  misc_feature (214)..(399): Pfam Name: CRAL_TRIO Pfam Description: CRAL/TRIO domain
  misc_feature (131)..(202): Pfam Name: CRAL_TRIO_N Pfam Description: CRAL/TRIO, N-terminus
  misc_feature (1)..(493): Public GI ID no. 225444143
  misc_feature (1)..(493): Bit score of 584.2 for HMM based on sequences of Figure 24
  misc_feature (1)..(493): Functional Homolog Of SEQ ID NO. 851
MTVESVEAVEVKAEDTQMTEVSVSLPEEEKAVEKVNEAKPKTVEKSSSYREESNFLSDLKDNENKALIELRSKLEEAILRNTLFKKEELKKETASEPKEEQPAAAEEKEKEPEATDGAAPEEAEPKTEGEDKQSSSEVEKPEEVVDRDITLWGVPLLPSKCAEGNDVILLKFLRAREFKVNEAFEMLKKTLEWRKEFKTDSILEEELGQDISSVAYMNGVDREGHPICYNIYGVLENQELYQKTFGTEEKRNQFLRWRIQLMEKGIQKLDFKPGGVTSLLQINDLSNSPGPSKKEIRIATKQAVGLLQDNYPEFVARNIFINVPFWYYALNALLSPFLTQRTKSKFVFVRPSKVTETLLKYICVEEIPVQYGGLKREKDTEFSIEDGGVTELVVKAGSTETIEIPVPEVGTTLVWDLTVLGWEVNYKEEFVPADEGSYTIIIQKGKKMGSQEEPVRNSFRNNEPGKVVLTIENSVSKKKRIFYRYKTKNCSSF

SEQ ID NO: 883 - DNA, 2052 bp, Arabidopsis thaliana
  misc_feature (1)..(2052): Ceres Annot ID no. 544140
  misc_feature (1)..(2052): Encodes the peptide sequence at SEQ ID NO. 884
atggctcaagaagagatacagaaacctactgcctctgttccagtggttaaggaggaaactcctgccccggttaaggaggttgaggtgccggttactacggagaaagctgtggctgcgcctgctccggaagctacggaggagaaagttgtgtctgaggtggcggtgcctgaaacagaggtgacggcggtgaaagaggaggaggttgcgacgggaaaggagatcttgcaatcggagtcgtttaaggaggaaggctatttggcttctgaattacaggaagctgagaagaatgctttggctgagttaaaggagttggttagggaggctttgaacaagcgtgaattcaccgcgccaccgccaccaccagctccggtaaaggaagagaaagttgaggagaagaaaacagaggaaacagaggaaaagaaggaagaagttaaaacagaggaaaaatctcttgaggctgaaaccaaagaagaggagaaatctgctgctccggccaccgtagagaccaagaaagaagagatcttggccgctccggctccgatcgtcgcagagaccaagaaggaagagacaccagttgctcctgctccggtagagactaaaccggctgctccggtcgttgcagagacaaagaaggaagaaatattaccagctgctccggtcaccacagagaccaaggtggaagagaaagtcgttccagtagaaaccacaccggctgctccagtcaccacagagaccaaggaagaagagaaagccgctccggtcaccacagagaccaaggaggaagagaaagcagctccgggagagaccaagaaagaagagaaagcaaccgcctctactcaggtcaagagggcctcaaaatttattaaagatatatttgtctcagtcaccactagcgagaagaagaaggaagaagagaaaccagcagtagtaacaatcgagaaggctttcgcagctgatcaagaagaagaaacaaaaaccgttgaagcagtcgaagaatcaatcgtctccatcactcttccagagacagctgcatacgtagagccagaagaagtctcaatctggggaatcccacttctagaggacgaaagatccgacgtgatcctcctcaaattcctccgtgcacgtgacttcaaggtcaaagaagccttcacgatgctgaaaaacaccgtccaatggcgcaaagagaacaagatcgacgacctagtctcagaagatcttgaaggaagcgagtttgagaagttggtgttcactcacggtgtcgacaaacaaggacatgtcgtgatctatagctcgtacggtgagtttcagaacaaggagattttctcagataaagagaagcttagcaagtttctcaaatggaggattcagttccaagagaagtgtgtgaggtctcttgactttagccctgaggctaagtcatcgttcgtgttcgttagtgacttcaggaacgctcctggacttggtcagagagcattgtggcagttcattaaacgcgccgttaagcaattcgaagataactatccagagtttgtcgctaaagagctgttcattaatgtcccatggtggtacattccttactacaaaacattcggaagtatcattacatcgccaaggacaaggagcaagatggtcctttctggtccatccaaatccgctgagaccattttcaaatacgtagctcctgaagtagtcccggttaagtatggtggactcagcaaagatagtccattcaccgttgaagatggagtcaccgaggccgtagttaaatcgacatctaaatataccattgatttgcctgctacagagggttccacgctctcatgggagcttagggttttgggtgcggacgtgagctacggagctcaatttgagccaagcaatgaggcaagctacaccgtgattgtctctaagaaccggaaggtcggtttaactgatgaaccggtgataaccgattctttcaaggcaagtgaggcgggaaaggtcgtgatcacgattgacaaccaaacctttaagaagaagaaggtgctctacaggtccaaaacccaagcataa

SEQ ID NO: 884 - protein, 683 aa, Arabidopsis thaliana
  misc_feature (336)..(398): Pfam Name: CRAL_TRIO_N Pfam Description: CRAL/TRIO, N-terminus
  misc_feature (414)..(593): Pfam Name: CRAL_TRIO Pfam Description: CRAL/TRIO domain
  misc_feature (1)..(683): Ceres Annot ID no. 544140
  misc_feature (1)..(683): Bit score of 603.3 for HMM based on sequences of Figure 24
  misc_feature (1)..(683): Functional Homolog Of SEQ ID NO. 851
MAQEEIQKPTASVPVVKEETPAPVKEVEVPVTTEKAVAAPAPEATEEKVVSEVAVPETEVTAVKEEEVATGKEILQSESFKEEGYLASELQEAEKNALAELKELVREALNKREFTAPPPPPAPVKEEKVEEKKTEETEEKKEEVKTEEKSLEAETKEEEKSAAPATVETKKEEILAAPAPIVAETKKEETPVAPAPVETKPAAPVVAETKKEEILPAAPVTTETKVEEKVVPVETTPAAPVTTETKEEEKAAPVTTETKEEEKAAPGETKKEEKATASTQVKRASKFIKDIFVSVTTSEKKKEEEKPAVVTIEKAFAADQEEETKTVEAVEESIVSITLPETAAYVEPEEVSIWGIPLLEDERSDVILLKFLRARDFKVKEAFTMLKNTVQWRKENKIDDLVSEDLEGSEFEKLVFTHGVDKQGHVVIYSSYGEFQNKEIFSDKEKLSKFLKWRIQFQEKCVRSLDFSPEAKSSFVFVSDFRNAPGLGQRALWQFIKRAVKQFEDNYPEFVAKELFINVPWWYIPYYKTFGSIITSPRTRSKMVLSGPSKSAETIFKYVAPEVVPVKYGGLSKDSPFTVEDGVTEAVVKSTSKYTIDLPATEGSTLSWELRVLGADVSYGAQFEPSNEASYTVIVSKNRKVGLTDEPVITDSFKASEAGKVVITIDNQTFKKKKVLYRSKTQA

SEQ ID NO: 885 - protein, 595 aa, Oryza sativa subsp. japonica
  misc_feature (316)..(503): Pfam Name: CRAL_TRIO Pfam Description: CRAL/TRIO domain
  misc_feature (253)..(303): Pfam Name: CRAL_TRIO_N Pfam Description: CRAL/TRIO, N-terminus
  misc_feature (1)..(595): Public GI ID no. 125572823
  misc_feature (1)..(595): Bit score of 697.6 for HMM based on sequences of Figure 24
  misc_feature (1)..(595): Functional Homolog Of SEQ ID NO. 851
MAEEPQPEAAPAAVAATTEVAVAEKAPVEAEKEKKVEEETPAVEAEAKEEKKDEAAAAAAAGGDEAGAIEGTGSFKEESNLVADLPDPEKKALDEFKQLIAAALAACEFNLPPPPPPPKAKVEAAVEETKAEETKAEEEPKAEEPAKEEEPKAEVAAAAAAPPEAGTEEPKAEASSEEAKTEEPKAEAAADEPAKEESKAEAAPAEEAKPAEPEPGGEDRRGHRGRGGHQDGGSDRGNRRARCCCACCRRHGGSRGAGTGGDDERTDTVLLKFLRAREFKVKEAMAMLRSAVLWRKRFGIESLLDADLALPELDSVVFYRGADREGHPVCYNVYGEFQDKDLYEKAFGDEEKRERFLKWRIQLLERGILSQLDFSPSGICSMVQVTDLKNSPPMLGKHRAVTRQAVALLQDNYPEFIAKKVFINVPWWYLAANKMMSPFLTQRTKSKFIFASPAKSAETLFRYIAPEQVPVQFGGLFKEDDPEFTTSDAVTELTIKPSSKETVEIPVTENSTIGWELRVLGWEVSYGAEFTPDAEGGYTVIVQKTRKVPANEEPIMKGSFKVGEPGKIVLTINNPASKKKKLLYRSKVKSTSESV

SEQ ID NO: 886 - protein, 493 aa, Vitis vinifera
  misc_feature (214)..(399): Pfam Name: CRAL_TRIO Pfam Description: CRAL/TRIO domain
  misc_feature (131)..(202): Pfam Name: CRAL_TRIO_N Pfam Description: CRAL/TRIO, N-terminus
  misc_feature (1)..(493): Public GI ID no. 147864826
  misc_feature (1)..(493): Bit score of 576.2 for HMM based on sequences of Figure 24
  misc_feature (1)..(493): Functional Homolog Of SEQ ID NO. 851
  misc_feature (106)..(106): Xaa is any aa, unknown, or other
  misc_feature (369)..(369): Xaa is any aa, unknown, or other
MTVESVEAVEVKAEDTQMTEVSVSLPEEEKAVEKVNEAKPKTVEKSSSYREESNFLSDLKDNENKALIELRSKLEEAILRNTLFKKEELKKETASESKEEQPAAAXKKEKEPEATDGAAPEEAEPKTEGEDKQSSSEVEKPEEVVDRDITLWGVPLLPSKCAEGNDVILLKFLRAREFKVNEAFEMLKKTLEWRKEFKTDSILEEELGQDISSVAYMNGVDREGHPICYNIYGVLENQELYQKTFGTEEKRNQFLRWRIQLMEKGIQKLDFKPGGVTSLLQINDLSNSPGPSKKEIRIATKQAVGLLQDNYPEFVARNIFINVPFWYYALNALLSPFLTQRTKSKFVFVRPSKVTETLLKYICVEEIPXQYGGLKREKDTEFSIEDGGVTELVVKAGSTETIEIPVPEVGTTLVWDLTVLGWEVNYKEEFVPADEGSYTIIIQKGKKMGSQEEPVRNSFLNNEPGKVVLTIENSVSKKKRIFYRYKTKNCSSF

SEQ ID NO: 887 - DNA, 1698 bp, Sorghum bicolor
  misc_feature (1)..(1698): Ceres Annot ID no. 8692801
  misc_feature (1)..(1698): Encodes the peptide sequence at SEQ ID NO. 888
atgacagaggagctgcagccagagtccgccggcgccgagcttgtcgtgaccgaggcggcgctggtagaggcggaggtgcctgcggcggcgaaagccgaagccgaggccgaggcggagaagacagctgatgaggccgcagtcaccgccgatgactcgggggaggagaccggatcgttcaaggaggagagcaacctggtggacgacctgcccgacccgcagaagcagcaggcgctcgacgagttcaagcagctgatcgctgccgccctcgccgccggtgagttcaacctgcctcccccgctgccgccgccgaaggccaaggaggaacctaacgccgaggagacgaagacggaggaacccaagaacgaggagccagccaaagaagagcccaaggccgaggccgaggctgcggatgccccggttgatgaggtcaagacggaggtgccgccggccgaggaggccaaggctgagacggtggccgaggaagccaagccttccgagcccgaggcgcaggagaagaccgtcgtgttcgctgtggaggagatcgaggaaaccgtcgtgtccgccgccgccgccgccacctcggaggaggcagcggcgccggaggtggtggccgagactcaggcggccgcgcctgagcccgtgctgatctggggcgtgccgctggtgggcgacgatgagcgcacggacacggttctgctcaagttcctgcgagcgcgggagttcaaggtgaaggaggccatggcgatgctcaagtccacagtgctgtggcgcgagcgctttggtatcacctcgctcctcgacgacgacctcggcctgccggagctggagaacgtggtgttctaccgcggcacggaccgcgagggccaccctgtctgctacaacgtctacggcgaattccaggacaaggatctctacgagaggaccttcggcgacgatgagaagcgggagcgcttcctcaagtggcgcatccagctgctggagcgcggcatcctgtcgaagctggatttctcgcccggcggcatctgctccatggttcaggttaccgacctcaagaactcgccgcccatgctccgcaagcaccggtccgtcacccgccaggccgtcgcgctgctccaagacaactatcccgagttcattgccaagaaggtgttcatcaatgtgccgtggtggtatttcgctgccaacaagatgatgagcccgttcctcacacagcgcaccaagagcaagtttgtctttgctaccccagccaagtcagcagagactctattaagatacatcgcaccggaacaagttcctgtccaatttggaggcctcttcaaggagaacgatcctgagttcaccacctccgacactgtcactgagctcactgtcgaaccctcatcgaaagaaaccattgagatccctgtcaccgagaactccacaattacatgggaactccaggtgctcggttgggaggtgagctatggcgccgagttcacccctgacactgtgggtgggtatgctgtcattgtccaaaaaacaaggaaggcaggcgagcccgggaaactcgtgctaactgtgaataaccctgcatccaagaagaagaagctcctttacagatcaaagacgaagcgcgctccaccgcgcccgcccctgctatgctctcctgctatacgctctactgggttagcttctttttacttctggtgccctgaataa

SEQ ID NO: 888 - protein, 565 aa, Sorghum bicolor
  misc_feature (278)..(464): Pfam Name: CRAL_TRIO Pfam Description: CRAL/TRIO domain
  misc_feature (197)..(265): Pfam Name: CRAL_TRIO_N Pfam Description: CRAL/TRIO, N-terminus
  misc_feature (1)..(565): Ceres Annot ID no. 8692801
  misc_feature (1)..(565): Bit score of 637.5 for HMM based on sequences of Figure 24
  misc_feature (1)..(565): Functional Homolog Of SEQ ID NO. 851
MTEELQPESAGAELVVTEAALVEAEVPAAAKAEAEAEAEKTADEAAVTADDSGEETGSFKEESNLVDDLPDPQKQQALDEFKQLIAAALAAGEFNLPPPLPPPKAKEEPNAEETKTEEPKNEEPAKEEPKAEAEAADAPVDEVKTEVPPAEEAKAETVAEEAKPSEPEAQEKTVVFAVEEIEETVVSAAAAATSEEAAAPEVVAETQAAAPEPVLIWGVPLVGDDERTDTVLLKFLRAREFKVKEAMAMLKSTVLWRERFGITSLLDDDLGLPELENVVFYRGTDREGHPVCYNVYGEFQDKDLYERTFGDDEKRERFLKWRIQLLERGILSKLDFSPGGICSMVQVTDLKNSPPMLRKHRSVTRQAVALLQDNYPEFIAKKVFINVPWWYFAANKMMSPFLTQRTKSKFVFATPAKSAETLLRYIAPEQVPVQFGGLFKENDPEFTTSDTVTELTVEPSSKETIEIPVTENSTITWELQVLGWEVSYGAEFTPDTVGGYAVIVQKTRKAGEPGKLVLTVNNPASKKKKLLYRSKTKRAPPRPPLLCSPAIRSTGLASFYFWCPE

SEQ ID NO: 889 - DNA, 2049 bp, Arabidopsis thaliana
  misc_feature (1)..(2049): Ceres Annot ID no. 869188
  misc_feature (1)..(2049): Encodes the peptide sequence at SEQ ID NO. 890
cctctgttttcttcttttaaaagcctcctcttcttcctcttctctctcctcacaactcaaaactctctccatctctcttctaaaatcagacaagaaagatggctcaagaggaagtacagaaatcggctgatgtcgctgctgctccggtggtgaaggagaaacctattaccgataaggaggttactattcctacccctgtggcagagaaagaggaagttgctgctcctgtctctgatgagaaggcggttccagagaaggaggtgactccggagaaggaagccccagcggcggaagcggagaaatctgtttcggtgaaggaggaagagacggttgttgtagctgagaaggttgttgttttaactgctgaggaagttcagaagaaggcacttgaggagtttaaggagcttgtaagggaggctttgaacaaacgtgaattcactgctccggtgacgccggttaaggaagagaaaacagaggagaagaaaacagaggaggaaactaaagaggaagagaaaacagaggagaagaaagaagagacaacgactgaggttaaggttgaagaagagaaaccggcggttccagcggcggaggaggagaaatcatcagaggctgctccggttgagaccaaatctgaggagaaacctgaagagaaagcagaggtaacaaccgagaaagcatccagtgccgaagaagatggaaccaagaccgtggaagcaatcgaagaatctatcgtctctgtttcaccacctgaatccgccgtagcacctgtcgtggtagagactgtcgccgttgctgaggcagagccagtggagccggaagaagtctcgatctggggagttccactactccaagacgagagatctgacgtgatcctcacgaaattcctccgtgcaagagactttaaggtcaaagaagctttaaccatgcttaaaaacaccgtccagtggcgtaaagaaaacaaaatcgacgaactcgttgaatccggagaagaagtgagtgagttcgagaagatggtgtttgctcacggtgttgacaaagaaggacacgtcgtgatctacagttcttacggtgagtttcagaacaaggagcttttctccgacaaggagaagcttaacaagttcctcagctggaggattcagctacaagagaagtgtgtgagagctattgatttcagcaaccctgaagcgaagtcttcgtttgtgttcgtcagcgacttcaggaacgctccaggacttggtaaaagagccttgtggcaattcatcagacgcgctgttaaacaattcgaggacaattatcctgaattcgccgctaaagagctattcatcaatgtcccatggtggtacattccatactacaaaacattcggatctatcatcacatccccaaggactaggagcaagatggtccttgctggtccatccaaatctgccgatactattttcaaatacatagctcctgaacaagttcccgttaaatacggtggacttagcaaagatactcctttgaccgaagaaaccataacggaagccatcgttaaaccggcagcaaactacactattgaattgcctgcttctgaggcttgcacgctttcatgggagcttagggttttgggtgctgatgtgagctacggagctcagtttgagccaaccaccgaaggaagctatgctgtgatcgtctctaagacacggaagattggatcaaccgatgaaccggtgataaccgattcttttaaggtgggtgaaccgggaaagattgtgatcacaatcgacaaccagacttccaagaagaagaaagtgctctacaggttcaaaactcaataaaaggtctgatctttgaaatccaaatccaaggaagaagcaaaaaaaatgttattttgttatttgggggaaacaaattttaattaattaatttagtttgttatttattatgtaattttgaaatctcaagatgtggttgtgtttttgctttgttttggtattgggggttgttttcgtgtgtggagaatatgtgattaaaattcaaaagaaagtaaagaacactttgtttcat

SEQ ID NO: 890 - protein, 573 aa, Arabidopsis thaliana
  misc_feature (305)..(489): Pfam Name: CRAL_TRIO Pfam Description: CRAL/TRIO domain
  misc_feature (227)..(289): Pfam Name: CRAL_TRIO_N Pfam Description: CRAL/TRIO, N-terminus
  misc_feature (1)..(573): Ceres Annot ID no. 869188
  misc_feature (1)..(573): Bit score of 596.5 for HMM based on sequences of Figure 24
  misc_feature (1)..(573): Functional Homolog Of SEQ ID NO. 851
MAQEEVQKSADVAAAPVVKEKPITDKEVTIPTPVAEKEEVAAPVSDEKAVPEKEVTPEKEAPAAEAEKSVSVKEEETVVVAEKVVVLTAEEVQKKALEEFKELVREALNKREFTAPVTPVKEEKTEEKKTEEETKEEEKTEEKKEETTTEVKVEEEKPAVPAAEEEKSSEAAPVETKSEEKPEEKAEVTTEKASSAEEDGTKTVEAIEESIVSVSPPESAVAPVVVETVAVAEAEPVEPEEVSIWGVPLLQDERSDVILTKFLRARDFKVKEALTMLKNTVQWRKENKIDELVESGEEVSEFEKMVFAHGVDKEGHVVIYSSYGEFQNKELFSDKEKLNKFLSWRIQLQEKCVRAIDFSNPEAKSSFVFVSDFRNAPGLGKRALWQFIRRAVKQFEDNYPEFAAKELFINVPWWYIPYYKTFGSIITSPRTRSKMVLAGPSKSADTIFKYIAPEQVPVKYGGLSKDTPLTEETITEAIVKPAANYTIELPASEACTLSWELRVLGADVSYGAQFEPTTEGSYAVIVSKTRKIGSTDEPVITDSFKVGEPGKIVITIDNQTSKKKKVLYRFKTQ

SEQ ID NO: 891 - DNA, 1416 bp, Solanum lycopersicum
  misc_feature (1)..(1416): Ceres Annot ID no. 8456541
  misc_feature (1)..(1416): Encodes the peptide sequence at SEQ ID NO. 892
atgactgttgaggtgcaatgtgaggcaactcaagtggctgaagtagttgttccacaagaggaattagtggctgctaacaaggttgtggaggaggttgaggtgaatgagaaggtaaaagaagatgaagaagaggaatccaagcctaatacaattgagaaaagctcttcttatagagaagagagcaacttcctctctgatctcaaagagaatgagaagaaggcattgaatgagttgaaatctatagttgaggaggccattgttgggaacactctattcaaaaaagaagagaccaacaagtctctagaggaagagggaaagaatgaggaaaatcccgatgcgaatatagaggagaaggagggtgatttggatgttgttgaagtggatagagagatttctatttggggtgtacccattttgcctagcaaaggggatgagaaaaccaatgtggttctattgaaattcttgagagcaagggattacaaagtgaatgaatctttcgaaatgctcaagaaaacactccagtggaggaaggattttaatatccaatccatcttggaggaagatttgggctcagatcttgcaccagctgcttacatgagtggggttgataaccaaggacaccctatttgttacaacattttcggcgttttggaagatgaagagatttataacaaaacgttcgggacagaggagaaacggaatcagttcttgaggtggagagttcagttaatggagaagggcattcagcagcttgatttcaaagctggaggtgttagttcactgcttcagataaatgatctgaagaactcgcctggaccgtctaagaaagaagtcagggttgcaaccaaacaagccgttgatcttcttcaggataactatcctgaatttgttgccaaaaatatattcatcaatgttccattttggtattacgccgtgcactctctgctgtcgcctttcctaacacaaagaaccaaaagcaaattcgtatttgctcgccctgctaaggtcactgagaccttgctcaagtacattccaatccatgaaatccctattcaatatggtggactcaagagggagaatgactttgagttttcagcctccgactgtgaagcttcggagattctccttaaagctggatcaattgaaactattgaaatacctgcagtagatgtggaaagtacatttatctgggatgttacgattgtgggcggagaagtgagctataaggaggaatttgtgccagaggatgagacttcttacactataatcattcagaaggacaagaaggtgagctcgacaattcgcaacacgttcaagaacactgaagcaggaaaggttgtgctgacaatcaagaacacttctagcaagaagaagaaggcgttttatcgacacaagatcaccaaatcaacaatttga

SEQ ID NO: 892 - protein, 471 aa, Solanum lycopersicum
  misc_feature (196)..(381): Pfam Name: CRAL_TRIO Pfam Description: CRAL/TRIO domain
  misc_feature (108)..(184): Pfam Name: CRAL_TRIO_N Pfam Description: CRAL/TRIO, N-terminus
  misc_feature (1)..(471): Ceres Annot ID no. 8456541
  misc_feature (1)..(471): Bit score of 553.9 for HMM based on sequences of Figure 24
  misc_feature (1)..(471): Functional Homolog Of SEQ ID NO. 851
MTVEVQCEATQVAEVVVPQEELVAANKVVEEVEVNEKVKEDEEEESKPNTIEKSSSYREESNFLSDLKENEKKALNELKSIVEEAIVGNTLFKKEETNKSLEEEGKNEENPDANIEEKEGDLDVVEVDREISIWGVPILPSKGDEKTNVVLLKFLRARDYKVNESFEMLKKTLQWRKDFNIQSILEEDLGSDLAPAAYMSGVDNQGHPICYNIFGVLEDEEIYNKTFGTEEKRNQFLRWRVQLMEKGIQQLDFKAGGVSSLLQINDLKNSPGPSKKEVRVATKQAVDLLQDNYPEFVAKNIFINVPFWYYAVHSLLSPFLTQRTKSKFVFARPAKVTETLLKYIPIHEIPIQYGGLKRENDFEFSASDCEASEILLKAGSIETIEIPAVDVESTFIWDVTIVGGEVSYKEEFVPEDETSYTIIIQKDKKVSSTIRNTFKNTEAGKVVLTIKNTSSKKKKAFYRHKITKSTI

SEQ ID NO: 893 - protein, 564 aa, Vitis vinifera
  misc_feature (276)..(457): Pfam Name: CRAL_TRIO Pfam Description: CRAL/TRIO domain
  misc_feature (172)..(264): Pfam Name: CRAL_TRIO_N Pfam Description: CRAL/TRIO, N-terminus
  misc_feature (1)..(564): Public GI ID no. 147801354
  misc_feature (1)..(564): Bit score of 542.2 for HMM based on sequences of Figure 24
  misc_feature (1)..(564): Functional Homolog Of SEQ ID NO. 851
  misc_feature (550)..(550): Xaa is any aa, unknown, or other
MAEEAIPKEIQVAKDEVPQKQEPSKKDVEVEGAATGDVKDAEKDGDSKKFNDPKPGLAALIDDEKENEGVSKDSVVDSLVAERGASFQEESNLPSDLKDLEKKALLDLRSKIEDAIRSNTLFEEEKKQAEEAEKARSPEKEGEEKEKSVVNEGQGEEKKPEELAVEEGKEEEKPENLGFNGEKNETKQKEEEQEKINIEIGKKAIEVDEEIKLWGVPLLPSKGDKGTDVILLKFLRAREFKVQEAFEMLRNTLKWIKDNNIDIILEEEFPPELSSVAYMQGMDRKGHPICYNIFGTFLNDEIYNKTFGTEELRHKFLRWRFQLMERGIKKLDFGSGGATSMLQVNDLRNSPGPTKKELRQAMKQAVGLLQDNYPEFVSRNIFINVPFWSYAFYAVVSPFFTQRSKNKFDFARPARVTETLLKYIDAQQIPVGYGGFHRENDPDFSIEDGVSEVIIKGGSSGAIAIPAPEVGTKFTWEITVLGWDVNYREEFVPKDEGSYTMIVQKERKVGWEEGAIRNSFTNKEAGMLVLTIDNATFKKKRVLYRYKPIXTSTTTTTPSSSTTT

SEQ ID NO: 894 - DNA, 1743 bp, Populus balsamifera subsp. trichocarpa
  misc_feature (1)..(1743): Ceres Annot ID no. 1442146
  misc_feature (1)..(1743): Encodes the peptide sequence at SEQ ID NO. 895
atggctttaccgaataaatccaagcttttgttgcaatgtggacccaaaaggattctttcatgccaaaatattgctggcctccagggtagcaaaactctagggaaagagaatccttcaacggctcccatgcgcttggtgttagaaggtgatttgaaagttgaaaccatgactgttgaggttaaggttgaagaaactaaggtggctgaggttgttgtggttcctcaagaagaacccgagaaggtggttgttgttgaagagagaaagaatgatgttaatggagatgtggaggtgaaggaagtggatgctgctgataatgatgggcctaaaacagttcaaaagagttcttcttacaaggaagaaagcaattttctttctgatcttaaggagtttgagaggaaggccttgagtgagctgaaattgaaactggaagaggcaattcttggaaacagtttgttcaagaaagaaggggcaaagaagaaggagaaggaggtggagaaggagaaggaggtggagaagccagtggaagaagagaaagagaaggaaaaagaaaccaaggaaggagaagagagtggggaacaagaaggtgaaaagaaagaagatgtgaaaccagaaggagataatgtgaaggaaaaaacagtcctggaatgtgaagaagagaaaagtgaggttgttattgaagaaaaaagtgaagaaattgacagggatatttccatttggggagtccctcttttccctagcaagggatcagaaggaactgatgtggtcttattgaagttcttaagggctagagatttcaaagttaacgatgcactggagatgctcaagaagacccttcaatggaggaaagaatccagcattgattcactcttggatgaagaaataggagtggatctaagctcggcattctacatgaatggcatcgatcgcgaaggccaccctgtgtgttacaacatctatggggtgtttgagaatgaggagctttatgcaaaggcatttggagatgaagagaagcgcaagcagttcttgagatggagatttcaattaatggagaaaggtattcaaaagcttgatttgaggcctggtggtattgcttctttgcttcaaatcagtgatctcaagaattctccttccccatcaaagaaagagctcaggactgccatgagcaaagctgtcacccttttgcaggacaattatccagaatttgttgcaaaaaatatattcataaatgttccattttggtattatgctttcaacgccctgctatctcctttcttggctcaaagaaccaagagcaaatttgtcgttgttcgccctgccaagaccaccgagacattgctcaagtatgttcaggccgaggaaatccctgtccaatatggtggcttcaagagggagaatgatttcgagttctccagcgaagatggtgaagtttcagaacttgtaatcaaagctggatcaactgaaaccattgagatccctgcagcagaggttggagccacattgctttgggacctgacagttgtgggatgggaagtgaattacaaggaggaatttgtgccaagtgatgaagcttcctacaccatcatcatccaaaagggcaagaaaatgagctcaaatgaagagccaactcgcaacactttcaggaacaatgaacctggaaaggtagttctgaccattcagaattggtcaagcaagaagaagagggtcctataccgatacaagaccaagaagaatgcttcctattga

SEQ ID NO: 895 - protein, 525 aa, Populus balsamifera subsp. trichocarpa
  misc_feature (246)..(430): Pfam Name: CRAL_TRIO Pfam Description: CRAL/TRIO domain
  misc_feature (155)..(234): Pfam Name: CRAL_TRIO_N Pfam Description: CRAL/TRIO, N-terminus
  misc_feature (1)..(525): Ceres Annot ID no. 1442146
  misc_feature (1)..(525): Bit score of 558.2 for HMM based on sequences of Figure 24
  misc_feature (1)..(525): Functional Homolog Of SEQ ID NO. 851
MTVEVKVEETKVAEVVVVPQEEPEKVVVVEERKNDVNGDVEVKEVDAADNDGPKTVQKSSSYKEESNFLSDLKEFERKALSELKLKLEEAILGNSLFKKEGAKKKEKEVEKEKEVEKPVEEEKEKEKETKEGEESGEQEGEKKEDVKPEGDNVKEKTVLECEEEKSEVVIEEKSEEIDRDISIWGVPLFPSKGSEGTDVVLLKFLRARDFKVNDALEMLKKTLQWRKESSIDSLLDEEIGVDLSSAFYMNGIDREGHPVCYNIYGVFENEELYAKAFGDEEKRKQFLRWRFQLMEKGIQKLDLRPGGIASLLQISDLKNSPSPSKKELRTAMSKAVTLLQDNYPEFVAKNIFINVPFWYYAFNALLSPFLAQRTKSKFVVVRPAKTTETLLKYVQAEEIPVQYGGFKRENDFEFSSEDGEVSELVIKAGSTETIEIPAAEVGATLLWDLTVVGWEVNYKEEFVPSDEASYTIIIQKGKKMSSNEEPTRNTFRNNEPGKVVLTIQNWSSKKKRVLYRYKTKKNASY

SEQ ID NO: 896 - DNA, 1584 bp, Gossypium hirsutum
  misc_feature (1)..(1584): Ceres Clone ID no. 1838310
  misc_feature (1)..(1584): Encodes the peptide sequence at SEQ ID NO. 897
attcacatttactagcatatcttaacaaatccctttgcagcatttttacacagattccatctgggtctttctcattcaatggagaatccacactcacccatttctatcccagaggcttctcgtaagccttacaagaaaagctttgttactactctaatggaagccgctagtcttcgctctccttttaaggaagatacctattttacctcccatttgaaggcttccgagaagaaggcgttgcaagagctcaaggacaagctcatggcttcttatggcccggacggtgaatgcaccatgtgggggatacctttacttgctgaagacgaaaaagctgatgtcgttttgttgaagttcttgcgagctagggacttcagggtgttggattccttccgcatgttggaaaaatgtcttgcttggaggaaagagtttaaggccgacagtgttggggaagaagacttggggttcaaggagcttgaaggagttgttgcttatatgcatggttacgacagggaaggtcaccctgtttgctacaatgcttatggtgtttttaaagataaggatatgtacgagagaatctttggtgatgaagagaaactgaacaagtttctgagatggagaattcaagtcctggaaagagggatcagtctcctacatttcaagcctggtgggattaactctattattcaagtcactgatctaaaagacatgcctaagagagaacttagggtagcttcaaatcagatcctttccctctttcaagataattaccctgaaatggtagctcgaaagattttcatcaatgtcccatggtacttcagtgtgctctactcaatgttcggtccatttttaactcagcgaactaagagcaagttcgtcatctccagagaagggcatgctgctgaaacactgtacaaatttataaggcctgaagatgttccagtacagtatggtggactgagtcgacccaatgacttacagaaaccagcctcggagttcactgttaaaggaggagagaaagtgaacattcaaattgaagggattgaggctggagcaaccataacatgggacctggtagtaggagggtgggacttagaatatagtgcagaattcgtgcccaacaaagaagacagctacaccattgcagtggagaagccaaggaaactaagtccaacagaggaagccattcgcaactcctatacatcaaaggaatcaggcaaactagtgctgtcagtggataatacaagttccaggagaaaaaaggttgctgcttatcgctatactgttcgcaaatcaaccttggagtagcttgagttaggtgttacaataaacgagtgatcatgtttaattttgaaaagggtattattaactaatggtttgtgaactttgatttgttagtagtctgtttgagtattagtaaattatttggtaatgggtgatgtataaatatggagatggtggtgtgagcattgtatgacattaatatatagttaaaagatgcagcagtagtttttactttttaactggtggtgtttcatcagccatgtcaggaagaagagatgaatgtgcaaacagattttggttgcg

SEQ ID NO: 897 - protein, 408 aa, Gossypium hirsutum
  misc_feature (136)..(322): Pfam Name: CRAL_TRIO Pfam Description: CRAL/TRIO domain
  misc_feature (41)..(122): Pfam Name: CRAL_TRIO_N Pfam Description: CRAL/TRIO, N-terminus
  misc_feature (1)..(408): Ceres Clone ID no. 1838310
  misc_feature (1)..(408): Bit score of 420.6 for HMM based on sequences of Figure 24
  misc_feature (1)..(408): Functional Homolog Of SEQ ID NO. 851
MENPHSPISIPEASRKPYKKSFVTTLMEAASLRSPFKEDTYFTSHLKASEKKALQELKDKLMASYGPDGECTMWGIPLLAEDEKADVVLLKFLRARDFRVLDSFRMLEKCLAWRKEFKADSVGEEDLGFKELEGVVAYMHGYDREGHPVCYNAYGVFKDKDMYERIFGDEEKLNKFLRWRIQVLERGISLLHFKPGGINSIIQVTDLKDMPKRELRVASNQILSLFQDNYPEMVARKIFINVPWYFSVLYSMFGPFLTQRTKSKFVISREGHAAETLYKFIRPEDVPVQYGGLSRPNDLQKPASEFTVKGGEKVNIQIEGIEAGATITWDLVVGGWDLEYSAEFVPNKEDSYTIAVEKPRKLSPTEEAIRNSYTSKESGKLVLSVDNTSSRRKKVAAYRYTVRKSTLE

SEQ ID NO: 898 - DNA, 1893 bp, Arabidopsis thaliana
  misc_feature (1)..(1893): Ceres Annot ID no. 866220
  misc_feature (1)..(1893): Encodes the peptide sequence at SEQ ID NO. 899
tttattcacaaccccccattaatctctttctctgctgcagcttaaactttaaaaaacactacaagaacaacttcttcaggttctataaagagattccgaagaagaatcttttccagaaacagtgctttaagatgactgctgaagttaaggttgaggagaaacaggtggagtcagaggttgttattgctcctgctgttgttcctgaggagactactgttaaggctgttgtggaagagactaaggttgaagaagatgagagcaagcctgagggtgtggagaagagtgcttccttcaaagaagagagtgatttctttgctgatttgaaagaatctgagaaaaaggcactgagtgatctcaagtctaagcttgaggaagctattgttgacaacactctcttaaagacgaagaagaaggagagctctcctatgaaggagaagaaggaagaggttgtgaaacctgaagctgaggttgagaagaagaaggaagaagcagcagaggagaaggttgaagaagagaagaaatctgaggctgttgttaccgaagaagcaccgaaagctgagactgttgaggctgttgttacagaggagataatccccaaggaagaagtgactactgttgttgagaaggtagaagaagaaaccaaggaagaagagaagaaaaccgaggatgttgttactgaagaagtgaaagctgagactattgaggtggaggatgaagatgagtcggtggataaggatatcgagctttggggagtgccattgcttccaagcaaaggagctgaaagcacggatgttatcctcttgaagttcttgagagcaagagactttaaagtcaacgaagcctttgagatgctgaagaaaaccctcaaatggagaaagcaaaacaagattgattcgatccttggagaggagtttggggaggatcttgccactgcagcttacatgaacggtgtggaccgcgagtcccacccagtttgttacaatgtccacagcgaggagctttaccagacgattgggtcggagaagaacagagagaagttcttgagatggaggtttcagctgatggagaagggaatccagaagcttaatcttaaaccaggaggtgttacttctcttctccagatccacgatctcaaaaacgctcctggagtgtcaagaacagagatttgggtcggaatcaagaaagtaatcgagactttgcaggacaactatccggaattcgtgtccagaaacatattcatcaacgttccattctggttctacgccatgagagctgtcctctcgccattcttaactcaacgaaccaagagcaagtttgttgtggctcgtcccgctaaggtcagagagactcttctcaagtacattccagctgatgagctcccagttcagtacggtgggttcaaaacagtagacgataccgaattctccaacgaaactgtctctgaagttgttgttaagcctggatcatctgaaaccatcgaaatcccagctcctgagactgaaggtacattggtatgggacatagcggttttgggatgggaagtgaattacaaggaagagtttgtgccaacagaagaaggagcttacacggtaatagtccaaaaggtgaagaagatgggagcaaatgaaggaccaatcaggaacagtttcaagaacagtcaggctggtaagattgttcttaccgttgacaatgtctctggcaagaagaagaaagttctgtacaggtacagaaccaagactgaatcctcttcctgaagtggaggatttcatgtagtctctggatatataatattcttttctaaatttaaacgtttggtgttattatttatttttgagtgatatgtaagagaaagagatactcccattatttcattgatattcaatcttttgcttc

SEQ ID NO: 899 - protein, 540 aa, Arabidopsis thaliana
  misc_feature (268)..(451): Pfam Name: CRAL_TRIO Pfam Description: CRAL/TRIO domain
  misc_feature (164)..(253): Pfam Name: CRAL_TRIO_N Pfam Description: CRAL/TRIO, N-terminus
  misc_feature (1)..(540): Ceres Annot ID no. 866220
  misc_feature (1)..(540): Bit score of 477.6 for HMM based on sequences of Figure 24
  misc_feature (1)..(540): Functional Homolog Of SEQ ID NO. 851
MTAEVKVEEKQVESEVVIAPAVVPEETTVKAVVEETKVEEDESKPEGVEKSASFKEESDFFADLKESEKKALSDLKSKLEEAIVDNTLLKTKKKESSPMKEKKEEVVKPEAEVEKKKEEAAEEKVEEEKKSEAVVTEEAPKAETVEAVVTEEIIPKEEVTTVVEKVEEETKEEEKKTEDVVTEEVKAETIEVEDEDESVDKDIELWGVPLLPSKGAESTDVILLKFLRARDFKVNEAFEMLKKTLKWRKQNKIDSILGEEFGEDLATAAYMNGVDRESHPVCYNVHSEELYQTIGSEKNREKFLRWRFQLMEKGIQKLNLKPGGVTSLLQIHDLKNAPGVSRTEIWVGIKKVIETLQDNYPEFVSRNIFINVPFWFYAMRAVLSPFLTQRTKSKFVVARPAKVRETLLKYIPADELPVQYGGFKTVDDTEFSNETVSEVVVKPGSSETIEIPAPETEGTLVWDIAVLGWEVNYKEEFVPTEEGAYTVIVQKVKKMGANEGPIRNSFKNSQAGKIVLTVDNVSGKKKKVLYRYRTKTESSS

SEQ ID NO: 900 - protein, 417 aa, Vitis vinifera
  misc_feature (141)..(331): Pfam Name: CRAL_TRIO Pfam Description: CRAL/TRIO domain
  misc_feature (55)..(127): Pfam Name: CRAL_TRIO_N Pfam Description: CRAL/TRIO, N-terminus
  misc_feature (1)..(417): Public GI ID no. 225439560
  misc_feature (1)..(417): Bit score of 425.1 for HMM based on sequences of Figure 24
  misc_feature (1)..(417): Functional Homolog Of SEQ ID NO. 851
MEASSPISMQQTPQKDQPEASPKPFRKRFVTSLMEAATLRSPSFKEDTYFVSRLKSSEKKALQEFKDKLVASHGSDSMWGIPLLGGDERADVILLKFLRARDFRVADSFNMLEKCLAWRKEFGADDVAEEDLGFKELEGVVAYMHGYDREEHPVCYNAYGVFRDKDMYERIFGDEEKLKKFLRWRVQVLERGIKLLHFKPGGVNSIIQVTDLKDMPKRELRVASNQILSLFQDNYPEMVARKIFINVPWYFSILYSMFSPFLTQRTKSKFVISKEGNVAETLYKFIRPEDVPVQYGGLSRPSDLQNGPPKPASEFTVKGGEKVNIQIEGIEAGATITWDIVVGGWDLEYSAEFVPNAEGSYTIAVEKPRKMAPSEEAVHNSFMSREAGRLVLSVDNTASRRKKVAAYRYVVRKSTVV

SEQ ID NO: 901 - DNA, 1541 bp, Arabidopsis thaliana
  misc_feature (1)..(1541): Ceres Clone ID no. 1209913
  misc_feature (1)..(1541): Encodes the peptide sequence at SEQ ID NO. 902
tgtttcttcaatatctctttctctccaacaaaatcaaaatcaagaaaacaaaaaagaaaaactctcaagaaacaatggatgcttcattgtctccattcgatcaccaaaaaactcaaaacacagagccaaagaaaagcttcattacctcactaatcactctccgttcaaacaacatcaaagaagacacatacttcgtctcagaactcaaacccacggagcaaaaatcacttcaagaactcaaagaaaagctctcagcttcatcctccaaagcttcttcaatgtggggagtctcactcctcggtggagacgacaaagctgacgtaatcctcctcaagttcctcagagcaagagatttcaaagtagcagactctttgagaatgcttgagaagtgtttggagtggagagaagagttcaaagcagagaaattgacagaagaagatctgggttttaaagatttggaaggtaaagttgcttacatgagaggctacgacaaagaaggacacccagtttgttacaatgcttatggtgtgtttaaagagaaagagatgtatgagagagtgtttggtgatgaagagaagcttaacaagtttctgagatggagagttcaggttttggagagaggtgttaaaatgcttcattttaaacctggtggtgttaattccattattcaagttacagatcttaaagatatgcctaagagagagcttagagttgcttctaatcagatcctctctctttttcaagataattaccctgaattggttgctactaagatattcataaacgtgccttggtacttcagtgtgatctactcaatgttcagcccattcctgactcagagaacaaagagcaagtttgtgatgtccaaagaaggcaatgcagcagaaacactctacaagttcattaggccagaagatattccggtgcaatacggtggtcttagccgtcctactgattcgcaaaacggaccgccaaaaccggcgtctgaattctccatcaagggtggtgagaaagttaacattcagattgaaggcattgagggtggagcaaccataacatgggatatagtagttggaggatgggatttagagtacagtgcagagtttgttccaaacgctgaagagagttacgcgatcgttgtcgagaaaccgaagaagatgaaagctacagatgaagctgtttgcaactctttcactacagtagaagctgggaagctcattctctctgttgacaatactctctctcgcaagaagaaagttgctgcttaccgttacactgtccggaaatctactacaaccgtctaatctataaccggtttttcagaagattggttgctttcttactactactttttgtgggtgtgttgaggggttttctttcttgggtttgagtactaggtttgttttgcttactcaacggttcatgttgaaccggaaatatcgataaatttgcgaggaaatcatatgtataaaaactatgatttgtatgacatttgatgtttggccttaatattttaactagagattgaagttttagtctgc

SEQ ID NO: 902 - protein, 409 aa, Arabidopsis thaliana
  misc_feature (132)..(316): Pfam Name: CRAL_TRIO Pfam Description: CRAL/TRIO domain
  misc_feature (42)..(118): Pfam Name: CRAL_TRIO_N Pfam Description: CRAL/TRIO, N-terminus
  misc_feature (1)..(409): Ceres Clone ID no. 1209913
  misc_feature (1)..(409): Bit score of 408.9 for HMM based on sequences of Figure 24
  misc_feature (1)..(409): Functional Homolog Of SEQ ID NO. 851
MDASLSPFDHQKTQNTEPKKSFITSLITLRSNNIKEDTYFVSELKPTEQKSLQELKEKLSASSSKASSMWGVSLLGGDDKADVILLKFLRARDFKVADSLRMLEKCLEWREEFKAEKLTEEDLGFKDLEGKVAYMRGYDKEGHPVCYNAYGVFKEKEMYERVFGDEEKLNKFLRWRVQVLERGVKMLHFKPGGVNSIIQVTDLKDMPKRELRVASNQILSLFQDNYPELVATKIFINVPWYFSVIYSMFSPFLTQRTKSKFVMSKEGNAAETLYKFIRPEDIPVQYGGLSRPTDSQNGPPKPASEFSIKGGEKVNIQIEGIEGGATITWDIVVGGWDLEYSAEFVPNAEESYAIVVEKPKKMKATDEAVCNSFTTVEAGKLILSVDNTLSRKKKVAAYRYTVRKSTTTV

SEQ ID NO: 903 - protein, 517 aa, Oryza sativa subsp. japonica
  misc_feature (236)..(423): Pfam Name: CRAL_TRIO Pfam Description: CRAL/TRIO domain
  misc_feature (145)..(215): Pfam Name: CRAL_TRIO_N Pfam Description: CRAL/TRIO, N-terminus
  misc_feature (1)..(517): Public GI ID no. 115469468
  misc_feature (1)..(517): Bit score of 470.1 for HMM based on sequences of Figure 24
  misc_feature (1)..(517): Functional Homolog Of SEQ ID NO. 851
MAVEVVSEGAAAAAAEVAAPETKEVTAKAAADEAVTLAAVVSKNASFREESNFLDDLKDGERKALAELRAKVEEAIVDGKLFDDGKVEAKKKAAAAEEEKAVEEAAGEKKDGEEKKEEEEPVTEEKKEEEQGEEEEEPKKEEADEGEKEEKPAEEEAAAVVDKDIALWGVPLLPSKGDDATDVVLLKFLRARDFKAGAAFDMLRKTLHWRREWKGFAAGTDDDDDGEALPAELADACYLDGADREGHPVCYNALGVFADDAVYKKALGTEEGKARFLRWRVRAMESHVAKLDLRPGGVASLLQVTDLKNSPGPAKKDLRVAMKQVLDLFQDNYPELVARNILINVPFWYYAFSTLFYPFMTQRTKSKFVIARPSKVTETLLKYIPIEAIPVKYGGLKRDDDTEFSAEDSEVTELVVKASSTETIEIEATEGDTTLTWDLTVLGWEVNYKEEFVPSEEGSYTVIVKKGKKMGSSEAAVRNSFRAGEPGKVVLTVENLTHRKKKVLFRHKAKSACAKEC

SEQ ID NO: 904 - DNA, 1915 bp, Panicum virgatum
  misc_feature (1)..(1915): Ceres Clone ID no. 1727755
  misc_feature (1)..(1915): Encodes the peptide sequence at SEQ ID NO. 905
actctctctctgtctctctctctctccgccgccgctgccgcattgattacttgggatctgcacacctgcctcgtgccgagtttcggtgttgcgagttgtgagtgtgagcgccatggccgtggaggctgtgtccgggaacggcggcgaggcggtggcgccggtgaaggaggtgagcgccaaggtggaggccaaggaggcggctgcggtcaccaagaatgcgtcgttcagggaggagagcaacttcctggatgacctcaaggagagcgagcggaaggcgctcgccgagctccgcgacaaggtggaggccgccatcctggagggcaagctgttcgacgacggcaagccggaggtgaaggagaagagggaggccaagaagaaggccgagaaggcgcccgaggagaagaaagaggaggaggaggaagggaagaaggagcccgaagccgtggagaagaaaggggaggaggacgccaagaaggaggccgaggtcgagggcaagaaagaggaggaagaaagcaagaaagaggctgagaaggagatggagcaggaggaagctggcgaggccgagaaggttgctgcggcggcggaggagaaaccggcggagacggcggccgtcgtcgtggacaaggacatcgccctgtggggcgtgcccctgctcccgagcaagggcgacgaggccaccgacgtcgtgctcctcaagttcctccgcgcgcgcgacttcaaggccggcgccgcgttcgagatgctccgccgcaccctccgctggcgcagggactggcccggcttcgacgccgacgccgacgccgatctccccgaggagctcgcgggcgcgtgctacctcgacggcgcggaccgcgagggccacccggtgtgctacaacgcgctcggggtgttcgccgacgacgccttgtacaagaaggcgctcggcaccgaggaaggcaaggcgcggttcctccggtggcgggtgcgcgccatggagcgccacgtcgcggagctggacttgaagcccggcggcgccgcgtcgctgctgcaggtgaccgacctcaagaactcgccggggccggccaagaaggacttccgcgtcgccgtcaagcaggtgctcgacctgttccaggacaactaccccgagctcgtcgcaagaaacatcttgatcaacgtgccgttctggtactacgcgttcagcaccctgttctacccgttcctgacgcagcggaccaagagcaagttcgtcattgctcgcccgtccaaggtcaccgagaccctcctcaagtacattccgattgaggccatcccggtgaagtacggcggcctgaaacgcgacgacgacactgaattctcctccgccgatgacggcgaagtcgcagagctcactgtcaagggaagctccaccgagaccattgagattgaagccactgaggctgatgccaccctgacatgggacctgacggtgctgggctgggaggtgaactacaaggaggagttcgtgccggccgacgagagctcctacaccatcatcgtcaggaagggcaagaagatgggggcgggcgaggaggctgtccgcaactcgttccgcgccggcgagcccggcaaggtggtgctcaccgtcgagaacacctcgcacaagaagaagaaggtgctgttcaggcacaagtccaagagcgccttcgccaagaagtgctgaggctcgatcgaaacctgcctgcaagccgaattcttcggagggtgtgatgtgctgagctcctatgccaaggagtgaattggttggtcgtgtggatccaatattcaattattcattacattctttatgtgtgtgtgtaagaaagaagagagcattgtttgtattcatggtgattaatttgaggttgggtgttgcggcatgacattcatgattcctgagaatataaagagctggtatcgc

SEQ ID NO: 905 - protein, 521 aa, Panicum virgatum
  misc_feature (239)..(424): Pfam Name: CRAL_TRIO Pfam Description: CRAL/TRIO domain
  misc_feature (126)..(224): Pfam Name: CRAL_TRIO_N Pfam Description: CRAL/TRIO, N-terminus
  misc_feature (1)..(521): Ceres Clone ID no. 1727755
  misc_feature (1)..(521): Bit score of 473.5 for HMM based on sequences of Figure 24
  misc_feature (1)..(521): Functional Homolog Of SEQ ID NO. 851
MAVEAVSGNGGEAVAPVKEVSAKVEAKEAAAVTKNASFREESNFLDDLKESERKALAELRDKVEAAILEGKLFDDGKPEVKEKREAKKKAEKAPEEKKEEEEEGKKEPEAVEKKGEEDAKKEAEVEGKKEEEESKKEAEKEMEQEEAGEAEKVAAAAEEKPAETAAVVVDKDIALWGVPLLPSKGDEATDVVLLKFLRARDFKAGAAFEMLRRTLRWRRDWPGFDADADADLPEELAGACYLDGADREGHPVCYNALGVFADDALYKKALGTEEGKARFLRWRVRAMERHVAELDLKPGGAASLLQVTDLKNSPGPAKKDFRVAVKQVLDLFQDNYPELVARNILINVPFWYYAFSTLFYPFLTQRTKSKFVIARPSKVTETLLKYIPIEAIPVKYGGLKRDDDTEFSSADDGEVAELTVKGSSTETIEIEATEADATLTWDLTVLGWEVNYKEEFVPADESSYTIIVRKGKKMGAGEEAVRNSFRAGEPGKVVLTVENTSHKKKKVLFRHKSKSAFAKKC

SEQ ID NO: 906 - DNA, 1820 bp, Zea mays
  misc_feature (1)..(1820): Ceres Clone ID no. 240809
  misc_feature (1)..(1820): Encodes the peptide sequence at SEQ ID NO. 907
acagtcccactcctctctctctcgcgctctctctctttcatcgccaccaccgccgtgaaatccgcacgcgtgcttcctgtcgatttttgagctgtgactgtgagcgccatggccgtggaggctgtgtccggaaatggcaccgaggcagtggccgcggcgccggcgaaggaggtgagcaccaagcaggcgtctttccgggaggagagcaacttcctggacgatctcaaggagagcgagcgtaaggcgcttgccgagctccgcgacaaggtcgaggcggccatcgtggagggcaagctgttcgacgacggtaagccggaggtgaaggagaaggagaaggagaaggaggaggccaagaagaaggcagtggagaagaaagatgagcagcccgaagccgaggagaagggagaggaggatgacaagaaggaggccgacgccgaggaggagaagaaggaaggcgtggaggaaggggagaagaaggaaggccaggaggaaggggagaaggaggaggccgaggaggagagcggagacgacaccaagcaggaggccaaggaagaggaagccgacgacaaggcggcggcgaaggagccggagacggcggccgttgtcgtcgacaaggacatcgcgctgtggggcgtgcctttgctccctagcaagggcgacgaggccaccgacgtggtgctcctcaagttcctccgcgcgcgcgacttcaaggccggcgccgcgttcgagatgctccgccgcacgctccgctggcgcagggactggaccggcttcagctccggcgccgagtccgacgccgacctccccgaggagctcgcgggcgcgtgctacctcgacggcgcagaccacgagggccacccggtgtgctacaacgcgctgggcgtgttcgcggacgacgccgtgtacaagaaggcgctgggcaccgaggaaggcaaggccaggttcctccggtggcgggtgcgcgccatggagcgccacgtcgccgagctggacctgaggcccggcggcgtcgcgtcgctgctgcaggtgatcgacctcaggaactcgccggggccggccaagaaggacttccgagtcgccgtcaagcaggtgctcgacctgttccaggacaactaccccgagctcgtcgcgagaaacatcttggtcaacgtgccgttctggtactacgcgttcagcaccctgttctacccgttcctgacgcagaggacgaagagcaagttcgtcgttgctcgcccgtcaaaggtcaccgagaccctcctcaagtacattccgatcgaggccatcccggtgaagtacggcggcctgaagcgcgacggcgacaccgagttctcggcggacgacggcgaggtcgcggaggtcaccgtcaagggaagctccacggagaccatcgagatcgaagctactgaggctgatgccacgctgacatgggacctgactgtgctggggtgggaggtgaactacaaggaggagttcgtgccggcggacgagggctcctacactatcatcgtcaggaaaggcaagaagatggcgtccggcgaggaggcggtccgcaactcgttccgcgccggcgagccgggcaaggtcgtgctcaccgtccagaacacctcgcacaggaagaagaaggtgctgttcaggcacaaggccaagagcgcctgcgccaagaagtgctgagaggctaagaaatttgggagtgaaattggttgtggatttcaatattcgttacattctttgtgtgtgtgtaaggagagagagagagaacattgttcgctgattatttgaggtggttgttgcagcaaaaatgcaaagagttttcgattgat

SEQ ID NO: 907 - protein, 520 aa, Zea mays
  misc_feature (239)..(423): Pfam Name: CRAL_TRIO Pfam Description: CRAL/TRIO domain
  misc_feature (144)..(221): Pfam Name: CRAL_TRIO_N Pfam Description: CRAL/TRIO, N-terminus
  misc_feature (1)..(520): Ceres Clone ID no. 240809
  misc_feature (1)..(520): Bit score of 468.6 for HMM based on sequences of Figure 24
  misc_feature (1)..(520): Functional Homolog Of SEQ ID NO. 851
MAVEAVSGNGTEAVAAAPAKEVSTKQASFREESNFLDDLKESERKALAELRDKVEAAIVEGKLFDDGKPEVKEKEKEKEEAKKKAVEKKDEQPEAEEKGEEDDKKEADAEEEKKEGVEEGEKKEGQEEGEKEEAEEESGDDTKQEAKEEEADDKAAAKEPETAAVVVDKDIALWGVPLLPSKGDEATDVVLLKFLRARDFKAGAAFEMLRRTLRWRRDWTGFSSGAESDADLPEELAGACYLDGADHEGHPVCYNALGVFADDAVYKKALGTEEGKARFLRWRVRAMERHVAELDLRPGGVASLLQVIDLRNSPGPAKKDFRVAVKQVLDLFQDNYPELVARNILVNVPFWYYAFSTLFYPFLTQRTKSKFVVARPSKVTETLLKYIPIEAIPVKYGGLKRDGDTEFSADDGEVAEVTVKGSSTETIEIEATEADATLTWDLTVLGWEVNYKEEFVPADEGSYTIIVRKGKKMASGEEAVRNSFRAGEPGKVVLTVQNTSHRKKKVLFRHKAKSACAKKC

SEQ ID NO: 908 - DNA, 1903 bp, Panicum virgatum
  misc_feature (1)..(1903): Ceres Clone ID no. 1769321
  misc_feature (1)..(1903): Encodes the peptide sequence at SEQ ID NO. 909
actctctctgtctctctctctctctctctctatctctctctccgccgccgctgccgcattgattacttggggatctgcacacctgcctcgtgccgagtttcggtgttgcgagttgtgagtgtgagcgccatggccgtggaggctgtgtccgggaacggcggcgaggcggtggcgccggcgccggcgccggtgaaggaggtgagcgccaaggtggaggccaaggaggcggctgcggtcaccaagaacgcgtcgttcagggaggagagcaacttcctggatgacctcaaggagagcgagcggaaggcgctcgccgagctccgcgacaaggtggaggccgccatcctggagggcaagctgttcgacgacggcaagccggaggtgaaggagaagagggaggccaagaagaaggccgagaaggcgcccgaggagaagaaagaggaggaggaggaagggaagaaggagcccgaagccgtggagaagaaaggggaggaggacgacaagaaggaggccgaggtcgagggcaaggaagaggaggaagaaagcaagaaagaggctgagaaggagatggagcaggaggaagctggcgaggccgagaaggttgctgcggcggcggaggagaaaccggcggagacggcggccgtcgtcgtggacaaggacatcgccctgtggggcgtgcccctgctcccgagcaagggcgacgaggccaccgacgtcgtgctcctcaagttcctccgcgcgcgcgacttcaaggccggcgccgcgttcgagatgctccgccgcaccctccgctggcgcagggactggcccggcttcgacgccgacgccgacgccgatctccccgaggagctcgcgggcgcgtgctacctcgacggcgcggaccgcgagggccacccggtgtgctacaacgctctccgggtgttcgccgacgacgccgtgtacaagaaggcgctcggcaccgaggaaggcaaggcgcggttcctccggtggcgggtgcgcgccatggagcgccacgtcgcggagctggacttgaagcccggcggcgccgcgtcgctgctgcaggtgaccgacctcaagaactcgccggggccggccaagaaggacttccgcgtcgccgtcaagcaggtgctcgacctgttccaggacaactaccccgagctcgtcgcaagaaacatcttgatcaacgtgccgttctggtactacgcgttcagcaccctgttctacccgttcctgacgcagcggaccaagagcaagttcgtcattgctcgcccgtccaaggtcaccgagaccctcctcaagtacattccgattgaggccatcccggtgaagtacggcggcctgaaacgcgacgacgacactgaattctcctccgccgatgacggcgaagtcgcagagctcactgtcaagggaagctccaccgagaccattgagattgaagccgctgaggctgatgccaccctgacatgggacctgacggtgctgggctgggaggtgaactacaaggaggagttcgtgccggccgacgagggctcctacaccatcatcgtcaggaagggcaagaagatgggggccggcgaggaggctgtccgcaactcgttccgcgccggcgagcccggcaaggtggtgctcaccgtcgagaacacctcgcacaagaagaagaaggtgctgttcaggcacaagtccaagagcgccttcgccaagaagtgctgaggctcgatcgaaacctgcctgcaagccgaattcttcggagggtgtgatgtgctgagctcctatgccaaggagtgaattggttggtcgtgtggatccaatattcaattattcattacattctttatgtgtgtgtgtaagaaagaagagagcattgtttgtattcatgattcctgagaatataaagagctggtatcgc

SEQ ID NO: 909 - protein, 525 aa, Panicum virgatum
  misc_feature (243)..(428): Pfam Name: CRAL_TRIO Pfam Description: CRAL/TRIO domain
  misc_feature (131)..(228): Pfam Name: CRAL_TRIO_N Pfam Description: CRAL/TRIO, N-terminus
  misc_feature (1)..(525): Ceres Clone ID no. 1769321
  misc_feature (1)..(525): Bit score of 466.1 for HMM based on sequences of Figure 24
  misc_feature (1)..(525): Functional Homolog Of SEQ ID NO. 851
MAVEAVSGNGGEAVAPAPAPVKEVSAKVEAKEAAAVTKNASFREESNFLDDLKESERKALAELRDKVEAAILEGKLFDDGKPEVKEKREAKKKAEKAPEEKKEEEEEGKKEPEAVEKKGEEDDKKEAEVEGKEEEEESKKEAEKEMEQEEAGEAEKVAAAAEEKPAETAAVVVDKDIALWGVPLLPSKGDEATDVVLLKFLRARDFKAGAAFEMLRRTLRWRRDWPGFDADADADLPEELAGACYLDGADREGHPVCYNALRVFADDAVYKKALGTEEGKARFLRWRVRAMERHVAELDLKPGGAASLLQVTDLKNSPGPAKKDFRVAVKQVLDLFQDNYPELVARNILINVPFWYYAFSTLFYPFLTQRTKSKFVIARPSKVTETLLKYIPIEAIPVKYGGLKRDDDTEFSSADDGEVAELTVKGSSTETIEIEAAEADATLTWDLTVLGWEVNYKEEFVPADEGSYTIIVRKGKKMGAGEEAVRNSFRAGEPGKVVLTVENTSHKKKKVLFRHKSKSAFAKKC

SEQ ID NO: 910 - DNA, 1531 bp, Triticum aestivum
  misc_feature (1)..(1531): Ceres Clone ID no. 704211
  misc_feature (1)..(1531): Encodes the peptide sequence at SEQ ID NO. 911
gtcgtcgcgttccatttcaaaaacgccacctttcgccccctgcatttccaccaaggcctacatgtctccgaccaccgccgcgtcccccgcgccggcgccggcaaccgacgcgcccccgaagccttcgccaggcgcgaagcgcagcctgatgggatccctcatcgacgccaccgcgctgctccgggcggcctccttcaaggaggactcgtacgtggccgcggcgctcccggcctcggacctccgcgcgctcgccgacctcagggcgctcctcgccacccacccggaccaaatctccatctggggcgtgccgctcaacccgcccagcgacgcccccgccgacgagcgcacggacgtggtgctcctcaagttcctccgcgccagggacttccgcgtccgcgacgcgcacgccatgctgctccgctgcgccgcctggcgggccgagttccgcgccgacgccgtgctggacgaggacctcgggttcaaggacctggagggcatcgtcgcctacatgcacggctgggaccgcgatggccacccggtctgctacaacgcctacggcgtgttcaaggaccgggacatgtacgaccgggtgttcggcgacggtgaccgcctcagccggttcctccggtggcgcgtccagatcatggagcgcggcgtgcgcgcgctccagctccgccccggcggcgtcaacgccatcatacaggtgaccgacctcaaggacatgccgaagcgagagctccgcgccgcgtccaaccagatactctccctcttccaggacaactaccccgagatggtcgcccgcaaggtgttcgtgaacgtaccgtggtacttctccgtgctgttctcgatgatctcgcccttcctcacggagcgcaccaagagcaagttcgtcatcgcgcgcgagggcaacgtcgcggagacgctcttcaagttcatccggccggagctggtgccggtgcagtacggcgggctgagccgcgccagcgagctggagaacgggccgcccaagccggcgtccgagttcaccatcaagggcggcgagaaggtcttcctagagatcgacggcatcgaggccggtgcaacaataacgtgggacctggtcgtcggcggctgggagctcgagtacggcgcggagtacgtgccggcgtcggagggcggctacacgctgtgcgtggagaggaccaagaaggtcccggccgccgccgacgagcccgtgcacaacgccttcacggccaaggagcccggcaagatggtgctctccatcgacaactccggctcacggaagcggaaggtcgccgcctaccgctacttcgtgcgcaagccgtcggcgtaggctgctcggctgctgtggccggcggcttgccggccggcttgtgctttgctttgctcgtctcggagaggaggttaatttaggtctatttaattagtgctataatgtgatatgcatgtattatgccatatgtagaatatattgtatgagccgtgagatcctacttgtcatcatcgttatataacgagttaagttttttcg

SEQ ID NO: 911 - protein, 423 aa, Triticum aestivum
  misc_feature (147)..(331): Pfam Name: CRAL_TRIO Pfam Description: CRAL/TRIO domain
  misc_feature (69)..(133): Pfam Name: CRAL_TRIO_N Pfam Description: CRAL/TRIO, N-terminus
  misc_feature (1)..(423): Ceres Clone ID no. 704211
  misc_feature (1)..(423): Bit score of 399.9 for HMM based on sequences of Figure 24
  misc_feature (1)..(423): Functional Homolog Of SEQ ID NO. 851
MSPTTAASPAPAPATDAPPKPSPGAKRSLMGSLIDATALLRAASFKEDSYVAAALPASDLRALADLRALLATHPDQISIWGVPLNPPSDAPADERTDVVLLKFLRARDFRVRDAHAMLLRCAAWRAEFRADAVLDEDLGFKDLEGIVAYMHGWDRDGHPVCYNAYGVFKDRDMYDRVFGDGDRLSRFLRWRVQIMERGVRALQLRPGGVNAIIQVTDLKDMPKRELRAASNQILSLFQDNYPEMVARKVFVNVPWYFSVLFSMISPFLTERTKSKFVIAREGNVAETLFKFIRPELVPVQYGGLSRASELENGPPKPASEFTIKGGEKVFLEIDGIEAGATITWDLVVGGWELEYGAEYVPASEGGYTLCVERTKKVPAAADEPVHNAFTAKEPGKMVLSIDNSGSRKRKVAAYRYFVRKPSA

SEQ ID NO: 912 - protein, 435 aa, Oryza sativa subsp. japonica
  misc_feature (159)..(343): Pfam Name: CRAL_TRIO Pfam Description: CRAL/TRIO domain
  misc_feature (83)..(145): Pfam Name: CRAL_TRIO_N Pfam Description: CRAL/TRIO, N-terminus
  misc_feature (1)..(435): Public GI ID no. 115463311
  misc_feature (1)..(435): Bit score of 402.4 for HMM based on sequences of Figure 24
  misc_feature (1)..(435): Functional Homolog Of SEQ ID NO. 851
MSPTATPSPAPAAVAAAPKPPPSGTGAKRSLMSSLMEATALLRSSSFKEDSYVASALPASDLRALADLRALLSTHPDPISIWGVPLNPAPPQGGEGAPAPAAAADERADVVLLKFLRARDFRVRDAHAMLLRCAAWRAEFRADAVLDEDLGFKDLEGVVAYMHGWDREGHPVCYNAYGVFKDRDMYDRVFGDGERLARFLRWRVQVMERGVRALHLRPGGVNAIIQVTDLKDMPKRELRAASNQILSLFQDNYPEMVARKVFINVPWYFSVLFSMISPFLTERTKSKFVIAREGNVAETLFKFIRPELVPVQYGGLSRAGDLENGPPKPASEFTIKGGEKVFLEIDGIEAGATITWDLVVGGWELEYGAEYVPAAEDSYTLCVERTRKVPAAADEPVHNAFTAREAGKMVLSIDNSGSRKRKVAAYRYFVRKPSA

SEQ ID NO: 913 - protein, 435 aa, Oryza sativa subsp. indica
  misc_feature (159)..(343): Pfam Name: CRAL_TRIO Pfam Description: CRAL/TRIO domain
  misc_feature (83)..(145): Pfam Name: CRAL_TRIO_N Pfam Description: CRAL/TRIO, N-terminus
  misc_feature (1)..(435): Public GI ID no. 125551906
  misc_feature (1)..(435): Bit score of 404.0 for HMM based on sequences of Figure 24
  misc_feature (1)..(435): Functional Homolog Of SEQ ID NO. 851
MSPTATPSPAPAEVAAAPKPPPSGTGAKRSLMSSLMEATALLRSSSFKEDSYVASALPASDLRALADLRALLSTHPDPISIWGVPLNPAPPQGGEGAPAPAATADERADVVLLKFLRARDFRVRDAHAMLLRCAAWRAEFRADAVLDEDLGFKDLEGVVAYMHGWDREGHPVCYNAYGVFKDRDMYDRVFGDGERLARFLRWRVQVMERGVRALHLRPGGVNAIIQVTDLKDMPKRELRAASNQILSLFQDNYPEMVARKVFINVPWYFSVLFSMISPFLTERTKSKFVIAREGNVAETLFKFIRPELVPVQYGGLSRAGDLENGPPKPASEFTIKGGEKVFLEIDGIEAGATITWDLVVGGWELEYGAEYVPAAEDSYTLCVERTRKVPAAADEPVHNAFTAREAGKMVLSIDNSGSRKRKVAAYRYFVRKPSA

SEQ ID NO: 914 - DNA, 1673 bp, Panicum virgatum
  misc_feature (1)..(1673): Ceres Clone ID no. 1868378
  misc_feature (1)..(1673): Encodes the peptide sequence at SEQ ID NO. 915
aaaaatcctcctccctcccatttcaaaacctcctccccttcccccatttccgcagaggcctgcttgtcaccttcccaatccctcctcccccacccccggaccccagcagcaggagtgctcgccaccatgtctcccaccaccaccccgtcccccgcgcccgcggcggcgccgtcctccaagggcgccaagcgcagcctcatgtcctcgctcatggacgccaccgcgctgctccgctccgcctccttcaaggaggactcgtacgtcgccgccgcgctcccgccctcggagctccgcgcgctcgccgacctcaaggcgctgctcgccaggcacccggaccccatcgccatctggggcgtcccgctcaacagccctcccgcggcggccgacggcgctgccgcagccgcctctcctccggtggacgagcgcgccgacgtggtgctcctcaagttcctccgcgcgcgcgacttccgcgtccgcgacgcgcacgccatgctgctgcgctgcgcggcgtggcgcgccgagttcggcgccgacgcggtgctggacgaggacctgggcttcaaggacctggagggcgtcgtcgcctacatgcacggctgggaccgcgagggccaccccgtctgctacaacgcctacggcgtcttcaaggaccgcgccatgtacgagcgcgtcttcggcgacggcgaccgcctcgcgcgcttcctccgctggcgcgtccaggtcatggagcgcggcgtccgggcgctcagcctcaggccgggcggcgtcaacgccatcatccaggtcaccgacctcaaggacatgcccaagcgagagctcagggccgccagcaaccagatcctctcgctcttccaggacaactacccggagatggtggcgcgcaaggtgttcatcaacgtgccgtggtacttctccgtgctcttctccatgatctctccattcctcacggagcgcaccaagagcaagttcgtcatcgcgcgcgagggcaacgtcgccgagacgctctacaagttcatccggccggagctggttcccgtgcagtacggcgggctgagccgcgccggcgacctcgagaacggcccgcccaagccggcgtccgagttcaccatcaagggcggcgagaaggtcttcctggagatcgacggcatcgaggccggcgcgacaataacgtgggacctggtggtcggcggctgggacctggagtacggcgcggagtacgtgccggcggccgaggggagctacacgctgtgcgtggagaagacgaggatggttccggccgccgccgaggagcctctaaacaatgccttcacggcgagggaggccggcaagatggtgctgtccatcgacaactccggctcccggaagcggaaggtcgccgcgtaccggtacttcgtgcgcaagccgtcggcgtagtgctcggtgttccagtggcggtggctggcagcttgccggccggcggtggcgacgggagttcgacatgggacggacggagaactgcttgcttgcatgctggggctttgttgtggtcttgttggaggggagaagttaaggttagggctacttaattactagtgctataatgacatgcatgtattatgccatatgtagaatataatgtaagagctgttgaacttttgtcatcaccaccgttataaagctaatgagttcatttt

SEQ ID NO: 915 - protein, 428 aa, Panicum virgatum
  misc_feature (152)..(336): Pfam Name: CRAL_TRIO Pfam Description: CRAL/TRIO domain
  misc_feature (76)..(138): Pfam Name: CRAL_TRIO_N Pfam Description: CRAL/TRIO, N-terminus
  misc_feature (1)..(428): Ceres Clone ID no. 1868378
  misc_feature (1)..(428): Bit score of 390.5 for HMM based on sequences of Figure 24
  misc_feature (1)..(428): Functional Homolog Of SEQ ID NO. 851
MSPTTTPSPAPAAAPSSKGAKRSLMSSLMDATALLRSASFKEDSYVAAALPPSELRALADLKALLARHPDPIAIWGVPLNSPPAAADGAAAAASPPVDERADVVLLKFLRARDFRVRDAHAMLLRCAAWRAEFGADAVLDEDLGFKDLEGVVAYMHGWDREGHPVCYNAYGVFKDRAMYERVFGDGDRLARFLRWRVQVMERGVRALSLRPGGVNAIIQVTDLKDMPKRELRAASNQILSLFQDNYPEMVARKVFINVPWYFSVLFSMISPFLTERTKSKFVIAREGNVAETLYKFIRPELVPVQYGGLSRAGDLENGPPKPASEFTIKGGEKVFLEIDGIEAGATITWDLVVGGWDLEYGAEYVPAAEGSYTLCVEKTRMVPAAAEEPLNNAFTAREAGKMVLSIDNSGSRKRKVAAYRYFVRKPSA

SEQ ID NO: 916 - DNA, 1694 bp, Panicum virgatum
  misc_feature (1)..(1694): Ceres Clone ID no. 1812513
  misc_feature (1)..(1694): Encodes the peptide sequence at SEQ ID NO. 917
aaaaatcccccacctccctcccatttcaaaacctcctccggttctccccttccaccatttccgcataggcctgcttgtcaccttcccaatccctcctcccccaccttcccagtccccagcagcagcaggagtcttggccaccatgtctcccaccaccaccccgtcccccgcgcccgcggcggcgccgtcctccaagggcgacaagcgcagcctcatgtcctcgctcatggacgccaccgcgctgctccgctccgcctccttcaaggaggactcgtacgtcgccgccgcgctcccgccgtccgagctccgcgcgctcgccaacctcaaggcgctgctcgccaggcacccggaccccatctccatctggggcgtcccgctcaacagcccccagcagccccctcccgcggcagccgacggcgccgccgctcctccggtggacgagcgagccgacgtggtgctcctcaagttcctccgcgcgcgcgacttccgcgtccgcgacgcgcacgccatgctgctgcgctgcgcggcgtggcgcgccgagttcggcgccggcgcggtgctggacgaggacctgggcttcaaggacctggagggcgtcgtcgcctacatgcacggctgggaccgcgagggccaccccgtctgctacaacgcctacggcgtcttcaaggaccgcgacatgtacgagcgcgtcttcggcgacggcgaccgcctcgcgcgcttcctccgctggcgcgtccaggtcatggagcgcggcgtcagggcactcagcctcaggccgggcggcgtcaacgccatcatccaggtcaccgacctcaaggacatgcccaagcgagagctaagggccgccagcaaccagatcctctcgctcttccaggacaactacccggagatggtggcgcgcaaggtgttcgtcaacgtgccgtggtacttctccgtgctcttctccatgatctcgcccttcctcacggagcgcaccaagagcaagttcgtcatcgcgcgcgagggcaacgtcgccgagacgctctacaagttcatccagccggagctggttcccgtgcagtacggcgggctcagccgcgccggcgacctcgagaacggcccgcccaagccggcgtccgagttcactatcaagggcggcgagaaggtcttcctggagatcgacggcatcgaggccggtgcgacaataacatgggacctggtggtcggcggctgggacctggagtacggcgcggagtatgtgccggcggccgaggggagctacacgctgtgcgtggagaagacgaggatggttccggccaccgccgaggagcccctgcacaatgccttcactgcgagggaggccggcaagatggtgctgtccatcgacaactccggctcccggaagcggaaggtcgccgcgtaccggtacttcgtgcgcaagccgtcggcgtagtgctcggcattccagtggcggtgggcggcagcttgccggccggcggtggcgacgggagtttgacatgggtcggacggagaactgcttccttgctggggctttgttgtggtcttgttggagggtgaaattaaggttaggggtacttaattactagtgctataatgacatgcatgtattatgccatatgtagaatataatgtaagagctgttgaacttttgtcatcaccaccgttataaagctaatgagttcagttttttgggc

SEQ ID NO: 917 - protein, 429 aa, Panicum virgatum
  misc_feature (153)..(337): Pfam Name: CRAL_TRIO Pfam Description: CRAL/TRIO domain
  misc_feature (76)..(139): Pfam Name: CRAL_TRIO_N Pfam Description: CRAL/TRIO, N-terminus
  misc_feature (1)..(429): Ceres Clone ID no. 1812513
  misc_feature (1)..(429): Bit score of 385.7 for HMM based on sequences of Figure 24
  misc_feature (1)..(429): Functional Homolog Of SEQ ID NO. 851
MSPTTTPSPAPAAAPSSKGDKRSLMSSLMDATALLRSASFKEDSYVAAALPPSELRALANLKALLARHPDPISIWGVPLNSPQQPPPAAADGAAAPPVDERADVVLLKFLRARDFRVRDAHAMLLRCAAWRAEFGAGAVLDEDLGFKDLEGVVAYMHGWDREGHPVCYNAYGVFKDRDMYERVFGDGDRLARFLRWRVQVMERGVRALSLRPGGVNAIIQVTDLKDMPKRELRAASNQILSLFQDNYPEMVARKVFVNVPWYFSVLFSMISPFLTERTKSKFVIAREGNVAETLYKFIQPELVPVQYGGLSRAGDLENGPPKPASEFTIKGGEKVFLEIDGIEAGATITWDLVVGGWDLEYGAEYVPAAEGSYTLCVEKTRMVPATAEEPLHNAFTAREAGKMVLSIDNSGSRKRKVAAYRYFVRKPSA

SEQ ID NO: 918 - DNA, 1675 bp, Zea mays
  misc_feature (1)..(1675): Ceres Clone ID no. 209421
  misc_feature (1)..(1675): Encodes the peptide sequence at SEQ ID NO. 919
gctcccatttcaaaacctcttcctcctctcctcgccgcagctcccaccattcccgcagacgccttgtccccttcccagcttcccctcccccaccccgccgcacgtccgcaagccccacgccaccgtcatgtctccgaccaccaccccgccgcccgcgcccgtggcagccccgacctccaagggcgccaagcgcagcctcatgtcctcgctcatggacgccactgcgctgctccgctcctcctctttcaaggaggactcgtacgtcgcggccgcgctcccggcgtccgagctccgcgcgctcgccgacctcaaggcgctgctcgccacccacccggaccccatctccatctggggcgtcccgctgaaccctcgctcccctcccgccgcggcggacgacgccgccccggtcgacgagcgcgccgacgtggtgctcctcaagttcctccgcgcgcgggacttccgcgtccgcgacgcccacgccatggtgctccgctgcgccgcctggcgcgccgagttcggcgccgacgccgtgctggacgaggagctgggcttcaaggacctggagggcatcgtcgcctacatgcacggctgggaccgcgacggccaccccgtctgctacaacgcctacggcgtcttcaaagacagggacatgtacgagcgcgtcttcggcgacggcgaccgcctcgcgcgcttcctccgctggcgcgtccaggtcatggagcgtggcgtgcgcgcgctcaccctgaggcccgggggcgtcaacgccatcatacaggtcaccgacctcaaggacatgccaaagcgggagctcagagccgccagcaaccagatcctctccctcttccaggacaactacccggagatggtagcgcggaaggtgttcattaacgtgccgtggtacttctccgtgctcttctccatgatctcgcccttcctcacggagcgcaccaagagcaagttcgtcatcgcgcgcgagggcaacgtcgccgagacactctacaagttcatccggccggagctggtgcctgtgcagtacggcgggctgagccgcaccggtgacctcgagaacggaccaccgaagccggcgtccgagttcaccatcaagggtggcgagaaggtcttcctggagatcgacggtatcgaggccggtgcaacgataacgtgggatctggtcgtcgggggctgggacctcgagtacggagccgagtacgtgccggcggccgaggacagctacacgctctgcgtggagaagacgaggatggtctcggccaccgccgaggagcccgtgcacaatgccttcacggctagggaagccggcaagatggtgctgtccatagacaattctggttcccggaagcgcaaggttgccgcctacaggtacttcgtgcgcaagtcgtcggcgtaggcatgctgatgtcttgtggtggtcgtcgcggccggcaccttgccggcaggtagccgcgagggggaggttaacgtggaacaactggtgaagtgtttacttgggcttgtgggatttggtggggagaggtcaagttaggctgtttaattattagtgctataacgacatgcatgtattatgccatatgtagaatataatgtactccgtaagagctgttgcacttttgtcatcaccactgttataaagctaatgatgagttaagttttttgggct

SEQ ID NO: 919 - protein, 425 aa, Zea mays
  misc_feature (149)..(333): Pfam Name: CRAL_TRIO Pfam Description: CRAL/TRIO domain
  misc_feature (76)..(135): Pfam Name: CRAL_TRIO_N Pfam Description: CRAL/TRIO, N-terminus
  misc_feature (1)..(425): Ceres Clone ID no. 209421
  misc_feature (1)..(425): Bit score of 392.7 for HMM based on sequences of Figure 24
  misc_feature (1)..(425): Functional Homolog Of SEQ ID NO. 851
MSPTTTPPPAPVAAPTSKGAKRSLMSSLMDATALLRSSSFKEDSYVAAALPASELRALADLKALLATHPDPISIWGVPLNPRSPPAAADDAAPVDERADVVLLKFLRARDFRVRDAHAMVLRCAAWRAEFGADAVLDEELGFKDLEGIVAYMHGWDRDGHPVCYNAYGVFKDRDMYERVFGDGDRLARFLRWRVQVMERGVRALTLRPGGVNAIIQVTDLKDMPKRELRAASNQILSLFQDNYPEMVARKVFINVPWYFSVLFSMISPFLTERTKSKFVIAREGNVAETLYKFIRPELVPVQYGGLSRTGDLENGPPKPASEFTIKGGEKVFLEIDGIEAGATITWDLVVGGWDLEYGAEYVPAAEDSYTLCVEKTRMVSATAEEPVHNAFTAREAGKMVLSIDNSGSRKRKVAAYRYFVRKSSA

SEQ ID NO: 920 - DNA, 1308 bp, Sorghum bicolor
  misc_feature (1)..(1308): Ceres Annot ID no. 8730934
  misc_feature (1)..(1308): Encodes the peptide sequence at SEQ ID NO. 921
atgtctcccaccaccaccccgtcgcccgcgcccgtggcagccccggcctccaagggcgccaagcgcagcctcatgtcctcgctcatggacgccaccgcgctgctccgctcctcctccttcaaggaggactcgtacgtcgccgccgcgctgccgtcgtccgagctccgcgcgctcgccgacctcaaggcgctgctcgccacccacccggaccccatttccatctggggcgtcccgctgaacccacactctcctcccgccgcggcggacgacgctgcccctgccccaaccccggcaccggtggacgagcgcgccgacgtggtgctcctcaagttcctccgcgcgcgggacttccgcgtccgcgacgcgcacgccatgctgctccgctgcgccgcctggcgcgccgagttcggcgccgacgccgtgctggacgaggacctgggcttcaaggacctcgagggcgtcgtcgcctacatgcacggctgggaccgcgacggccaccccgtctgctacaacgcctacggcgtcttcaaagacagggacatgtacgagcgcgtcttcggcgacggcgaccgcctctcgcgcttcctccgctggcgcgtccaggtcatggagcgcggcgtgcgcgcgctcaccctcaggcccggcggcgtcaacgccatcatacaggtcaccgacctcaaggacatgcccaagcgggagctcagagccgccagcaaccagatcctctccctcttccaggacaattacccggagatggtggcgcgcaaggtgttcatcaacgtgccgtggtacttctccgtgctcttctccatgatctcgccattcctcaccgagcgcaccaagagcaagttcgtcatcgcgcgcgagggcaacgtcgccgagacactctacaagttcatccggccggagctggtgccggtgcagtacggcgggctgagccgcgccggcgacctcgagaacggaccaccaaagccggcgtccgagttcaccatcaagggtggcgagaaggtcttcctggagatcgacggtatcgagggcaatgttcatgccggtgcaacaataacctgggatctggtcgtcgggggctgggacctcgagtacggcgccgagtatgtgccggcagccgaggacagctacacgctctgcgtggagaagacgaggatggtctcggccaccgccgacgagcccgtgcacaacgccttcacggcgagggaagccggcaagatggtgttgtccatagacaactctggttcccggaagcggaaggttgccgcctaccggtacttcgtgcgcaagccgtcggtgtag

SEQ ID NO: 921 - protein, 435 aa, Sorghum bicolor
  misc_feature (155)..(339): Pfam Name: CRAL_TRIO Pfam Description: CRAL/TRIO domain
  misc_feature (81)..(141): Pfam Name: CRAL_TRIO_N Pfam Description: CRAL/TRIO, N-terminus
  misc_feature (1)..(435): Ceres Annot ID no. 8730934
  misc_feature (1)..(435): Bit score of 398.0 for HMM based on sequences of Figure 24
  misc_feature (1)..(435): Functional Homolog Of SEQ ID NO. 851
MSPTTTPSPAPVAAPASKGAKRSLMSSLMDATALLRSSSFKEDSYVAAALPSSELRALADLKALLATHPDPISIWGVPLNPHSPPAAADDAAPAPTPAPVDERADVVLLKFLRARDFRVRDAHAMLLRCAAWRAEFGADAVLDEDLGFKDLEGVVAYMHGWDRDGHPVCYNAYGVFKDRDMYERVFGDGDRLSRFLRWRVQVMERGVRALTLRPGGVNAIIQVTDLKDMPKRELRAASNQILSLFQDNYPEMVARKVFINVPWYFSVLFSMISPFLTERTKSKFVIAREGNVAETLYKFIRPELVPVQYGGLSRAGDLENGPPKPASEFTIKGGEKVFLEIDGIEGNVHAGATITWDLVVGGWDLEYGAEYVPAAEDSYTLCVEKTRMVSATADEPVHNAFTAREAGKMVLSIDNSGSRKRKVAAYRYFVRKPSV

SEQ ID NO: 922 - DNA, 1368 bp, Populus balsamifera subsp. trichocarpa
  misc_feature (1)..(1368): Ceres Annot ID no. 1452687
  misc_feature (1)..(1368): Encodes the peptide sequence at SEQ ID NO. 923
atggaggagaaaattgagaagagacaccaagacaacgaagacaggatgattaaaaaagggcaggaagagggtaatgggaaaaaagtcaccttccaagaccaagagatctacatagaaaatcttgatcagccagctgttcaagaaaatgaagaaacagctgcttctattgaattggagatgagaaagcagaaggccttgaacaaattcaggagcatggtggaaggtgcaattattgataattaccttctagaaaatcccaaaaagagtttcttaaggagagaatcagagagggagaaacagcagcagagggagattagcctttggggtgtgcctttattgccaagtaaaggccatgcgagcaccgatcttgtgctgttaaaattcctgacagcaacggactttaaggttaacgaagctttcaagatgcttcgcaatgctctgaaatggcggaacgaatgcaggatagatgctattcctgaagagaatttgcatctcggccttgaaaaatttgtgtacataaatagcgtcggaaaacaaggtcagcctgtgtattatattttgtacggggctttcaaggacaaagaattgtacaggaaagtattaggaacagaagagaatcgcgaaaagtttttgagattaagaatccaactcatggagaagagcatcgagcaacttagtttcaaagctggaggggcagattctatacttcagattacagatctcaagcactcgccagggccagaaagggaggagttccgttcagtccacaaaagggcctccacattgattcaagccaattaccctgagctcattcaaaagcatattttgataaatgttccattttggtactacacatcccgttttctaacatccaggctcaagcatcagagaggtaaaaagaaggttgttcttgctagaccatcaaaagtcacaaaaacccttctaaagcacatatcccctgaaaaccttccagttaaatatggtggtctgaaaagagagaatgatatcgagttttttccagaggacaaagcttcagagctaattgtcaaaccaaattcagctagctgcatccaaattccagtcattgaggccggggtaacaattgtatgggactttaccgtggttggatgggaggtgacatgtaaacaacagttcatcccagacgacgagggatcatacgaagttctgctcaggaaggacaaggagaagaaaatgggtgacagtgttaggaattctttttacattagtgaaccagggaagattgtgataaccattgacaatgcaacactgaagaagaaaagggtgtactacagatccaaagccaaacccaccgcaccgccctatatcattttcaagaaacagctttaa

SEQ ID NO: 923 - protein, 440 aa, Populus balsamifera subsp. trichocarpa
  misc_feature (154)..(341): Pfam Name: CRAL_TRIO Pfam Description: CRAL/TRIO domain
  misc_feature (71)..(143): Pfam Name: CRAL_TRIO_N Pfam Description: CRAL/TRIO, N-terminus
  misc_feature (1)..(440): Ceres Annot ID no. 1452687
  misc_feature (1)..(440): Bit score of 359.0 for HMM based on sequences of Figure 24
  misc_feature (1)..(440): Functional Homolog Of SEQ ID NO. 851
MIKKGQEEGNGKKVTFQDQEIYIENLDQPAVQENEETAASIELEMRKQKALNKFRSMVEGAIIDNYLLENPKKSFLRRESEREKQQQREISLWGVPLLPSKGHASTDLVLLKFLTATDFKVNEAFKMLRNALKWRNECRIDAIPEENLHLGLEKFVYINSVGKQGQPVYYILYGAFKDKELYRKVLGTEENREKFLRLRIQLMEKSIEQLSFKAGGADSILQITDLKHSPGPEREEFRSVHKRASTLIQANYPELIQKHILINVPFWYYTSRFLTSRLKHQRGKKKVVLARPSKVTKTLLKHISPENLPVKYGGLKRENDIEFFPEDKASELIVKPNSASCIQIPVIEAGVTIVWDFTVVGWEVTCKQQFIPDDEGSYEVLLRKDKEKKMGDSVRNSFYISEPGKIVITIDNATLKKKRVYYRSKAKPTAPPYIIFKKQL

SEQ ID NO: 924 - DNA, 1714 bp, Zea mays
  misc_feature (1)..(1714): Ceres Clone ID no. 351936
  misc_feature (1)..(1714): Encodes the peptide sequence at SEQ ID NO. 925
actccaaatcctcctcccatttgaaaacctcctcttttctcctctcctcgccgcagctcccaccattcccgcagacggacgcttttccccttcccagcttcccctgaccactccgcagcaggcccgcaagccccgacgccagcggcatgtcccccgccaccaccccgttgcccgcccccgtggcagccccagcgtccaagggcgggaagcgcagcctcatgtcgtcactcatggacgccaccgcgctgctccgctcctcctccttcaaggaggactcgtacgtggcggcggcgctcccggcgtccgagctccgcgcgctcgccgacctcaaggcgctggtggccacccacccggaccccatctccatctggggcgtcccgctgaatccccactcccctcctcccggcgcggcgaacgacgacgccgacgagcgcgccgacgtggtgctcctcaagttcctccgcgcgcgggacttccgcgcgcgcgacgcgcacgcgatgctgctccgctgcgccgcgtggcgcgccgagttcggcgcggacgcggtggtggacgaggagctgggcttcaaggacctggagggcgtggtggcgtacatgcacgggtgggaccgggacgggcaccccgtgtgctacaacgcgtacggcgtgttcaaggacagggccatgtacgagcgcgccttcggcgacggcgaccgcctggcgcgcttcctccggtggcgcgtccaggtgatggagcgcggcgtgcgcgcgctcacgctcaggccccgcggcgtcaacgccatcatacaggtgaccgacctgagggacatgccgaagcgggagctcagagccgccagcaaccagatcctctccctcttccaggacaactacccggagatggtggcgcgcaaggtgttcatcaacgtgccgtggtacttctccgtgctcttctccatggtctcgcccttcctgacggagcgcaccaagagcaagttcgtcatcgctcgcgagggcaacgtcgccgagacactgtacaagttcatccggcccgagctggtgccggtgcagtacggcgggctgagccgcgccggcgagctcgagaacggaccgccgaagccggcgtccgagttcaccatcaagggtggcgagaaggtctttctggagatcgacggtatcgaggccggcgcaacgataacgtgggacctcgtcgtcggtggctgggacctggagtacggcgccgagtacgtgccggcggccgacggcagctacaccctctgcgtggagaaggcgaggacggtcccggccaccgccgacgccgacgccgggccgctgcacaacgccttcacggctcgggaggccggcaggatggtgctgtccatagacaactccggttcccggaagcggaaggtcgccgcctaccgctacttcgtgcgcaagccgtcgccgtagcccgtaggccttgctgtgctcgtggcggccgccggcgtcttgccgaccggccgcgccaggggggaggcaaacgtggaaccaccaccggtgaagtgcctgcatgcatgctttgcttgggcttatatttgtcggacttggagaggagagagaggttaagctaggctattttattattagtgctatatataacgacatgcatgtattgtgccatgtgtagagtataatgtaagagctgtcgaacttctgtttttttgtcaccgccgttataaagctgatgatgagcc

SEQ ID NO: 925 - protein, 427 aa, Zea mays
  misc_feature (148)..(326): Pfam Name: CRAL_TRIO Pfam Description: CRAL/TRIO domain
  misc_feature (76)..(134): Pfam Name: CRAL_TRIO_N Pfam Description: CRAL/TRIO, N-terminus
  misc_feature (1)..(427): Ceres Clone ID no. 351936
  misc_feature (1)..(427): Bit score of 368.3 for HMM based on sequences of Figure 24
  misc_feature (1)..(427): Functional Homolog Of SEQ ID NO. 851
MSPATTPLPAPVAAPASKGGKRSLMSSLMDATALLRSSSFKEDSYVAAALPASELRALADLKALVATHPDPISIWGVPLNPHSPPPGAANDDADERADVVLLKFLRARDFRARDAHAMLLRCAAWRAEFGADAVVDEELGFKDLEGVVAYMHGWDRDGHPVCYNAYGVFKDRAMYERAFGDGDRLARFLRWRVQVMERGVRALTLRPRGVNAIIQVTDLRDMPKRELRAASNQILSLFQDNYPEMVARKVFINVPWYFSVLFSMVSPFLTERTKSKFVIAREGNVAETLYKFIRPELVPVQYGGLSRAGELENGPPKPASEFTIKGGEKVFLEIDGIEAGATITWDLVVGGWDLEYGAEYVPAADGSYTLCVEKARTVPATADADAGPLHNAFTAREAGRMVLSIDNSGSRKRKVAAYRYFVRKPSP

SEQ ID NO: 926 - protein, 593 aa, Gossypium hirsutum
  misc_feature (313)..(499): Pfam Name: CRAL_TRIO Pfam Description: CRAL/TRIO domain
  misc_feature (233)..(301): Pfam Name: CRAL_TRIO_N Pfam Description: CRAL/TRIO, N-terminus
  misc_feature (1)..(593): Bit score of 905.1 for HMM based on sequences of Figure 24
  misc_feature (1)..(593): Functional Homolog Of SEQ ID NO. 851
  misc_feature (567)..(567): Xaa is any aa, unknown, or other
MADETPAQNPPMAAAPPPPSSATVSDSDSPAVLEKQDPSPPSHVPAVSVSVTESASTTIAENEEQAPPPEPAALEPDSSDKGSGKEELPPTPPPQAVESESEPPVVTEAPKEENPPAPAAETVVISESEPQQPPAPLQQEVVTESESLAAMMEKEETGAPAEPTAAGTTTTTTTSAQEEVAAAVEEKKVPQNLASFKEESNKEADLSDSERKALEELKQLVREAIDSNLFNSESKSEENPEKEKKQESKEVSIWGIPLLKDERSDVILWKFLRAGDFKAKDAFVMIKNTIRWRKEFGIDELLDEDLGDDMEKVVFMHGQDKEGHPVCYNVYGEFQNKESYQKAFSVEEKRMKFLRWRIQLLEKSIRKLDFSPGGVSTIFQVSDLKNSPGPGKKELRLATKQALQVLQDNYPEFVAKQVFINVPWWYLAFYTMISPFMTQRTKSKFVIALPSKSAETLFKYIPPEQVPIQYGGLSVDYCDCNPEFSDADPATEMTVKPGTKQTVEITIFEKCILVWEIRVVGWEVSYGAEFVPDAKDSYAVIIQKPTKMTAKDEPVVSQSFKVGELGXVLLTVDNPTSKKKKLLYRFKVKPFCD

SEQ ID NO: 927 - DNA, 1566 bp, Panicum virgatum
  misc_feature (1)..(1566): Ceres Clone ID no. 1781794
  misc_feature (1)..(1566): Encodes the peptide sequence at SEQ ID NO. 928
caggaacttgtcccaccagctagcagtcagtagcggtgttcttgcagaggcggccggccggctcgacgtgcgtcgacgatggggctccgccgcgactccgccgccgcgctggtggctctggtgctcgcggtcacctgctgctccgttgcagtagtggcctacgatcccctggacccgaacggcaacatcaccatcaagtgggacgtcatctcctggacgcccgacggctacgtggcgatggtgacgatgagcaactaccagatgtaccggcacatcatggcgcccgggtggacggtggggtggtcgtgggccaagaaagaggtgatctggtccatcgtgggcgcgcaggccacggagcagggcgactgctccaagttcaaggccggcatcccgcactgctgcaagcgcacccccgccgtggtggacctcctcccgggcgtaccctacaaccagcagatcgccaactgctgcaaggccggcgtcgtcgccgcctacggccaggaccccaccgccgccgtctccgccttccaggtctccgtcggcctcgccggcaccaccaacaagaccgtcaagctccccaccaacttcaccctccagggccccggcccgggctacacctgcggccccgcccgcgtcgtcccctccaccgtctacctcacccccgaccgccgccgccgcacgcaggcgctcatgacctggaccgtcacctgcacctactcccagcagctcgcctcccggtacccctcctgctgcgtctccttctcctccttctacaacagcaccatcgtgccctgcgcccactgcgcctgcggctgcggccatggcggccacggcggcgccggctgcatcgccggcgactccaagcgcgcgctctcccccggcgtcaacacgccgcgcagggacgggcagccgctgctgcagtgcacgccgcacatgtgcccggtgcgcgtccactggcacgtcaagctcaactacaaagactactggcgcgccaagatcgccatcaccaacttcaactaccggatcaactacacgcagtggacgctggtggcgcagcaccccaacctggacaacgtcaccgaggtcttcagcttccagtacaggccgctgctgccctacggcgccatcaacgacaccggcatgttctacgggctcaaattctacaacgacctgctcatggaggccgggcctttcggcaacgtgcagtccgaggtgctcatgcgcaaggacgccagaaccttcaccttcagccagggatgggccttcccaaggaagatctacttcaacggcgacgagtgcaagatgccgccgccggactcctacccctacctgcccaacaggtccgcccgggttgcggcaccgtcggtgatcgcctcggcattcctgctggcgctgctgctcctgctggcgccgtgattgatagggagcagcagagtgtgttgttacctgtgcagcggtggtttcgtcatgtaaacataacgcggtgggatctccaattactttctagacagcctgagaacaaatgatagtaatacatagtagagcacaagcctttttctgcggttt

SEQ ID NO: 928 - protein, 445 aa, Panicum virgatum
  misc_feature (51)..(215): Pfam Name: COBRA Pfam Description: COBRA-like protein
  misc_feature (1)..(445): Ceres Clone ID no. 1781794
  misc_feature (1)..(445): Bit score of 1149.2 for HMM based on sequences of Figure 9
  misc_feature (1)..(445): in Figure 9
MGLRRDSAAALVALVLAVTCCSVAVVAYDPLDPNGNITIKWDVISWTPDGYVAMVTMSNYQMYRHIMAPGWTVGWSWAKKEVIWSIVGAQATEQGDCSKFKAGIPHCCKRTPAVVDLLPGVPYNQQIANCCKAGVVAAYGQDPTAAVSAFQVSVGLAGTTNKTVKLPTNFTLQGPGPGYTCGPARVVPSTVYLTPDRRRRTQALMTWTVTCTYSQQLASRYPSCCVSFSSFYNSTIVPCAHCACGCGHGGHGGAGCIAGDSKRALSPGVNTPRRDGQPLLQCTPHMCPVRVHWHVKLNYKDYWRAKIAITNFNYRINYTQWTLVAQHPNLDNVTEVFSFQYRPLLPYGAINDTGMFYGLKFYNDLLMEAGPFGNVQSEVLMRKDARTFTFSQGWAFPRKIYFNGDECKMPPPDSYPYLPNRSARVAAPSVIASAFLLALLLLLAP

SEQ ID NO: 929 - DNA, 1341 bp, Sorghum bicolor
  misc_feature (1)..(1341): Ceres Annot ID no. 8640603
  misc_feature (1)..(1341): Encodes the peptide sequence at SEQ ID NO. 930
atggggctccgcgactcctccgtgctgctggccgctctgtccctcgcgctcgcctactgctccgtttcagtggtggcctacgatcccctggaccctcggggcaacatcacgataaagtgggacgtgatctcatggacgcccgacgggtacgtggcgatggtgacgatgagcaactaccagatgtaccggcacatcatgtccccgggctggacggtgggctggtcgtgggcgaagaaggaggtgatctggtccatcgtcggcgcgcaggccacggagcagggcgactgctccaagttcaaaggcggcatccctcactgctgcaagcgcacccccgccgtggtcgacctcctccccggggtgccctacaaccagcagatcgccaactgctgcaaggccggcgtcgtgtcggcgtacggccaggaccaggccggctccgtctccgcgttccaggtctccgtcggcctcgccggcaccaccaacaagacggtcaagctccccaagaacttcaccctcatgggtccggggccagggtacacctgcgggccggcgaccgtcgtcccgtccaccgtgtactggacgcccgaccaccggcgacggacgcaggcgctcatgacctggaccgtcacctgcacctactcgcagcagctggcgtccaagtacccgtcctgctgcgtctccttctcctccttctacaacgacaccatcgtgccctgcgccaagtgcgcctgcggctgcggccatggcggccacgccggaccgggaggctgcatcgagggggactccaagcgcgcgctgtcgccgggagtgaacacgccgcggaaggacgggcaggcgctgctgcagtgcacgccgcacatgtgccctgtccgtgtgcactggcatgtcaagctcaactacaaggactactggcgcgccaagatcgccatcaccaacttcaactacaggatgaactacacgcagtggacgctggtggcgcagcacccaaacctggacaatgtcaccgaggtcttcagcttccagtacaagccgctgctaccatacggcagcatcaatgacactggcatgttctacgggctcaagttctacaacgattttctgatggaggccgggccgttcgggaacgtgcagtcggaggtgctcatgcgcaaggacgccaggacattcaccttcagccagggatgggccttcccgcgcaagatctacttcaacggcgacgagtgcaagatgccgccgccggactcgtacccgtacctgcccaacgccgcgcccgtcgccgcctcgcagctggtcgtgtccgccgccgcctcagcgttcctactggcgctgctcctggtggcatga

SEQ ID NO: 930 - protein, 446 aa, Sorghum bicolor
  misc_feature (50)..(214): Pfam Name: COBRA Pfam Description: COBRA-like protein
  misc_feature (1)..(446): Ceres Annot ID no. 8640603
  misc_feature (1)..(446): Bit score of 1161.6 for HMM based on sequences of Figure 9
  misc_feature (1)..(446): Functional Homolog Of SEQ ID NO. 928
  misc_feature (1)..(446): in Figure 9
MGLRDSSVLLAALSLALAYCSVSVVAYDPLDPRGNITIKWDVISWTPDGYVAMVTMSNYQMYRHIMSPGWTVGWSWAKKEVIWSIVGAQATEQGDCSKFKGGIPHCCKRTPAVVDLLPGVPYNQQIANCCKAGVVSAYGQDQAGSVSAFQVSVGLAGTTNKTVKLPKNFTLMGPGPGYTCGPATVVPSTVYWTPDHRRRTQALMTWTVTCTYSQQLASKYPSCCVSFSSFYNDTIVPCAKCACGCGHGGHAGPGGCIEGDSKRALSPGVNTPRKDGQALLQCTPHMCPVRVHWHVKLNYKDYWRAKIAITNFNYRMNYTQWTLVAQHPNLDNVTEVFSFQYKPLLPYGSINDTGMFYGLKFYNDFLMEAGPFGNVQSEVLMRKDARTFTFSQGWAFPRKIYFNGDECKMPPPDSYPYLPNAAPVAASQLVVSAAASAFLLALLLVA

SEQ ID NO: 931 - DNA, 1684 bp, Zea mays
  misc_feature (1)..(1684): Ceres Clone ID no. 285169
  misc_feature (1)..(1684): Encodes the peptide sequence at SEQ ID NO. 932
attcgccctgcctctagctgctgcttcttccaggatcggggatcggagcttgtgctgctactgctactataccagcgctagctagcagcagccgccggccggctcgcgcaactaaggaagggtcgacatgacgatggggctccgcgtccgcgactcctccgcgctgctggctctggccgtcgcgctcgcctgctgctccgttgcagtggtggcctacgaccccctggacccgaacggcaacatcaccatcaagtgggacgtgatctcgtggacgcccgacgggtacgtggcgatggtgacgatgagcaactaccagatgtaccggcacatcatggcgcccgggtggacgttggggtggtcgtgggccaagaaggaggtgatctggtccatcgtgggggcgcaggccacggagcagggggactgctccaagttcaagggcggcatcccgcactgctgcaagcgcaccccggccgtggtggacctcctcccgggggtgccctacaaccagcagatcgccaactgctgcaaggccggcgtggtgtcggcgtacgggcaggacccggcggggtccgtctccgcgttccaggtctccgtcggcctggccggtaccaccaacaagacggtgaagctgcccaggaacttcacgctcatggggcccgggctgggctacacctgcgggcccgccgccgtggtgccgtccaccgtgtactggacgcccgaccaccggcgccggacgcaggcgctcatgacgtggacggtgacctgcacctactcgcagcagctggcgtcccggtacccgtcctgctgcgtctccttctcctccttctacaacagcaccatcgtgccgtgcgcccggtgcgcgtgcggctgcggcggccacggcggccacgcgggtccgggcggctgcatcgagggggactccaagcgcgcgctgtcggccggggtgaacacgccgcgcaaggacggccaggcgctgctgcagtgcacgccgcacatgtgccccatccgggtgcactggcacgtcaagctcaactacaaggactactggcgcgccaagatcgccatcaccaactacaactacaggatgaactacacgcagtggacgctggtggcgcagcaccccaacctggacaacgtcaccgaggtcttcagcttccagtacaagccgctgcaaccatacgggagcatcaatgacactggcatgttctacgggctcaagttctacaacgactttctcatggaggccggcccgttcggcaacgtgcagtcggaggtgctcatgcgcaaggacgcaaggaccttcaccttcagcatgggctgggcgttcccgcgcaagatctacttcaacggcgacgagtgcaagatgccgccgccggactcctacccctacctgcccaacgccgcgcccgtcgtcgcctcgcagctggtcctgtccgccgccgcctcggcgttcctactgttgctgctcctggtggcatgaccgtgaccgaaccaagggcaaggcctccgttttgttttcccgtctcgtcccgtgggcagggagcagacttcagtaggcagggcattttatttggtttttttgccaaggattcaacacttgggttttcgtcagaggaaaactgtcgtgtatgtagtgtgagttgcaggtcgtcggatccccacgtacaagacaatctttggatcg

SEQ ID NO: 932 - protein, 450 aa, Zea mays
  misc_feature (53)..(217): Pfam Name: COBRA Pfam Description: COBRA-like protein
  misc_feature (1)..(450): Ceres Clone ID no. 285169
  misc_feature (1)..(450): Bit score of 1157.4 for HMM based on sequences of Figure 9
  misc_feature (1)..(450): Functional Homolog Of SEQ ID NO. 928
  misc_feature (1)..(450): in Figure 9
MTMGLRVRDSSALLALAVALACCSVAVVAYDPLDPNGNITIKWDVISWTPDGYVAMVTMSNYQMYRHIMAPGWTLGWSWAKKEVIWSIVGAQATEQGDCSKFKGGIPHCCKRTPAVVDLLPGVPYNQQIANCCKAGVVSAYGQDPAGSVSAFQVSVGLAGTTNKTVKLPRNFTLMGPGLGYTCGPAAVVPSTVYWTPDHRRRTQALMTWTVTCTYSQQLASRYPSCCVSFSSFYNSTIVPCARCACGCGGHGGHAGPGGCIEGDSKRALSAGVNTPRKDGQALLQCTPHMCPIRVHWHVKLNYKDYWRAKIAITNYNYRMNYTQWTLVAQHPNLDNVTEVFSFQYKPLQPYGSINDTGMFYGLKFYNDFLMEAGPFGNVQSEVLMRKDARTFTFSMGWAFPRKIYFNGDECKMPPPDSYPYLPNAAPVVASQLVLSAAASAFLLLLLLVA

SEQ ID NO: 933 - protein, 441 aa, Oryza sativa subsp. japonica
  misc_feature (46)..(210): Pfam Name: COBRA Pfam Description: COBRA-like protein
  misc_feature (1)..(441): Public GI ID no. 125586664
  misc_feature (1)..(441): Bit score of 1149.8 for HMM based on sequences of Figure 9
  misc_feature (1)..(441): Functional Homolog Of SEQ ID NO. 928
  misc_feature (1)..(441): in Figure 9
MELHRCSLLALLLAVTCSVAVAYDPLDPKGNITIKWDVISWTPDGYVAMVTMSNYQMYRQILAPGWTVGWSWAKKEVIWSIVGAQATEQGDCSKFKGGIPHSCKRTPAIVDLLPGVPYNQQIANCCKAGVVSAYGQDPAGSVSAFQVSVGLAGTTNKTVKLPTNFTLAGPGPGYTCGPATIVPSTVYLTPDRRRRTQALMTWTVTCTYSQQLASRYPTCCVSFSSFYNSTIVPCASRRNSGGGGGHSGGTECIMGDSKRALSAGVNTPRKDGAPLLQCTSHMCPIRVHWHVKLNYKDYWRAKIAITNFNYRMNYTQWTLVAQHPNLNNVTEVFSFQYKPLLPYGNINDTGMFYGLKFYNDLLMEAGPFGNVQSEVLMRKDYNTFTFSQGWAFPRKIYFNGDECKMPPPDSYPYLPNSAPIGPPRSVAAAASAILVVLLLVA

SEQ ID NO: 934 - DNA, 1540 bp, Triticum aestivum
  misc_feature (1)..(1540): Ceres Clone ID no. 829440
  misc_feature (1)..(1540): Encodes the peptide sequence at SEQ ID NO. 935
gtattctaattttcgccctttaatcagctccatcgatggagctccccaactctatgctcctggctctgttcctcgcgatcacctgctccgtcgcagctgcgtatgatccgctggacccgacgggcaacattacgatcaagtgggacatccagtcatggacgccggacgggtacgtggcgatggtggcgatgaacaactaccagcagtaccgtcagatcatggcgccggggtggacgctggggtggtcgtgggccaagaaggaggtgatctggtccatcgtgggcgcgcaggccacggagcagggcgactgctccaagttcaagggcggcatcccgcactgctgcaagcacacgccctccgtcgtcgacctcctccccggcgtgccctacaaccagcagatcgccaactgctgccgcggcggcgtcgtctccgcctacggccaggacccggccggcgcgctctcggcgttccaggtctccgtggggctcgccggcaccaccaacaagacggtgaagctgcccaaaaacttcacgctcatggggcccgggctcggctacacctgcggccccgccaccgtcgtcccctccaccgtgtactggagcgccgaccaccgccgcaagacgcaggcgctgatgacctggacggtgacctgcacctactcgcagcagctggcgtcgaggtacccgacgtgctgcgtctccttctcctccttctacaacagcacgatcgtgccgtgcgcccggtgcgcgtgcggctgcggcgcgcacaagagcacgggcgggcgcggcggcaagagccacagcgacgggtgcatcgccggcgactccaagcgcgcgctgacccccggggtgaacacgcccaagaaggacggggcgcagctgctgcagtgcaccaaccacatgtgccccatccgcgtgcactggcacgtcaagctcaactacaaggactactggcgcgccaagatcgccgtcaccaacttcaactaccgcatgaactacacgcagtggacgctcgtcgctcagcacccgaacctcaacaacgtcacggaggtcttcagcttccagtacaagccgctcctgccatacggcaacatcaacgacaccggcatgttctacggcctcaagctctacaacgacctgctcatggaggccggcccgttcggcaacgtgcagtcggaggtgctcatgcgcaaggacgacgccaccttcaccttcggtcagggatgggctttcccgcgcaagatctacttcaacggcgatgagtgcaagatgccgccgccggactcgtacccgtacctgcccaactccgcgccgccgcgttcttccatcatcaccgctgctgcctcaacgtgcctggtgttgctgctcctgctcctggcggcgtgatctatatatcctggtgccacaattttcccattttgtaaaagacaacgcactgttgtaggtaggggcattttggtcttgcgagtattttaccttgtacaccaagatggtatgttcaagtgatttcatggtaatccttaagggaaacgttaccttcc

SEQ ID NO: 935 - protein, 449 aa, Triticum aestivum
  misc_feature (46)..(210): Pfam Name: COBRA Pfam Description: COBRA-like protein
  misc_feature (1)..(449): Ceres Clone ID no. 829440
  misc_feature (1)..(449): Bit score of 1151.6 for HMM based on sequences of Figure 9
  misc_feature (1)..(449): Functional Homolog Of SEQ ID NO. 928
  misc_feature (1)..(449): in Figure 9
MELPNSMLLALFLAITCSVAAAYDPLDPTGNITIKWDIQSWTPDGYVAMVAMNNYQQYRQIMAPGWTLGWSWAKKEVIWSIVGAQATEQGDCSKFKGGIPHCCKHTPSVVDLLPGVPYNQQIANCCRGGVVSAYGQDPAGALSAFQVSVGLAGTTNKTVKLPKNFTLMGPGLGYTCGPATVVPSTVYWSADHRRKTQALMTWTVTCTYSQQLASRYPTCCVSFSSFYNSTIVPCARCACGCGAHKSTGGRGGKSHSDGCIAGDSKRALTPGVNTPKKDGAQLLQCTNHMCPIRVHWHVKLNYKDYWRAKIAVTNFNYRMNYTQWTLVAQHPNLNNVTEVFSFQYKPLLPYGNINDTGMFYGLKLYNDLLMEAGPFGNVQSEVLMRKDDATFTFGQGWAFPRKIYFNGDECKMPPPDSYPYLPNSAPPRSSIITAAASTCLVLLLLLLAA

SEQ ID NO: 936 - protein, 453 aa, Populus balsamifera subsp. trichocarpa
  misc_feature (64)..(228): Pfam Name: COBRA Pfam Description: COBRA-like protein
  misc_feature (1)..(453): Public GI ID no. 118488472
  misc_feature (1)..(453): Bit score of 1173.8 for HMM based on sequences of Figure 9
  misc_feature (1)..(453): Functional Homolog Of SEQ ID NO. 928
  misc_feature (1)..(453): in Figure 9
MEFDKSAKDCYQSLQRSLLAEMKFIFLIALVFMIVPHAAAYDPLDPNGNITIKWDVMSWTPDGYVATVTMSNFQMYRHIISPGWTLSWSWAKKEVLWSMVGAQTTEQGDCSKFKGNIPHCCKKTPTVVDLLPGVPYNQQFSNCCKGGVMAAWGQDPTASVSAFQVSVGLAGTSNKTVKLPKNFTLLGPGPGYTCGPAKVVPSTVFLTPDRRRKTQALMTWNVTCTYSQFLASKNPTCCVSFSSFYNETITPCPTCACGCQNKNSCVKSNSKESHKKGINTPKKDNTPLLQCTHHMCPIRVHWHVKVNYRDYWRAKVAVTNFNYRMNYTEWTLVVQHPNLNNVTQVFSFDYKPLVPYESINDTGMFYGMKFYNDLLMEAGPFGNVQSEVLLQKDKNTFSLKQGWAFPRKVYFNGDECMLPPPDTYPYLPNSAYANPTSILSMAASLLLILLSMG

SEQ ID NO: 937 - protein, 440 aa, Cleome spinosa
  misc_feature (49)..(213): Pfam Name: COBRA Pfam Description: COBRA-like protein
  misc_feature (1)..(440): Public GI ID no. 90657534
  misc_feature (1)..(440): Bit score of 1174.3 for HMM based on sequences of Figure 9
  misc_feature (1)..(440): Functional Homolog Of SEQ ID NO. 928
  misc_feature (1)..(440): in Figure 9
MRLSISGFFFFFFFFFSVFIYCTSAYDPLDPNGNVTIKWDVMSWTPDGYVAVVAMNNFQMYRHIPNPGWTLGWTWAKKEVIWSMVGAQTTEQGDCSKFKGNVPHCCKKTPTLVDLLPGVPYNQQFSNCCKGGVVAAWGQDPSASVSQFQVSVGLAGTSNKTVKLPKNFTLLGPGLGYTCGPAKIVPSTIFLTPDKRRKTQALMTWNVTCTYSQFLARKHPSCCVSFSSFYNDTITPCPSCACGCESKKGCVKSDSKILSVKGINTPRKDNAPLLQCTHHMCPVRVHWHVKVNYKDYWRVKIAVTNFNYRMNFSLWTLAIQHPNLNNVTQVFSFDYKPLVPYESINDTGMFYGMKYYNDLLMEAGPFGNVQSEVLLQKDRNTFTFKQGWAFPRKVYFNGDECMLPPPDTYPFLPNSAHGNLSSLWTLPLALLLLLLLISIW

SEQ ID NO: 938 - protein, 462 aa, Vitis vinifera
  misc_feature (74)..(238): Pfam Name: COBRA Pfam Description: COBRA-like protein
  misc_feature (1)..(462): Public GI ID no. 225456557
  misc_feature (1)..(462): Bit score of 1161.1 for HMM based on sequences of Figure 9
  misc_feature (1)..(462): Functional Homolog Of SEQ ID NO. 928
  misc_feature (1)..(462): in Figure 9
MEFNNSANPVHHTPFEAKDRCQWQDCYSFRELKHIFSVVIFFMMVSHAIAYDPLDPTGNITIKWDVVSWTPDGYVALVTMNNFQMYRHIMTPGWTLSWSWAKKEVIWSMVGAQTTEQGDCSKFKANIPHCCEKTPTVVDLLPGVPYNQQIANCCKAGVVAAWGQDPAGSVSSFQVSVGQAGTSNKTVKLPKNFTLLGPGPGYTCGPAKIVPSTIYLTPDHRRKTQAMMTWNVTCTYSQFLASKNPTCCVSFSSFYNDTMTPCPSCACGCRNKNMCISSDSKKLKALHNPKRSNTPLLQCTHHMCPIRVHWHVKLNYKDYWRVKIAITNFNYRMNYTQWTLVAQHPNLNNVTQVFSFDYKPLVPYESINDTGMFYGMKFYNDLLVEAGQHGNVQSEVLLQKNKDTFTFKQGWAFPRKVYFNGDECKLPPPDTYPFLPNSAHANPFAFWTMAAPLLLMILYTIW

SEQ ID NO: 939 - DNA, 1296 bp, Arabidopsis thaliana
  misc_feature (1)..(1296): Ceres Annot ID no. 1355066
  misc_feature (1)..(1296): Encodes the peptide sequence at SEQ ID NO. 940
atgaggctcctcttcagcttctgcttcttcttcttcatgatcatctttaccgcaactgcttatgatccattagatcctagtggtaacattacaatcaaatgggatattatgtcctggacggcagatggctatgtggctacggtaactatgaacaacttccaaatctaccggcacatacaaaaccctggttggacattaggttggacatgggcaaagaaagaggtgatttggtcaatggttggtgcacaaacaacagaacaaggagactgttccaagtttaagggaaatgtacctcattgctgtaagaaaacccctacagttgttgatctcttgccaggtgtgccttataatcaacagttctcaaactgttgcaaaggaggtgtaattggagcttggggtcaagatccatcagccgctgtatcccagtttcaggttagtgctggtttagctggaactacaaacaagactgtcaagcttcctaagaacttcactttgcttggtcccggccctggttacacttgcggtcctgccaaaatcgtgccctctaccgtttttctcacaactgacaaacggcgaaaaacacaagctttgatgacatggaatgttacctgcacatactcacagtttttagcaagaaagcatccaagctgttgtgtctccttctcttctttctacaacgacaccataactccttgcccgtcttgtgcctgtggctgcgagaacaaaaagagctgcgtcaaggctgattctaagattctaaccaagaaaggtctcaacacaccaaaaaaggacaacactcctttgttgcaatgcacacatcacatgtgccctgttagagtccactggcacgttaaaactaactacaaagactattggcgagtgaagatagcaatcacaaatttcaattaccggatgaatcatacactctggactttagcaattcagcatccaaatctcaacaatgtgactcaagttttcagctttgactacaaaccagtctctccttacggatccataaatgatactggaatgttctatggaacgaagttttacaatgatttattaatggaagctggaccttcagggaatgtgcaatcagaggttttgctacagaaagatcaaaagacttttactttcaagcaaggttgggcttttcctagaaaagtttactttaatggtgatgaatgtatgttacctccaccagattcatacccttttctaccaaactctgcacaagggaactttgcttcgttctcactcaccattcttcttctcctattcatctcaatatggtga

SEQ ID NO: 940 - protein, 431 aa, Arabidopsis thaliana
  misc_feature (44)..(208): Pfam Name: COBRA Pfam Description: COBRA-like protein
  misc_feature (1)..(431): Ceres Annot ID no. 1355066
  misc_feature (1)..(431): Bit score of 1151.0 for HMM based on sequences of Figure 9
  misc_feature (1)..(431): Functional Homolog Of SEQ ID NO. 928
  misc_feature (1)..(431): in Figure 9
MRLLFSFCFFFFMIIFTATAYDPLDPSGNITIKWDIMSWTADGYVATVTMNNFQIYRHIQNPGWTLGWTWAKKEVIWSMVGAQTTEQGDCSKFKGNVPHCCKKTPTVVDLLPGVPYNQQFSNCCKGGVIGAWGQDPSAAVSQFQVSAGLAGTTNKTVKLPKNFTLLGPGPGYTCGPAKIVPSTVFLTTDKRRKTQALMTWNVTCTYSQFLARKHPSCCVSFSSFYNDTITPCPSCACGCENKKSCVKADSKILTKKGLNTPKKDNTPLLQCTHHMCPVRVHWHVKTNYKDYWRVKIAITNFNYRMNHTLWTLAIQHPNLNNVTQVFSFDYKPVSPYGSINDTGMFYGTKFYNDLLMEAGPSGNVQSEVLLQKDQKTFTFKQGWAFPRKVYFNGDECMLPPPDSYPFLPNSAQGNFASFSLTILLLLFISIW

SEQ ID NO: 941 - protein, 463 aa, Phaseolus vulgaris
  misc_feature (75)..(239): Pfam Name: COBRA Pfam Description: COBRA-like protein
  misc_feature (1)..(463): Public GI ID no. 38194917
  misc_feature (1)..(463): Bit score of 1159.5 for HMM based on sequences of Figure 9
  misc_feature (1)..(463): Functional Homolog Of SEQ ID NO. 928
  misc_feature (1)..(463): in Figure 9
MRLVISAAVCVLVLFSYAGEITSTLYAEFASLSFTFHTRPTDFLMFLIVAAYDPLDPNGNVTIKWDVVSWTPDGYVAVVTMSNFQMFRHIMNPGWTLSWSWAKKEVIWSMVGAQTTEQGDCSKFKGNVPHCCKKTPTVVDLLPGVPYNQQFSNCCKGGVVAAWGQDPSSAVSSFQVSIGLAGTSNKTVKLPKNFTLLGPGPGYTCGPAKVVPSTVFLTADKRRKTQALMTWNVTCTYSQFLARKNPGCCVSLSSFYNETITPCPSCACGCQNKRNCIKSDSKRINMVGIHTPKKDNEPLLQCTHHMCPIRVHWHVKLNYMDYWRVKVAVTNFNYRMNYSLWTLAVQHPNLNNVTQVFSFDYKPILPYESINDTGMFYGMKYFNDLLMEAGPTGNVQSEILLQKDKDTFTLKQGWAFPRKVYFNGEECMLPPPDTYPILPNSAPVNLLNFTVFILTMLVMLALW

SEQ ID NO: 942 - DNA, 1587 bp, Glycine max
  misc_feature (1)..(1587): Ceres Clone ID no. 1237946
  misc_feature (1)..(1587): Encodes the peptide sequence at SEQ ID NO. 943
aaaacttttgtcactgaaggtgtcttggagccaattgtagcagttggtaacatcaaacacatattcagacaatgaggcttgtcgtctcagctctttgtgttcttgtgttattctcttgtgcagttgcttatgatcctttggatccaaacggaaacgtaacaatcaaatgggatgtaatgtcttggacaccagatggctatgtggctgtggtaacaatgcacaacttccaaatgtttcggcacatcatgaatcctggatggaccttgggatggacatgggcaaagaaagaagtcatttggtccatgataggagctcaaaccacagaacaaggagattgctctaagttcaaaggcaacatacctcattgctgcaagaaaattcccacagttgtggaccttctccctggtgtaccttacaaccagcaattctcaaactgctgcaagggtggagtagtggcagcatggggccaagatccttcacaagctatctcttccttccaagtgagtgtaggccaagctggtacctcaaacaagacagttaaacttcccaagaacttcactctctttgctccaggaccaggctacacttgtggccctgcaaagattgttccttccaccaattttcttacgcctgacaagcgccgcaagactcaagcactaatgacatggaatgttacctgcacatactcacagtttctggcaagaaagaacccaagttgttgtgtatctttgtcatccttttacaatgaaaccattaccccttgtccctcttgtgcatgtggctgccagaacaagaagcattgtgtcaagggaaactccaaaattctcagcatggtgggggttcacactccaaagaaagacaatgaaccattgctgcagtgcactcatcacatgtgtccaatcagggtccactggcatgtgaagactaactataaggactattggcgagtcaaggttgccataacaaacttcaattacagaatgaatcactccctttggtctcttgctgttcagcatccaaatctcaacaatctcacacaagttttcagtttcaattacaagccacttcttccctatggatccataaatgatactggcatgttctatggcatgaagtacttcaatgatcttctaatggaagctggaccaactgggaatgttcaatcagagttgcttcttcagaaggacaaggatgcattcacattcaagcagggttgggcatttcctcgcaaggtttactttaatggtgatgaatgcatgctgccaccacctgacacctacccttttctccctaactctgctcctgcaagcctacttaacttccctgcgttcatgttgttattgttcttcttgcttgcagtttggtgaattggtgcatattgtgtcagaattttgtgaaatttttgaaaccatgtataccttcttaatggtaacgtgacaataggcatgaatactcaaattctttggaaacactaagccaaatctcatggctgtgttttatctgacatgtgagcaccaaaggggatgctaatatgtaaatctcaacagtgattttgtctgaatcatagattgatgatgctattactcc

SEQ ID NO: 943 - protein, 431 aa, Glycine max
  misc_feature (43)..(207): Pfam Name: COBRA Pfam Description: COBRA-like protein
  misc_feature (1)..(431): Ceres Clone ID no. 1237946
  misc_feature (1)..(431): Bit score of 1157.6 for HMM based on sequences of Figure 9
  misc_feature (1)..(431): Functional Homolog Of SEQ ID NO. 928
  misc_feature (1)..(431): in Figure 9
MRLVVSALCVLVLFSCAVAYDPLDPNGNVTIKWDVMSWTPDGYVAVVTMHNFQMFRHIMNPGWTLGWTWAKKEVIWSMIGAQTTEQGDCSKFKGNIPHCCKKIPTVVDLLPGVPYNQQFSNCCKGGVVAAWGQDPSQAISSFQVSVGQAGTSNKTVKLPKNFTLFAPGPGYTCGPAKIVPSTNFLTPDKRRKTQALMTWNVTCTYSQFLARKNPSCCVSLSSFYNETITPCPSCACGCQNKKHCVKGNSKILSMVGVHTPKKDNEPLLQCTHHMCPIRVHWHVKTNYKDYWRVKVAITNFNYRMNHSLWSLAVQHPNLNNLTQVFSFNYKPLLPYGSINDTGMFYGMKYFNDLLMEAGPTGNVQSELLLQKDKDAFTFKQGWAFPRKVYFNGDECMLPPPDTYPFLPNSAPASLLNFPAFMLLLFFLLAVW

SEQ ID NO: 944 - protein, 460 aa, Vitis vinifera
  misc_feature (72)..(236): Pfam Name: COBRA Pfam Description: COBRA-like protein
  misc_feature (1)..(460): Public GI ID no. 157341292
  misc_feature (1)..(460): Bit score of 1154.8 for HMM based on sequences of Figure 9
  misc_feature (1)..(460): Functional Homolog Of SEQ ID NO. 928
  misc_feature (1)..(460): in Figure 9
MRFVISAFFFLMMFSYTGELLDGSQASIRFNFVPLVQFSCSVFVYAAAYDPLDPNGNITIKWDIMSWTPDGYVAVVTMHNFQMYRHIISPGWTLGWTWAKKEVIWSMVGAQTTEQGDCSKFKGNIPHCCKKTPTVVDLLPGVPYNQQFSNCCKGGVVSSWGQDPAASVSAFQVSVGLAGTSNKTVKLPKNFTLLGPGPGYTCGIAKIVPPTNFLTPDRRRKTQALMTWNVTCTYSQLRARKNPSCCVSFSSFYNETITPCPSCACGCQNKNNCVQSDSKLLSMVGINTPRKDNVPLLQCTHHMCPVRVHWHLKINYKDYWRVKVSITNFNYRLNYTLWTLVVQHPNLNNVTQVFSFDYKPLVPYESINDTGMFYGMKFYNDQLMEAGPFGNVQSEVLFQKDNSFTFKQGWAFPRKVYFNGDECMLPLPETYPFLPNSAHQNLLAFSTFISSVIFLLVTVW

SEQ ID NO: 945 - protein, 468 aa, Oryza sativa subsp. japonica
  misc_feature (46)..(210): Pfam Name: COBRA Pfam Description: COBRA-like protein
  misc_feature (1)..(468): Public GI ID no. 115453531
  misc_feature (1)..(468): Bit score of 1154.3 for HMM based on sequences of Figure 9
  misc_feature (1)..(468): Functional Homolog Of SEQ ID NO. 928
MELHRCSLLALLLAVTCSVAVAYDPLDPKGNITIKWDVISWTPDGYVAMVTMSNYQMYRQILAPGWTVGWSWAKKEVIWSIVGAQATEQGDCSKFKGGIPHSCKRTPAIVDLLPGVPYNQQIANCCKAGVVSAYGQDPAGSVSAFQVSVGLAGTTNKTVKLPTNFTLAGPGPGYTCGPATIVPSTVYLTPDRRRRTQALMTWTVTCTYSQQLASRYPTCCVSFSSFYNSTIVPCARCACGCGHDGYRGNGGGGKNARAGDGRSRRNSGGGGGHSGGTECIMGDSKRALSAGVNTPRKDGAPLLQCTSHMCPIRVHWHVKLNYKDYWRAKIAITNFNYRMNYTQWTLVAQHPNLNNVTEVFSFQYKPLLPYGNINDTGMFYGLKFYNDLLMEAGPFGNVQSEVLMRKDYNTFTFSQGWAFPRKIYFNGDECKMPPPDSYPYLPNSAPIGPPRSVAAAASAILVVLLLVA

SEQ ID NO: 946 - DNA, 1576 bp, Panicum virgatum
  misc_feature (1)..(1576): Ceres Clone ID no. 1804732
  misc_feature (1)..(1576): Encodes the peptide sequence at SEQ ID NO. 947
aaccaaatgcggcgtcctgctggtgtggtctagcgagccgcgtggtgcttgggctccgttcgttccgttgaggctcgcgtcgatctagcgatggagccccggtgctccgtgatggtcctggccctcgccgccgcgctatccgtcgcagtggcttacgacccgctggacccgaacgggaacattaccatcaaatgggacatcatgtcgtggacgcctgacggctatgtcgcggtggtgacgatcaacaacttccagatgtaccggcagatcatggcgccggggtggacggtggggtggacgtgggccaagaaggaggtgatctggtccatggtgggcgcgcaggccacggagcagggcgactgctcccgcttcaagggcaacatcccgcactgctgcaagcgcacccccgccgtcgtggacctgctgcccggcgtgccctacaaccagcagatcgccaactgctgccggggcggcgtcatcagcgcctacggccaggaccccggcgccgccgtcgccgcgttccaggtcagcgtcggccaggccggcaccaccaaccgcaccgtcaaggtgcccaagaacttcacgctgctcggccccggccctgggtacacctgcggccccgccaaggtcgtcccctccaccgtcttcctcacgcccgaccgccgccgcaagacccaggcactcatgacgtggaacgtgacgtgcacctactcgcagtacctggcgtccaagtacccgtcctgctgcgtctctttctcctccttctacaacgacaccatcgtgccctgcgccaagtgcgcctgcggctgcgagcacaagacctgcgtccagggcgactcgaagcggccgctggcggtgacggggaagcacacgcacgcggcggcgacgcgcgggcaccgggacaaggaggcgccgctgctgcagtgcacgacgcacatgtgccccgtgcgcgtgcactggcacgtcaagctcaactacaaggagtactggcgcgccaagatcgccatcaccaacttcaactaccgcatgaactacacgcagtggacgctcgtcgcgcagcaccccaacctcgacaacatcaccgaggtcttcagcttcgactacaagcccgtcgttgcctacggatccatcaatgacacggccatgttctacgggctcaagtacttcaacgaccacctcatgcaggcggggccgtacgggaacgtgcagtcggaggtgctcatgcgcaaggacgccagcaccttcaccttcaggcagggctgggcgttcccgcgcaaggtctacttcaacggcgatgagtgccagatgccgccgccggacgcctacccctacctgcccaacgccgccctgccggcccccgtggcgtcgctgggcgccgcggtggtggccgtcgtggcgttcctggtgctggtcgtggtatgagacatgagaaaaacacaggagagcgatcgacctagcgctagaatcggccggcatggggagaaaaagacgacgatgttttgctctgtagatacagtcgacgttttgacttttgagtttcaggattggtttggatatctaagtttttttttctttc

SEQ ID NO: 947 - protein, 443 aa, Panicum virgatum
  misc_feature (45)..(209): Pfam Name: COBRA Pfam Description: COBRA-like protein
  misc_feature (1)..(443): Ceres Clone ID no. 1804732
  misc_feature (1)..(443): Bit score of 1057.6 for HMM based on sequences of Figure 9
  misc_feature (1)..(443): Functional Homolog Of SEQ ID NO. 928
MEPRCSVMVLALAAALSVAVAYDPLDPNGNITIKWDIMSWTPDGYVAVVTINNFQMYRQIMAPGWTVGWTWAKKEVIWSMVGAQATEQGDCSRFKGNIPHCCKRTPAVVDLLPGVPYNQQIANCCRGGVISAYGQDPGAAVAAFQVSVGQAGTTNRTVKVPKNFTLLGPGPGYTCGPAKVVPSTVFLTPDRRRKTQALMTWNVTCTYSQYLASKYPSCCVSFSSFYNDTIVPCAKCACGCEHKTCVQGDSKRPLAVTGKHTHAAATRGHRDKEAPLLQCTTHMCPVRVHWHVKLNYKEYWRAKIAITNFNYRMNYTQWTLVAQHPNLDNITEVFSFDYKPVVAYGSINDTAMFYGLKYFNDHLMQAGPYGNVQSEVLMRKDASTFTFRQGWAFPRKVYFNGDECQMPPPDAYPYLPNAALPAPVASLGAAVVAVVAFLVLVVV

SEQ ID NO: 948 - DNA, 1341 bp, Sorghum bicolor
  misc_feature (1)..(1341): Ceres Annot ID no. 8656625
  misc_feature (1)..(1341): Encodes the peptide sequence at SEQ ID NO. 949
atggagccccgatgcttcgtgctggtcctggccctcgccgccgcgctctccgtcgcagtggcttacgacccgttggacccgaacgggaacattaccatcaaatgggacatcatgtcgtggacgcctgacggctatgtcgcggtggtgaccatcaacaacttccagatgtaccggcagatcatggcgccggggtggacggtggggtggacgtgggcgaagcgtgaggtgatctggtccatggtgggcgcgcaggcgacggagcagggcgactgctcccgcttcaaggccaacatcccgcactgctgcaagcgcacgcccaccgtcgtcgacctgctccccggcgtgccctacaaccagcagatcgccaactgctgccgcggcggcgtcatcagcgcctacggccaggacccggcctccgccgtcgccgcgttccaggtcagcgtcggccaggccggcaccaccaaccgcaccgtcaaggttcccaagaacttcacgctgcttgggccagggccagggtacacctgcggccccggcaagattgttccctccaccgtcttcctcacgcccgaccgccggcgcaagacacaagccctcatgacgtggaacgtgacgtgcacctactcgcagcacctggcgtccaagtacccgtcctgctgcgtctccttctcctccttctacaacgacaccatcgtgccctgcgccaagtgcgcctgcggctgcgagcacaagacctgcgtccagggcgactcgaagcggctggcggtgacggggaagcacgagcacgcgcacgcggcggcggcgcgcgggcacagggacaaggaggcgccgctgctgcagtgcacgacgcacatgtgccccgtgcgcgtgcactggcacgtcaagctcaactacaaggagtactggcgggccaagatcgccatcaccaacttcaactaccacatgaactacacgcagtggacgctcgtcgcgcagcaccccaacctcgacaacatcaccgaggtcttcagcttcgactacaagcctgtcgtcgcctacggatccatcaatgacacggcgatgttctacgggctcaagtacttcaacgaccacctgatgcaggcggggccgtacgggaacgtgcagtcggaggtgctgatgcgcaaggacgccagcaccttcaccttcaggcagggctgggcgttcccgcgcaaggtctacttcaacggcgacgagtgccagatgccgccgccggacgagtatccctacttgcccaactcagccctgccggcagccgcggcgtcgtcgtcgctgggcgctgcggtagcggccgtcgtggtgctcttggtgatgatcgtggcatga

SEQ ID NO: 949 - protein, 446 aa, Sorghum bicolor
  misc_feature (45)..(209): Pfam Name: COBRA Pfam Description: COBRA-like protein
  misc_feature (1)..(446): Ceres Annot ID no. 8656625
  misc_feature (1)..(446): Bit score of 1052.2 for HMM based on sequences of Figure 9
  misc_feature (1)..(446): Functional Homolog Of SEQ ID NO. 928
MEPRCFVLVLALAAALSVAVAYDPLDPNGNITIKWDIMSWTPDGYVAVVTINNFQMYRQIMAPGWTVGWTWAKREVIWSMVGAQATEQGDCSRFKANIPHCCKRTPTVVDLLPGVPYNQQIANCCRGGVISAYGQDPASAVAAFQVSVGQAGTTNRTVKVPKNFTLLGPGPGYTCGPGKIVPSTVFLTPDRRRKTQALMTWNVTCTYSQHLASKYPSCCVSFSSFYNDTIVPCAKCACGCEHKTCVQGDSKRLAVTGKHEHAHAAAARGHRDKEAPLLQCTTHMCPVRVHWHVKLNYKEYWRAKIAITNFNYHMNYTQWTLVAQHPNLDNITEVFSFDYKPVVAYGSINDTAMFYGLKYFNDHLMQAGPYGNVQSEVLMRKDASTFTFRQGWAFPRKVYFNGDECQMPPPDEYPYLPNSALPAAAASSSLGAAVAAVVVLLVMIVA

SEQ ID NO: 950 - protein, 447 aa, Zea mays
  misc_feature (47)..(211): Pfam Name: COBRA Pfam Description: COBRA-like protein
  misc_feature (1)..(447): Public GI ID no. 162462515
  misc_feature (1)..(447): Bit score of 1046.2 for HMM based on sequences of Figure 9
  misc_feature (1)..(447): Functional Homolog Of SEQ ID NO. 928
MEPRRSVLLLALAVAAALSVAVAYDPLDPNGNITIKWDIMSWTPDGYVAVVTINNFQTYRQITAPGWTVGWTWAKREVIWSMVGAQATEQGDCSRFKANIPHCCKRTPAVVDLLPGVPYNQQIANCCRGGVVSAYGQDPATAVAAFQVSVGQAGTTNRTVKVPKNFTLLGPGPGYTCGPGKVVPSTVFLTPDRRRKTQALMTWNVTCTYSQHLASKYPSCCVSFSSFYNDTIVPCAKCACGCEHKTCVQGDSKRLAVTGKHAHTAAAVRGQHRDKEAPLLQCTTHMCPVRVHWHVKLNYKEYWRAKIAITNFNYHMNYTQWTLVAQHPNLDNITEVFSFGYKPVVSYGSINDTAMFYGLKYFNDHLMQAGPYGNVQSEVLMRKDASTFTFRQGWAFPRKVYFNGDECQMPPPDAYPYLPNSAPPTAAASLGGAAAAAVVVLLGMIVA

SEQ ID NO: 951 - DNA, 1529 bp, Sorghum bicolor
  misc_feature (1)..(1529): Ceres Clone ID no. 570485
  misc_feature (1)..(1529): Encodes the peptide sequence at SEQ ID NO. 952
atctgcgccttctggtgagagtacgtgtgttggttgttcttgcaggcacttgcacgcgtggtcaccatggagctgccccacgccgcgctcgcgctgatcgtcgccgcggccgccacgctctccgtcgcagtggcctacgacccgctggatcccaacgggaacatcaccatcaaatgggacgttctctcgtggacgccagacggatacgtcgcgacggtgacgatcaacaacttccagacgtaccggcagatcatggcgccggggtggacggtggggtggacgtgggcgaagcgggaggtgatctggtccatggtgggcgcgcaggccacggagcagggcgactgctccaagttcaaggccaacctcccgcactcgtgcaagcgcacccccgccgtcgtcgacctgctcccgggcgtgccctacaaccagcagatcgccaactgctgccgcggcggcgtcgtctccgcctacggccaggacccgtccggcgccgtgtcctccttccaggtcagcgtcggccaggccggcaccaccaaccgcaccgtcaaggtccccaagaacttcaccctcctcggccccggcccaggctacacctgcggccccgccaaggtcgtcccctccaccgtcttcctcaccgccgaccaccgccgcaagacccaggccctcatgacgtggaacgtgacgtgcacctactcgcagcacctggcgtccaagtacccgacctgctgcgtctccttctcctccttctacaacgacaccatcgtgccctgcgccaagtgcgcgtgcggctgcgagcacaagacctgcgcccgcagcgagcgggactcgaagcggctcatgtcggcgtcggggaagagcagcgcgcacgcggtcaccgcggtgcgcgggcacgtgaaccggcagagcgcggcgccgctgctgcagtgcacgacccacatgtgccccgtgcgcgtccactggcacgtcaagctcaactaccacgactactggcgcgccaaggtgaccgtcaccaacttcaactaccgcaccaactacaccggctggacgctcgtcgcccagcaccccaacctcgacaacatcaccgaggtcttcagcttcgactacaagcccgtcgtctcctacggctccatcaatgatacggcgctgttctacgggatgaagttcttcaacgaccagctcatggaggcggggccgtacgggaacgtgcagtcggaggtgctgatgcgcaaggacgccagcacattcacgttcaggcaggggtgggcgttcccgcggaagatctacttcaacggcgacgagtgccggatgccgccgccggactcctacccttacctgcccaactccgcgccggcgtcgctcgtgagctccgcctccgtcgtcgtcgccttcttggttctactcatggcatgagcgtcggaggcggccatgatgttttgcctgtagatcataggagaacgttttgggcttcaaggttgagatcggtggtgttttaatctggatataattaaacgcaagtttttccccattac

SEQ ID NO: 952 - protein, 447 aa, Sorghum bicolor
  misc_feature (47)..(211): Pfam Name: COBRA Pfam Description: COBRA-like protein
  misc_feature (1)..(447): Ceres Clone ID no. 570485
  misc_feature (1)..(447): Bit score of 1044.6 for HMM based on sequences of Figure 9
  misc_feature (1)..(447): Functional Homolog Of SEQ ID NO. 928
MELPHAALALIVAAAATLSVAVAYDPLDPNGNITIKWDVLSWTPDGYVATVTINNFQTYRQIMAPGWTVGWTWAKREVIWSMVGAQATEQGDCSKFKANLPHSCKRTPAVVDLLPGVPYNQQIANCCRGGVVSAYGQDPSGAVSSFQVSVGQAGTTNRTVKVPKNFTLLGPGPGYTCGPAKVVPSTVFLTADHRRKTQALMTWNVTCTYSQHLASKYPTCCVSFSSFYNDTIVPCAKCACGCEHKTCARSERDSKRLMSASGKSSAHAVTAVRGHVNRQSAAPLLQCTTHMCPVRVHWHVKLNYHDYWRAKVTVTNFNYRTNYTGWTLVAQHPNLDNITEVFSFDYKPVVSYGSINDTALFYGMKFFNDQLMEAGPYGNVQSEVLMRKDASTFTFRQGWAFPRKIYFNGDECRMPPPDSYPYLPNSAPASLVSSASVVVAFLVLLMA

SEQ ID NO: 953 - protein, 451 aa, Oryza sativa subsp. japonica
  misc_feature (45)..(209): Pfam Name: COBRA Pfam Description: COBRA-like protein
  misc_feature (1)..(451): Public GI ID no. 75133694
  misc_feature (1)..(451): Bit score of 1006.5 for HMM based on sequences of Figure 9
  misc_feature (1)..(451): Functional Homolog Of SEQ ID NO. 928
MAVLGSLLLLILAATLSVAVAYDPLDPNGNITIKWDVMSWTPDGYVAMVTINNYQTYRQIMAPGWTVGWTWARQEVIWSMVGAQATDQGDCSRFKANLPHCCRRTPAVVDLLPGVPYNQQIANCCRGGVLPAYGQAPSAAAAAFQVSVGQAGTTNRTVRLPRNFTLLGPGPGYTCGRARVVPSTVFLTADRRRKTQALMTWNVTCTYSQHLASKYPSCCVSFSSFYNDTIVPCAKCACGCDAHKPCVRSERDGKRLAVTGKKHDANANAHGRGNGVAAAAMAAPLLQCTTHMCPVRVHWHVKLNYREYWRAKITIVNFNYRMNYTGWTLVAQHPNLDNITEVFSFDYKPVVSYGSINDTAMFYGLKYFNDQLMEAGPHGNVQSEVLMRKDARTFTFRQGWAFPRKVYFNGDECQMPPPDSYPYLPNAAPPAAASLVGSAVAMAALVFFLMA

SEQ ID NO: 954 - protein, 473 aa, Oryza sativa subsp. japonica
  misc_feature (45)..(231): Pfam Name: COBRA Pfam Description: COBRA-like protein
  misc_feature (1)..(473): Public GI ID no. 115473243
  misc_feature (1)..(473): Bit score of 971.2 for HMM based on sequences of Figure 9
  misc_feature (1)..(473): Functional Homolog Of SEQ ID NO. 928
MAVLGSLLLLILAATLSVAVAYDPLDPNGNITIKWDVMSWTPDGYVAMVTINNYQTYRQIMAPGWTVGWTWARQEVIWSMVGAQATDQGDCSRFKANLPHCCRRTPAVVDLLPGVPYNQQIANCCRGGVLPAYGQAPSAAAAAFQVSVGQAGTTNRTVRLPRNFTLLGPGPGYTCGRARVVPSTVFLTADRRRKTQALSKLTTPSSSSPAPPLMMSCLCAVTWNVTCTYSQHLASKYPSCCVSFSSFYNDTIVPCAKCACGCDAHKPCVRSERDGKRLAVTGKKHDANANAHGRGNGVAAAAMAAPLLQCTTHMCPVRVHWHVKLNYREYWRAKITIVNFNYRMNYTGWTLVAQHPNLDNITEVFSFDYKPVVSYGSINDTAMFYGLKYFNDQLMEAGPHGNVQSEVLMRKDARTFTFRQGWAFPRKVYFNGDECQMPPPDSYPYLPNAAPPAAASLVGSAVAMAALVFFLMA

SEQ ID NO: 955 - protein, 499 aa, Oryza sativa subsp. indica
  misc_feature (45)..(231): Pfam Name: COBRA Pfam Description: COBRA-like protein
  misc_feature (1)..(499): Public GI ID no. 125559102
  misc_feature (1)..(499): Bit score of 949.4 for HMM based on sequences of Figure 9
  misc_feature (1)..(499): Functional Homolog Of SEQ ID NO. 928
MAVLGSLLLLILAATLSVAVAYDPLDPNGNITIKWDVMSWTPDGYVAMVTINNYQTYRQIMAPGWTVGWTWARQEVIWSMVGAQATDQGDCSRFKANLPHCCRRTPAVVDLLPGVPYNQQIANCCRGGVLPAYGQAPSAAAAAFQVSVGQAGTTNRTVRLPRNFTLLGPGPGYTCGRARVVPSTVFLTADRRRKTQALSKLTTPSSSSPAPPLMMSCLCAVTWNVTCTYSQHLASKYPSCCVSFSSFYNDTIVPCAKCACGCDAHKPCVGTYARRAAAAAADDDELTAFSRRDVCRSERDGKRLAVTGKKHDANANAHGRGNGVAAAAMAAPLLQCTTHMCPVRVHWHVKLNYREYWRAKITIVNFNYRMNYTGWTLVAQHPNLDNITEVFSFDYKPVVSYGSINDTAMFYGLKYFNDQLMEAGPHGNVQSEVLMRKDARTFTFRQGWAFPRKVYFNGDECQMPPPDSYPYLPNAAPPAAASLVGSAVAMAALVFFLMA

SEQ ID NO: 956 - DNA, 1296 bp, Populus balsamifera subsp. trichocarpa
  misc_feature (1)..(1296): Ceres Annot ID no. 1450186
  misc_feature (1)..(1296): Encodes the peptide sequence at SEQ ID NO. 957
atgagatttctcttctttattgtcttgtttcttgtgctcttttcttgttcaggtgcatatgatcctttggatccaactggaaatgtaacaataaaatgggatattatgtcttggacgacagatggctatattgcaattgtaacattgttcaacttccaaacgttccggcacttcatgaaacctggatggaccataggctggacatgggcaaagaaagaaatcatatggtccatcaatggtgctcaagcggttgaacaaggcgactgctccaagttcaaagcaaacatacctcattcctgcaagagaagccctgcagttgtggacttgcttcccggtgctcctttcaaccagcaattcggtaattgttgcaaaggcggagtagtggcagcatggggcaaagatccttcagctgctgtctctcaatttcagattactgttggattatccggtacttcaaataaaacagtgaaacttccaaagagcttcaccttgttaggtccaggaccaggatacacttgtggccctccaaagatggtgccttccaccaagtttcttactcctgatggtctgcgaagaactcaggccctgttgacttggaatgttacctgcacttactcacaattcatggcaagaaaaaacccaagttgctgtgtatctctttcatctttctacaatcagatactcactccctgcccaacttgtgcgtgcggttgccaaaacaatgacacttgtgtcaatggcgattccagaattcttcaattgccggtaggaaacacaacccggaaagataatagctctcttctgcaatgcacacaccatatgtgcccggttcgagtgcactggcatgtgaaggtgaactataaggagtactggcgtgtcaagattgcgatcacaaatttcaactacatgaagaactactcgacttggaccctcgttgtacagcatccgaatctcaacaacgtaacgcaagtttttagcttcgagtacaaacctctcattgcctatgactcgataaatgacacagggatgttctatggcatgaaggactacaatgacgtattaatggaagcagggccacttggaaatcttcaatctgaggtgcttcttcagaaggaccagaacactttcaccttcaagcagggatgggcatttccacggaaagtctacttcaatggcgatgagtgcatggtacccccgccagatacatacccatttctgcccaattctgctcatggatccccacacttctccatgttgatttctacgttgattttcctgttcgtgtatatctggtaa

SEQ ID NO: 957 - protein, 431 aa, Populus balsamifera subsp. trichocarpa
  misc_feature (43)..(207): Pfam Name: COBRA Pfam Description: COBRA-like protein
  misc_feature (1)..(431): Ceres Annot ID no. 1450186
  misc_feature (1)..(431): Bit score of 1003.5 for HMM based on sequences of Figure 9
  misc_feature (1)..(431): Functional Homolog Of SEQ ID NO. 928
MRFLFFIVLFLVLFSCSGAYDPLDPTGNVTIKWDIMSWTTDGYIAIVTLFNFQTFRHFMKPGWTIGWTWAKKEIIWSINGAQAVEQGDCSKFKANIPHSCKRSPAVVDLLPGAPFNQQFGNCCKGGVVAAWGKDPSAAVSQFQITVGLSGTSNKTVKLPKSFTLLGPGPGYTCGPPKMVPSTKFLTPDGLRRTQALLTWNVTCTYSQFMARKNPSCCVSLSSFYNQILTPCPTCACGCQNNDTCVNGDSRILQLPVGNTTRKDNSSLLQCTHHMCPVRVHWHVKVNYKEYWRVKIAITNFNYMKNYSTWTLVVQHPNLNNVTQVFSFEYKPLIAYDSINDTGMFYGMKDYNDVLMEAGPLGNLQSEVLLQKDQNTFTFKQGWAFPRKVYFNGDECMVPPPDTYPFLPNSAHGSPHFSMLISTLIFLFVYIW

SEQ ID NO: 958 - protein, 456 aa, Oryza sativa subsp. indica
  misc_feature (59)..(223): Pfam Name: COBRA Pfam Description: COBRA-like protein
  misc_feature (1)..(456): Public GI ID no. 125552171
  misc_feature (1)..(456): Bit score of 928.0 for HMM based on sequences of Figure 9
  misc_feature (1)..(456): Functional Homolog Of SEQ ID NO. 928
MAVGGAGSSRSVAPCCCAVLLAAALLFSAPATTEAYDALDPNGNITIKWDVMSWTPDGYVAVVTMFNYQQFRHIQAPGWQLGWTWAKKEVIWSMVGAQTTEQGDCSKFKGGTPHCCKKDPTVVDLLPGTPYNMQIANCCKAGVINTFNQDPSNAASSFQISVGLAGTTNKTVKLPKNFTLKAPGPGYTCGRAMIVRPTKFFTGDGRRATQALMTWNVTCTYSQFLAQKTPSCCVSLSSFYNDTIVNCPTCSCGCQNNGTSPGSCVNENSPYLQSAIDGPGKWTGQPLVQCTSHMCPIRIHWHVKLNYKEYWRVKITITNFNYRMNYTQWNLVAQHPNFNNITQLFSFNYKPLTPYGSKINDTAMFWGVKFYNDLLMQAGPLGNAQSELLLRKDSKDFTFDKGWAFPHRVYFNGDNCVMPPPDAYPWLPNASPLTKQPLTLSVLVFSIVLATLLAYA

SEQ ID NO: 959 - protein, 457 aa, Oryza sativa subsp. japonica
  misc_feature (60)..(224): Pfam Name: COBRA Pfam Description: COBRA-like protein
  misc_feature (1)..(457): Public GI ID no. 115463639
  misc_feature (1)..(457): Bit score of 925.9 for HMM based on sequences of Figure 9
  misc_feature (1)..(457): Functional Homolog Of SEQ ID NO. 928
MAVGGAGSSRSVAPCCCCAVLLAAALLFSAPATTEAYDALDPNGNITIKWDVMSWTPDGYVAVVTMFNYQQFRHIQAPGWQLGWTWAKKEVIWSMVGAQTTEQGDCSKFKGGTPHCCKKDPTVVDLLPGTPYNMQIANCCKAGVINTFNQDPSNAASSFQISVGLAGTTNKTVKLPKNFTLKAPGPGYTCGRAMIVRPTKFFTGDGRRATQALMTWNVTCTYSQFLAQKTPSCCVSLSSFYNDTIVNCPTCSCGCQNNGTSPGSCVNENSPYLQSAIDGPGKWTGQPLVQCTSHMCPIRIHWHVKLNYKEYWRVKITITNFNYRMNYTQWNLVAQHPNFNNITQLFSFNYKPLTPYGSKINDTAMFWGVKFYNDLLMQAGPLGNAQSELLLRKDSKDFTFDKGWAFPHRVYFNGDNCVMPPPDAYPWLPNASPLTKQPLTLSVLVFSIVLATLLAYA

SEQ ID NO: 960 - protein, 471 aa, Picea sitchensis
  misc_feature (69)..(234): Pfam Name: COBRA Pfam Description: COBRA-like protein
  misc_feature (1)..(471): Public GI ID no. 116790012
  misc_feature (1)..(471): Bit score of 943.3 for HMM based on sequences of Figure 9
  misc_feature (1)..(471): Functional Homolog Of SEQ ID NO. 928
MMEKRELNSSRGQRCMQNCHILNKNAAGFFLALTILAIAFSPAGAYDPLDPNGNITIKWDIVSWTADGYVAAVTMHNFQQYRHIPSPPGWTLGWNWAKKEVIWAVVGGQTTEQGDCSKWKAGSPHCCKKDPTVVDLLPGVPYNQQFTNCCKGGALASWAQDPPNSVASFQVSVGNSGTTNKTVKLPKNFTLKAPGPGYTCGPAKIVKSSLFFSTDRRRTTQALMTWNVTCTYSQFLAQKSSTCCVSLSSFYNDTITPCPTCACACRNNVTQPSCVHSDSPVLKLPGPTNPITNSLQPPLLQCTRHMCPVRVHWHVKLNYKDYWRVKITVTNFNYRMNYTDWTLVAQHPNFDNVTQVFSFNYKPLTPYGSINDTAMFWGQKYYNDLLMQAGPMGSVQSELLLRKDKQTFTFKQGWAFPRRLYFNGDQCVMPSPDAYPWLPSTAHPAPAPPSLFAFILPLALALAIVPSLFLP

SEQ ID NO: 961 - protein, 448 aa, Phaseolus vulgaris
  misc_feature (53)..(217): Pfam Name: COBRA Pfam Description: COBRA-like protein
  misc_feature (1)..(448): Public GI ID no. 38194916
  misc_feature (1)..(448): Bit score of 939.6 for HMM based on sequences of Figure 9
  misc_feature (1)..(448): Functional Homolog Of SEQ ID NO. 928
MGFSLLPKATPCILLLVLLYCTCFTSTDAYDPLDPNGNITIKWDIITWTPDGYVAVVTMNNFQQYRHIASPGWRLGWTWAKKEVIWSMMGGQTTEQGDCSKFKAGIPHCCKKDPTVVDLLPGTPYNQQIANCCKGGVLGSWVQDPTNAVSSFQVSVGRAGTTNKTVKVPKNFTLSAPGPGYTCGPAKIVKPTQFIQADKRRVTQALMTWNVTCQYSQFLAQKTPSCCVSLSSFYNDTIVPCPTCACGCQGNSSLSGSCVNSQTPHLASVVSGSGKNNLSPLVQCTSHMCPVRIHWHVKVNYKEYWRVKVTITNFNYRMNYSEWNMVVQHPNFDNLTQLFSFNYKSLTPYGSINDTAMLWGVKFYNDFLSQAGPNGNVQSELLFRKDKATFTFDKGWAFPRRIYFNGDNCVMPPPDAYPWLPNAGSRQEVSLFALVIAYLVALVFYAHA

SEQ ID NO: 962 - DNA, 1823 bp, Panicum virgatum
  misc_feature (1)..(1823): Ceres Clone ID no. 1806851
  misc_feature (1)..(1823): Encodes the peptide sequence at SEQ ID NO. 963
ctcgcacccacaagaatagctcaaacccgcgtgcatgtctgcatccccgggcggacacggcgcgcgccagaagcctcgcatcgccatcgcgcatacaaactggcaggccagacaccacaggacgagagacagagaggaaacctctgcttctccctctgacccactcctcgttcttctgagctcctgttgccttcctccgcacggagagcagacacgccgagagcgatcagggcagggaggggtctgctgcttacttcctgagctctgccgggccgggccatggcgggacggcggacggcgcccctgcgcctgtgcgcctccgtcgcgctgctcgtcgtcgccgtctcctctctgacgccttcgtcagatgcatacgatccactcgatccgaatgggaacataacaatcaagtgggatgtaatgcagtggactccagatggctatgtggctgttgtttccctatacaattaccagcagtaccgccacatccaagcgccgggctggaaactcggatgggtttgggcaaagaaggagataatctgggcaatgaccggtggccaagccactgagcaaggcgattgctccaaattcaaaagcaacattccccattgctgcaagaaggatcctgaggttgtggacctgcttcctggcacaccttataacatgcagatcgccaactgctgcaagggaggagtcctcaccgcatgggcacaggaccctgacaatgctgtggcttcgttccaagtcagtgttggtcaggctgggacgaccaacaagactgtgaaggtgcccaagaatttcactctgaaggctcccgggccagggtatacctgcggccctgccaaactagtgaaacctactaagttcatatcgccggatgggagaagatcaactcaagcacacatgacttggaatgtgacctgtacatactcacagtttgttgcccaaagatctccaacctgctgtgtttcgctttcatcgttttacaacgacaccattgtcaactgcccaacatgctcttgtggatgccagaataacagcactgcaccaggaagctgtgtagagggtaattcaccttatctggcctctgtcgtgaacgatcctaacaagaacagcttggcacctctagtccaatgcacttctcacatgtgcccaataagagtgcattggcatgtcaaagtgaactacaaggagtactggagggtcaagatcaccgtgacaaacttcaactaccggatgaactactcgcagtggaacctcgttgcgcagcaccccaacttcgacaacctgactaccattttcagcttcaactacaaatctctgaacccctatggcgtaataaacgacaccgcgatgttatggggcatcaagtactacaacgatctgctgatgacggctgggccggacgggaatgttcagtctgagcttctgttccggaaggagccctccaccttcaccttccagaaaggctgggctttcccaagacgagtgtacttcaatggcgacaactgcgtgatgccgccgccggacgcgtacccatggctgcccaacgcctctccacggcagtcagcttcggttctcctcacatttgttgctgtttgggcagcattggcgatcctactggccaatccctagtgatgtagtacatgtttcacagaaagttttgacctgattgcattggatgctattgccttctgatcattgagtttcttgcgatggtgttcaaatgtacagttacgtactcaaggatgtacattcccgtacttgtaaattttagcaaagactgactggcgagaaataaagctgtttcctcggcatcatgc

SEQ ID NO: 963 - protein, 451 aa, Panicum virgatum
  misc_feature (55)..(219): Pfam Name: COBRA Pfam Description: COBRA-like protein
  misc_feature (1)..(451): Ceres Clone ID no. 1806851
  misc_feature (1)..(451): Bit score of 914.7 for HMM based on sequences of Figure 9
  misc_feature (1)..(451): Functional Homolog Of SEQ ID NO. 928
MAGRRTAPLRLCASVALLVVAVSSLTPSSDAYDPLDPNGNITIKWDVMQWTPDGYVAVVSLYNYQQYRHIQAPGWKLGWVWAKKEIIWAMTGGQATEQGDCSKFKSNIPHCCKKDPEVVDLLPGTPYNMQIANCCKGGVLTAWAQDPDNAVASFQVSVGQAGTTNKTVKVPKNFTLKAPGPGYTCGPAKLVKPTKFISPDGRRSTQAHMTWNVTCTYSQFVAQRSPTCCVSLSSFYNDTIVNCPTCSCGCQNNSTAPGSCVEGNSPYLASVVNDPNKNSLAPLVQCTSHMCPIRVHWHVKVNYKEYWRVKITVTNFNYRMNYSQWNLVAQHPNFDNLTTIFSFNYKSLNPYGVINDTAMLWGIKYYNDLLMTAGPDGNVQSELLFRKEPSTFTFQKGWAFPRRVYFNGDNCVMPPPDAYPWLPNASPRQSASVLLTFVAVWAALAILLANP

SEQ ID NO: 964 - DNA, 1845 bp, Zea mays
  misc_feature (1)..(1845): Ceres Clone ID no. 236876
  misc_feature (1)..(1845): Encodes the peptide sequence at SEQ ID NO. 965
gagtgtctcgtgctgctgcttccgctgcagtaaaatacggggaagaggaggggagggagacgcggccgctgcctgccgcacatgctttaagtcccactccccacctccccagatctccgccctcctccccaccgcccccattcctcccctcggccgcaaccgtagccgccgcactacggagcaagatcgtcgggtagacggacgggcgggcgggcgggcgcggctctgtatctatctgtcggtgggagaccgcgtgtgtcggttaggcggcgggtggcaaggaagaatggcggcgagcggcagatccgtcgcgtgctgtgccgccgcgctgctcgcggccgcgttgctcctctccgcaccgactgcaacagaggcttatgattcgctggatccaaatggcaacatcaccataaaatgggatatcatgcagtggactcctgatggatatgtcgctgttgtcacaatgtttaattatcaacaatttcggcatatcggcgcacctggttggcagcttgggtggacatgggcaaagaaggaggttatatggtcaatggttggggctcagaccactgaacagggcgactgctcaaagttcaagagcagcccaccccattgctgcaagaaagatccaacaattgtcgatttacttccaggcactccatacaacatgcaaattgccaattgctgcaaggcaggagttgtaaatacctttaaccaggacccagcaaatgctgcttcctccttccagatcagtgttggtcttgctggaactaccaataaaactgttaaggtgcccaggaacttcactcttaagactccaggccctgggtacacatgtgggcgtgccattgttggcaggcctacgaagtttttcaccgcggacgggcgcagggcaacccaagctctaatgacatggaatgtgacctgcacatattcccaatttcttgctcagaagactccatcctgctgtgtatctctatcatcgttttataatgacacaattgtgaactgcccaacatgctcatgtggctgccagaacccaagtgggtcaaactgtgtgaatgaggattcacctaatctacaagctgcaattgatggccctggcaaatgcactggtcagccccttgtacaatgcacttcccacatgtgcccgataagaatccactggcatgtgaagctcaactacaaggattactggagagtgaaaatcactatcacaaacttcaacttccgcatgaattacacgcagtggaacttagtagcccagcatccaaactttgataatatcactcagttgttcagcttcaactacaaaccacttactccatatggtggtggcataaatgatacggcaatgttctggggtgtaaaattctacaatgatctgctgatgcaagccggcaaacttgggaatgtgcaatcagagctgcttctccgcaaggactcccggactttcactttcgaaaagggatgggccttcccacgccgagtttacttcaatggtgataattgtgtcatgccatctcctgaaaattatccatggctgccgaatgcaagccctctaacaaaaccattggcactcccattcttggtattctgggttgccttggctgctctgttggcttatgcatgattagtgggatcaagaggtttagcaagtttcaagttgatgtcagattccatgaggtgcactgcaacaagtcatttgttcattcaattccatggttgcacagaaaagatgaggcgatgccaagaaaaagtcgatatgtctatgtgtttaagttaaagggccaaaatgtatttcttgtttggtatataacagccctacaacactttggtgaactg

SEQ ID NO: 965 - protein, 448 aa, Zea mays
  misc_feature (54)..(218): Pfam Name: COBRA Pfam Description: COBRA-like protein
  misc_feature (1)..(448): Ceres Clone ID no. 236876
  misc_feature (1)..(448): Bit score of 904.5 for HMM based on sequences of Figure 9
  misc_feature (1)..(448): Functional Homolog Of SEQ ID NO. 928
MAASGRSVACCAAALLAAALLLSAPTATEAYDSLDPNGNITIKWDIMQWTPDGYVAVVTMFNYQQFRHIGAPGWQLGWTWAKKEVIWSMVGAQTTEQGDCSKFKSSPPHCCKKDPTIVDLLPGTPYNMQIANCCKAGVVNTFNQDPANAASSFQISVGLAGTTNKTVKVPRNFTLKTPGPGYTCGRAIVGRPTKFFTADGRRATQALMTWNVTCTYSQFLAQKTPSCCVSLSSFYNDTIVNCPTCSCGCQNPSGSNCVNEDSPNLQAAIDGPGKCTGQPLVQCTSHMCPIRIHWHVKLNYKDYWRVKITITNFNFRMNYTQWNLVAQHPNFDNITQLFSFNYKPLTPYGGGINDTAMFWGVKFYNDLLMQAGKLGNVQSELLLRKDSRTFTFEKGWAFPRRVYFNGDNCVMPSPENYPWLPNASPLTKPLALPFLVFWVALAALLAYA

SEQ ID NO: 966 - protein, 448 aa, Zea mays
  misc_feature (54)..(218): Pfam Name: COBRA Pfam Description: COBRA-like protein
  misc_feature (1)..(448): Public GI ID no. 162459408
  misc_feature (1)..(448): Bit score of 904.6 for HMM based on sequences of Figure 9
  misc_feature (1)..(448): Functional Homolog Of SEQ ID NO. 928
MAASGRSVACCAAALLAAALLLSAPTATEAYDSLDPNGNITIKWDIMQWTPDGYVAVVTMFNYQQFRHIGAPGWQLGWTWAKKEVIWSMVGAQTTEQGDCSKFKSSPPHCCKKDPTIVDLLPGTPYNMQIANCCKAGVVNTFNQDPANAASSFQISVGLAGTTNKTVKVPRNFTLKTPGPGYTCGRAIVGRPTKFFTADGRRATQALMTWNVTCTYSQFLAQKTPSCCVSLSSFYNDTIVNCPTCSCGCQNPSGSNCVNEDSPNLQAAIDGPGKWTGQPLVQCTSHMCPIRIHWHVKLNYKDYWRVKITITNFNFRMNYTQWNLVAQHPNFDNITQLFSFNYKPLTPYGGGINDTAMFWGVKFYNDLLMQAGKLGNVQSELLLRKDSRTFTFEKGWAFPRRVYFNGDNCVMPSPENYPWLPNASPLTKPLALPFLVFWVALAALLAYA

SEQ ID NO: 967 - protein, 456 aa, Oryza sativa subsp. indica
  misc_feature (59)..(223): Pfam Name: COBRA Pfam Description: COBRA-like protein
  misc_feature (1)..(456): Public GI ID no. 125545759
  misc_feature (1)..(456): Bit score of 920.6 for HMM based on sequences of Figure 9
  misc_feature (1)..(456): Functional Homolog Of SEQ ID NO. 928
MAAGGGAGSARSVAWGASALLVAALLLSAPSATEAYDSLDPNGNITIKWDVMQWTPDGYVAVVTMFNYQQFRHIQAPGWQLGWTWAKKEVIWSMVGAQTTEQGDCSKFKGNPPHCCKKDPTIVDLLPGTPYNMQIANCCKAGVINTFNQDPLNAASSFQISVGLAGTTNKTVKLPKNFTLKAPGPGYTCGRAMIVRPTKFFTNDGRRATQALMTWNVTCTYSQFLAQKTPTCCVSLSSFYNDTIVNCPTCSCGCQNNGTSPGSCVNENSPYLQSAIDGPGKWTGQPLVQCTSHMCPIRIHWHVKLNYKEYWRVKVTITNFNYRMNYTQWNLVIQHPNFNNITQLFSFNYKPLTPYGGRINDTAMFWGVKFYNDLLMQAGPLGNAQSELLLRKDSMAFTFDKGWAFPHRVYFNGDNCVMPPPDAYPWLPNASPLTKQPLTLPLLAFWIVLATFLAYA

SEQ ID NO: 968 - protein, 456 aa, Vitis vinifera
  misc_feature (60)..(224): Pfam Name: COBRA Pfam Description: COBRA-like protein
  misc_feature (1)..(456): Public GI ID no. 225456559
  misc_feature (1)..(456): Bit score of 943.2 for HMM based on sequences of Figure 9
  misc_feature (1)..(456): Functional Homolog Of SEQ ID NO. 928
MEFFFTSIARSITKLSSYAILLVLLFSCSIFTSTEAYDSLDPEGNITIKWDVMSWTPDGYVAVVTMFNFQQYRHIQAPGWSLGWSWAKKEVIWSMMGGQTTEQGDCSRFKGNVPHCCKKDPTVVDLLPGTPYNQQIANCCKGGVINSWVQDPANAASSFQVSVGAAGTTNKTVKLPKNFTLRAPGPGYTCGPAKIVKPTKFTTADQRRVTQALMTWNVTCTYSQFLAQKTPTCCVSLSSFYNNTIVSCPTCTCGCQNNLTHPGSCVDPNNPYLASVVEGSGKTSYQPLVQCTSHMCPIRVHWHVKLNYKDYWRVKITITNFNYRMNYTQWNLVVQHPNFDNLTQIFSFNYKSLTPYAAINDTAMLWGVKFYNDLLSQAGPLGNVQSELLFRKDKATFTFDKGWAFPRRIYFNGDNCVMPPPDAYPWLPNASSRPTVSLLYSILTILAVSVIVLAYA

SEQ ID NO: 969 - protein, 456 aa, Vitis vinifera
  misc_feature (60)..(224): Pfam Name: COBRA Pfam Description: COBRA-like protein
  misc_feature (1)..(456): Public GI ID no. 225451792
  misc_feature (1)..(456): Bit score of 943.5 for HMM based on sequences of Figure 9
  misc_feature (1)..(456): Functional Homolog Of SEQ ID NO. 928
MGFCLSLISRSISSFCGCTILLLFLLSCSCFTSTEAYDALDPNGNITIKWDIMSWTPDGYVAVVTMYNFQQYRHIQSPGWSLQWTWAKKEVIWSMLGGQTTEQGDCSRFKGNVPHCCKKDPTVVDLLPGTPYNQQIANCCKGGVVSSWVQDPANAASSFQVSVGSAGTTNKTVRVPKNFTLKAPGPGYTCGPAKIVKPTRFVTQDGRRVTQALMTWNVTCTYSQFLSQKTPTCCVSLSSFYNDTIVPCPTCTCGCQNNITQPGSCVEEDSPYLASVVSGSGKNSYTPLVQCTKHMCPIRVHWHVKLSYKEYWRVKVTITNFNYRMNYTQWNLVVQHPNFDNLTQIFSFNYKSLTPYAAINDTAMLWGVKFYNDLLVQAGPLGNVQSELLFRKDKSTFTFEKGWAFPRRIYFNGDNCVMPPPDSYPWLPNATSRTSTSLLTLIMVLLSALLLLNAHV

SEQ ID NO: 970 - DNA, 1715 bp, Arabidopsis thaliana
  misc_feature (1)..(1715): Ceres Clone ID no. 17250
  misc_feature (1)..(1715): Encodes the peptide sequence at SEQ ID NO. 971
aaaaaatgtctcattgcttctctcgttctaaaaaaaatcttgctgctatctctctataagtccactcctccttcaagcaaagcaccttcctcttctttttgctcctctgagattggtttaagattaaaccagacccatctaagggatctggaacaagcttcgtctctggttccactctgatcatcagagtattaaaaatggagtctttcttctccagatccacctccatcgtctccaaattgagtttcttggccttatggatcgtcttcttgatttcttcatcttcttttacttcgacagaagcatatgatgcgcttgatccagaaggcaacattacaattaaatgggatgttatgagctggactcctgatggctatgttgccgtggttacgatgttcaacttccagaaatacagacacattcaatctccaggatggacattaggttggaaatgggcaaagaaggaagttatatggagtatggttggagcacaaacaactgaacaaggtgattgttcaaagtacaaaggaaacataccacattgttgtaagaaggatccaacagttgtagacttgcttccagggactccttataatcagcagattgctaattgctgcaagggtggtgttatgaactcatgggttcaagaccctgccactgcggctagctccttccagattagtgttggtgctgctggaaccacaaacaaaaccgttagggtcccaagaaacttcactctcatgggacctggtccaggttacacttgtggtccagcaaagattgtcagaccaacaaaatttgtcacgactgacacacgcagaaccactcaagctatgatgacatggaacattacgtgcacatactcgcagttccttgctcaaagaactccaacttgctgtgtttctttatcttctttctacaatgaaaccattgttggatgtccaacttgtgcttgcggatgtcaaaacaacagaacagaatccggtgcctgcctcgacccggacacaccacacttagcctcggttgtgtcaccaccaacaaagaaaggaacggttttaccaccattagtgcaatgcacgagacacatgtgcccgatcagagtgcattggcatgtaaagcagaactacaaagagtattggcgtgtgaagatcacaatcacaaacttcaactatcgcttgaactacacacaatggaaccttgttgctcaacatccaaatctcgacaacatcactcaaatcttcagcttcaactacaaatctcttactccttacgctggactaaacgatacggcgatgttatggggagtgaagttctacaacgatttcttatcagaagcaggtcctcttgggaatgttcaatcagagattttgttccgtaaagaccaatcaaccttcacattcgagaaaggttgggcttttccacgaaggatttactttaatggagacaattgcgtcatgcctcctccagactcttacccttttcttcccaacggtggttcccggtcacaattctcattcgtcgccgccgtgctcctccctcttcttgtctttttcttcttctctgcctaatctcggatttacggttttgccactggtttgcttagggttacggtggagtggtataaacgtttatttatgattcttttgtgtcccacaaaaattataatcttttgatactttttaaaaatataaatagttttcaacttccttgttttt

SEQ ID NO: 971 - protein, 456 aa, Arabidopsis thaliana
  misc_feature (60)..(224): Pfam Name: COBRA Pfam Description: COBRA-like protein
  misc_feature (1)..(456): Ceres Clone ID no. 17250
  misc_feature (1)..(456): Bit score of 942.8 for HMM based on sequences of Figure 9
  misc_feature (1)..(456): Functional Homolog Of SEQ ID NO. 928
MESFFSRSTSIVSKLSFLALWIVFLISSSSFTSTEAYDALDPEGNITIKWDVMSWTPDGYVAVVTMFNFQKYRHIQSPGWTLGWKWAKKEVIWSMVGAQTTEQGDCSKYKGNIPHCCKKDPTVVDLLPGTPYNQQIANCCKGGVMNSWVQDPATAASSFQISVGAAGTTNKTVRVPRNFTLMGPGPGYTCGPAKIVRPTKFVTTDTRRTTQAMMTWNITCTYSQFLAQRTPTCCVSLSSFYNETIVGCPTCACGCQNNRTESGACLDPDTPHLASVVSPPTKKGTVLPPLVQCTRHMCPIRVHWHVKQNYKEYWRVKITITNFNYRLNYTQWNLVAQHPNLDNITQIFSFNYKSLTPYAGLNDTAMLWGVKFYNDFLSEAGPLGNVQSEILFRKDQSTFTFEKGWAFPRRIYFNGDNCVMPPPDSYPFLPNGGSRSQFSFVAAVLLPLLVFFFFSA

SEQ ID NO: 972 - protein, 469 aa, Vitis vinifera
  misc_feature (60)..(224): Pfam Name: COBRA Pfam Description: COBRA-like protein
  misc_feature (1)..(469): Public GI ID no. 147780878
  misc_feature (1)..(469): Bit score of 942.9 for HMM based on sequences of Figure 9
  misc_feature (1)..(469): Functional Homolog Of SEQ ID NO. 928
MGFCLSLISRSISSFCGCTILLLFLLSCSCFTSTEAYDALDPNGNITIKWDIMSWTPDGYVAVVTMYNFQQYRHIQSPGWSLQWTWAKKEVIWSMLGGQTTEQGDCSRFKGNVPHCCKKDPTVVDLLPGTPYNQQIANCCKGGVVSSWVQDPANAASSFQVSVGSAGTTNKTVRVPKNFTLKAPGPGYTCGPAKIVKPTRFVTQDGRRVTQALMTWNVTCTYSQFLSQKTPTCCVSLSSFYNDTIVPCPTCTCGCQNNITQPGSCVEEDSPYLASVVSGSGKNSYTPLVQCTKHMCPIRVHWHVKLSYKEYWRVKVTITNFNYRMNYTQWNLVVQHPNFDNLTQIFSFNYKSLTPYAAINDTAMLWGVKFYNDLLVQAGPLGNVQSELLFRKDKSTFTFEKGWAFPRRIYFNGDNCVMPPPDSYPWLPNATSRTSTSLLTLIMVLLSALLLYAHGYDNFIGKFYMQYAK

SEQ ID NO: 973 - DNA, 1371 bp, Arabidopsis thaliana
  misc_feature (1)..(1371): Ceres Annot ID no. 1363625
  misc_feature (1)..(1371): Encodes the peptide sequence at SEQ ID NO. 974
atggagtctttcttctccagatccacctccatcgtctccaaattgagtttcttggccttatggatcgtcttcttgatttcttcatcttcttttacttcgacagaagcatatgatgcgcttgatccagaaggcaacattacaatgaaatgggatgttatgagctggactcctgatggctatgttgccgtggttacgatgttcaacttccagaaatacagacacattcaatctccaggatggacattaggttggaaatgggcaaagaaggaagttatatggagtatggttggagcacaaacaactgaacaaggtgattgttcaaagtacaaaggaaacataccacattgttgtaagaaggatccaacagttgtagacttgcttccagggactccttataatcagcagattgctaattgctgcaagggtggtgttatgaactcatgggttcaagaccctgccactgcggctagctccttccagattagtgttggtgctgctggaaccacaaacaaaaccgttagggtcccaagaaacttcactctcatgggacctggtccaggttacacttgtggtccagcaaagattgtcagaccaacaaaatttgtcacgactgacacacgcagaaccactcaagctatgatgacatggaacattacgtgcacatactcgcagttccttgctcaaagaactccaacttgctgtgtttctttatcttctttctacaatgaaaccattgttggatgtccaacttgtgcttgcggatgtcaaaacaacagaacagaatccggtgcctgcctcgacccggacacaccacacttagcctcggttgtgtcaccaccaacaaagaaaggaacggttttaccaccattagtgcaatgcacgagacacatgtgcccgatcagagtgcattggcatgtaaagcagaactacaaagagtattggcgtgtgaagatcacaatcacaaacttcaactatcgcttgaactacacacaatggaaccttgttgctcaacatccaaatctcgacaacatcactcaaatcttcagcttcaactacaaatctcttactccttacgctggactaaacgatacggcgatgttatggggagtgaagttctacaacgatttcttatcagaagcaggtcctcttgggaatgttcaatcagagattttgttccgtaaagaccaatcaaccttcacattcgagaaaggttgggcttttccacgaaggatttactttaatggagacaattgcgtcatgcctcctccagactcttacccttttcttcccaacggtggttcccggtcacaattctcattcgtcgccgccgtgctcctccctcttcttgtctttttcttcttctctgcctaa

SEQ ID NO: 974 - protein, 456 aa, Arabidopsis thaliana
  misc_feature (60)..(224): Pfam Name: COBRA Pfam Description: COBRA-like protein
  misc_feature (1)..(456): Ceres Annot ID no. 1363625
  misc_feature (1)..(456): Bit score of 939.8 for HMM based on sequences of Figure 9
  misc_feature (1)..(456): Functional Homolog Of SEQ ID NO. 928
MESFFSRSTSIVSKLSFLALWIVFLISSSSFTSTEAYDALDPEGNITMKWDVMSWTPDGYVAVVTMFNFQKYRHIQSPGWTLGWKWAKKEVIWSMVGAQTTEQGDCSKYKGNIPHCCKKDPTVVDLLPGTPYNQQIANCCKGGVMNSWVQDPATAASSFQISVGAAGTTNKTVRVPRNFTLMGPGPGYTCGPAKIVRPTKFVTTDTRRTTQAMMTWNITCTYSQFLAQRTPTCCVSLSSFYNETIVGCPTCACGCQNNRTESGACLDPDTPHLASVVSPPTKKGTVLPPLVQCTRHMCPIRVHWHVKQNYKEYWRVKITITNFNYRLNYTQWNLVAQHPNLDNITQIFSFNYKSLTPYAGLNDTAMLWGVKFYNDFLSEAGPLGNVQSEILFRKDQSTFTFEKGWAFPRRIYFNGDNCVMPPPDSYPFLPNGGSRSQFSFVAAVLLPLLVFFFFSA

SEQ ID NO: 975 - protein, 457 aa, Triticum monococcum
  misc_feature (59)..(223): Pfam Name: COBRA Pfam Description: COBRA-like protein
  misc_feature (1)..(457): Public GI ID no. 30090032
  misc_feature (1)..(457): Bit score of 889.5 for HMM based on sequences of Figure 9
  misc_feature (1)..(457): Functional Homolog Of SEQ ID NO. 928
MAPVGGVAGSSRSAACCAVLLAAVLFFSAPATTEAYDSLDPNGNITIKWDIISWTPDGYVATVTMFNYQQFRHIPAPGWQLGWSWAKKEVIWSMVGAQATEQGDCSKFKSAPPHCCKRDPTIVDLLPGTPFNQQIANCCKAGVIKTFNQDPGNAASSFQISVGLAGTTNKTVKMPKNFTLRAPGPGYTCGRALVGRPTKYYSSDGRRVTQALMSWNVTCTYSQFLAQKTPTCCVSLSSFYNDTIVNCPTCSCGCQNNITRPGSCVNDNSPYLQSAINGPGKLTGQPLVQCTSHMCPIRIHWHVKLNYKDYWRVKVTITNFNYRMNYTDWNMVAQHPNFDNITKLFSFNYKPLTPYGGRINDTAMFWGMKFYNDLLNQAGPLGNAQSELLMRKDSETFTFQKGWAFPRRVYFNGDNCVMPSPDDYPWLPSASPLTKQPWTLPLLVFWTALATLLAYYV

SEQ ID NO: 976 - DNA, 1877 bp, Gossypium hirsutum
  misc_feature (1)..(1877): Ceres Clone ID no. 1848658
  misc_feature (1)..(1877): Encodes the peptide sequence at SEQ ID NO. 977
aataaccgacagcttgcacccatatggatggagcatgtacctctctgtctcagactctgtactaaattgcttttataagcttcacttgcaactcaacagctgacctctctcttctccatttgatgtgagaaggatctttctttctttattctgcacatcttaaccttaaccacatcataagatagagatctcttaaacgatcgagttatggagactgtcttttcagcagcaagtagatccatttccaagctcattagcttcaccgctttgcttcttttcttgttttcctgctctactttcacttctactgaagcttatgatgcgcttgatccaactggcaatatcactatcaaatgggacgtaataagttggaccccagatggctatgttgctgttgttacaatgtacaatttccaacagtatcgccatattcaggcacctggttggacattggggtggacatgggccaaaaaggaagtaatctggagcatgatgggaagccaaaccacggaacaaggggattgttcaaaatacaaaggaaacgtccctcattgctgtaaaaaggatcccacagttgtggatttattgcctggaactccttataaccagcagattgcaaattgctgcaaaggcggtgtattaaattcatgggttcaagacccagccaatgcagcaagctcatttcaggttagtgtgggcgctgcaggaacaacgaacaaaactgtgagagtgcctagaaactttaccctgaaagcaccaggtccaggatatacttgtgggcctgccaagattgtgaaacccactaaattcataacggctgataaaaggagaataactcaagctatgatgacatggaatgttacatgcacatattcccaatttctggctcaaaagactcctacatgttgcgtctcgctctcttccttctataataacactatcgtgaattgcccgacatgtgcttgtggctgtcagaataactcaactgaatctgggagttgtgtaagcgaaaggtcttcacatttagcttcagctgttccgggcaaatctaccaatgcaccacctctgcttcagtgtacgagccatatgtgtccagttcgaattcactggcatgttaagctcaactacaaggaatactggcgtgtgaagatcacaatcaccaatttcaattacgcattgaactacagtcagtggaatctagttgtgcaacaccccaactttgacaatcttacacaacttttcagcttcaattacaaaccattaactccttatgctggcttaaatgatactgccatgttatggggacttaagttttataatgatttcctcaacgaagccggtcctcttgggaatgtgcagtcagaactattattcagaaaagatgcatcaacttttacttttgaaaagggatgggcttttccacggagaatatatttcaatggtgataactgtgtcatgccacctcccgatgcctacccttggttgccgaatactggtttgaagccagttatctctctgtttcagccagtcatgacgatcttggcatcatgtgttttcttatgggctaatatgtgatgaatgctgtctgcggaaaccgctaaaactatttgttcgacatcctgcaatttgcatctggtttcatattatcacactgaagcttttggtgatcgattcaatggtgttggaatagtttggtgcggcaatgtaacacgctaaagagtggatcaaggtgcacaatctctggtccctatagcatgtggtgtattatttatatgttggggtttgtaatttacaccatttccttttggagttaactgctttgttgtatgtttcattcacatcatacacatgatcgatttatttgtagaatatccttg

SEQ ID NO: 977 - protein, 455 aa, Gossypium hirsutum
  misc_feature (60)..(224): Pfam Name: COBRA Pfam Description: COBRA-like protein
  misc_feature (1)..(455): Ceres Clone ID no. 1848658
  misc_feature (1)..(455): Bit score of 929.2 for HMM based on sequences of Figure 9
  misc_feature (1)..(455): Functional Homolog Of SEQ ID NO. 928
METVFSAASRSISKLISFTALLLFLFSCSTFTSTEAYDALDPTGNITIKWDVISWTPDGYVAVVTMYNFQQYRHIQAPGWTLGWTWAKKEVIWSMMGSQTTEQGDCSKYKGNVPHCCKKDPTVVDLLPGTPYNQQIANCCKGGVLNSWVQDPANAASSFQVSVGAAGTTNKTVRVPRNFTLKAPGPGYTCGPAKIVKPTKFITADKRRITQAMMTWNVTCTYSQFLAQKTPTCCVSLSSFYNNTIVNCPTCACGCQNNSTESGSCVSERSSHLASAVPGKSTNAPPLLQCTSHMCPVRIHWHVKLNYKEYWRVKITITNFNYALNYSQWNLVVQHPNFDNLTQLFSFNYKPLTPYAGLNDTAMLWGLKFYNDFLNEAGPLGNVQSELLFRKDASTFTFEKGWAFPRRIYFNGDNCVMPPPDAYPWLPNTGLKPVISLFQPVMTILASCVFLWANM

SEQ ID NO: 978 - protein, 457 aa, Populus balsamifera subsp. trichocarpa
  misc_feature (60)..(224): Pfam Name: COBRA Pfam Description: COBRA-like protein
  misc_feature (1)..(457): Public GI ID no. 224124236
  misc_feature (1)..(457): Bit score of 940.7 for HMM based on sequences of Figure 9
  misc_feature (1)..(457): Functional Homolog Of SEQ ID NO. 928
MEPSSSLVTVSVTKISAFTILLLFLISCSTLTSTEAYDALDPNGNITIKWDVIQWTPDGYVAVVTMYNFQQYRHIQAPGWTLGWTWAKKEVIWNMMGAQTTEQGDCSKFKGNIPHCCKKDPTVVDLLPGTPYNQQIANCCKGGVINSWAQDPANAVSSFQISVGAAGTTNKTVRVPKNITLKAPGPGYTCGPAKIVRPTKFISADKRRITQALMTWNITCTYSQFLAQKTPTCCVSLSSFYNDTIVSCPTCACGCQNTTGAGSGTCVHPDTPHLASVISPPGKSDNTPLVQCTSHMCPIRVHWHVKLNYKEYWRVKVTVTNFNYRMNYSLWNMVVQHPNFDNLTKIFSFQYKSLTPYEGLNDTAMLWGVKFYNDFLSQAGPLGNVQSELLFRKDKSTFTFEKGWAFPRRIYFNGDNCVMPPPDAYPWLPNDSSRPVISLLLPVMTLFLSMAFLFAHV

SEQ ID NO: 979 - DNA, 1849 bp, Zea mays
  misc_feature (1)..(1849): Ceres Clone ID no. 1546455
  misc_feature (1)..(1849): Encodes the peptide sequence at SEQ ID NO. 980
gccctcctcaccactgcccccccattccccggcgcccagcacccggcgccgcaaccgccgcagtccggagcaagatcggtgggtagacggacgggcgacaggcgggcgggcgcggctctgtctgtatctatctgttggtgggagaccggttgtgtcggttaggcggcggcgggtgggaaggaagaatggcggcgggcggcagatccatcgcgtgcgttgccgccgtgctgctcgcggccgcgctgctcctctccgcaccgaccaccacagaggcctacgattcgctggatccaaacggcaacatcactataaaatgggatatcatgcagtggactcctgacggatatgtcgctgttgtcacaatgttcaattatcaacaatttcggcacatcggggcacctggatggcagcttgggtggacatgggcaaaaaaggaggttatatggtcaatggttggggctcagaccactgaacagggtgactgctcaaagttcaagggcaacaccccccattgctgcaagaaagatccaacaattgttgatttacttccaggcactccatacaacatgcaaattgccaattgctgcaaggcaggagttataaatacctttaaccaggacccagcaaatgctgcttcctccttccagatcagtgttggtcttgctggaactaccaataaaactgttaaggtgccgaagaatttcactcttaagactccaggccctgggtacacatgtgggcgtgctattgttggcaggccaacgaagtttttctctgcagatgggcgcagggtaacccaagctctaatgacatggaatgtgacctgcacatattcccaatttcttgctcagaagactccatcctgctgtgtatctctctcatcattttataatgacacaattgtgaactgcccgacatgctcatgtggctgccagaacccaagtgggtcaaactgtgtgaacgaggattcacctaatctacaagccgcaattgatggtcctggtaaatggactggccagcctcttgtacaatgcacttctcacatgtgcccaataagaatccactggcatgtgaagctcaactacaaggaatactggagagtgaaaatcactatcacgaacttcaacttccgcatgaattacacacagtggaacttagttgctcagcatccaaactttgataatatcactcagttgttcagcttcaactacaaaccacttactccatatgggggtggcataaatgatacggcaatgttctggggtgtaaagttctacaatgatttgctgatgcaagccggcaaacttgggaatgtgcaatcagaactgcttctccgcaaggactcacggactttcacattcgaaaagggatgggccttcccacgccgagtgtacttcaatggtgataattgtgtcatgccatctcctgaaaattatccatggctgccgaatgcaagccctctaacaaaacaagcattgacactcccactcttgatattctgggttgccttggctgttctgttggcttatgcatgatgagtgggatcaagatgtttagcaagcttcaagttgatgtcggattccatgaggtgcactgcaacgggatatttattcattcaattccatagcggcacaggagagatgaggcgaagccaagaaaaagtggatgtgtgtgtgtgtgtgtttgtaagttaaagggccaaaatgtatttcttgtctggtagtatatagcagctctacaacactttggtgaacttagttactgcaaattaggcaattacagttgcaccttttgtattttatagcaaacccagacttctattggattctatgactgcccctcttgtagc

SEQ ID NO: 980 - protein, 449 aa, Zea mays
  misc_feature (54)..(218): Pfam Name: COBRA Pfam Description: COBRA-like protein
  misc_feature (1)..(449): Ceres Clone ID no. 1546455
  misc_feature (1)..(449): Bit score of 912.6 for HMM based on sequences of Figure 9
  misc_feature (1)..(449): Functional Homolog Of SEQ ID NO. 928
MAAGGRSIACVAAVLLAAALLLSAPTTTEAYDSLDPNGNITIKWDIMQWTPDGYVAVVTMFNYQQFRHIGAPGWQLGWTWAKKEVIWSMVGAQTTEQGDCSKFKGNTPHCCKKDPTIVDLLPGTPYNMQIANCCKAGVINTFNQDPANAASSFQISVGLAGTTNKTVKVPKNFTLKTPGPGYTCGRAIVGRPTKFFSADGRRVTQALMTWNVTCTYSQFLAQKTPSCCVSLSSFYNDTIVNCPTCSCGCQNPSGSNCVNEDSPNLQAAIDGPGKWTGQPLVQCTSHMCPIRIHWHVKLNYKEYWRVKITITNFNFRMNYTQWNLVAQHPNFDNITQLFSFNYKPLTPYGGGINDTAMFWGVKFYNDLLMQAGKLGNVQSELLLRKDSRTFTFEKGWAFPRRVYFNGDNCVMPSPENYPWLPNASPLTKQALTLPLLIFWVALAVLLAYA

SEQ ID NO: 981 - DNA, 1948 bp, Panicum virgatum
  misc_feature (1)..(1948): Ceres Clone ID no. 1788775
  misc_feature (1)..(1948): Encodes the peptide sequence at SEQ ID NO. 982
aagggagcagccgctgcggagcagagtgtcgcgctgccgccgcggtaaaaacaggggaggagggagagacgcggccgcacccgcacatgctttaagtcccactccccaccgccccagatctccgccctcctccctctgccccccacattccccggcgcgccacctctgcccgcggccgccgccgctgtccggagcgagatcggcgtgggtgcacgggcgcagctcctgtatctgtcggtgggagaccccgcgcgtgtcggtgggagcgggtggggaggaagcgaaggatggcggcgggcggcagatccgtcgcgtgctgcaccgccgtgctgctcgcggccgcgctgctcctctccgcgccgactgccacagaggcttatgattccttggatccgaacggcaacatcactataaaatgggatattatgcagtggactcctgatggatatgtcgctgttgtcacaatgttcaactatcaacaattccggcacattggggcacctgggtggcagcttgggtggacatgggcaaagaaagaggtcatatggtcaatggttggggcacagactaccgaacagggtgactgctcgaaattcaagggcaacactccccactgctgcaagaaagatcccacgatcgtcgatttacttccgggcactccatacaacatgcaaattgccaattgctgcaaagcaggagttataaatacatttaatcaggacccagcaaatgctgcttcctccttccagattagtgtaggtcttgctgggactaccaataagactgttaaggtgccgaagaacttcactcttaagactccaggtcctgggtacacctgtgggcgtgccattgttggcaggccgacaaagtttttcacctcggatggacgcagggcaacccaagctctaatgacgtggaatgtgacttgcacatattcccaatttctagcccagaagactccgtcctgctgtgtatctctctcatcattttacaatgacacaattgtgaactgcccaacatgctcttgtggctgccaaaatccaagtggctccaactgtgtgaatgaggattcaccgaatctacaatctgcaattgatggccctgggaaatggactggtcagcctcttgtacaatgcacctcccacatgtgcccgataagaatccactggcatgtgaagctcaattacaaggaatactggagagtgaaaatcactatcacaaacttcaacttccgcatgaattacacgcagtggaacttagtcgttcagcatccaaactttgataatatcactcagctgttcagtttcaactacaaaccacttaccccatatggtggtggcataaatgatacggcaatgttctggggtgtaaaattctacaacgatttgctgatgcaagctggtaaacttgggaatgtgcaatcagaactacttcttcgcaaggactcccaggctttcaccttcgaaaagggatgggccttcccacgccgagtgtacttcaatggtgataactgtgtcatgccatctcctgaaaattatccatggctgcccaatgcaagccctctaacaaaacaaccattgacactcccactcttagtattctgggttgtgttggctactctgttggcttatgcgtgatgagtgggatcaagagatttagcgagcttcaagttgatgtcagattccatgaggtgcactgcagcaggccatttgttcattcacttccatggttgcacagaagagatgacaccacgccgagaaaagaaagtttatatgtgtgtgtgtttttggaagttaaggcccaaaatgtatttcttgtctggtatatactggccccacagcactttggtgaacttagttactgcaaattaggtaattacagttgcaccttttgtattttatagcaaactcagaatttttcattgaattatgactgctcttcttgtagc

SEQ ID NO: 982 - protein, 449 aa, Panicum virgatum
  misc_feature (54)..(218): Pfam Name: COBRA Pfam Description: COBRA-like protein
  misc_feature (1)..(449): Ceres Clone ID no. 1788775
  misc_feature (1)..(449): Bit score of 907.4 for HMM based on sequences of Figure 9
  misc_feature (1)..(449): Functional Homolog Of SEQ ID NO. 928
MAAGGRSVACCTAVLLAAALLLSAPTATEAYDSLDPNGNITIKWDIMQWTPDGYVAVVTMFNYQQFRHIGAPGWQLGWTWAKKEVIWSMVGAQTTEQGDCSKFKGNTPHCCKKDPTIVDLLPGTPYNMQIANCCKAGVINTFNQDPANAASSFQISVGLAGTTNKTVKVPKNFTLKTPGPGYTCGRAIVGRPTKFFTSDGRRATQALMTWNVTCTYSQFLAQKTPSCCVSLSSFYNDTIVNCPTCSCGCQNPSGSNCVNEDSPNLQSAIDGPGKWTGQPLVQCTSHMCPIRIHWHVKLNYKEYWRVKITITNFNFRMNYTQWNLVVQHPNFDNITQLFSFNYKPLTPYGGGINDTAMFWGVKFYNDLLMQAGKLGNVQSELLLRKDSQAFTFEKGWAFPRRVYFNGDNCVMPSPENYPWLPNASPLTKQPLTLPLLVFWVVLATLLAYA

SEQ ID NO: 983 - DNA, 1362 bp, Populus balsamifera subsp. trichocarpa
  misc_feature (1)..(1362): Ceres Annot ID no. 1450185
  misc_feature (1)..(1362): Encodes the peptide sequence at SEQ ID NO. 984
atgggctttcttgtctctcccatgatgagtttgttctcaaaattcactgtcctgctgctttttgtgctttggtgcgctagttttacttcaacagaagcctatgatcctcttgaccctactgggaatattacaatcaaatgggacatcataagctggactgctgatggctatgtcgctgttgtcacgatttacaacttccagcagtatcgtcacattcaagcaccaggatggtcactgggatggacatgggcaaagaaggaggtaatatggagcatgctgggaggccaagcaaccgaccaaggagattgttcaaaattcaaaggaaacgttccacattgttgtaaaaagagtccgacggttgtagatttattgccaggaactccttataaccagcagactgcaaattgctgcaaggggggagttatcagctcatgggcgcaagatccagccaatgcagcaagctccttccagcttagcgtgggttcagctggaaccagtaacaaaacagtgagattaccaaaaaacttcactctgaaggcaccaggacctggttatacttgtgctcgtgcaaaaattgttaagcctactagatttatgtctacagataaaaggagaatcactcaagctttgatgacatggaacgttacttgcacatattcacaattcctggctcagaagactcctagttgctgtgtctccctctcatcattctacaacgacactatagttccttgtccaaaatgcacctgtggctgccaaagaaacaattcggattcggggggttgtgttgatccaaatgcaccacatttagcttcggttgtttcgagtctagggaataacaaccctatgcctcttgtccaatgcacaagtcacatgtgcccgatcagagttcactggcatgttaagcttaactacaagcaatactggcgcgttaaggtcacaattacaaatttcaattataacatgaactatacgcaatggaacttagttgtgcaacaccccaactttgacaatctgacccagagtttcagttttaactaccagtcattatctccttattcagctattaatgatactgccatgttgtggggagtaaagttctacaatgacttgcttatgcaagccggtcgttctggtaatgttcagtcagagctactttttcgaaaggacaagtcaacttttacctttgataaaggctgggccttccctcggagaatctatttcaatggtgacaattgcgttatgcctcctccagatgcgtatccatggttgcctaatgcaagttcacgccagcttacttcaccgcttatgctaatgatagccttcttttctgttttggctttcttatatggatacgcgtag

SEQ ID NO: 984 - protein, 453 aa, Populus balsamifera subsp. trichocarpa
  misc_feature (57)..(221): Pfam Name: COBRA Pfam Description: COBRA-like protein
  misc_feature (1)..(453): Ceres Annot ID no. 1450185
  misc_feature (1)..(453): Bit score of 918.6 for HMM based on sequences of Figure 9
  misc_feature (1)..(453): Functional Homolog Of SEQ ID NO. 928
MGFLVSPMMSLFSKFTVLLLFVLWCASFTSTEAYDPLDPTGNITIKWDIISWTADGYVAVVTIYNFQQYRHIQAPGWSLGWTWAKKEVIWSMLGGQATDQGDCSKFKGNVPHCCKKSPTVVDLLPGTPYNQQTANCCKGGVISSWAQDPANAASSFQLSVGSAGTSNKTVRLPKNFTLKAPGPGYTCARAKIVKPTRFMSTDKRRITQALMTWNVTCTYSQFLAQKTPSCCVSLSSFYNDTIVPCPKCTCGCQRNNSDSGGCVDPNAPHLASVVSSLGNNNPMPLVQCTSHMCPIRVHWHVKLNYKQYWRVKVTITNFNYNMNYTQWNLVVQHPNFDNLTQSFSFNYQSLSPYSAINDTAMLWGVKFYNDLLMQAGRSGNVQSELLFRKDKSTFTFDKGWAFPRRIYFNGDNCVMPPPDAYPWLPNASSRQLTSPLMLMIAFFSVLAFLYGYA

SEQ ID NO: 985 - DNA, 1834 bp, Gossypium hirsutum
  misc_feature (1)..(1834): Ceres Clone ID no. 1883580
  misc_feature (1)..(1834): Encodes the peptide sequence at SEQ ID NO. 986
ataatttaaaagaaaaaaggcgttttacagtgagattaaagtgttccactacttaaactcaaagtcttaaactttcgtgtcatgtcctgttggacgaaaaagctactcatctccgttcttctctctgagtcttccctgtctgccacagatcttgaaccgaagtcaataacaaaagaagactcctaaaatcctacagaaatgtctaatctttttttgttcattgctagatctttcttcaacctaagctctttcagcgtcttgcttctgtttttgctctctttctcaagtttcactgcaacagaagcctatgatcctttggatcctaatggaaatatcacaatcaaatgggatatcatgagttggactgctgatggctatgttgcagttgtcacaatctttaacttccagcagtaccgtcacatccaagcaccagggtggacattaggttggaaatggtctaagaaggaggtgatttggagtatgatgggaggacaaacaactgaacaaggggattgttcaagattcaaagggaacattccacattgttgtaagaaggacccaacagtcgtggatttattgccaggaacaccttataatcagcagattgcgaattgctgtaaagggggagtgctaaactcatgggtacaagatccagctacggcagcaagctcattccaggtgagtgtggggcaagctggaactacaaacaagacagttagagttccaaaaaacttcactttgaaggcaccagggcccggttatacttgtggtccagcgaaaattgtgaaacccagtagatttgttaccgcggacaaaagaagagtcacacaagctttgatgacttggaatgttacttgcacgtattcacaatttctagctcagaaaacacctacttgttgcgtctctctctcatcattctataatgaaaccatagtaccttgcccgcaatgtgcttgtggctgccaaaatacttctcagcctgggagctgtgtagaccccaaagctccgcatatagcatcggttgttccaagtacagggaagaataactatgcacctttggtccaatgtacaagtcatatgtgtccggtccgagttcattggcatgttaagctaaactacaaggagtattggcgggttaaggtcacaattactaatttcaattataatatgaactatacacagtggaacttagttgtgcaacatcccaacttcgacaatctcacccagattttcagctttaactacaagtctttaactccgtatactgcaataaatgatactgccatgttatggggtgttaaatttttcaacgatttgctttcccaagctggtcagctcggtaatgtgcagtcagagctacttttccgaaaggacaaagcaactttcacttttgagaagggttgggctttcgctcgaagaatctacttcaatggagataattgtgttatgccaccgcccgacgcctatccttggttgcctaacggcagttcccatcagcttatctccacacttagtttgttgacaactctcttggcagcaatggcatttttattgggatatgcataaagttcaaccatttttatactgggaaatctggtatgctccaaaattttgactgaatcagttcgatgtagaatgtacggcgtgagaagttgcagtttgtgtcagttagaggaagtcaatgtgcagtggtgtcgttttaatgtatggtcagtgaattcactcgtgctgttgtatgtatgcatgttcgtttatgtacttaaaccaaaaacaatgttgattgtagaattcccacgatattttattacagtagtaacagacataaatcattgac

SEQ ID NO: 986 - protein, 455 aa, Gossypium hirsutum
  misc_feature (60)..(224): Pfam Name: COBRA Pfam Description: COBRA-like protein
  misc_feature (1)..(455): Ceres Clone ID no. 1883580
  misc_feature (1)..(455): Bit score of 931.0 for HMM based on sequences of Figure 9
  misc_feature (1)..(455): Functional Homolog Of SEQ ID NO. 928
MSNLFLFIARSFFNLSSFSVLLLFLLSFSSFTATEAYDPLDPNGNITIKWDIMSWTADGYVAVVTIFNFQQYRHIQAPGWTLGWKWSKKEVIWSMMGGQTTEQGDCSRFKGNIPHCCKKDPTVVDLLPGTPYNQQIANCCKGGVLNSWVQDPATAASSFQVSVGQAGTTNKTVRVPKNFTLKAPGPGYTCGPAKIVKPSRFVTADKRRVTQALMTWNVTCTYSQFLAQKTPTCCVSLSSFYNETIVPCPQCACGCQNTSQPGSCVDPKAPHIASVVPSTGKNNYAPLVQCTSHMCPVRVHWHVKLNYKEYWRVKVTITNFNYNMNYTQWNLVVQHPNFDNLTQIFSFNYKSLTPYTAINDTAMLWGVKFFNDLLSQAGQLGNVQSELLFRKDKATFTFEKGWAFARRIYFNGDNCVMPPPDAYPWLPNGSSHQLISTLSLLTTLLAAMAFLLGYA

SEQ ID NO: 987 - DNA, 1660 bp, Arabidopsis thaliana
  misc_feature (1)..(1660): Ceres Annot ID no. 1809854
  misc_feature (1)..(1660): Encodes the peptide sequence at SEQ ID NO. 988
gctaattcgtcatttcttgttactataatcttttcattgttattaatcactttggcttaagtttctgtatattacgtcgagcttcttcagtcttcatccttgtcttgtcacttgtcagagacagaagattaaagaagaagaggcgtttctctctctttttttgcttcagaaaaaatggggtttttcttgtgttcctcttcttcaatcttcttcaagttcggaatctctataatctttctagtttctttctctggtttaactccttcagaagcttatgatcctttggacccgagtgggaacattactgtcaaatgggatatcataacctggactggagatggctatgtggcgactgtaacggtatataattttcagcaatatcgacacattcaagctccaggttggactcttggatggtcatgggcaaagagagaggttatatggggaatgaatggaggacaaaccacagaacaaggagattgttctaaattcaaaggaaccattcctcattgctgtaaaaagacaccttctgttgttgatctcttacctggatctccttacaatcagcagattgctaattgttgcagagggggtgtgcttaactcgtgggctcaagatcccgcaactgctgtttccgctttccagcttactgttggacaagctggaaccacaaataagacagttagggtacctaagaatttcactctcaaagctcctggaccgggatatacttgtagccccgcgaagattgtaaaaccgactagattcatcggtactgataaacgaagagttactcaagcattaatgacttggaatgtaacttgcacatactcgcagttcttagctcagaaaacaccaacttgctgtgtatctctttcatcgttttataacaagacaatagtttcttgtccaacatgctcttgtggatgcagaaacacttctcagccagggaattgtgtagacccaaaaggtccacggatagcatcagtcattccaaatccggggaagaacgcatatataccgcctctggtccaatgtacaaagcatatgtgtccagttagaatccactggcatgtgaaagtcaactacaaacagtactggagagttaaagtcaccatcacaaatttcaactacaacatgaactattcacagtggaatctcgtcgtgcagcatccgaatttcgacaatctaactcagacttttagcttcaactataaacctctgactccttatgcttccataaatgatactgggattctctggggaataaagttctacaatgatctgttgatgcaagctgggccatttggtaatgtacaatctgagctacttttccagaaagaagcatcagctttcacatttgagaaaggttgggcgtttccaagaagaatctatttcaatggagataactgtgtgatgcctcctcctgattcttacccttggctgcccaataccggctcgcacaaatcagtcggttccctgtttgcagcaatggccttgttactgattgtgttcctacatggaaacttgtaagaatcatcaagtgtagaattcttctgctgcagtttttcgaactgatataacccatcaagagagagttggtagcttagttttttgtgttctctcttgtctgtcctcttcctgtacaacgctttaatat

SEQ ID NO: 988 - protein, 452 aa, Arabidopsis thaliana
  misc_feature (57)..(221): Pfam Name: COBRA Pfam Description: COBRA-like protein
  misc_feature (1)..(452): Ceres Annot ID no. 1809854
  misc_feature (1)..(452): Bit score of 905.8 for HMM based on sequences of Figure 9
  misc_feature (1)..(452): Functional Homolog Of SEQ ID NO. 928
MGFFLCSSSSIFFKFGISIIFLVSFSGLTPSEAYDPLDPSGNITVKWDIITWTGDGYVATVTVYNFQQYRHIQAPGWTLGWSWAKREVIWGMNGGQTTEQGDCSKFKGTIPHCCKKTPSVVDLLPGSPYNQQIANCCRGGVLNSWAQDPATAVSAFQLTVGQAGTTNKTVRVPKNFTLKAPGPGYTCSPAKIVKPTRFIGTDKRRVTQALMTWNVTCTYSQFLAQKTPTCCVSLSSFYNKTIVSCPTCSCGCRNTSQPGNCVDPKGPRIASVIPNPGKNAYIPPLVQCTKHMCPVRIHWHVKVNYKQYWRVKVTITNFNYNMNYSQWNLVVQHPNFDNLTQTFSFNYKPLTPYASINDTGILWGIKFYNDLLMQAGPFGNVQSELLFQKEASAFTFEKGWAFPRRIYFNGDNCVMPPPDSYPWLPNTGSHKSVGSLFAAMALLLIVFLHGNL

SEQ ID NO: 989 - DNA, 1380 bp, Sorghum bicolor
  misc_feature (1)..(1380): Ceres Annot ID no. 8640602
  misc_feature (1)..(1380): Encodes the peptide sequence at SEQ ID NO. 990
atggcgaggctgcgactcctactgctccggcatctggctgccgccgctgctctgctcgccggcttctcttctctgccacctttggcagaagcatatgatcctcttgatccaaatgggaatatcacaataaaatgggatatcattcagtggacttcagatggttatgttgctgttgtttccatatacaattaccataaataccgacatatccaagcacccgggtggaaccttggatgggtgtgggcaaagaaggagatcatctggaccatagttggcgggcagaccacagagcaaggggattgctctcagttcaaaggcagtataccacactgctgcaagagggatccagcagttgttgacttgcttcctgggacaccttacaacatgcaggatgcaaattgttgcaaaggaggagtgcttaactcatgggttcaagacccagtcagtgcagtggcatcgtttcagatcagtgtcggccgatctggtactaccaactacacagtgaaagcgccactaaacttcactctgaaggccccaggaccaggatacagttgtggagtagctcatgtggtgaagcctcctacgaagttcatttcccaggacggaaggagaaccactcaagctcatgtgacatggaacgtgacatgtacatattcccaatttgttgctcagcgggctccaacttgttgtgtttcactctcatcattttacaatgaaaccatagttaactgcccaaaatgttcatgtggctgtcagaataccagaccgggaagttgtgttgagggtgattcaccttatttggcttctgtcgtgaatggaccgggcaagagcagcatgactcctctagttcagtgcacgccccatatgtgcccgataagagtgcattggcatgttaagctcaactacagggaatactggagggtgaagatcacggttacaaactggaattaccggatgaattactcacaatggaacttggtagttcagcacccaaatttcgacaaagttaccactattttcagcttcaactacaagcctctgaacccctatggagtaataaatgatactggaatgctgtggggtatcaagtactacaatgacctgctcatggtggctgggccagatggaaatgtgcaatctgagcttctgttccggaaggacccgtcgacattcactttcgagaaaggctgggcgttcccaaggcggatatacttcaatggcgacagctgtgtcatgcctccaccagatgcgtacccatggctaccaaactcttcccctgtactcctactgaagagctcatccctcgttctgcccatcgtgatttggacggcgatgctgttcttacggcttggtatgtactcaatccatcccaaattgtaa

SEQ ID NO: 990 - protein, 459 aa, Sorghum bicolor
  misc_feature (55)..(220): Pfam Name: COBRA Pfam Description: COBRA-like protein
  misc_feature (1)..(459): Ceres Annot ID no. 8640602
  misc_feature (1)..(459): Bit score of 868.3 for HMM based on sequences of Figure 9
  misc_feature (1)..(459): Functional Homolog Of SEQ ID NO. 928
MARLRLLLLRHLAAAAALLAGFSSLPPLAEAYDPLDPNGNITIKWDIIQWTSDGYVAVVSIYNYHKYRHIQAPGWNLGWVWAKKEIIWTIVGGQTTEQGDCSQFKGSIPHCCKRDPAVVDLLPGTPYNMQDANCCKGGVLNSWVQDPVSAVASFQISVGRSGTTNYTVKAPLNFTLKAPGPGYSCGVAHVVKPPTKFISQDGRRTTQAHVTWNVTCTYSQFVAQRAPTCCVSLSSFYNETIVNCPKCSCGCQNTRPGSCVEGDSPYLASVVNGPGKSSMTPLVQCTPHMCPIRVHWHVKLNYREYWRVKITVTNWNYRMNYSQWNLVVQHPNFDKVTTIFSFNYKPLNPYGVINDTGMLWGIKYYNDLLMVAGPDGNVQSELLFRKDPSTFTFEKGWAFPRRIYFNGDSCVMPPPDAYPWLPNSSPVLLLKSSSLVLPIVIWTAMLFLRLGMYSIHPKL

SEQ ID NO: 991 - DNA, 1326 bp, Arabidopsis thaliana
  misc_feature (1)..(1326): Ceres Annot ID no. 1326475
  misc_feature (1)..(1326): Encodes the peptide sequence at SEQ ID NO. 992
atgaacattctcttctccagattctcctttttgcttctgtttctctgttcttggaccagtttcactttcaccacaacagaagcttatgatgcacttgatccatatggaaacattactataaaatgggatattatgagctggactggtgatggttatgtggctgttgtaacaatctttaatttccaacaataccgtcacattgaggcgccggggtggcaattaggatggagttggatgaagaaggaagtaatttggagtatggttggtggtcaagcaacagaacaaggagattgttctaagtttaagggtaacattcctcattgctgcaagaaaactccggctatcgttgatttgttaccgggaactccttataaccaacagatatcaaactgttgtagaggcggtgtgattagcgcgtgggcgcaagaccccgcaaccgcgatttcttcgtttcagattagtgttggccagtctggaacaactaatactacggttagagcacctaggaatataactttgaaggctccaggacctggttacacttgcgggcctgcaaaactcgttaagccgagtagattcatttccgcggataaacgaagaaagactcagtctttgcttacatggaacattacttgcacatattcgcagtttctagcacggaaaactccgacttgttgtgtctcactctcagccttctacaatgaaactatagtaccatgtccaacttgttcttgtggatgtcaaaatagttctcaagctggtacatgtgttgaccctaaaatagcttcagtagtaccagccttagggaagaacaacctcgaacctctcttgcaatgtacgcaacatatgtgtcccattcgagttcattggcatgtaaaaactagctacaaagagtactggagagtgaaggttgccatcacaaactttaactacaatatgaactactctcagtggaacttagtcgttcagcatcccaacttcgacaatctcactaagcttttcagtttcaactacaaaccgcttaatccttacttgaacataaatgacacggccatgctatggggaatcaagttctacaatgattttttaagccaagctggtccagtaggcaatgtacagtcagagcttctcttccaaaagaacccattggagttcacattcgagaaaggatgggcgtttccgaggcgcatatacttcaacggtgataactgcgttatgccacctccagactcttatccatggcttccaaacgctagtccaaacattgcaacctcgccatttgtcatacttctcatcactttcttatctgttttgattcttatgtaa

SEQ ID NO: 992 - protein, 441 aa, Arabidopsis thaliana
  misc_feature (52)..(216): Pfam Name: COBRA Pfam Description: COBRA-like protein
  misc_feature (1)..(441): Ceres Annot ID no. 1326475
  misc_feature (1)..(441): Bit score of 895.8 for HMM based on sequences of Figure 9
  misc_feature (1)..(441): Functional Homolog Of SEQ ID NO. 928
MNILFSRFSFLLLFLCSWTSFTFTTTEAYDALDPYGNITIKWDIMSWTGDGYVAVVTIFNFQQYRHIEAPGWQLGWSWMKKEVIWSMVGGQATEQGDCSKFKGNIPHCCKKTPAIVDLLPGTPYNQQISNCCRGGVISAWAQDPATAISSFQISVGQSGTTNTTVRAPRNITLKAPGPGYTCGPAKLVKPSRFISADKRRKTQSLLTWNITCTYSQFLARKTPTCCVSLSAFYNETIVPCPTCSCGCQNSSQAGTCVDPKIASVVPALGKNNLEPLLQCTQHMCPIRVHWHVKTSYKEYWRVKVAITNFNYNMNYSQWNLVVQHPNFDNLTKLFSFNYKPLNPYLNINDTAMLWGIKFYNDFLSQAGPVGNVQSELLFQKNPLEFTFEKGWAFPRRIYFNGDNCVMPPPDSYPWLPNASPNIATSPFVILLITFLSVLILM

SEQ ID NO: 993 - DNA, 1503 bp, Arabidopsis thaliana
  misc_feature (1)..(1503): Ceres Clone ID no. 98007
  misc_feature (1)..(1503): Encodes the peptide sequence at SEQ ID NO. 994
cttctctttcctctctctcacacacatcttcgagaagtttccgccggcgggagagatcaaagacaactgctgatcagaaatcagagatcagagatatgaacattctcttctccagattctcctttttgcttctgtttctctgttcttggaccattttcactttcaccacaacagaagcttatgatgcacttgatccatatggaaacattactataaaatgggatattatgagctggactggtgatggttatgtggctgttgtaacaatctttaatttccaacaataccgtcacatagaggcgccggggtggcaattaggatggagttggatgaagaaggaagtaatatggagtatggttggtggtcaagcaacagaacaaggagattgttctaagtttaagggtaacattcctcattgctgcaagaaaactccggctatcgttgatttgttaccgggaactccttataaccagcagatatccaactgttgtagagggggtgtgattagcgcgtgggcacaagaccccgcaaccgcgatttcttcgtttcagatcagtgttggccagtctggaacaactaatactacggttagagcacctaggaatataactttgaaggctccaggacctggttacacttgcgggcctgcaaaactcgttaagccgagtagattcatttccgcggataaacgaagaaagactcagtctttgcttacatggaacattacttgcacatattcgcagtttctagcacggaaaactccgacttgttgtgtctcactctcagccttctacaatgaaactatagtaccatgtccaacttgttcttgtggatgtcaaaatagttctcaagctggtacatgtgttgaccctaaaatagcttcagtagtaccagccttagggaagaacaacctcgaacctctcttgcaatgtacgcaacatatgtgtcccattcgagttcattggcatgtaaaaactagctacaaagagtactggagagtgaaggttgccatcacaaactttaactacaatatgaactactctcagtggaacttagtctttcagcatcccaacttcgacaatctcactcagcttttcagtttcaactacaaaccgcttaatccttacttgaacataaatgacacggccatgctatggggaatcaagttctacaatgattttttaagccaagctggtccagtaggcaatgtacagtcagagcttctcttccaaaagaacccattggagttcacattcgagaaaggatgggcgtttccgaggcgcatatacttcaacggtgataactgcgttatgccacctccagactcttatccatggcttccaaacgctagtccaaacattgcaacctcgccatttgtcatacttctcatcactttcttatctgttttgattcttatgtaaatggatatctatataccgtcatggacatgtttggtgatgtttacattataagtgagtgtgttattaggaaatcattctttgc

SEQ ID NO: 994 - protein, 441 aa, Arabidopsis thaliana
  misc_feature (52)..(216): Pfam Name: COBRA Pfam Description: COBRA-like protein
  misc_feature (1)..(441): Ceres Clone ID no. 98007
  misc_feature (1)..(441): Bit score of 895.3 for HMM based on sequences of Figure 9
  misc_feature (1)..(441): Functional Homolog Of SEQ ID NO. 928
MNILFSRFSFLLLFLCSWTIFTFTTTEAYDALDPYGNITIKWDIMSWTGDGYVAVVTIFNFQQYRHIEAPGWQLGWSWMKKEVIWSMVGGQATEQGDCSKFKGNIPHCCKKTPAIVDLLPGTPYNQQISNCCRGGVISAWAQDPATAISSFQISVGQSGTTNTTVRAPRNITLKAPGPGYTCGPAKLVKPSRFISADKRRKTQSLLTWNITCTYSQFLARKTPTCCVSLSAFYNETIVPCPTCSCGCQNSSQAGTCVDPKIASVVPALGKNNLEPLLQCTQHMCPIRVHWHVKTSYKEYWRVKVAITNFNYNMNYSQWNLVFQHPNFDNLTQLFSFNYKPLNPYLNINDTAMLWGIKFYNDFLSQAGPVGNVQSELLFQKNPLEFTFEKGWAFPRRIYFNGDNCVMPPPDSYPWLPNASPNIATSPFVILLITFLSVLILM

SEQ ID NO: 995 - DNA, 1296 bp, Populus balsamifera subsp. trichocarpa
  misc_feature (1)..(1296): Ceres Annot ID no. 1481980
  misc_feature (1)..(1296): Encodes the peptide sequence at SEQ ID NO. 996
atgggcatggtcttgattttgatcttcttcttcttctatctcattagctctatatcaccttcttatgggtttgacccacttgatccttatggcaacataaccatcaaatgggatcttcttctatcgaattccggtacaaataatctgatggtatcaatttacaacttccaacaatatcgccatgtggaaccaccaggctggaaattgaattgggcatggaaaggcaaagaggtgatatggtcaatgcagggagctgaggctactgagcaaggaaactgcactgaattcaaggaatcaacccttcctcattgttgtgagaaggagccattcattgtagaccttcttcccggaaccaattataatgctcaaacccaaaattgttgcaagggaggtgtactgtcatccatgaagcaagatccttccaagtatgttgctacttttcagatggctgtcggaggttctggtaccaattcccaatttaaaatgccggaaaatttcaaacttggagttccaggctatagttgtgggggtgcagttaaggtagaacccagcaggtacacaacagatggaggccggcgatggacacaggctcttgcgacatggaatgtgacctgcatgtactcccagagtttagcatcacctacaccaagatgttgtgtttccttgtctgcattctacaatcaaactattgtttcgtgccccagatgcagctgcggctgccaaggacaacctggaacaaaatgtgtaaagtatggtgagaccccaccattgctgaaacaaaatcaagatccaacacctgtagtaaggtgctcagagcatatgtgcccaataagggtgcattggcatctgaaagaaagttacaaacaatattggagggctaaaatgacagttacaaatttccacatcatgaaaaattattcagaatggaacttggtggtgctacatcccaacctgcaaagtctgacacaggttttcagcttcaactacgcacccctcaatcgatacggatatatcaatgatactgggatgttttgggggcttcctttttacaatgacattttactacaagaaggaaaggatgggaatttacagactgaaattttactacgcaaagatccagggatttttactttcagagaaggttggggtttccctagaaagattcaatttaatggtgatgaatgtgtcatgcctccaccggatgaatatccatcgctgcccaacaaggggcatagtgcctctgctaccacacctttcataattcttttctctttgtttctcgcatttatgctctaa

SEQ ID NO: 996 - protein, 429 aa, Populus balsamifera subsp. trichocarpa
  misc_feature (48)..(207): Pfam Name: COBRA Pfam Description: COBRA-like protein
  misc_feature (1)..(429): Ceres Annot ID no. 1481980
  misc_feature (1)..(429): Bit score of 631.8 for HMM based on sequences of Figure 9
  misc_feature (1)..(429): Functional Homolog Of SEQ ID NO. 928
MVLILIFFFFYLISSISPSYGFDPLDPYGNITIKWDLLLSNSGTNNLMVSIYNFQQYRHVEPPGWKLNWAWKGKEVIWSMQGAEATEQGNCTEFKESTLPHCCEKEPFIVDLLPGTNYNAQTQNCCKGGVLSSMKQDPSKYVATFQMAVGGSGTNSQFKMPENFKLGVPGYSCGGAVKVEPSRYTTDGGRRWTQALATWNVTCMYSQSLASPTPRCCVSLSAFYNQTIVSCPRCSCGCQGQPGTKCVKYGETPPLLKQNQDPTPVVRCSEHMCPIRVHWHLKESYKQYWRAKMTVTNFHIMKNYSEWNLVVLHPNLQSLTQVFSFNYAPLNRYGYINDTGMFWGLPFYNDILLQEGKDGNLQTEILLRKDPGIFTFREGWGFPRKIQFNGDECVMPPPDEYPSLPNKGHSASATTPFIILFSLFLAFML

SEQ ID NO: 997 - DNA, 1329 bp, Sorghum bicolor
  misc_feature (1)..(1329): Ceres Annot ID no. 8702104
  misc_feature (1)..(1329): Encodes the peptide sequence at SEQ ID NO. 998
atggccgcgcaatccgcgattattgctgatcgttttcaccgcgtcgaatcagatgcctacgaccccgtagatccgaacgggaacatcacgatcaactgggattttcaggtcctcaacgtcaaggacatgtccccgtacacggtcatggtgagcatccacaactaccagatgtaccggcacatcgagcacccggggtggcggctgagctggaactggaccggcaaggaggtcatctggaacacggtgggcgcggagacgacggagcagggcgactgctcccgcgtcggcgccgccaacgcccgcccgcattgctgcctgaggcggcccgtcatggtggacctcccgcccggcaccccgtacaacaggcaggtcgccaactgctgccgcggcggcgtgctgtcgtccttcgtccagaacaatctgacgtccaccgccgcgttccagatggtcgtcggcgagttcgccctcgccaaggacgacggcggcggtagtatggagcccgagaagccgtggcatttcgacatcggcgtgccagggtacacctgcagcaacgccaccacggtagccccgaccagggtcaaggtcgacaagaaccgctacgaacaagtgctcctgacatggcaggtgacctgctcgtactctcagtaccgggcgtcgggggtgccgtcgtgctgcgtctccatgtcgacgttctacagcgagacgatcgtggattgcccgcgctgcagctgcgcctgccaagggtccccaacgccaacgtcgccacaatgcgtcagcgtcgaccaaccacggacaccagcgttgccggcgagcagcgacgacgagccggcggcgccgatcgtctggtgctcggagcacatgtgcccgatccgggtgcactggcacgtgaaggtgaactaccggcagtactggcgggtgaaagtgacggtgtccaactacaacctggtgaagaactacagcgactggaacctggtgctgcagcaccccaacctgcggagcctcacgcagctgttcagcttcaattacaagcctctcgtcgagtacggcagcttcaatgacacggggatgttctgggggttacgtttctacaacgagatgctgctgcaggacgggaacgtgcagacggagatgattctggagaaggagagcgacttcacctattccggcggctgggcgttcccgaggagggtctacttcaacggccaagagtgcgtcatgccgccggcggaccagtaccccaaactgcccaacggggcctcggaattgcgggggtcgtcgctgatcgccggcaattgcttgctgctgctattcttcttcgttctcgtgtag

SEQ ID NO: 998 - protein, 442 aa, Sorghum bicolor
  misc_feature (46)..(215): Pfam Name: COBRA Pfam Description: COBRA-like protein
  misc_feature (1)..(442): Ceres Annot ID no. 8702104
  misc_feature (1)..(442): Bit score of 570.7 for HMM based on sequences of Figure 9
  misc_feature (1)..(442): Functional Homolog Of SEQ ID NO. 928
MAAQSAIIADRFHRVESDAYDPVDPNGNITINWDFQVLNVKDMSPYTVMVSIHNYQMYRHIEHPGWRLSWNWTGKEVIWNTVGAETTEQGDCSRVGAANARPHCCLRRPVMVDLPPGTPYNRQVANCCRGGVLSSFVQNNLTSTAAFQMVVGEFALAKDDGGGSMEPEKPWHFDIGVPGYTCSNATTVAPTRVKVDKNRYEQVLLTWQVTCSYSQYRASGVPSCCVSMSTFYSETIVDCPRCSCACQGSPTPTSPQCVSVDQPRTPALPASSDDEPAAPIVWCSEHMCPIRVHWHVKVNYRQYWRVKVTVSNYNLVKNYSDWNLVLQHPNLRSLTQLFSFNYKPLVEYGSFNDTGMFWGLRFYNEMLLQDGNVQTEMILEKESDFTYSGGWAFPRRVYFNGQECVMPPADQYPKLPNGASELRGSSLIAGNCLLLLFFFVLV

SEQ ID NO: 999 - DNA, 1365 bp, Arabidopsis thaliana
  misc_feature (1)..(1365): Ceres Annot ID no. 1297618
  misc_feature (1)..(1365): Encodes the peptide sequence at SEQ ID NO. 1000
atgggtgcaatgctaaatcttttgctcgtcgttactgtcattctctgttcaatcttatcacccacacggtttatgattatgattgataaaatggttgcagatggatacgatcctcttgatccgttcggaaaaatcattatcaaatgggatcttcttttatcatcacctggccaacaccacgtacaagtaacgttagagaacatgcaagagtatcgacacgtggaaaagccagggtggaagcttagctggcattggctcaaccaagaagtgatatgggacatgaaaggagctgagacgacggagcaaggtaattgctctgcctttgcctccagcggtaaccttcctcactgctgtctcgagcgaccaaccatagtcgaccttcttcccggtgcttctctcaacgttcaagttgccaattgttgccgtggaggcgtcttgacttccatgtctcaggaccacgccaatcacgtctctgcttttcacatgacagttggaagctctcctgatggccctgaggagttcaatatgccttctaatttcgatataggggtcccgggttatagctgcgacaatgctacatccgtgtccccgactaagtttagtactgataagggccgtcgcaaaacacaagctctagcaacatgggaggcagtgtgtgtatactcgcagtttcggtcatcaccatcgccaaaatgctgcgtttcactctctgccttctactaccaaaacattgttccttgtcctacctgtagctgcggctgctcgagttcccattgtgtcaaggatggagagttgccgccatatcttgaacagaaacatgatccagatgaggaagtatcgcctgtcgtgaagtgttcggatcatatgtgtcccatccgcatccactggcatgtgaaagtgaactatagagagtattggagggttaagatcacagcaacaaatttcaacacaatgaagaattacactaattggaacttagtggtgcttcatccaaacttgaaaagcgtccaacaagtctttagctttaactacaaatctttgacaccatatcaaaacagcatcaatgacacagggatgttttggggagtccagttttataatgatgttttgcttcaagaaggaaagattgggaatgttcaaacagagttattgctgaagaaggatatgggaaatttcactttcagagaaggttgggctttcccaaggagaatcttgttcaatggtgatgaatgtgttatgccttctccagatgactttccaaggctgccaaaatctgctcattcctcttcgtcttcctctgctgttattagctctgtttcagtcgttttctgttttctccttcatcatcttcttctactagtttga

SEQ ID NO: 1000 - protein, 454 aa, Arabidopsis thaliana
  misc_feature (59)..(223): Pfam Name: COBRA Pfam Description: COBRA-like protein
  misc_feature (1)..(454): Ceres Annot ID no. 1297618
  misc_feature (1)..(454): Bit score of 613.1 for HMM based on sequences of Figure 9
  misc_feature (1)..(454): Functional Homolog Of SEQ ID NO. 928
MGAMLNLLLVVTVILCSILSPTRFMIMIDKMVADGYDPLDPFGKIIIKWDLLLSSPGQHHVQVTLENMQEYRHVEKPGWKLSWHWLNQEVIWDMKGAETTEQGNCSAFASSGNLPHCCLERPTIVDLLPGASLNVQVANCCRGGVLTSMSQDHANHVSAFHMTVGSSPDGPEEFNMPSNFDIGVPGYSCDNATSVSPTKFSTDKGRRKTQALATWEAVCVYSQFRSSPSPKCCVSLSAFYYQNIVPCPTCSCGCSSSHCVKDGELPPYLEQKHDPDEEVSPVVKCSDHMCPIRIHWHVKVNYREYWRVKITATNFNTMKNYTNWNLVVLHPNLKSVQQVFSFNYKSLTPYQNSINDTGMFWGVQFYNDVLLQEGKIGNVQTELLLKKDMGNFTFREGWAFPRRILFNGDECVMPSPDDFPRLPKSAHSSSSSSAVISSVSVVFCFLLHHLLLLV

SEQ ID NO: 1001 - protein, 451 aa, Bambusa oldhamii
  misc_feature (47)..(211): Pfam Name: COBRA Pfam Description: COBRA-like protein
  misc_feature (1)..(451): Bit score of 1154.2 for HMM based on sequences of Figure 9
  misc_feature (1)..(451): Functional Homolog Of SEQ ID NO. 928
MELRRNSMLVALILAVTCSVAVAYDPLDPNGNITIKWDVTSWTPDGYVAMVTMNNYQMYRQIMAPGWTVGWSWAKKEVIWSIVGAQATEQGDCSKFKGGIPHCCKRTPAIVDLLPGVPYNQQIANCCKAGVVSAYGQDPAGALSAFQVSVGLAGTTNKTVKLPKNFTLMGPGLGYTCGPATIVPSTVYLTPDRRRKTQALMTWTVTCTYSQQLASRYPTCCVSFSSFYNSTIVPCAKCACGCGHGHGHGGGHSDGGRGSCVMGDSKRALSPGVNTPRKDGAALLQCTPHMCPVRVHWHVKLNYKDYWRAKIAITNFNYRMNYTQWTLVAQHPNLNNVTEVFSFEYKPLLPYGNINDTGMFYGLKFYNDLLMEAGPFGNVQSEVLMRKDANTFTFSQGWAFPRKIYFNGDECKMPPPDSYPYLPNSAPLAPPRSATAAAMASASLLVLLLVA

SEQ ID NO: 1002 - protein, 468 aa, Oryza sativa
  misc_feature (46)..(210): Pfam Name: COBRA Pfam Description: COBRA-like protein
  misc_feature (1)..(468): Bit score of 1150.9 for HMM based on sequences of Figure 9
  misc_feature (1)..(468): Functional Homolog Of SEQ ID NO. 928
MELHRCSLLALLLAVTCSVAVAYDPLDPKGNITIKWDVISWTPDGYVAMVTMSNYQMYRQILAPGWTVGWSWAKKEVIWSIVGAQATEQGDCSKFKGGIPHSCKRTPAIADLLPGVPYNQQIANCCKAGVVSAYGQDPAGSVSAFQVSVGLAGTTNKTVKLPTNFTLAGPGPGYTCGPATIVPSTVYLTPDRRRRTQALMTWTVTCTYSQQLASRYPTCCVSFSSFYNSTIVPCARCACGCGHDGYRGNGGGGKNARAGDGRSRRNSGGGGGHSGGTECIMGDSKRALSAGVNTPRKDGAPLLQCTSHMCPIRVHWHVKLNYKDYWRAKIAITNFNYRMNYTQWTLVAQHPNLNNVTEVFSFQYKPLLPYGNINDTGMFYGLKFYNDLLMEAGPFGNVQSEVLMRKDYNTFTFSQGWAFPRKIYFNGDECKMPPPDSYPYLPNSAPIGPPRSVAAAASAILVVLLLVA

SEQ ID NO: 1003 - protein, 436 aa, Oryza sativa
  misc_feature (46)..(210): Pfam Name: COBRA Pfam Description: COBRA-like protein
  misc_feature (1)..(436): Bit score of 1148.5 for HMM based on sequences of Figure 9
  misc_feature (1)..(436): Functional Homolog Of SEQ ID NO. 928
  misc_feature (415)..(415): Xaa is any aa, unknown, or other
MELHRCSLLALLLAVTCSVAVAYDPLDPKGNITIKWDVISWTPDGYVAMVTMSNYQMYRQILAPGWTVGWSWAKKEVIWSIVGAQATEQGDCSKFKGGIPHSCKRTPAIVDLLPGVPYNQQIANCCKAGVVSAYGQDPAGSVSAFQVSVGLAGTTNKTVKLPTNFTLAGPGPGYTCGPATIVPSTVYLTPDRRRRTQALMTWTVTCTYSQQLASRYPTCCVSFSSFYNSTIVPCARCACGCGGGTECIMGDSKRALSAGVNTPRKDGAPLLQCTSHMCPIRVHWHVKLNYKDYWRAKIAITNFNYRMNYTQWTLVAQHPNLNNVTEVFSFQYKPLLPYGNINDTGMFYGLKFYNDLLMEAGPFGNVQSEVLMRKDYNTFTFSQGWAFPRKIYFNGDECKMPPPDSYPYLPNSAPXRAAAFGLKILLLFFLQAWKPV

SEQ ID NO: 1004 - protein, 461 aa, Ricinus communis
  misc_feature (72)..(236): Pfam Name: COBRA Pfam Description: COBRA-like protein
  misc_feature (1)..(461): Bit score of 1150.7 for HMM based on sequences of Figure 9
  misc_feature (1)..(461): Functional Homolog Of SEQ ID NO. 928
MMVVDNSAYSSQKIVFQATKSHQWNLFAQVKLILLVTLASLMLPYADAYDPLDPNGNITIKWDVMSWTPDGYVATVTMSNFQMYRHIISPGWTLSWSWAKKEVIWSMNGAQATEQGDCSKFKGNIPHCCKKTPTIVDLLPGVPYNQQFSNCCKGGVVAAWGQDPSASVSAFQVSVGLAGTSNKTVKLPKNFTLLGPGPGYTCGPAKVVPSTVFFTPDHRRKTQALMTWNVTCTYSQFLASKNPTCCVSLSSFYNETITPCPSCACGCRNKNSCIMSDSKEAHRKGINTPKKDNTPLLQCTHHMCPVRVHWHVKVNYKDYWRAKVAVTNFNYRMNYTQWTLVVQHPNLNNVTQVFSFDYKPLVPYESINDTGMFYGMKFYNDLLMEAGPFGNIQSEVLLRKDRNTFTLKQGWAFPRKVYFNGDECKMPPPDAYPYLPNSAYRNPVTFLTVAASLLLLLVSWW

SEQ ID NO: 1005 - protein, 453 aa, Populus trichocarpa
  misc_feature (64)..(228): Pfam Name: COBRA Pfam Description: COBRA-like protein
  misc_feature (1)..(453): Bit score of 1174.0 for HMM based on sequences of Figure 9
  misc_feature (1)..(453): Functional Homolog Of SEQ ID NO. 928
MEFDKSAKDCYQSLQRSLLAEMKFIFLIALVFMIVSRAAAYDPLDPNGNITIKWDVMSWTPDGYVATVTMSNFQMYRHIISPGWTLSWSWAKKEVLWSMVGAQTTEQGDCSKFKGNIPHCCKKTPTVVDLLPGVPYNQQFSNCCKGGVMAAWGQDPTASVSAFQVSVGLAGTSNKTVKLPKNFTLLGPGPGYTCGPAKVVPSTVFLTPDRRRKTQALMTWNVTCTYSQFLASKNPTCCVSFSSFYNETITPCPTCACGCQNKNSCVKSNSKESHKKGINTPKKDNTPLLQCTHHMCPIRVHWHVKVNYRDYWRAKVAVTNFNYRMNYTEWTLVVQHPNLNNVTQVFSFDYKPLVPYESINDTGMFYGMKFYNDLLMEAGPFGNVQSEVLLQKDKNTFSLKQGWAFPRKVYFNGDECMLPPPDTYPYLPNSAYANPTSILSMAASLLLILLSMG

SEQ ID NO: 1006 - protein, 433 aa, Gossypium hirsutum
  misc_feature (43)..(207): Pfam Name: COBRA Pfam Description: COBRA-like protein
  misc_feature (1)..(433): Bit score of 1135.9 for HMM based on sequences of Figure 9
  misc_feature (1)..(433): Functional Homolog Of SEQ ID NO. 928
MKFFISVLFLFVLFSYAAAYDPLDPNGNVTIKWDIVSWTPDGYVAVVTMNNFQMYRHIMSPGWTLGWTWAKKEVIWSMVGAQTTEQGDCSKFKGNIPHCCKKTPTVVDLLPGVPYNQQFTNCCKGGVLAAWGQDPQSAVSAFQISVGLAGTSNKTVKLPKNFTLLGPGPGYTCGPAKVVPSTTFLTPDRRRKTQALMTWNVTCTYSQFLARKNPNCCVSFSSFYNETITPCPTCACGPRVRNNCVKSDSKFLKMVGLNTPRKDNAPLLQCTHHMCPVRVHWHVKLNYKEYWRVKVSITNFNYRMNYTLWSLVVQHPNLNNVTQVFSFDYKPLVPYESINDTGMFYGMKYYNDLLMEAGPLGNVQSEVLLRKDKDTFTFKQGWAFPRKVYFNGDECMLPPPDTYPFLPNSAHQHLSFTSFTFIAAMFFLFVTFW

SEQ ID NO: 1007 - protein, 450 aa, Vitis vinifera
  misc_feature (62)..(226): Pfam Name: COBRA Pfam Description: COBRA-like protein
  misc_feature (1)..(450): Bit score of 1141.7 for HMM based on sequences of Figure 9
  misc_feature (1)..(450): Functional Homolog Of SEQ ID NO. 928
MPYPFDKGELLDGSQASIRFNFVPLVQFSCSVFVYAAAYDPLDPNGNITIKWDIMSWTPDGYVAVVTMHNFQMYRHIISPGWTLGWTWAKKEVIWSMVGAQTTEQGDCSKFKGNIPHCCKKTPTVVDLLPGVPYNQQFSNCCKGGVVSSWGQDPAASVSAFQVSVGLAGTSNKTVKLPKNFTLLGPGPGYTCGIAKIVPPTNFLTPDRRRKTQALMTWNVTCTYSQLRARKNPSCCVSFSSFYNETITPCPSCACGCQNKNNCVQSDSKLLSMVGINTPRKDNVPLLQCTHHMCPVRVHWHLKINYKDYWRVKVSITNFNYRLNYTLWTLVVQHPNLNNVTQVFSFDYKPLVPYESINDTGMFYGMKFYNDQLMEAGPFGNVQSEVLFQKDNSFTFKQGWAFPRKVYFNGDECMLPLPETYPFLPNSAHQNLLAFSTFISSVIFLLVTVW

SEQ ID NO: 1008 - protein, 430 aa, Eucalyptus nitens
  misc_feature (42)..(206): Pfam Name: COBRA Pfam Description: COBRA-like protein
  misc_feature (1)..(430): Bit score of 1093.2 for HMM based on sequences of Figure 9
  misc_feature (1)..(430): Functional Homolog Of SEQ ID NO. 928
MRSVILAFVFVFVFHAAAYDPLDPNGNVTIKWDIMSWTTDGYVAVVTLNNFQMYRHIMSPGWTIGWAWAKKEIIWSMVGAQTTEQGDCSKFKAAIPHSCKRTPTVVDLLPGVPYNLQYANCCKGGVVAAWGQDPLASVSAFQISVGLSGTSNKTVKLPKNLTLLGPGPGYACGPAKVVPSTNFLTTDKRRKTQALMTWNVTCTYSQFLARKNPSCCVSFSSFHNETITPCPSCACGCQNKNTCVNGSKILSMAGVNTPKKDNAPLLQCTHHMCPVRVHWHVKLNYKDYWRVKIAITNFNYRMNYTLWSLVVQHPNLNNVTQVFSMDYKPLVAYESINDTGMFFGMKYYNDLLMEAGPLGNVQSEVLLQKDKNTFTFKQGWAFPRKVYFNGDECMLPPPDSYPFLPNSARRKLLPVSTLVSWVLLMMFAAW

SEQ ID NO: 1009 - protein, 437 aa, Vitis vinifera
  misc_feature (49)..(213): Pfam Name: COBRA Pfam Description: COBRA-like protein
  misc_feature (1)..(437): Bit score of 1039.2 for HMM based on sequences of Figure 9
  misc_feature (1)..(437): Functional Homolog Of SEQ ID NO. 928
MEFNRVAYSIVSAVFFSMVLSPAVAYDPLDPNGNITIKWDVMSWTSDGYVVMVTMSNFQMYRHIMSPGWTLGWIWAKKEVIWSMVGAQATEQGDCSKFKGNIPHCCKRNPTVIDLLPGVPYNQQIANCCKGGVVASWGQDSSAAVSSFQLSVGLSGTSNKTVRLPKNFTLLGPGPGYTCGQAKTVPSSIFLSSDGRRKTQALMTWNVTCTYSQMVVSKYPSCCVSFSSFYNSTITPCTSCACGCQNKNNCIIDTKIESVVGLHTPTKDNMPLLQCTQHNCPVRVHWHVKVNYKEYWRVKITITNFNYRMNYTQWTLVAQHPNLNNITQVFSFAYKPLIPYTSINDSGMFYGIKFYNDVLMEDGPDGNVQSEMILQKDKNTFTLKEGWAFPQRIYFNGDECMMPLPDSYPLLAGSAPANQIALSTLASLVLLILLAFQ

SEQ ID NO: 1010 - protein, 431 aa, Glycine max
  misc_feature (43)..(207): Pfam Name: COBRA Pfam Description: COBRA-like protein
  misc_feature (1)..(431): Bit score of 1148.4 for HMM based on sequences of Figure 9
  misc_feature (1)..(431): Functional Homolog Of SEQ ID NO. 928
MRVVISAVCAIVLFSYAAAYDPLDPNGNITIKWDVVSWTPDGYVAVVTMSNFQMFRHIMNPGWTLGWTWAKKEVIWSMVGAQTTEQGDCSKFKGNVPHCCKKTPTVVDLLPGVPYNQQFSNCCKGGVVAAWGQDPSSAVSSLQVSIGLAGTSNKTVKLPKNFTLLGPGPGYTCGPAKVVPSTVFLTPDKRRKTQALMTWNVTCTYSQFLARKNPGCCVSLSSFYNEAITPCPTCACGCQNRRNCVKSDSKRINMVGIHTPKKDNEPLLQCTHHMCPIRVHWHVKLNYKDYWRVKVAVTNFNYRMNYSLWTLAVQHPNLNNVTQVFRFDYKPLLPYESINDTGMFYGMKYFNDLLMEAGPTGNVQSEILLQKNQETFTFKQGWAFPRKVYFNGEECMLPPPDSYPILPNSAPVNLLNFPAFIFTMLVMIAVW

SEQ ID NO: 1011 - protein, 431 aa, Glycine max
  misc_feature (43)..(207): Pfam Name: COBRA Pfam Description: COBRA-like protein
  misc_feature (1)..(431): Bit score of 1161.2 for HMM based on sequences of Figure 9
  misc_feature (1)..(431): Functional Homolog Of SEQ ID NO. 928
  misc_feature (255)..(255): Xaa is any aa, unknown, or other
MRLVISAVCVIVLFSYAAAYDPLDPNGNITIKWDVVSWTPDGYVAVVTMSNFQMFRHIMNPGWTLGWTWAKKEVIWSMVGAQTTEQGDCSKFKGNVPHCCKKTPTVVDLLPGVPYNQQFSNCCKGGVVAAWGQDPSSAVSSFQVSIGLAGTSNKTVKLPKNFTLLGPGPGYTCGPAKVVPSTVFLTPDKRRKTQALMTWNVTCTYSQFLARKNPGCCVSLSSFYNETITPCPTCACGCQNKRNCVKSNSKRINMXGIHTPKKDNEPLLQCTHHMCPIRVHWHVKLNYKDYWRVKVAVTNFNYRMNYSLWTLAVQHPNLNNVTQVFSFDYKPLLPYESINDTGMFYGMKYFNDLLMEAGPTGNVQSEILLQKNQDTFTFKQGWAFPRKVYFNGEECMLPPPDSYPILPNSAPVNLLNFPAFVLTMLVMITVW

SEQ ID NO: 1012 - protein, 431 aa, Glycine max
  misc_feature (43)..(207): Pfam Name: COBRA Pfam Description: COBRA-like protein
  misc_feature (1)..(431): Bit score of 1157.0 for HMM based on sequences of Figure 9
  misc_feature (1)..(431): Functional Homolog Of SEQ ID NO. 928
MRLVISAVCVIVLFSYAAAYDPLDPNGNITIKWDVVSWTPDGYVAVVTMSNFQMFRHIMNPGWTLGWTWAKKEVIWSMVGAQTTEQGDCSKFKGNVPHCCKKTPTVVDLLPGVPYNQQFSNCCKGGVVAAWGQDPSSAVSSFQVSIGLAGTSNKTVKLPKNFTLLGPGPGYTCGPAKVVPSTVFLTPDKRRKTQALMTWNVTCTYSQFLARKNPGCCVSLSSFYNETITPCPTCACGCQNKRNCVKSNSKRINMVGIHTSKKDNEPLLQCTHHMCPIRVHWHVKLNYKDYWRVKVAVTNFNYRMNYSLWTLAVQHPNLNNVTQVFSFDYKPLLPYESINDTGMFYGMKYFNDLLMEAGPTGNVQSEILLQKNQDTFTFKQGWAFPRKVYFNGEECMLPPPDSYPILPNSAPVNLLNFPAFVLTMLVMITVW

SEQ ID NO: 1013 - protein, 439 aa, Populus trichocarpa
  misc_feature (49)..(213): Pfam Name: COBRA Pfam Description: COBRA-like protein
  misc_feature (1)..(439): Bit score of 1026.6 for HMM based on sequences of Figure 9
  misc_feature (1)..(439): Functional Homolog Of SEQ ID NO. 928
MDFDRFSSPFFSAVCFILVFSRAEAYDYLDPTGNITLKWDVISWTPDGYVAVVTMTNFQMYRHIMSPGWTVGWTWAKKEVIWSMVGAQATEQGDCSKFRMNIPHCCMKNPTVVDMLPGVPYNQQIANCCKGGVVSSWGQDPSAAVSSFQLSVGRSGTTNKTVRLPKNFTLLGPGLGYSCSQAKIVPSTVFLTSDGRRKTQAMMTWNVTCTYSQMLASKNPTCCVSMSSFYNSTITPCRTCACGCQNNSTCVPSDSMIQSVVGLNTPTKDNTPLVQCTKHNCPIRVHWHVKLNYKEYWRVKISITNFNYRLNYTQWTLVAQHPNLNNITQVFSFAYKPLLPYKSANDSGMFYGVKFFNDILMEAGPDGNIQTELILQKDKNTFTLNKGWAFPRKVYFNGDECMMPLPDDYPYLPNSAPKNVIGLSFVISAFFLLELIAFW

SEQ ID NO: 1014 - protein, 456 aa, Glycine max
  misc_feature (61)..(225): Pfam Name: COBRA Pfam Description: COBRA-like protein
  misc_feature (1)..(456): Bit score of 960.0 for HMM based on sequences of Figure 9
  misc_feature (1)..(456): Functional Homolog Of SEQ ID NO. 928
MEHTMLPAIGSVFPRGVFAALLLMLLFSFSTFTSIEAYDPLDPTGNITIKWDVISWTPDGYVAVVTMYNFQQYRHIQAPGWSLGWTWAKKEVIWSMMGAQTTEQGDCSKFKAGIPHCCKKDPTVVDLLPGTPYNQQIANCCKGGVLNSWGQDPSNAVSSFQFSVGSAGTTNKTVKMPKNFTLKAPGPGYTCGPAKVVKPTVFITNDKRRTTQAMMTWNITCTYSQFLAQKAPSCCVSLSSFYNDTVVNCPTCTCGCRNKTEPGSCVDPNSPHLASVVSASGKTANTPLVQCTSHMCPIRVHWHVKLNYKEYWRVKITITNFNYRMNYSQWNLVVQHPNLDNITQLFSFNYKSLNPYEGLNDTSMLWGVKFYNDFLSSAGSLGNVQSEILLRKDKSTFTFDKGWAFPRRIYFNGDNCVMPPPDAYPWLPNASSKLVFSLLSTVIATLASLLILLNQS

SEQ ID NO: 1015 - DNA, 843 bp, Arabidopsis thaliana
  misc_feature (1)..(843): Ceres Annot ID no. 553111
  misc_feature (1)..(843): Encodes the peptide sequence at SEQ ID NO. 1016
atgacgtcgtcctctccaacacagcgtactcacgtctcaattcctcctgaaccaggaggaaagtcactaacacaagaagctaatgagccaccagttccgatatcagtttcctcgccgtgcgggaaacgaaccagagatcccgaagacgaggtctatctcgataaccttcgctctcagaaacgttatcttagcgagataatggcttgtagtttaaacggactaacagtaggagactcacttcctgtcaacatgttagagtctccagcacggtctgagagctttctttatcacagggatgatttatcattacaatactctcccatgtcagaagactcggacgaagcgagattctgtgaggacccaacagcaacagcaagcactagctcatcgcaacccgagagccgcccaactagtccagtttcaccataccgataccaaagacctcttacttcaacaaactcaccacaaccgtcaccaacaatcttacaccattcacatacatgtcctgcctccatgatctccaatgcagcaactactactacaccacagtctcgccaaagaggatcagacacagaaggaaggtttccatcatcgcccagtgatatctgccattcgggtgacttgaggagaaccgctctactcaggtcggttcaaatgagaacacaaccatgtggttatagttcaagttcgggaccaagcaatattgacggtgaagagaggatgtgttctaagtctatggaagaagatagaggctataacaaaggggaagatatcccttacgctgaagtctctagtaagagcaagtcttgtaaagcattggacatgagactttgtgaaaagtga

SEQ ID NO: 1016 - protein, 280 aa, Arabidopsis thaliana
  misc_feature (1)..(280): Ceres SEED LINE ID no. CW00758
  misc_feature (1)..(280): Ceres Annot ID no. 553111
  misc_feature (1)..(280): Bit score of 501.4 for HMM based on sequences of Figure 25
  misc_feature (1)..(280): in Figure 25
MTSSSPTQRTHVSIPPEPGGKSLTQEANEPPVPISVSSPCGKRTRDPEDEVYLDNLRSQKRYLSEIMACSLNGLTVGDSLPVNMLESPARSESFLYHRDDLSLQYSPMSEDSDEARFCEDPTATASTSSSQPESRPTSPVSPYRYQRPLTSTNSPQPSPTILHHSHTCPASMISNAATTTTPQSRQRGSDTEGRFPSSPSDICHSGDLRRTALLRSVQMRTQPCGYSSSSGPSNIDGEERMCSKSMEEDRGYNKGEDIPYAEVSSKSKSCKALDMRLCEK

SEQ ID NO: 1017 - DNA, 869 bp, Brassica napus
  misc_feature (1)..(869): Ceres Clone ID no. 949027
  misc_feature (1)..(869): Encodes the peptide sequence at SEQ ID NO. 1018
aaccgctttatagagattcgttgatacactgtaaaatttgttagggtttgaaaatggggccggaatcgcgatcgacgccgatatcagcatcgtcgccggcgtcgtcttcttcgccgagcgggaaacgaacaagagatccggaagacgacgaggtctatctcgacaacctccgctcccagaaacgttatctcagcgagataatggcttgcagtttaaacggactaaccgtcggagactcgcttcctgtcaacatgttagactctccttctcgctctgacacccttctttctcccaacaatcacattcacagggatgacttgtcattacagtactctcccatgtctgaagactccgacgaagctaggttctgcgaggacccaataacaagcacgagctcatcgcagcaacccgagagccgccctactagtcctgtttcaccttaccgataccatagacctcttacttcaacaacctcacaccatttgtcaaattcacattcatgccctgcctccatgagcaccaatgctactactccacagtctcgtccaagaggatcagacacggaaggaaggtttccatcgtcgcctagcgacatctgccattccagtgacttgagaaggaccgctctactcaggtctgttcaaatgagaacacagccttgtggtattgcttcaacttytgggacaagcaatgttgacggtggtgaagagaagttgtgctttaagtctatggaagaagataatagaggggaagatgtctcttatactcaagtctccggcggtaagagcaagtcttgtaaagcattggacatgagactatgtgaacgatgatttaaagacactattctctatcttaaaatacggtttctt

SEQ ID NO: 1018 - protein, 258 aa, Brassica napus
  misc_feature (1)..(258): Ceres Clone ID no. 949027
  misc_feature (1)..(258): Bit score of 477.2 for HMM based on sequences of Figure 25
  misc_feature (1)..(258): Functional Homolog Of SEQ ID NO. 1016
  misc_feature (1)..(258): in Figure 25
  misc_feature (209)..(209): Xaa is any aa, unknown, or other
MGPESRSTPISASSPASSSSPSGKRTRDPEDDEVYLDNLRSQKRYLSEIMACSLNGLTVGDSLPVNMLDSPSRSDTLLSPNNHIHRDDLSLQYSPMSEDSDEARFCEDPITSTSSSQQPESRPTSPVSPYRYHRPLTSTTSHHLSNSHSCPASMSTNATTPQSRPRGSDTEGRFPSSPSDICHSSDLRRTALLRSVQMRTQPCGIASTXGTSNVDGGEEKLCFKSMEEDNRGEDVSYTQVSGGKSKSCKALDMRLCER

SEQ ID NO: 1019 - DNA, 798 bp, Populus balsamifera subsp. trichocarpa
  misc_feature (1)..(798): Ceres Annot ID no. 1471603
  misc_feature (1)..(798): Encodes the peptide sequence at SEQ ID NO. 1020
atgaggttggattcgaacccagcttcatcatcagcatcgacatcaacgtcaacaccaaacgggaagcgaagtagagatcctgaagatgaggtctaccttgacaatctcaattctcataagcgatacctcagtgagataatggcatctagtttgaatggattaacagttggagacccactccaggacaatcttatggaatctcctgccaggtctgacaccatgatttttgccagggatgaaatgtccttgcaatattcaccaatgtcagaagactttgatgactctagattttgcgagacccctataaatgcttgctcacctcaatctgaaagtctacccggcagtccagtttctccatataggtaccaaagaccacttggtggattctcttctgctccttatagcagctctttctcttcacatggctgcagtgtcaccgccacttattcacagcctcgtcaacgaggttcagattctgagggccggttcccgtcatcacctagtgatatatgccactcagctgacctgaggaggactgcactcctgcgttctgtgcagatgagaacacaaccacttggttcatcatcttttgaattgccatttgattcaggacacgagcctggatctaacatagaggctgaagagcggccatgctcatatatgaagtccttggttgaagagagggagtatgcacttgaagagtgttcttcaatgagcatctcagaacctggatttaatgaagagaaggcatgccgggttttgaatatgaatataaaaggggatggttctggagtttaa

SEQ ID NO: 1020 - protein, 265 aa, Populus balsamifera subsp. trichocarpa
  misc_feature (1)..(265): Ceres Annot ID no. 1471603
  misc_feature (1)..(265): Bit score of 577.8 for HMM based on sequences of Figure 25
  misc_feature (1)..(265): Functional Homolog Of SEQ ID NO. 1016
  misc_feature (1)..(265): in Figure 25
MRLDSNPASSSASTSTSTPNGKRSRDPEDEVYLDNLNSHKRYLSEIMASSLNGLTVGDPLQDNLMESPARSDTMIFARDEMSLQYSPMSEDFDDSRFCETPINACSPQSESLPGSPVSPYRYQRPLGGFSSAPYSSSFSSHGCSVTATYSQPRQRGSDSEGRFPSSPSDICHSADLRRTALLRSVQMRTQPLGSSSFELPFDSGHEPGSNIEAEERPCSYMKSLVEEREYALEECSSMSISEPGFNEEKACRVLNMNIKGDGSGV

SEQ ID NO: 1021 - protein, 257 aa, Vitis vinifera
  misc_feature (1)..(257): Public GI ID no. 225437511
  misc_feature (1)..(257): Bit score of 566.7 for HMM based on sequences of Figure 25
  misc_feature (1)..(257): Functional Homolog Of SEQ ID NO. 1016
  misc_feature (1)..(257): in Figure 25
MGSESNSPSPSSSSSPSGKRSRDPEDEVYLDNLHSHKRYLSEIMASSLNGLTVGDPLHENLMESPARSETMFYLRDDMSLQYSPMSEDSDDNRYCEIPINISSSQTDSLPTSPVSPHRYQRPFSALSSSGTTACPSHGCTLAAVACAQPRQRGSDSEGRFPSSPSDICHSADLRRAALLRSVQMRAQPPGPSVFELPFSAGQEAVRNMETEERPCLVDERDYRIEECSSMGISEHEFNREKSCRVLNMNLKGEEPGD

SEQ ID NO: 1022 - DNA, 1173 bp, Glycine max
  misc_feature (1)..(1173): Ceres Clone ID no. 527044
  misc_feature (1)..(1173): Encodes the peptide sequence at SEQ ID NO. 1023
gactgctgtgtttcactgccaatgacggaagacggaaagggaagccgaagccatctctgcacaacaaattagggtttcaacattgagcagtccctttttcttcaccaaagagaaagccttggtttagatgagttggtctcamcaatgggttctgattccaatttgggagggtcgccctcagcatcttcgcccagtgccaagcgcaccagagatcccgaagaggaagtttatctcgacaatcttcgctctcacaagcgttacctaagcgagataatggcatccagtctcaacggattgacagttggagactcacttcctgataatctcatggaatctccagcaaggtctgaaagcatgttctctttcagagatgatatgtctttacaatattcaccgatgtcagaagattcagatgacctaaggttttgcgagacccctgtgcacagttgctcatcccaaccggacagtcttcccagtagtccagtttctccacacaggtaccaaagaccacagaatgcattgccttcagcaccttcttcaagttcaaatgcctcttatggctccaccattgcttgcccccagcctcgtcagcgagggtcggattctgaaggccgcttcccatcatccccaagtgatatatgccactcagctgacttgagaagagctgcacttstaagatctgtgcagatgagaacacagcctcctggccctgcatctttggacctgccttttgtttctaaccaagagtctgctcctaacatagatcctgaggaaagatcttgctcatatatgaaatctctggttgacgagagagagtattgagagttcatcaatgggtattccgtaaccccgatttcaaccttggtcatggtattacgccgtgcaggtcttaatgtgtttggaaggttaacttgctatattggagaattgtctcagtatcactatccagcgtctcctagtacgagatggttgcttgtgttagtcttggtcttgtttatgggattttgttcctccagctgctctctagtaaattatgcgtacagtcctgtgcctccggaattttactttattataattttcattcgagatagttgattattgcgttcatttcttataatttataggcttaaacaacttttaagtccatataatataatataatttttatttttg

SEQ ID NO: 1023 - protein, 225 aa, Glycine max
  misc_feature (1)..(225): Ceres Clone ID no. 527044
  misc_feature (1)..(225): Bit score of 456.4 for HMM based on sequences of Figure 25
  misc_feature (1)..(225): Functional Homolog Of SEQ ID NO. 1016
  misc_feature (1)..(225): in Figure 25
  misc_feature (177)..(177): Xaa is any aa, unknown, or other
MGSDSNLGGSPSASSPSAKRTRDPEEEVYLDNLRSHKRYLSEIMASSLNGLTVGDSLPDNLMESPARSESMFSFRDDMSLQYSPMSEDSDDLRFCETPVHSCSSQPDSLPSSPVSPHRYQRPQNALPSAPSSSSNASYGSTIACPQPRQRGSDSEGRFPSSPSDICHSADLRRAALXRSVQMRTQPPGPASLDLPFVSNQESAPNIDPEERSCSYMKSLVDEREY

SEQ ID NO: 1024 - protein, 265 aa, Pisum sativum
  misc_feature (1)..(265): Public GI ID no. 61611694
  misc_feature (1)..(265): Bit score of 567.5 for HMM based on sequences of Figure 25
  misc_feature (1)..(265): Functional Homolog Of SEQ ID NO. 1016
  misc_feature (1)..(265): in Figure 25
MGFDSNLGGSPSSSSPTAKRTRDPEEEVYVDNLRSHKRYLSEIMASSLNGLTVGDSLPDNLLESPARSESAFSLRDDISLQYSPMSEDSDDSRFCETPVHSCLTNLDSRPSSPVSPCRYQRQQNSFSSAPSTSLNTSHGFPVSAVTCSQPRQRSSDSDGRFPSSPSDICHSADLRRAALLRSVQMRTHPPGSASLELPFGSGQEPAPNIDSEDRPCSYMKSLVDERDYQIEECSSIGAPETEFNHDNNKPCRVLNMNPKAADSGG

SEQ ID NO: 1025 - DNA, 1124 bp, Arabidopsis thaliana
  misc_feature (1)..(1124): Ceres Clone ID no. 1343264
  misc_feature (1)..(1124): Encodes the peptide sequence at SEQ ID NO. 1026
gatcaaaaaagaaaaaaaaactcaggaagaatctagttgcggttatcttcagcccaaagagtaaagacccatccatccgttgctgaatctgctgctttgatcgaaaatgacgtcgtcctctccaacacagcgtactcacgtctcagttcctcctgaaccaggaggaaagtcactaacacaagaagctaatgagccaccagttccgatatcagtttcctcgccgtgcgggaaacgaaccagagatcccgaagacgaggtctatctcgataaccttcgctctcagaaacgttatcttagtgagataatggcttgtagtttaaacggactaacagtaggagactcacttcctgtcaacatgttagagtctccagcacggtctgagagctttctttatcacagggatgatttatcattacaatactctcccatgtcagaagactcggacgaagcgagattctgtgaggacccaacagcaacagcaagcactagctcatcgcaacccgagagccgcccaactagtccagtttcaccataccgataccaaagacctcttacttcaacaaactcaccacaaccgtcaccaacaatcttacaccattcacatacatgtcctgcctccatgatctccaatgcagcaactactactacaccacagtctcgccaaagaggatcagacacagaaggaaggtttccatcatcgcccagtgatatctgccattcgggtgacttgaggagaaccgctctactcaggtcggttcaaatgagaacacaaccatgtggttatagttcaagttcgggaccaagcaatattgacggtgaagagaggatgtgttctaagtctatggaagaagatagaggctataacaaaggggaagatatcccttacgctgaagtctctagtaagagcaagtcttgtaaagcattggacatgagactttgtgaaaagtgatgaaagaggctctatgaagctgacatggcaatcctccttttaacagtgttaaaaaataaaaatccaaatatattaatatccgtttttattttctttagttataatttttttttttaaagttgtgaggtatgttaaaattttttttttaattaaagaacataaagttatttggatt

SEQ ID NO: 1026 - protein, 280 aa, Arabidopsis thaliana
  misc_feature (1)..(280): Ceres Clone ID no. 1343264
  misc_feature (1)..(280): Bit score of 501.5 for HMM based on sequences of Figure 25
  misc_feature (1)..(280): Functional Homolog Of SEQ ID NO. 1016
MTSSSPTQRTHVSVPPEPGGKSLTQEANEPPVPISVSSPCGKRTRDPEDEVYLDNLRSQKRYLSEIMACSLNGLTVGDSLPVNMLESPARSESFLYHRDDLSLQYSPMSEDSDEARFCEDPTATASTSSSQPESRPTSPVSPYRYQRPLTSTNSPQPSPTILHHSHTCPASMISNAATTTTPQSRQRGSDTEGRFPSSPSDICHSGDLRRTALLRSVQMRTQPCGYSSSSGPSNIDGEERMCSKSMEEDRGYNKGEDIPYAEVSSKSKSCKALDMRLCEK

SEQ ID NO: 1027 - protein, 271 aa, Populus balsamifera subsp. trichocarpa
  misc_feature (1)..(271): Public GI ID no. 118482768
  misc_feature (1)..(271): Bit score of 556.5 for HMM based on sequences of Figure 25
  misc_feature (1)..(271): Functional Homolog Of SEQ ID NO. 1016
MGSDSNAVPSASASASTSTSTSTPSTPNGKRSRDPEDEVYLDNLHSHKRYLSEIMASSLNGLTVGDPLQDNLMESPARSDTMFFARDEMSLQYSPMSEDFDDSRFCETPINACSPQSESLPGSPVSPYRYQRPLCGFSSAPYSSSFSSHGCSVTSSQPRQRGSDSEGRFPSSPSDICHSADLRRAALLRSVQMRTQPTGSSSFELPFSSGHEPGSNMEAEERPCSYMKSLVEEREYPLEECSSMSISEPEFNEEKACRVLNMNIKGDDSGG

SEQ ID NO: 1028 - DNA, 816 bp, Populus balsamifera subsp. trichocarpa
  misc_feature (1)..(816): Ceres Annot ID no. 1497745
  misc_feature (1)..(816): Encodes the peptide sequence at SEQ ID NO. 1029
atgggttcggattcgaacgcagtcccatcagcatcagcttcagcatcgacatcgacatcgacatcaacaccatcgacaccaaatgggaagcgaagtagagaccctgaagatgaggtctaccttgacaatctccattctcacaagcgttacctcagtgaaataatggcatctagtttgaatggattaacggtcggagacccactccaggacaatcttatggaatctcctgccaggtctgacaccatgttttttgccagggatgaaatgtccttgcaatattcaccaatgtcagaagactttgatgactctagattttgcgagacccctataaatgcttgctcgcctcaatctgaaagtctacccggcagtccagtttctccatataggtaccaaagaccactttgtggattctcttctgctccttatagcagctctttctcttcacatggatgcagtgtcacttcttcacagcctcgtcaacgaggctcagattctgagggtcggtttccgtcatcacctagtgatatatgccactcagctgacctgaggagggctgcactcctgcgttctgtgcagatgagaacacaacctactggttcatcatcctttgaattgccatttggttcaggacaggagcctggatcaaacatggaagctgaagagcggccatgctcatatatgaaatccttggttgaagagagggagtatccactcgaggagtgttcttcaatgagcatctcagaacctgaatttaatgaagagaaggcgtgtcgggttttaaatatgaatataaaaggggatgactctggaggttaa

SEQ ID NO: 1029 - protein, 271 aa, Populus balsamifera subsp. trichocarpa
  misc_feature (1)..(271): Ceres Annot ID no. 1497745
  misc_feature (1)..(271): Bit score of 557.3 for HMM based on sequences of Figure 25
  misc_feature (1)..(271): Functional Homolog Of SEQ ID NO. 1016
MGSDSNAVPSASASASTSTSTSTPSTPNGKRSRDPEDEVYLDNLHSHKRYLSEIMASSLNGLTVGDPLQDNLMESPARSDTMFFARDEMSLQYSPMSEDFDDSRFCETPINACSPQSESLPGSPVSPYRYQRPLCGFSSAPYSSSFSSHGCSVTSSQPRQRGSDSEGRFPSSPSDICHSADLRRAALLRSVQMRTQPTGSSSFELPFGSGQEPGSNMEAEERPCSYMKSLVEEREYPLEECSSMSISEPEFNEEKACRVLNMNIKGDDSGG

SEQ ID NO: 1030 - protein, 251 aa, Vitis vinifera
  misc_feature (1)..(251): Public GI ID no. 147783944
  misc_feature (1)..(251): Bit score of 524.2 for HMM based on sequences of Figure 25
  misc_feature (1)..(251): Functional Homolog Of SEQ ID NO. 1016
MGSESNSPSPSSSSSPSGKRSRDPEDEVYLDNLHSHKRYLSEIMASSLNGLTVGDPLHENLMESPARDDMSLQYSPMSEDSDDNRYCEIPINISSSQTDSLPTSPVSPHRYQRPFSALSSSGTTACPSHGCTLAAVACAQPRQRGSDSEGKTRFPSSPSDICHSADLRRAALLRSVQMRAQPPGPSVFELPFSAGQEAVRNMETEERPCLVDERDYRIEECSSMGISEHEFNREKSCRVLNMNLKGEEPGD

SEQ ID NO: 1031 - DNA, 891 bp, Populus balsamifera subsp. trichocarpa
  misc_feature (1)..(891): Ceres Annot ID no. 1444766
  misc_feature (1)..(891): Encodes the peptide sequence at SEQ ID NO. 1032
atgggttcggattcgaacgcagtcccatcagcatcagcttcagcatcgacatcgacatcgacatcaacaccatcgacaccaaatgggaagcgaagtagagaccctgaagatgaggtctaccttgacaatctccattctcacaagcgttacctcagtgaaataatggcatctagtttgaatggattaacggtcggagacccactccaggacaatcttatggaatctcctgccaggtctgacaccatgttttttgccagtttgcctagggatttggctgcatattatctactatttgcttatgcaaaatcaaatcccggggatcaggtgctgggggatgaaatgtccttgcaatattcaccaatgtcagaagactttgatgactctagattttgcgagacccctataaatgcttgctcgcctcaatctgaaagtctacccggcagtccagtttctccatataggtaccaaagaccactttgtggattctcttctgctccttatagcagctctttctcttcacatggatgcagtgtcacttcttcacagcctcgtcaacgaggctcagattctgagggtcggtttccgtcatcacctagtgatatatgccactcagctgacctgaggagggctgcactcctgcgttctgtgcagatgagaacacaacctactggttcatcatcctttgaattgccatttggttcaggacaggagcctggatcaaacatggaagctgaagagcggccatgctcatatatgaaatccttggttgaagagagggagtatccactcgaggagtgttcttcaatgagcatctcagaacctgaatttaatgaagagaaggcgtgtcgggttttaaatatgaatataaaaggggatgactctggaggttaa

SEQ ID NO: 1032 - protein, 296 aa, Populus balsamifera subsp. trichocarpa
  misc_feature (1)..(296): Ceres Annot ID no. 1444766
  misc_feature (1)..(296): Bit score of 537.9 for HMM based on sequences of Figure 25
  misc_feature (1)..(296): Functional Homolog Of SEQ ID NO. 1016
MGSDSNAVPSASASASTSTSTSTPSTPNGKRSRDPEDEVYLDNLHSHKRYLSEIMASSLNGLTVGDPLQDNLMESPARSDTMFFASLPRDLAAYYLLFAYAKSNPGDQVLGDEMSLQYSPMSEDFDDSRFCETPINACSPQSESLPGSPVSPYRYQRPLCGFSSAPYSSSFSSHGCSVTSSQPRQRGSDSEGRFPSSPSDICHSADLRRAALLRSVQMRTQPTGSSSFELPFGSGQEPGSNMEAEERPCSYMKSLVEEREYPLEECSSMSISEPEFNEEKACRVLNMNIKGDDSGG

SEQ ID NO: 1033 - protein, 208 aa, Populus balsamifera subsp. trichocarpa
  misc_feature (1)..(208): Public GI ID no. 118485088
  misc_feature (1)..(208): Bit score of 324.3 for HMM based on sequences of Figure 25
  misc_feature (1)..(208): Functional Homolog Of SEQ ID NO. 1016
MHYSIYMIARGTLPFILAFRDEMSLQYSPMSEDFDDSRFCETPTNACSPQSESLPSSPVSPCRYQRPLGGFSSAPYSSSFLSHGCSVTSATYSQPRQRGSDSEGRFPSSPSDICHSADLRRTALLRSVQMRTQPLGSSSFELPFDSGHEPGSNIEAEERPCSYMKSLVEEREYALEECSSMSISEPGFNEEKACRVLNMNIKGDGSGV

SEQ ID NO: 1034 - DNA, 499 bp, Musa acuminata
  misc_feature (1)..(499): Ceres Clone ID no. 1744499
  misc_feature (1)..(499): Encodes the peptide sequence at SEQ ID NO. 1035
gaccaaaacagcaagggaacggagatggcgtcactgagcatggcgttcggcgcggcggtcgcgggcgggcgggtgtttgcagcgacagcagaggccaagggcgccggaagcagcggggaggagaaagggctgttggactggatactgggagggttgcagaaggaggaccaactgctggagacggaccccattcttaagaaggtgggggagaagaacggcggcggcagccgcagcaccgccaccgggtccagaaagtcgtccacctccgtctccgttcccagcaagaagaaatccggcggcttcggtggccttggcggcctcttcgctaagaaatgattcagtctgtagtaaccctcatatgctcctacttcacaaatatttagccttgaacagactctccctctcctccgctgctacgtcttgtttacttcatcggaatgatttgatctgaaacaatttgataggttcagaagaacaattcctacgcattaccaccatt

SEQ ID NO: 1035 - protein, 103 aa, Musa acuminata
  misc_feature (1)..(103): Ceres SEED LINE ID no. CW00813
  misc_feature (1)..(103): Ceres Clone ID no. 1744499
  misc_feature (1)..(103): Bit score of 220.3 for HMM based on sequences of Figure 19
  misc_feature (1)..(103): in Figure 19
MASLSMAFGAAVAGGRVFAATAEAKGAGSSGEEKGLLDWILGGLQKEDQLLETDPILKKVGEKNGGGSRSTATGSRKSSTSVSVPSKKKSGGFGGLGGLFAKK

SEQ ID NO: 1036 - DNA, 591 bp, Glycine max
  misc_feature (1)..(591): Ceres Clone ID no. 1660759
  misc_feature (1)..(591): Encodes the peptide sequence at SEQ ID NO. 1037
tcaaagttcaccaaaatattgtccaccccattatttgtcttctcattctcatcactaacacacaagtgtgtgttgtagatttctcagcttgcaacatggcttccatcatcatgtcatttgctccagcaactggtagagtctttgcagccacagcggcaaagggtgctggtggaagcaaagaagagaagggtcttcttgattggatccttggagggttgcagaaggaagaccagctgctagagactgatccaatcctcaagaaggtggaggagaagaatggaggcaccaccagcaacactggccgcaacaagaactctgtggcagtgccacaaaagaagaaaggtggctttggaggcctctttgcgaagaactgaaggagcagtgatttattaccttatatttgttttacctgttttttttttctcaaatgcatgcgttgttgtcttgtccacttagattccaacctcttgatcttatggaatactttatgtctggctcttctggatcaacgtatttacagaactatatgattcattttggatcagttactggccaggtacaattttgtaattgacaatttgatatatttgg

SEQ ID NO: 1037 - protein, 92 aa, Glycine max
  misc_feature (1)..(92): Ceres Clone ID no. 1660759
  misc_feature (1)..(92): Bit score of 226.2 for HMM based on sequences of Figure 19
  misc_feature (1)..(92): Functional Homolog Of SEQ ID NO. 1035
  misc_feature (1)..(92): in Figure 19
MASIIMSFAPATGRVFAATAAKGAGGSKEEKGLLDWILGGLQKEDQLLETDPILKKVEEKNGGTTSNTGRNKNSVAVPQKKKGGFGGLFAKN

SEQ ID NO: 1038 - protein, 88 aa, Vitis vinifera
  misc_feature (1)..(88): Public GI ID no. 225434658
  misc_feature (1)..(88): Bit score of 203.3 for HMM based on sequences of Figure 19
  misc_feature (1)..(88): Functional Homolog Of SEQ ID NO. 1035
  misc_feature (1)..(88): in Figure 19
MASLTIAFAPAAGRVFAATAEKSSGGSGEKGILDWILGGLQKEDQMLETDPILKKVEEKNGGSNGGRKNSVVVPPKKKGGFGGLFAKK

SEQ ID NO: 1039 - DNA, 279 bp, Populus balsamifera subsp. trichocarpa
  misc_feature (1)..(279): Ceres Annot ID no. 1439822
  misc_feature (1)..(279): Encodes the peptide sequence at SEQ ID NO. 1040
atggcttctcttcccatcgccttcgctgttccttctgttagagtgtacgcagccacagcagctaaaggagcagggggcggcaaagaggagaaagggcttcttgactggattattgggagtttgcaaaaggaagaccagttctatgagactgaccccatcctcaaaaaagtggaggggaagaacaatggtggcaccgccagtggacgcaagaactctgttgctgtcccccagaagaagaagagtggaggctttggtggactgtttgccaagaatgattaa

SEQ ID NO: 1040 - protein, 92 aa, Populus balsamifera subsp. trichocarpa
  misc_feature (1)..(92): Ceres Annot ID no. 1439822
  misc_feature (1)..(92): Bit score of 229.8 for HMM based on sequences of Figure 19
  misc_feature (1)..(92): Functional Homolog Of SEQ ID NO. 1035
  misc_feature (1)..(92): in Figure 19
MASLPIAFAVPSVRVYAATAAKGAGGGKEEKGLLDWIIGSLQKEDQFYETDPILKKVEGKNNGGTASGRKNSVAVPQKKKSGGFGGLFAKND

SEQ ID NO: 1041 - DNA, 681 bp, Gossypium hirsutum
  misc_feature (1)..(681): Ceres Clone ID no. 1808650
  misc_feature (1)..(681): Encodes the peptide sequence at SEQ ID NO. 1042
ataagccgcttgtggcgagctcgtggtacaagcactcgcactccattgttttcccactcatcatatcttaaaatcccaatccagcggtccaaaattcactactaacactatccccataaaagtatatttcagcaataacattattgttcatcatcatcatttcagtggaaggaagagaaaagaaaaacaccagttcaatttctaagctaagtaacaatggcttctctccctatattttcctttgttccttcaaaaacaaggatttacgcaacagcagctgcaaaaggtgcaggtggaggcaaagaagagaaagggcttttcgattggattcttgggaacttgcagaaggaagagcagttttatgaaactgaccctatcctcaagaaagttgaagaaaagaatggcggtggcagtggcagtggcactaccagtggtcgcaagaactctgtttcaatccctcagaagaagaaggacaatgctggctttgggcttggagggcttttcaagaaatgaaagatactataatcatcctttggggaagtttcattggtttggaattaattcatgttttctatcttcaatattatgaacctttcttcattcttgaacactaagctgttatcgatttcctttaatgcacactacttaaaaatcttataaattactaattcatttgaagtc

SEQ ID NO: 1042 - protein, 98 aa, Gossypium hirsutum
  misc_feature (1)..(98): Ceres Clone ID no. 1808650
  misc_feature (1)..(98): Bit score of 231.4 for HMM based on sequences of Figure 19
  misc_feature (1)..(98): Functional Homolog Of SEQ ID NO. 1035
  misc_feature (1)..(98): in Figure 19
MASLPIFSFVPSKTRIYATAAAKGAGGGKEEKGLFDWILGNLQKEEQFYETDPILKKVEEKNGGGSGSGTTSGRKNSVSIPQKKKDNAGFGLGGLFKK

SEQ ID NO: 1043 - protein, 103 aa, Spinacia oleracea
  misc_feature (1)..(103): Public GI ID no. 27529048
  misc_feature (1)..(103): Bit score of 234.3 for HMM based on sequences of Figure 19
  misc_feature (1)..(103): Functional Homolog Of SEQ ID NO. 1035
  misc_feature (1)..(103): in Figure 19
MSSLPFVFGAAASSRVVTAAAAKGTAETKQEKSFVDWLLGKITKEDQFYETDPILRGGDVKSSGSTSGKKGGTTSGKKGTVSIPSKKKNGNGGVFGGLFAKKD

SEQ ID NO: 1044 - DNA, 645 bp, Musa acuminata
  misc_feature (1)..(645): Ceres Clone ID no. 1743842
  misc_feature (1)..(645): Encodes the peptide sequence at SEQ ID NO. 1045
aagacggctgtggatgacccccacgctatcctcaacatcccggaattaatcccacgtatatgtgtaggtggtgagaggtggaggagagtagtgagcggaagaagagaaagagatggcggcgatgaccttggcaatgggcacggcagccgccggcgggcgggtgttcgcggcgacggcggcggcgaagggcgcagggagcagcggagaggagaaagggctgctggactggatactgggagggctgcagaaggaggaccagctgctggagactgatcccatcctcaggaaggtggaggagagcaacggccgcggccgcaccaccgggtcctggaagtcgaccaccacctccgtctcggttcccaacaagaagaagtccggcggcttcggaggcctcttcgctaagaaatgatattactgcccatgcacgtcgtcttcatctgttactacaacatagatggtcacacactctccctgccatgaactgttcctgtgtgcttcggggagaggtgtgttgttacttttcttatgctcgcttgggctccgtctctgatatgatttggcctgaaaagactgggaagcttcacaaacatggccaccgatgaatgttgtgattctgttttgcataacatctctaagcttaggttg

SEQ ID NO: 1045 - protein, 98 aa, Musa acuminata
  misc_feature (1)..(98): Ceres Clone ID no. 1743842
  misc_feature (1)..(98): Bit score of 180.1 for HMM based on sequences of Figure 19
  misc_feature (1)..(98): Functional Homolog Of SEQ ID NO. 1035
MAAMTLAMGTAAAGGRVFAATAAAKGAGSSGEEKGLLDWILGGLQKEDQLLETDPILRKVEESNGRGRTTGSWKSTTTSVSVPNKKKSGGFGGLFAKK

SEQ ID NO: 1046 - DNA, 560 bp, Glycine max
  misc_feature (1)..(560): Ceres Clone ID no. 560309
  misc_feature (1)..(560): Encodes the peptide sequence at SEQ ID NO. 1047
ttcgaagttcaccaaaactttgtccaccccatcatttgtcttctcaattctcatcactaacacacaagtgtgcgttgtagatttctcagtttgcaacatatggcttccatcatcatgtcatttgctccagcaactggtagagtctttgcagccacagcagcaaagggtgctggtggaagcaaagagaagggtcttcttgattggataattggaggattgcagaaggaagaccagctggtagagactgatcctatcctcaagaaggtggaggagaagaatggaggcaccaccaccaccaccactggccgcaacaagaactctgtggcagtgccacaaaagaagaaaggtggctttggaggcctctttgccaagaactgaagcagcagtgatgatttgttatttaccttacaattgtttttacctgttttcttctgaaatgcttgcactgttgtcttgtccacttagattccaaccacctgatcttatggaatactttattatgtctggctcttctgggtcaatgtatttactgaactatatcgattccttttggatcagtc

SEQ ID NO: 1047 - protein, 92 aa, Glycine max
  misc_feature (1)..(92): Ceres Clone ID no. 560309
  misc_feature (1)..(92): Bit score of 214.1 for HMM based on sequences of Figure 19
  misc_feature (1)..(92): Functional Homolog Of SEQ ID NO. 1035
MASIIMSFAPATGRVFAATAAKGAGGSKEKGLLDWIIGGLQKEDQLVETDPILKKVEEKNGGTTTTTTGRNKNSVAVPQKKKGGFGGLFAKN

SEQ ID NO: 1048 - DNA, 273 bp, Populus balsamifera subsp. trichocarpa
  misc_feature (1)..(273): Ceres Annot ID no. 1461680
  misc_feature (1)..(273): Encodes the peptide sequence at SEQ ID NO. 1049
atggcttctcttcccattgtctttgcttctccttctgttagggtgtatgccgccactgcatcaggaggaagcaaagaggagaaggggcttcttgattggattcttgggagtttgcaaaaggaagatcagttctatgagactgaccccatcctcaagaaagtggaggagaagaacagcggtggcaccaccagtggccgcaggaactctgttgctgtacctcagaagaagaagaagaatggtggctttggtgggctgtttgccaagaaagattaa

SEQ ID NO: 1049 - protein, 90 aa, Populus balsamifera subsp. trichocarpa
  misc_feature (1)..(90): Ceres Annot ID no. 1461680
  misc_feature (1)..(90): Bit score of 210.3 for HMM based on sequences of Figure 19
  misc_feature (1)..(90): Functional Homolog Of SEQ ID NO. 1035
MASLPIVFASPSVRVYAATASGGSKEEKGLLDWILGSLQKEDQFYETDPILKKVEEKNSGGTTSGRRNSVAVPQKKKKNGGFGGLFAKKD

SEQ ID NO: 1050 - DNA, 518 bp, Gossypium hirsutum
  misc_feature (1)..(518): Ceres Clone ID no. 1853867
  misc_feature (1)..(518): Encodes the peptide sequence at SEQ ID NO. 1051
aagcttctacaatcttcatcaccatttcaaaagaaaagggtaaacatctaagctaagtaacaatggcgtcactgctaattccctttgctccttccacaacaagggttttcgcagcaaaaagttcagctgcaggtggaaccaaacaggaaaaagggtttcttgattggatcctcgggaacttgcagaaagaagatcagttctacgaaaccgatcctctcctcaagaaagttgaagacaaaaatggaagtgcccgaacttccaatggccgcaacgactcggtttcagcccctcagaagaagaagggcagtgtttttggtggacttttcgccaagaaaggaaattatacttgcaacttacaaatcgtctaaagggggaaactggactcattgtctatggtatcccctgtttaatatatcttgtttcttttatattcgtctctccatataaactattaaaattattaaaaatacgaaattgtattttaatttttataaaatttaataatttaattttgattc

SEQ ID NO: 1051 - protein, 101 aa, Gossypium hirsutum
  misc_feature (1)..(101): Ceres Clone ID no. 1853867
  misc_feature (1)..(101): Bit score of 167.0 for HMM based on sequences of Figure 19
  misc_feature (1)..(101): Functional Homolog Of SEQ ID NO. 1035
MASLLIPFAPSTTRVFAAKSSAAGGTKQEKGFLDWILGNLQKEDQFYETDPLLKKVEDKNGSARTSNGRNDSVSAPQKKKGSVFGGLFAKKGNYTCNLQIV

SEQ ID NO: 1052 - DNA, 405 bp, Brassica napus
  misc_feature (1)..(405): Ceres Clone ID no. 1087882
  misc_feature (1)..(405): Encodes the peptide sequence at SEQ ID NO. 1053
acaagaatggtttcttcgcttctaatgtcgtttgctccggccaccgtgagggtttacgccacaactaagggaacttcaggcggcgccaaggaggagaagaatccccttgattttgtgcttggttatttgacaaagcaagatcagttctacgagactgatccaattctcaagaaggtggaggagaaaggcggcaccagaagtggcaccaccggaggcagaggaaccgttcggggcggtaaaagctcggctccggtgcctgtggcgcccaagaagaacgatggtggatttgccggcttaggtggcttcttcaacaaaaagtaaaagaaaaacgtatagtaaatttgcattgtttattgcctctgttttgcattatctataattcttcagacttcaattattatacat

SEQ ID NO: 1053 - protein, 104 aa, Brassica napus
  misc_feature (1)..(104): Ceres Clone ID no. 1087882
  misc_feature (1)..(104): Bit score of 124.0 for HMM based on sequences of Figure 19
  misc_feature (1)..(104): Functional Homolog Of SEQ ID NO. 1035
MVSSLLMSFAPATVRVYATTKGTSGGAKEEKNPLDFVLGYLTKQDQFYETDPILKKVEEKGGTRSGTTGGRGTVRGGKSSAPVPVAPKKNDGGFAGLGGFFNKK

SEQ ID NO: 1054 - DNA, 466 bp, Brassica napus
  misc_feature (1)..(466): Ceres Clone ID no. 1108470
  misc_feature (1)..(466): Encodes the peptide sequence at SEQ ID NO. 1055
atacgcatttacacagacacaatcccgagaaagagagatcgaaaggagataacaagaatggtttcttcgcttcttatgtcgtttgctccggccaccgtgagggcttacgccacaaccgcaaaaggagcatcaggcggcgccraggaggagaagaatcccctcgactttatgctgggctatttgacaaagcaagatcagttctacgagactgatccaatcctcaagaaggtggagaaggaacaaggcaccactggaggcagaggaaccgttcgcggcggtggtaaaagcgctgctccggtgcctgtggcggcaaagaagaacgatggtggtgggttcggcggcttagctggcctcttcaacaaaaaatgaatgtaaatctgcattatctatttgcttctgtgttgtttattctctatacattcttcagatttcagctatatatataaactgctcttttcttcatctt

SEQ ID NO: 1055 - protein, 103 aa, Brassica napus
  misc_feature (1)..(103): Ceres Clone ID no. 1108470
  misc_feature (1)..(103): Bit score of 114.4 for HMM based on sequences of Figure 19
  misc_feature (1)..(103): Functional Homolog Of SEQ ID NO. 1035
  misc_feature (29)..(29): Xaa is any aa, unknown, or other
MVSSLLMSFAPATVRAYATTAKGASGGAXEEKNPLDFMLGYLTKQDQFYETDPILKKVEKEQGTTGGRGTVRGGGKSAAPVPVAAKKNDGGGFGGLAGLFNKK

SEQ ID NO: 1056 - DNA, 495 bp, Parthenium argentatum
  misc_feature (1)..(495): Ceres Clone ID no. 1605553
  misc_feature (1)..(495): Encodes the peptide sequence at SEQ ID NO. 1057
acaccagttccattatctccatatactttcatccatcccttcatcctctcaaacccactcaaaccacaaccaaaacacaccacaaaacatggcttctttgaacatgtttcttgctccagcaaccaccatatcctccaccaccacaagaccatcagcaagaagatcagtacacacatatgccacagcagcaaagggttcaggtaagagcagtgaagaaaaaggtttttttgactggctgggggttgcattacaaaaagagagctttgttgaaactgacccaattctacaaaaggtggagggcaagagtggtactactactgtctccggtaagaagaccacctcatcggctacggctgcaccacccaagaagagtgaaggtggctttggtgggcttggtggactctttgctaagaaatgatcatgttattattatgttagtatgaaatttttattaatattcggtataatattatcatcgcatttgatctttggttc

SEQ ID NO: 1057 - protein, 109 aa, Parthenium argentatum
  misc_feature (1)..(109): Ceres Clone ID no. 1605553
  misc_feature (1)..(109): Bit score of 101.2 for HMM based on sequences of Figure 19
  misc_feature (1)..(109): Functional Homolog Of SEQ ID NO. 1035
MASLNMFLAPATTISSTTTRPSARRSVHTYATAAKGSGKSSEEKGFFDWLGVALQKESFVETDPILQKVEGKSGTTTVSGKKTTSSATAAPPKKSEGGFGGLGGLFAKK

SEQ ID NO: 1058 - DNA, 640 bp, Arabidopsis thaliana
  misc_feature (1)..(640): Ceres Clone ID no. 25829
  misc_feature (1)..(640): Encodes the peptide sequence at SEQ ID NO. 1059
aaaaacaattaaaccaaaaaaaatgtatccaagtgattcaaagaaaaatgtgtgaagggaaaaaagaaagaggataagacacttgtggagagcttgtgccaaaaaaatccaacggctcagattcaaccaacctcgttataatcccttcgtaacaaatgccacacgaagacacacatacacacactaccgataaagaaaaaccagagaagagagagagataacaacaatggtttcttcgcttcttatgtcatttgctccggccaccgtgagggtttacgccacaagcacaaagggaggttcaggcggcccaaaggaggagaagaatcccatcgactttgttcttgggtttatgacaaaacaagatcagttctatgagactaatccacttctaaagaaggtggatgagaaagaaggcaccaccaccggaggccgaggaaccgttcgcggtggtaaaaactcagctccgacgccagtgccgaagaagagcgagggtggatttggtggcttaggaagcctcttcaagaaatagaagaaaaaaatgtatagtaatttgcattattcatgcctctgttttcattctctataattcttcggatttcacttatatataagctactctttcktaatcttatttgacacc

SEQ ID NO: 1059 - protein, 100 aa, Arabidopsis thaliana
  misc_feature (1)..(100): Ceres Clone ID no. 25829
  misc_feature (1)..(100): Bit score of 112.7 for HMM based on sequences of Figure 19
  misc_feature (1)..(100): Functional Homolog Of SEQ ID NO. 1035
MVSSLLMSFAPATVRVYATSTKGGSGGPKEEKNPIDFVLGFMTKQDQFYETNPLLKKVDEKEGTTTGGRGTVRGGKNSAPTPVPKKSEGGFGGLGSLFKK

SEQ ID NO: 1060 - DNA, 467 bp, Brassica napus
  misc_feature (1)..(467): Ceres Clone ID no. 958635
  misc_feature (1)..(467): Encodes the peptide sequence at SEQ ID NO. 1061
ataacacaaagaagcagaagagataccaagcagaacagaacagaagacaacaagaatggcttcctcgatactaatgtcctttgctccggccaccgtaagatgcttcgccmcgggggctaagggaaccaccaacaccaccaccrcgaaagaagagaaaagtatcattgacttcgttcttggcagtttgaccaagcaagatcagttttacgagactgatcctctcctcaagaaggtggacgataaagaaggaaccaccggaggcaacggtggccgtaaaacggtttcaggtggcaagaactcgctggcagtgccacagaagaagaacggtggtggcttcggtggtctctttgccaagaaatgagaaaaaatagtaaaaatgtgtgtaatctatgtactctgcattttaaaagtctaattgttgactccttgtacgtcaatatcatcataaaaaaagcttcatgttctcg

SEQ ID NO: 1061 - protein, 101 aa, Brassica napus
  misc_feature (1)..(101): Ceres Clone ID no. 958635
  misc_feature (1)..(101): Bit score of 132.6 for HMM based on sequences of Figure 19
  misc_feature (1)..(101): Functional Homolog Of SEQ ID NO. 1035
  misc_feature (19)..(19): Xaa is any aa, unknown, or other
  misc_feature (30)..(30): Xaa is any aa, unknown, or other
MASSILMSFAPATVRCFAXGAKGTTNTTTXKEEKSIIDFVLGSLTKQDQFYETDPLLKKVDDKEGTTGGNGGRKTVSGGKNSLAVPQKKNGGGFGGLFAKK

SEQ ID NO: 1062 - protein, 86 aa, Glycine max
  misc_feature (1)..(86): Bit score of 209.9 for HMM based on sequences of Figure 19
  misc_feature (1)..(86): Functional Homolog Of SEQ ID NO. 1035
MSFAPATGRVFAATAAKGAGGSKEKGLLDWILGGLQKEDQLLETDPILKKVEEKNGGTTSNTGRNKNSVAVPQKKKGGFGGLFAKN

SEQ ID NO: 1063 - protein, 94 aa, Ricinus communis
  misc_feature (1)..(94): Bit score of 232.8 for HMM based on sequences of Figure 19
  misc_feature (1)..(94): Functional Homolog Of SEQ ID NO. 1035
MASLPIAFAAPTVRVYAATAAKGAGGSKEEKGFLDWVLGNLTKEDQFYETDPILKKVEEKSSGGTTSGRKNSVSIPQKKKNGGFGGFGGLFAKK

SEQ ID NO: 1064 - DNA, 1918 bp, Arabidopsis thaliana
  misc_feature (1)..(1918): Ceres Clone ID no. 106263
  misc_feature (1)..(1918): Encodes the peptide sequence at SEQ ID NO. 1065
acaaatactcttcttcacacagctttgaatccatctgtcttctcctctctctctcttctccatttgcaattacgataatgtgaaagcaataagaagaggaaaagttatcttcgcacctcagcaaagatccaatcgattcgattcttaagctttttcgtcttctccgataaggtcactacttagaagccgcgttgtggtttagttgactcctccaggttttatcttcaagctttttcgtctatcagatctggtgtcactgtcttctcataggattacatagagatggggaaaaaagctaaatggttttcaagtgttaagaaagcattcagcccagattcaaagaagtcgaagcaaaaattggctgagggacaaaatggtgttatctctaatcctcctgttgtggataatgttagacaatcttcttcttctcctcctcctgctcttgctcctcgtgaagtgagagtagctgaagtgattgttgaacggaacagggatctttcacctccttctacagcagatgctgtgaatgttacagctactgatgttcctgtagttccatcttcatctgctcctggtgttgttcgtcgcgctacacctactcgatttgctggaaagtcaaacgaagaagccgctgctatcttgatccagactatatttagaggttatttggcaaggagagcgttgcgggcaatgaggggtttggtcagacttaagttattgatggaaggatctgttgttaagcggcaagctgcaaatactctaaaatgtatgcagactctctctcgtgtacagtcgcagatccgagctaggagaatcaggatgtcagaagagaatcaggctcgccagaaacaactccttcagaaacatgctaaagagctagctggcttgaagaacggggataactggaatgatagcattcaatcaaaggagaaagttgaagcgaatttgctaagcaagtacgaggcaacaatgagaagggaaagggcattggcttattcatactctcatcagcaaaactggaagaacaactctaaatctggaaacccgatgttcatggatccaagcaacccgacatggggttggagctggttggagagatggatggctggtaggccactagagagttccgagaaagaacaaagcaacagcaacaatgacaatgctgcctcggtcaagggctctattaaccgcaacgaagctgcaaaatctctaacccgcaatggctcaactcaaccaaacacaccatcatccgcaagagggaccccaagaaacaaaaacagtttcttctcacctccaactccctcaaggctaaaccaatcctcgaggaaatccaatgacgacgactccaaaagcacaatctcggtcctgtccgagaggaaccgcagacacagcattgctggttcatcagtcagagacgatgagagcctcgctggctcaccagctctcccgagctacatggttccaactaaatcagctcgagccaggctcaagccccaaagcccattaggtggtaccacacaggaaaacgaagggttcacagacaaggcatcagctaagaaacggctctcgtatccaacttcgcctgcattgcctaaaccacggcggttctcagctccccctaaggtggagagtggcggcgttaccgtgaccaacggagcaggcagctgaggtattttatttaatataattattttcccacttatgaatgtgtccgagattgttgtctcttatgtgttcccttcatttcgtaattcatttgtgcagtgtaagcgccagtcatttatttttttactataataaattttataaccttttaaaattcatgttcttttgtttctttgaatatttaagttatttttattaatgttggatgaattggaatatgatgatgttatttgtattgtaatgcagatccttt

SEQ ID NO: 1065 - protein, 461 aa, Arabidopsis thaliana
  misc_feature (1)..(461): Ceres SEED LINE ID no. CW00780
  misc_feature (115)..(135): Pfam Name: IQ Pfam Description: IQ calmodulin-binding motif
  misc_feature (1)..(461): Ceres Clone ID no. 106263
  misc_feature (1)..(461): Bit score of 1067.0 for HMM based on sequences of Figure 22
  misc_feature (1)..(461): in Figure 22
MGKKAKWFSSVKKAFSPDSKKSKQKLAEGQNGVISNPPVVDNVRQSSSSPPPALAPREVRVAEVIVERNRDLSPPSTADAVNVTATDVPVVPSSSAPGVVRRATPTRFAGKSNEEAAAILIQTIFRGYLARRALRAMRGLVRLKLLMEGSVVKRQAANTLKCMQTLSRVQSQIRARRIRMSEENQARQKQLLQKHAKELAGLKNGDNWNDSIQSKEKVEANLLSKYEATMRRERALAYSYSHQQNWKNNSKSGNPMFMDPSNPTWGWSWLERWMAGRPLESSEKEQSNSNNDNAASVKGSINRNEAAKSLTRNGSTQPNTPSSARGTPRNKNSFFSPPTPSRLNQSSRKSNDDDSKSTISVLSERNRRHSIAGSSVRDDESLAGSPALPSYMVPTKSARARLKPQSPLGGTTQENEGFTDKASAKKRLSYPTSPALPKPRRFSAPPKVESGGVTVTNGAGS

SEQ ID NO: 1066 - DNA, 1703 bp, Glycine max
  misc_feature (1)..(1703): Ceres Clone ID no. 467508
  misc_feature (1)..(1703): Encodes the peptide sequence at SEQ ID NO. 1067
aaaccatcctctcttagcatttggcaagatctgatttccctcttcacaaggagagaaatagaaaggcatatgatcttcttcaagttgcaatctttttagagagagagggttagaagaacaacatacttgagatctgtcactttgtttgagttcagatcttcaaagtttccttccttgttcttttggtgcaaaggatcaaattaaggaatgccaaatggggaggaaggggaattggttttccagtgtgatgaaagctctcagtcctgactcaaaggagaagaaagaacagaaatcaagtaaatctaagaagaaatggtttgggaagcaaaaattggagacttcagtctcatactcagaagctcataaagcaccaccaccaccgcgacctattcctccaccagaagcgattaaattaactgatattgaaaatgaaatcagtcatgatcacgactatgttgttgaagttgcaactgccatggatgccgaggaacctgttccttctgttcagatagaacctgttagggttgaagctgccccaattgctcattatgctggtaaaccaaaggatgaagtggcagctatcaaaattcaaacagcttttcgtggatacttggcaagaagagcattgcgggctttaagggggctggtcaggttgaaattattgatggaagggccagttgttaaacgccaagccacaagtaccctccactctatgcagacattatctcgcttgcagtctcagattcgttcaaggaggatcagaatgttagaggagaatcaggctctgcagagacagctcttacagaagcatgcaagagagcttgagagcttgcggatgggagaggaatgggatgacagcctacaatcaaaagaacaaatcgaagccaagttacttagcaagtatgaagctactacgagaagagaaagagcgctggcttatgcattcactcatcagcaaaattggaagaactcatctagatctgtaaatccaatgttcatggatccaaccaatccaagctggggttggagctggttggaacgatggatggcagcccgaccttgggagagccgtagccatatggataaagagttgaatgaccactcatccgtaagaagctcaagccgcagtattaccggtggagaaatcagcaagtcatttgctcgtttccagctcaatttggaaaagcactctccaacagcctgccagaatcctggctcacctagctttcagtccactccttccaagccagcttcaatatctgctaagaaaccaaagaaggtaagtccaagcccaaggggcagctgggttacagacgaggactccaaaagcttggtcagtgtacagtcagaccggttccggaggcactccattgccggttcattggtgagagatgatgagagccttgctagctctccagcagttccaagctacatggtgccaactcaatctgcaaaagccaagtccaggacacaaagtccattagccccagaaaatggaaaagcagagaaaggttcctttgggagtgcgaagaagcggctttctttcccagcttcacctgccaggccaaggcgccattcaggtccaccaaaggtagaaagcagcagcttaaatgcagagttagctgtggacaagggtgtggacagttgatcatacaagtaaaaggatggaaaaacattaaagtaggattgaaaatatatcactg

SEQ ID NO: 1067 - protein, 477 aa, Glycine max
  misc_feature (119)..(139): Pfam Name: IQ Pfam Description: IQ calmodulin-binding motif
  misc_feature (1)..(477): Ceres Clone ID no. 467508
  misc_feature (1)..(477): Bit score of 1200.4 for HMM based on sequences of Figure 22
  misc_feature (1)..(477): Functional Homolog Of SEQ ID NO. 1065
  misc_feature (1)..(477): in Figure 22
MGRKGNWFSSVMKALSPDSKEKKEQKSSKSKKKWFGKQKLETSVSYSEAHKAPPPPRPIPPPEAIKLTDIENEISHDHDYVVEVATAMDAEEPVPSVQIEPVRVEAAPIAHYAGKPKDEVAAIKIQTAFRGYLARRALRALRGLVRLKLLMEGPVVKRQATSTLHSMQTLSRLQSQIRSRRIRMLEENQALQRQLLQKHARELESLRMGEEWDDSLQSKEQIEAKLLSKYEATTRRERALAYAFTHQQNWKNSSRSVNPMFMDPTNPSWGWSWLERWMAARPWESRSHMDKELNDHSSVRSSSRSITGGEISKSFARFQLNLEKHSPTACQNPGSPSFQSTPSKPASISAKKPKKVSPSPRGSWVTDEDSKSLVSVQSDRFRRHSIAGSLVRDDESLASSPAVPSYMVPTQSAKAKSRTQSPLAPENGKAEKGSFGSAKKRLSFPASPARPRRHSGPPKVESSSLNAELAVDKGVDS

SEQ ID NO: 1068 - DNA, 1726 bp, Gossypium hirsutum
  misc_feature (1)..(1726): Ceres Clone ID no. 1942871
  misc_feature (1)..(1726): Encodes the peptide sequence at SEQ ID NO. 1069
gtttcttcttcaatttgtctgaaaaacataacctttccttcttctcaagatctgtttttgttctttctctgtaactgtttaccgacacacacacaaaaaaaaagttcgttcttccgaatttcttgagatctgggcattattgtttcaggatcatatcgaggaaagaaaagatggggaagaaagtaaaatggctatcttctttaaagaaagccttcaatccagagtcaaaggaaaagaaaaatcagattttggataagcaagtgcatttgggtcctagtagttctaatgcggctgcacccacattagaaactgttaatttgtcccctccacctcagccggaagatgagaaaataatcaaacccgagacggttgctgaagctaccgatgatgatgttgttgttgctccagctgttccgaccccggctgctgttacggtcgttcaacgccgacttaatatagactctcggtttgctggaaaatctatggaggaagttgcagcgatcaaaattcagacagcttttcgagtttacatggcgaaaagagcattgtgtgctttacgaggacttgtgaggctgaaatcgttaatggaaggacctgcggtgaaacggcaagtgacgagtacccttcgttgtatgcaaacactttctcgtgtgcagtgtcagattcggatgaggagaatccgtatgaccgaagaaaatcaagctcttcagagacaaatcttgcagaaacatgcgaaagagcttgtgaatttgcagatgggggaagattgggacgatagcttgcaatcgaaggaacaaatcgaagcgagcttattgagcaaacacgaggctgcaatgagacgagaaagggcaatggcttattcatttactcatcagcaaacttggaagaacggttcgaaatctatgaatccgttattcatggatatgaacaacctgacgtggggttggagttggttagaacgatggatggcagctcgaccatgggaaggacgtggcgtgacgggaaaggaaccgaacaacgaccagtcatcggtaaagagtgcacatttcgaaggagaaatcagcaaagcttacgctcgttaccaactcaatttggataataaacaatccccgaaatcgagccaaaagcctaaccgaacatcaagtcacctatccccttctccgaaaccaccttccacaccatccccaaagctgaagtccgcaagccctagcggcagtatcattgcccaggacgacgacacaagaagcatagtcagcgcgcaatccgaacggaaccgaagacacagcattgccggctcattggtgcgtgacgacgagagcttagcaagctcgccgtcacttccgagttatatggtaccaactaaatcggcaagagccaaaaccaggttgcaaagtcccttgggactagaagcaaatggtacacccgacaaaggaccgatcatgtcgaccaaaaaacgactcttgtatccaccttcaccggccaaaccgaggcggcactctggtccaccgagagtcgataccagcattattactaatacaaaaattggtgcggtgaatggtggtgtcatttaatttctctatatttttaattcatacaggttttatttgtgagatttgagaacaaactacgcataatttttagttcattgacaatttgttcattataattcttgtgctggtgttgtattgatttgtataataaattatatacattacttgtttatttt

SEQ ID NO: 1069 - protein, 466 aa, Gossypium hirsutum
  misc_feature (107)..(127): Pfam Name: IQ Pfam Description: IQ calmodulin-binding motif
  misc_feature (1)..(466): Ceres Clone ID no. 1942871
  misc_feature (1)..(466): Bit score of 1150.4 for HMM based on sequences of Figure 22
  misc_feature (1)..(466): Functional Homolog Of SEQ ID NO. 1065
  misc_feature (1)..(466): in Figure 22
MGKKVKWLSSLKKAFNPESKEKKNQILDKQVHLGPSSSNAAAPTLETVNLSPPPQPEDEKIIKPETVAEATDDDVVVAPAVPTPAAVTVVQRRLNIDSRFAGKSMEEVAAIKIQTAFRVYMAKRALCALRGLVRLKSLMEGPAVKRQVTSTLRCMQTLSRVQCQIRMRRIRMTEENQALQRQILQKHAKELVNLQMGEDWDDSLQSKEQIEASLLSKHEAAMRRERAMAYSFTHQQTWKNGSKSMNPLFMDMNNLTWGWSWLERWMAARPWEGRGVTGKEPNNDQSSVKSAHFEGEISKAYARYQLNLDNKQSPKSSQKPNRTSSHLSPSPKPPSTPSPKLKSASPSGSIIAQDDDTRSIVSAQSERNRRHSIAGSLVRDDESLASSPSLPSYMVPTKSARAKTRLQSPLGLEANGTPDKGPIMSTKKRLLYPPSPAKPRRHSGPPRVDTSIITNTKIGAVNGGVI

SEQ ID NO: 1070 - protein, 466 aa, Vitis vinifera
  misc_feature (112)..(132): Pfam Name: IQ Pfam Description: IQ calmodulin-binding motif
  misc_feature (1)..(466): Public GI ID no. 157347478
  misc_feature (1)..(466): Bit score of 1147.3 for HMM based on sequences of Figure 22
  misc_feature (1)..(466): Functional Homolog Of SEQ ID NO. 1065
  misc_feature (1)..(466): in Figure 22
MGRKGNWLSSVKKALSPEPKEKKDQRADKSKKKWFGKHKYPDPNPSSLETVPGPSLAPPEEVKTIEPDNEHHKHVYSVAATTTMASLDVPETDVEVVEITTLTQSTGKAKEEAAAIKIQTAFRGYLARRALRALRGLVRLQSLIQGTAVKRQAANTLRCMQTLARVQSQICYRRIRMSEENQALQRQLLQKQAKEFEQLKMGEEWDDSLQSKEQIEAGLLNKQGAAMRRERALAYAFSHQQAWKNSSKSTNLLFMDPSNPHWGWSWLERWMAARPWESRSTTDKELNNDQLSIKSGSRSITGGEITKAYARHLLDSSKPSPTASQKPYHPPARQSPSTPPSKALENLSLQQAQGGICGSMVSIQSERFRRHSIAGSSVGDDESLASSPAVPSYMAPTKSAKAKSRLQSPLGLENNGTPEKGSSGIAKKRLSFPASPARPRRHSGPPRVESSSLTEGIVSNGGGTVS

SEQ ID NO: 1071 - DNA, 1437 bp, Populus balsamifera subsp. trichocarpa
  misc_feature (1)..(1437): Ceres Annot ID no. 1528800
  misc_feature (1)..(1437): Encodes the peptide sequence at SEQ ID NO. 1072
atggggaggaaaggaaaatggttttctagtgtaaagaaagctcttagccctgatcccaaggagaagacagaccagaaatcaaataaatcaaagaagaaatggtttggaaagcaacaactggattcggattccacttctttagaaaatgtcacaatgctgtctcctcctccccaaccagaagaagtgaaattaattgagacaacagatgaagtgaaccagcatactttccctgttccagttgccactgctgcagtacctgagcctgctccgactactgtccaaaccaatattgaggttgttcaactgaccaaggtaaacaaatatgctggcaaatcaaaggaagaagaggcggcaattaagattcaaacaacattcagaggatacatggccagaagagcattgcgggctctgagagggttggcgaggctcaaatttctgatggaagggcctagaataaaaaggcaagcaacacataccctccgctgcatgcagactctagctcgggtgcagtcacagattcacacaaggaggatcagaatgtcagaagagaaccaggccctacagagacaactcctacagaagcatgccaaagagcttgaaaacttgcggattggagaggaatgggatgacagtctacagtcgaaggaacagattgaagctagcctgctaaacaagtttgaggccgctacgagaagggaaagagcactggcttatgctttctctcatcagcaaactttgaagaattcttcacgatctgcaaaccccatgttcatgaatgggaatccttcctggggttggagctggttggaacgatggatggcagcccatccatgggagagccggagcttgatggagaaagaacacaataacgaccactcatctgtaaagagtgccagccgcagcattactggaggagaaataagcaaatcttatgctcgctaccagctcaattctgataaattaactccaagagaaagtgaaaggccaaccaaaaccacgaacctacagtccccatcaactcctaaaaagccagctgcttctacagttgctagaaaattgaagtcagcaagcccaaggagtaacattgggggcattgaagatgactctagaagcatggtcagtgttcaatcagatcgtagtagaaggcatagcattgctggttcatttgtgcgagatgatgagagcctcggaagctctccagcgcttccaagttacatggtacctacacaatctgcaagagcaaagtccagaatacatagcctattgggagcagaaaaggacgggacaccagaaaaggaaaagggttcctctgggcatacaaagaaacggctttcataccctccatcgccagccaaaggaaggaggtattctggccccccaaagttggaaagcagcttcaatgcaagaaatagcgtggctgctggcgagggaatttaa

SEQ ID NO: 1072 - protein, 478 aa, Populus balsamifera subsp. trichocarpa
  misc_feature (115)..(135): Pfam Name: IQ Pfam Description: IQ calmodulin-binding motif
  misc_feature (1)..(478): Ceres Annot ID no. 1528800
  misc_feature (1)..(478): Bit score of 1213.4 for HMM based on sequences of Figure 22
  misc_feature (1)..(478): Functional Homolog Of SEQ ID NO. 1065
  misc_feature (1)..(478): in Figure 22
MGRKGKWFSSVKKALSPDPKEKTDQKSNKSKKKWFGKQQLDSDSTSLENVTMLSPPPQPEEVKLIETTDEVNQHTFPVPVATAAVPEPAPTTVQTNIEVVQLTKVNKYAGKSKEEEAAIKIQTTFRGYMARRALRALRGLARLKFLMEGPRIKRQATHTLRCMQTLARVQSQIHTRRIRMSEENQALQRQLLQKHAKELENLRIGEEWDDSLQSKEQIEASLLNKFEAATRRERALAYAFSHQQTLKNSSRSANPMFMNGNPSWGWSWLERWMAAHPWESRSLMEKEHNNDHSSVKSASRSITGGEISKSYARYQLNSDKLTPRESERPTKTTNLQSPSTPKKPAASTVARKLKSASPRSNIGGIEDDSRSMVSVQSDRSRRHSIAGSFVRDDESLGSSPALPSYMVPTQSARAKSRIHSLLGAEKDGTPEKEKGSSGHTKKRLSYPPSPAKGRRYSGPPKLESSFNARNSVAAGEGI

SEQ ID NO: 1073 - protein, 474 aa, Oryza sativa subsp. japonica
  misc_feature (107)..(127): Pfam Name: IQ Pfam Description: IQ calmodulin-binding motif
  misc_feature (1)..(474): Public GI ID no. 54306075
  misc_feature (1)..(474): Bit score of 1166.0 for HMM based on sequences of Figure 22
  misc_feature (1)..(474): Functional Homolog Of SEQ ID NO. 1065
  misc_feature (1)..(474): in Figure 22
MGKKGKWFGAVKKVFSPESKEKKEERLRRKLAASNPNPPDLTPSASLEVNVSVPPPPPPPPVQQIEEVKVPEVEQEQSKHVTVEAVPEAVPVPAQTSSLPPGVSREEQATIKIQTAFRGYLARRALRALRGLVRLKSLVEGNSVKRQAASTLRCMQTLARVQSQIRSRRLKMSEENQALQRQLLLKQELESLRMGEQWDDSTQSKEQIEASLISRQEAAVRRERALAYAFSHQWKSTSRSVNPMFVDPNNPQWGWSWLERWMAAKPWEGRAGTDKESNLDRASAKSASLNLGEGEITKAFNRRGSKPDKSSPTTPKLTRPASRQSPSTPSAKVSPIFAKKKSATPKNGLSQVDDDAKSVFSVQSERPRRHSIATSTVRDDESLASSPSVPSYMAPTKSARAKLRLQGSAVTDGAETPPEKVASVGSVKKKLSFQAGMAPPSPMRRHSGPPKVEVVKDIAEPPQPEALVINGGSK

SEQ ID NO: 1074 - DNA, 1422 bp, Sorghum bicolor
  misc_feature (1)..(1422): Ceres Annot ID no. 8724651
  misc_feature (1)..(1422): Encodes the peptide sequence at SEQ ID NO. 1075
atggggaagaagggcaagtggttcggcgccgtcaagaaggtcttcagccctgaatccaaggagaagaaagaggagagactaaggaggaaatcagcagctagcaacccagcaccgctagatctgaccccatctacctccttggaagtcaatgtttcggtgccaccccctccagctccggcacctcctccagttctccaccaggccgaggaggtcagggtccctgaacccgagcaggagcagagcaagcatgtcaccgtggaggagccccctgctgttccagcacagccgtcggtgctgccacctggtgtgccaaccgaagagcttgctgcggtcaagatccagaccgccttccgaggttacctggcaaggagggcactaagagcactgcgaggtcttgttcgattgaagtcattggttgagggtaattcagtcaagcgtcaatctgcaagcactctgcgctgtatgcaaactctatcgcgggtgcagtcacaaatacgttctaggagagcaaagatgtccgaggagaaccaggccctccaacgccagctcctacttaaacaggaattggagaatttcagaatgggtgagaactgggatgacagcactcaatccaaggagcaaatcgaggcaagcctgataagcaggcaagaagcagcgataagaagagaaagagcgcttgcatatgcattttcacatcagtggaagagtacttcaagatctgtcaacccaatgtttgtagacccaaacaacttgcagtggggctggagctggttggagcgctggatggcagcaaaaccttgggagggccgtaatggggctgacaaggagagcaactttgaccgcggatcagttaagagtatgagcttgaaccttggagagggtgaaatcacaaaagctttcaaccgccgggactcaaagccagaaaagccatcaccaccaactccaaaaccaacccgtccagcctggcaatccccttcgacgccatctgctaaagtggcaccaatacctgccaggaggaaatccgccacgccaaagaatgggctttcacaggtggacgatgacgctaggagtgtgctcagcgtgcagtctgagcgaccaaggaggcacagtatagccacctcgactgtgcgggatgatgaaagcctcgcaagctccccatcactccccagctacatggttcccacggaatctgcaagagccaaatctcgtctccagggctcatcaatgaccaatggtgcagagacaccagagaaaggaggctctactggaccagtcaagaagaggttgtccttccaaggtggaactgcagctgcctcaccaatgcggcggcattctggtcctcccaaggtggagagtgcagtgaaggacattgttgcaccaccacagccagaggccttggtagtcaatggtggaagcaagtga

SEQ ID NO: 1075 - protein, 473 aa, Sorghum bicolor
  misc_feature (107)..(127): Pfam Name: IQ Pfam Description: IQ calmodulin-binding motif
  misc_feature (1)..(473): Ceres Annot ID no. 8724651
  misc_feature (1)..(473): Bit score of 1172.2 for HMM based on sequences of Figure 22
  misc_feature (1)..(473): Functional Homolog Of SEQ ID NO. 1065
  misc_feature (1)..(473): in Figure 22
MGKKGKWFGAVKKVFSPESKEKKEERLRRKSAASNPAPLDLTPSTSLEVNVSVPPPPAPAPPPVLHQAEEVRVPEPEQEQSKHVTVEEPPAVPAQPSVLPPGVPTEELAAVKIQTAFRGYLARRALRALRGLVRLKSLVEGNSVKRQSASTLRCMQTLSRVQSQIRSRRAKMSEENQALQRQLLLKQELENFRMGENWDDSTQSKEQIEASLISRQEAAIRRERALAYAFSHQWKSTSRSVNPMFVDPNNLQWGWSWLERWMAAKPWEGRNGADKESNFDRGSVKSMSLNLGEGEITKAFNRRDSKPEKPSPPTPKPTRPAWQSPSTPSAKVAPIPARRKSATPKNGLSQVDDDARSVLSVQSERPRRHSIATSTVRDDESLASSPSLPSYMVPTESARAKSRLQGSSMTNGAETPEKGGSTGPVKKRLSFQGGTAAASPMRRHSGPPKVESAVKDIVAPPQPEALVVNGGSK

SEQ ID NO: 1076 - protein, 476 aa, Zea mays
  misc_feature (108)..(128): Pfam Name: IQ Pfam Description: IQ calmodulin-binding motif
  misc_feature (1)..(476): Public GI ID no. 194696788
  misc_feature (1)..(476): Bit score of 1149.0 for HMM based on sequences of Figure 22
  misc_feature (1)..(476): Functional Homolog Of SEQ ID NO. 1065
  misc_feature (1)..(476): in Figure 22
MGKKGKWFGAVKKVFSPESKEKKEERLRRKSAASNPAPVDLTPSTSLEVNVSVPPPPAPPPVPRQTDEVRVPEAEQEQSKHVTLEEAPAAAAAPAQAPVLPPGAPTEELAAIKIQTAFRGYLARRALRALRGLVRLKSLVEGNSVKRQSASTLRCMQTLSRVQSQIRSRRAKMSEENQALQRQLLLKQELENFRMGENWDDSTQSKEQIEASLISRQEAAIRRERALAYAFSHQWKSTSRSANPMFVDPNNLQWGWSWLERWMAAKPWEGRNGTDKESNIDRGSVKNMSLNLGVGEGEITKAFNRRDSKPEKPSPPTPKPARPASRQSPSTPSARVAPIPARRKSSTPKNGLSQVDDDVRSVLSVQSERPRRHSIATTSTMRDDESLASSPSLPSYMVPTESARAKSRTATANGAETPEKGGSAGPVKKRLSFQGGAAAASPMRRHSGPPKVESAVKDIAAPPQPEALVANGGGSK

SEQ ID NO: 1077 - DNA, 2001 bp, Panicum virgatum
  misc_feature (1)..(2001): Ceres Clone ID no. 1792902
  misc_feature (1)..(2001): Encodes the peptide sequence at SEQ ID NO. 1078
gtcactctcggcactgctcccagctgttgcgacctccgaacatccaaggctcctgcacccctgtcagtcctagctccagccaaaaatcgttggctcccgctgcctgctcctccgccttgcacctcccatgaccttccacgcgacatgattgcattgcaggcccctgcggagctcagctgtcctcccacgccgctgacgccttcttgttgcctccacgctgctgcgctcaaccgaaagggccttcctctctttgcttccgcggaaggatttggcgatttattcatctactaaagttgcatctctcttgtgcgtggtgattgtttcgaggagcgtggagcggagccatggggaagaagggcaagtggttcggcgcggtcaagaaagtgttcagccctgaatccaaggagaagaaggaggagaggcagaggaggaaatcagcagctagcaaccctactccactagatctgaccccgtcgacctccttggaagtcaatgtttcggtgccaccccctccagctcctccggctcttcaccagattaaggaggtcaggatccctgaagctgagcaggagcagagcaagcacatcaccgtagaggaggcccctgctgcccctgcacaggcgtcggtgcttccacctggtgtgccaagtgaagagcttgctgcaatcaagatccagactgccttccgaggttacctggcaaggagggcactgcgagcgctgcggggccttgttcgattgaagtcattggttgagggtgattcagttaggcgtcaatctgcaagcactctgcgctgtatgcagactctatcgcgggtgcagtcacaaatacgttctaggagagcaaagatgtctgaggagaaccaggccctccagcgccagctcctactgaagcaggaactggagaatttcaggatgggtgagaactgggatgacagcactcaatccaaagagcaaatcgaggcgagcctaataagcaggcaagaggcagcgattagaagagaaagagcgcttgcatatgcattttcacatcagtggaagagcacgtcgaggtctgtcaacccaatgtttgtagacccaaacaacttgcagtggggctggagctggctggagcgctggatggctgcaaaaccttgggagggccgcaatgggactgataaggagagcaatgttgaccgtggatccgttaagagcatgagcttgaaccttggagagggtgagatcactaaagctttcaaccgccgggactcaaagccagaaaagccatccccgccaactccaaaactgacccgtccagcctccaggcaatccccttcaacgccctccgctaaagtagcgccaatacctgtgaggagaaaatccgtcacgccaaagaatgggctttcacatgtggatgacgatgcgagaagtgtgttcagtgtgcagtctgagcgaccaaggaggcacagtatagccacctcgactgtgcgggacgatgagagtctcgcaagctccccatcactcccaagttatatggttcccacagaatctgcaagggcgaagtctcgtctccagggatcagcattgaataatggtgcagagacaccagagaaaggaagctctgctggaccggtcaagaaaaggttgtcctttcaaggtggaacagcggctgcctcaccaatgcgacggcattctggtcctcccaaggtggggagtgcggtgaaggatattgttgccccaccacagccagaggccttggtgatcaatggtggaagcaagtgactcatgacaagtaccaggagggtaaagcggacaatgaatatatattttatccatgaagaaaggttaacgtgatatcagctctatgagtgatttgaattgttttccagttacgaccacattgtttgctctataagattcacagtacctgccagttgattccattcgttgtttctgtaaaacaagtaccggttcgtcactagaatcagtgatgtttgtatgtaaacaggtcttctatttatgt

SEQ ID NO: 1078 - protein, 471 aa, Panicum virgatum
  misc_feature (104)..(124): Pfam Name: IQ Pfam Description: IQ calmodulin-binding motif
  misc_feature (1)..(471): Ceres Clone ID no. 1792902
  misc_feature (1)..(471): Bit score of 1170.7 for HMM based on sequences of Figure 22
  misc_feature (1)..(471): Functional Homolog Of SEQ ID NO. 1065
  misc_feature (1)..(471): in Figure 22
MGKKGKWFGAVKKVFSPESKEKKEERQRRKSAASNPTPLDLTPSTSLEVNVSVPPPPAPPALHQIKEVRIPEAEQEQSKHITVEEAPAAPAQASVLPPGVPSEELAAIKIQTAFRGYLARRALRALRGLVRLKSLVEGDSVRRQSASTLRCMQTLSRVQSQIRSRRAKMSEENQALQRQLLLKQELENFRMGENWDDSTQSKEQIEASLISRQEAAIRRERALAYAFSHQWKSTSRSVNPMFVDPNNLQWGWSWLERWMAAKPWEGRNGTDKESNVDRGSVKSMSLNLGEGEITKAFNRRDSKPEKPSPPTPKLTRPASRQSPSTPSAKVAPIPVRRKSVTPKNGLSHVDDDARSVFSVQSERPRRHSIATSTVRDDESLASSPSLPSYMVPTESARAKSRLQGSALNNGAETPEKGSSAGPVKKRLSFQGGTAAASPMRRHSGPPKVGSAVKDIVAPPQPEALVINGGSK

SEQ ID NO: 1079 - protein, 445 aa, Arabidopsis thaliana
  misc_feature (114)..(134): Pfam Name: IQ Pfam Description: IQ calmodulin-binding motif
  misc_feature (1)..(445): Public GI ID no. 7413581
  misc_feature (1)..(445): Bit score of 959.4 for HMM based on sequences of Figure 22
  misc_feature (1)..(445): Functional Homolog Of SEQ ID NO. 1065
MGKKAKWFSSVKKAFSPDSKSKQKLAEGQNGVISNPPVVDNVRQSSSSPPPALAPREVRVAEVIVERNRDLSPPSTADAVNVTATDVPVVPSSSAPGVVRRATPTRFAGKSNEEAAAILIQTIFRGYLARRALRAMRGLVRLKLLMEGSVVKRQAANTLKCMQTLSRVQSQIRARRIRMSEENQARQKQLLQKHAKELAGLKNGDNWNDSIQSKEKVEANLLSKYEATMRRERALAYSYSHQQNWKNNSKSGNPMFMDPSNPTWVPRKNKSNSNNDNAASVKGSINRNEAAKSLTRNGSTQPNTPSSARGTPRNKNSFFSPPTPSRLNQSSRKSNDDDSKSTISVLSERNRRHSIAGSSVRDDESLAGSPALPSYMVPTKSARARLKPQSPLGGTTQENEGFTDKASAKKRLSYPTSPALPKPRRFSAPPKVESGGVTVTNGAGS

SEQ ID NO: 1080 - protein, 454 aa, Arabidopsis thaliana
  misc_feature (108)..(128): Pfam Name: IQ Pfam Description: IQ calmodulin-binding motif
  misc_feature (1)..(454): Public GI ID no. 15232741
  misc_feature (1)..(454): Bit score of 581.1 for HMM based on sequences of Figure 22
  misc_feature (1)..(454): Functional Homolog Of SEQ ID NO. 1065
MVKKAKWLKNVKKAFSPDSKKLKHESVECQDSVISYPVLIATSRSSSPQFEVRVDEVNYEQKKNLYPPSSDSVTATVAHVLVDSPPSSPESVHQAIVVNRFAGKSKEEAAAILIQSTFRGHLARRESQVMRGQERLKLLMEGSVVQRQAAITLKCMQTLSRVQSQIRSRRIRMSEENQARHKQLLQKHAKELGGLKNGGNWNYSNQSKEQVEAGMLHKYEATMRRERALAYAFTHQQNLKSFSKTANPMFMDPSNPTWGWSWLERWMAGRPWESSEKEQNTTNNDNSSVKNSTNRNSQGGETAKSSNRNKLNSSTKPNTPSASSTATRNPRKKRPIPSSIKSKSSDDEAKSSERNRRPSIARPSVSDDETLSSSTARRSSNLIPTTKSARGKPKSQTSSRVAVTTSTTEESSILPEKAPAKKRLSTSASPAPKPRRSSAPPKVEKGVLKAERTP

SEQ ID NO: 1081 - DNA, 1440 bp, Populus balsamifera subsp. trichocarpa
  misc_feature (1)..(1440): Ceres Annot ID no. 1484880
  misc_feature (1)..(1440): Encodes the peptide sequence at SEQ ID NO. 1082
atggggaggaaaggaaaatggttttctagtgtaaagaaagctcttagccctgattccaaggagaagaaagaccagaaatcaaataaatcgaagaagaaatggtttggcaagcaacaactggattcggattccacttctttagaaaatgttacaatgcgatctcctcctcctcctcaaccagacgaggtgaaattaattgaaaccacaaatgaagagaaccagcatacttactctgttccagttgtcactgctgcagtagctgagcatgctccgattactgttcaaaccaccactgaggtttttcaaccaaccaaggttaataaatatgctggcaaatcaaaggaagaagtggcggcaattaagattcagacagcattccgaggatacatggcaagaagagcattgcgggctctgagagggctgttcaggctcaaatctctgatggaagggcctacgataaaaagacaagcaacccatactctccactgcatgcagactctagctcgggtgcagtcacagatacacacaaggaggattagaatgtcagaagagaaccaggccctacagagacaactcctacatgagcatgcaaaagagtttgaaagcttgcagattggagaggaatgggatgacagtctacagtcaaaggaacagattgaagctaacctgctaaacaagtttgaggcagctgtgagaagggaaagagcactggcttattctttctctcatcagcaagcctggaaaatttcttcacgagctgtaaacccaatgttcatgagtggcaatccatcctggggttggagctggttggaacgatggatggcagcccatccatgggagagccggagcatgacggagaaagaacttaataatgaccactcatctctaaagagtgcgagccgcagcattactggaggggatataagcaaatcttatgctcgctaccagctcaattctgataaactaactccaagagaaagtgaaaggccaaccaaaaccgcgaacctacagttccaatcaactcctaacaagccagctgcttctacagttgctagaaaattgaagtcagccagcccaaggagtggcattgggggcctagatgatgaatctaaaagtgtggtcagtgttcagtcagatcatagtagaaggcatagcattgcaggttcatttgtacgagatgatgagagccttggaagctctccaccacttccaagttacatggtacctacagaatccgcgagagcaaagtccagattacaaaacccattgggggcagagatgaacggagcgcctgaaaaggaaaagggatccttggggtctgccaagaagcggctttcctaccctccctcaccagccaaagcaaggaggtattcaggtcccccgaaattggaaagcagcttaaaagcagaaaacagtgaggctgctggcgagggcatttaa

SEQ ID NO: 1082 - protein, 479 aa, Populus balsamifera subsp. trichocarpa
  misc_feature (116)..(136): Pfam Name: IQ Pfam Description: IQ calmodulin-binding motif
  misc_feature (1)..(479): Ceres Annot ID no. 1484880
  misc_feature (1)..(479): Bit score of 1113.0 for HMM based on sequences of Figure 22
  misc_feature (1)..(479): Functional Homolog Of SEQ ID NO. 1065
MGRKGKWFSSVKKALSPDSKEKKDQKSNKSKKKWFGKQQLDSDSTSLENVTMRSPPPPQPDEVKLIETTNEENQHTYSVPVVTAAVAEHAPITVQTTTEVFQPTKVNKYAGKSKEEVAAIKIQTAFRGYMARRALRALRGLFRLKSLMEGPTIKRQATHTLHCMQTLARVQSQIHTRRIRMSEENQALQRQLLHEHAKEFESLQIGEEWDDSLQSKEQIEANLLNKFEAAVRRERALAYSFSHQQAWKISSRAVNPMFMSGNPSWGWSWLERWMAAHPWESRSMTEKELNNDHSSLKSASRSITGGDISKSYARYQLNSDKLTPRESERPTKTANLQFQSTPNKPAASTVARKLKSASPRSGIGGLDDESKSVVSVQSDHSRRHSIAGSFVRDDESLGSSPPLPSYMVPTESARAKSRLQNPLGAEMNGAPEKEKGSLGSAKKRLSYPPSPAKARRYSGPPKLESSLKAENSEAAGEGI

SEQ ID NO: 1083 - protein, 482 aa, Vitis vinifera
  misc_feature (117)..(137): Pfam Name: IQ Pfam Description: IQ calmodulin-binding motif
  misc_feature (1)..(482): Public GI ID no. 147809623
  misc_feature (1)..(482): Bit score of 978.6 for HMM based on sequences of Figure 22
  misc_feature (1)..(482): Functional Homolog Of SEQ ID NO. 1065
MGKKGNWFSAVKKALSPEPKEKKDKTTPKSKKKWFGKHKNLDPVSSSTENAMPLPAPAPPIEDVKLTEAENEQSKHAYSVALATAVAAEAAVAAAHAAAEVVRLTTVTRFSGKSKEEVAAIKIQTAFRGYLARRALRALRGLVRLKSLIQGQSVKRQATTTLRCMQTLARVQSQIRARRIRMSEENLALQRQLQLKRDKELEKLRASIGDDWDDSVQSKEQIEANLQSKQEAAVRRERALAYAFSHQQTWKNSSKPANPTFMDPNNPHWGWSWLERWMAARPWESRSAMEKELNTDHASLKSTTSRAFSIGEISKAYARRDLNLDKKPSPTAQKPSRPPSRQSPSTPPSKAQSSSSVTGKTRPASPKGSGWGADDDSRSMLSIQSEWYRRHSIAGSLVRDDESLASSPAVPSYMASTESTRARSRLPSPLGLEKNGTPEKASGSSAKKRLSFPASPAGPRRHSGPPRVETSSIKAISPAHRG

SEQ ID NO: 1084 - DNA, 1455 bp, Populus balsamifera subsp. trichocarpa
  misc_feature (1)..(1455): Ceres Annot ID no. 1475350
  misc_feature (1)..(1455): Encodes the peptide sequence at SEQ ID NO. 1085
atggggaggaaaggaaaatggttttctagtgtaaagaaagctcttagccctgatcccaaggagaagacagaccagaaatcaaataaatcaaagaagaaatggtttggaaagcaacaactggattcggattccacttctttagaaaatgtcacaatgctgtctcctcctccccaaccagaagaagtgaaattaattgagacaacagatgaagtgaaccagcatactttccctgttccagttgccactgctgcagtacctgagcctgctccgactactgtccaaaccaatattgaggttgttcaactgaccaaggtaaacaaatatgctggcaaatcaaaggaagaagaggcggcaattaagattcaaacaacattcagaggatacatggccagaagagcattgcgggctctgagagggttggcgaggctcaaatttctgatggaagggcctagaataaaaaggcaagcaacacataccctccgctgcatgcagactctagctcgggtgcagtcacagattcacacaaggaggatcagaatgtcagaagagaaccaggccctacagagacaactcctacagaagcatgccaaagagcttgaaaacttgcggggcatgcaatgttttcatattggagaggaatgggatgacagtctacagtcgaaggaacagattgaagctagcctgctaaacaagtttgaggccgctacgagaagggaaagagcactggcttatgctttctctcatcagcaaactttgaagaattcttcacgatctgcaaaccccatgttcatgaatgggaatccttcctggggttggagctggttggaacgatggatggcagcccatccatgggagagccggagcttgatggagaaagaacacaataacgaccactcatctgtaaagagtgccagccgcagcattactggaggagaaataagcaaatcttatgctcgctaccagctcaattctgataaattaactccaagagaaagtgaaaggccaaccaaaaccacgaacctacagtccccatcaactcctaaaaagccagctgcttctacagttgctagaaaattgaagtcagcaagcccaaggagtaacattgggggcattgaagatgactctagaagcatggtcagtgttcaatcagatcgtagtagaaggcatagcattgctggttcatttgtgcgagatgatgagagcctcggaagctctccagcgcttccaagttacatggtacctacacaatctgcaagagcaaagtccagaatacatagcctattgggagcagaaaaggacgggacaccagaaaaggaaaagggttcctctgggcatacaaagaaacggctttcataccctccatcgccagccaaaggaaggaggtattctggccccccaaagttggaaagcagcttcaatgcaagaaatagcgtggctgctggcgagggaatttaa

SEQ ID NO: 1085 - protein, 484 aa, Populus balsamifera subsp. trichocarpa
  misc_feature (115)..(135): Pfam Name: IQ Pfam Description: IQ calmodulin-binding motif
  misc_feature (1)..(484): Ceres Annot ID no. 1475350
  misc_feature (1)..(484): Bit score of 1201.0 for HMM based on sequences of Figure 22
  misc_feature (1)..(484): Functional Homolog Of SEQ ID NO. 1065
MGRKGKWFSSVKKALSPDPKEKTDQKSNKSKKKWFGKQQLDSDSTSLENVTMLSPPPQPEEVKLIETTDEVNQHTFPVPVATAAVPEPAPTTVQTNIEVVQLTKVNKYAGKSKEEEAAIKIQTTFRGYMARRALRALRGLARLKFLMEGPRIKRQATHTLRCMQTLARVQSQIHTRRIRMSEENQALQRQLLQKHAKELENLRGMQCFHIGEEWDDSLQSKEQIEASLLNKFEAATRRERALAYAFSHQQTLKNSSRSANPMFMNGNPSWGWSWLERWMAAHPWESRSLMEKEHNNDHSSVKSASRSITGGEISKSYARYQLNSDKLTPRESERPTKTTNLQSPSTPKKPAASTVARKLKSASPRSNIGGIEDDSRSMVSVQSDRSRRHSIAGSFVRDDESLGSSPALPSYMVPTQSARAKSRIHSLLGAEKDGTPEKEKGSSGHTKKRLSYPPSPAKGRRYSGPPKLESSFNARNSVAAGEGI

SEQ ID NO: 1086 - DNA, 2163 bp, Gossypium hirsutum
  misc_feature (1)..(2163): Ceres Clone ID no. 1886384
  misc_feature (1)..(2163): Encodes the peptide sequence at SEQ ID NO. 1087
aaacttttattccttccgtaaaggttcttctttgtttaaaactcaatttttattcctaatatctactgttcccccatgattttgcctcttaagatgggaaagaaagggaaatggttgtcctctctaaagaaagccttcttctcagagtccaagggaaagaaaaaccagaaatcaaaagaacaatttttggagaaggtgcatttggatcccactggttctgatgcagccaagttatccccacttcctcagcctgaagaggtgaaattaattgaacctgaagttgagcaaagcaagcagacttaccctgtggcagttgccaattctcctgccgttccagctcaggttgctctacaggccattcgacatcaacttaatacagatgctaggtttgccggaaaatctaaggaggaagtggcggcaatcaaaattcaagcagctttccgagcttaccttgcaaaaagggcattgcgtgctttaagaggactggctaggttgaaatcactgatggaagggcctgccgccagacggcaagcagccggttcccttcggtgcttgcagactctttctcgtatgcagtgtcagattcatgctcggagaaccaggatgatggaagaaaaccaggctcttcagaggcaactcttgcagaaacatgcgaaagagattgtgaacttgcaaatgggtgaagattgggatgacactgtgcggtcaaaggaacaaattgaggcaagcttgttgagcaaacatgaggctgccatgagaagagaaagggccatggcgtactcatttactcatcagcaaacctggaagaatgcttcgagatctatgaatccattgttcatggatccaagcaatccctcatggggatggagctggatggaacggtggatgacagcccggccatgggaggttcgtggtggcatgagagataaagaacatctcgatgaccagtcatccctaaagagtgcacgaagcaacttcggtggagaaatcagcaaagcttatgctcgttatcaactcaatttggataagcaatccacgaaggccaaccaaaagccaagccgaacttcgagcctcctatccccttctactcctaagtcagcatccataccagcccgaaagctgaagtcagcaagcccgaggagtggtgtggctggtttagatgatgaaacaagaagcatagtcagtatgaagtctgacagaaaccggagacacagcatcgcaggctcctcagtgcgtgataatgagagccttgccaactctccatcacttccaagttacatggtaccaactaagtctgcaagagttaagaccagtttgcagagccccttgggaccagaagcaaatggaacacctgagaaggatccaattggatctgctaagaaacggctttcttatccgccttcaccggccaggctaaggcgccactcctgtctgccaaaagtggacggtagcattagcaatacaaaagttgcagtggtgaatggaggggacggttttttcaaataaaaaagagatgaagtcctgatgcacgctaatccagaagaatcggaaaagaagagagaaactttgtatgtttcaaaagttagttaactaacgggattgtcgttgcacccaaaacaccccgttttcattaaagtgttgcatcgttttattaactttgagccctagtattttaaaaaaaatagtagagatctcttcttgctctctctcccttttcttgcggctagggttttgaaacccctcatcgccgttgttgccacggtgccaccacaagcggtggtaagggcggtgcgagctggcctaccctgaggtgtccccgaaggccaagccttcttaacccaaaagttgcgaaagaaaggtcttcccctccttattcggtccgatcccggtgacggaggagagccctccgcgaagaaatcacgagcgattccagtgttgcgcgacgaatggaagaggtggcgtgtggtgcgatgaaacggcgcgcgttggtggccatgctggtggggagcggcggctgaaggcttggtggctagggtttgctgaaaattttgtttgtgttgtgggcttggactattagggtttgtgaattaggtttgggtattgtcttatttgggccattttaatatataaagggactgttaataaacatttggattttcaccc

SEQ ID NO: 1087 - protein, 470 aa, Gossypium hirsutum
  misc_feature (106)..(126): Pfam Name: IQ Pfam Description: IQ calmodulin-binding motif
  misc_feature (1)..(470): Ceres Clone ID no. 1886384
  misc_feature (1)..(470): Bit score of 936.0 for HMM based on sequences of Figure 22
  misc_feature (1)..(470): Functional Homolog Of SEQ ID NO. 1065
MGKKGKWLSSLKKAFFSESKGKKNQKSKEQFLEKVHLDPTGSDAAKLSPLPQPEEVKLIEPEVEQSKQTYPVAVANSPAVPAQVALQAIRHQLNTDARFAGKSKEEVAAIKIQAAFRAYLAKRALRALRGLARLKSLMEGPAARRQAAGSLRCLQTLSRMQCQIHARRTRMMEENQALQRQLLQKHAKEIVNLQMGEDWDDTVRSKEQIEASLLSKHEAAMRRERAMAYSFTHQQTWKNASRSMNPLFMDPSNPSWGWSWMERWMTARPWEVRGGMRDKEHLDDQSSLKSARSNFGGEISKAYARYQLNLDKQSTKANQKPSRTSSLLSPSTPKSASIPARKLKSASPRSGVAGLDDETRSIVSMKSDRNRRHSIAGSSVRDNESLANSPSLPSYMVPTKSARVKTSLQSPLGPEANGTPEKDPIGSAKKRLSYPPSPARLRRHSCLPKVDGSISNTKVAVVNGGDGFFK

SEQ ID NO: 1088 - DNA, 1470 bp, Populus balsamifera subsp. trichocarpa
  misc_feature (1)..(1470): Ceres Annot ID no. 1465047
  misc_feature (1)..(1470): Encodes the peptide sequence at SEQ ID NO. 1089
atggggaaaagagggagttggttctctgctttgaagaaagccctcggttcctctaagaaatccaaatcaaagaagaaatggtcagaaaaagagaagaaccgggatctaggtgtttcttcacatgaagaaaccgttgcaccctctctttctcctcctcgtacaccacctcctcctacagcagaagatgtgaaattaactgaagctgagaacgagcagagcaagcatgcttattccgtggcgcttgccactgctgtggcagctgaggcagctgttgcagccgcccaggctgccgctgaggttgttcggcttactacagtggcacattactctggaaaatcgaaggaggaaatagctgcaatcaggattcaaacagcatttagaggatacctggcgaggagggcattacgtgctttgagagggctggtgagattgaagtcattgatacaagggcaatctgtcaaacggcaagcaactgccacattacgagccatgcagactcttgctcgtgtgcagtctcagattcgtgcaagaaggatcagaatgtccgaggaaaatgaggccctccaacggcagctccagcagaaacatgacaaagaacttgagaagttgagaacttctattggagaacaatgggatgatagcccacaatcaaaggaagaagttgaagccagcctactacaaaagcaagaagctgccatgagaagagaaagggcactggcttatgcatactcgcatcagcaaatgtggaagcaatcttcaaaatcagcaaatgctacattcatggatccaaacaatcctcgttggggatggagttggttagagaggtggatggcagcccgaccttgggagagccgaagcacaatagataacaatgatcgggcctctgttaagagtacaacaagccgtaccatgtctcttggagaaatcagcagagcttattctcgtcgtgatcttaaccatgacaataaagcttctcctggtgcgcaaaaatcaagtcggcctcccagtcggcaatcaccttctactcccccctctaaggcaccatctacatcttcagtaacagggaaagcaaagccaccaagccctagagggagtgcttggggaggagacgaggactccaggagcacattcagtgtccagtctgagcgctatcggagacatagcatagcagggtcatcaataagagatgatgagagtcttgcaagttcgccttcagttccaagttacatggcacccacacggtcacagtcagcaaaggcaaaatcccgcttgtcaagcccgttaggcatagataataatgggacaccagataaggcatcagtgggttatgtaaagaagcggctttccttctctgcttcaccagctggagcaaggagacactctggtcctcctagggtggatgccagtgctgttaaagacattcaaatgcacagagaagagaaaatgagcaatggagcaagcagcaagtag

SEQ ID NO: 1089 - protein, 489 aa, Populus balsamifera subsp. trichocarpa
  misc_feature (116)..(136): Pfam Name: IQ Pfam Description: IQ calmodulin-binding motif
  misc_feature (1)..(489): Ceres Annot ID no. 1465047
  misc_feature (1)..(489): Bit score of 879.4 for HMM based on sequences of Figure 22
  misc_feature (1)..(489): Functional Homolog Of SEQ ID NO. 1065
MGKRGSWFSALKKALGSSKKSKSKKKWSEKEKNRDLGVSSHEETVAPSLSPPRTPPPPTAEDVKLTEAENEQSKHAYSVALATAVAAEAAVAAAQAAAEVVRLTTVAHYSGKSKEEIAAIRIQTAFRGYLARRALRALRGLVRLKSLIQGQSVKRQATATLRAMQTLARVQSQIRARRIRMSEENEALQRQLQQKHDKELEKLRTSIGEQWDDSPQSKEEVEASLLQKQEAAMRRERALAYAYSHQQMWKQSSKSANATFMDPNNPRWGWSWLERWMAARPWESRSTIDNNDRASVKSTTSRTMSLGEISRAYSRRDLNHDNKASPGAQKSSRPPSRQSPSTPPSKAPSTSSVTGKAKPPSPRGSAWGGDEDSRSTFSVQSERYRRHSIAGSSIRDDESLASSPSVPSYMAPTRSQSAKAKSRLSSPLGIDNNGTPDKASVGYVKKRLSFSASPAGARRHSGPPRVDASAVKDIQMHREEKMSNGASSK

SEQ ID NO: 1090 - DNA, 1806 bp, Zea mays
  misc_feature (1)..(1806): Ceres Clone ID no. 228069
  misc_feature (1)..(1806): Encodes the peptide sequence at SEQ ID NO. 1091
gagccgcggaggagcagcggcgcatcgcaacactaaccaaagtcctcctctccaggtgccgagccagggtgactgttccgaggagcgtggcgtggacccatggggaagaagggcaagtggttcggtgccgtcaagaaggtcttcagccccgaatccaaggagaagaaagaggagaggctaaggaggaaatcagcagctagcaacccagcaccggtagatctgaccccatctacctccctggaagtcaatgtttcggtgccaccccctccggctcctcctccagttcctcgccagaccgacgaggtcagggtccccgaagccgagcaggagcagagcaagcatgtcaccctggaggaggcccctgctgctgctgctgccccagcacaggcgtcggtgctgccacctggtgcgccaaccgaagagctcgccgcaatcaagatccagaccgccttccgaggttacctggcaaggagggcactaagagcactacgaggccttgtacgattgaagtcattggttgagggtaattcagttaagcgtcaatctgcaagcactctgcgctgtatgcaaactctatcgcgggtgcagtcacaaatacgatctaggagagcaaagatgtccgaggagaaccaggccctccaacgccagctcctacttaaacaggaactggagaatttcagaatgggtgagaactgggacgacagcactcaatccaaggagcaaatcgaggcaagcctaataagcaggcaagaggcagcgataagaagagaaagagctcttgcatatgcattttcacatcagtggaagagcacatcaagatctgcgaacccaatgtttgtagacccaaataacttgcagtggggctggagctggttggagcgctggatggcagcaaaaccttgggagggacgcaatgggaccgacaaggagagcaacattgatcgcggctccgtcaagaatatgagcttgaaccttggagttggagagggtgagatcacaaaagctttcaaccgccgggactcaaagccagagaagccatcaccaccgactccaaaaccggcccgtccagcttccaggcaatccccttcgacgccctctgctagagtggccccaatacctgcgaggaggaaatccagcacgccaaagaatgggctttcacaggtggacgatgacgtgaggagcgtgctcagtgtgcagtctgagcgaccaaggaggcacagcatagccacgacgtcgaccatgcgggacgatgagagcctcgcgagctccccgtcgctcccgagctacatggttcccacagaatctgcgagggccaaatctcgcacagcaacggccaatggcgcagagacgcctgagaaaggaggctctgctggaccagtcaagaagaggttgtctttccaaggtggagctgcggctgcctcaccgatgcgacggcattctggccctcccaaggtggagagcgctgtgaaggacattgctgcgccaccacagcctgaggccttggtagccaatggtggtggaagcaagtgacttgtattgacaagttccaggatgggggagcgggttatggtcttatggagggacatgtttcatccgtgaacagaagttaagagtggtgccggatctacgaatggtttgaattgttttcccgttacaaccacattgtttgctgtataagattcactgtacctgccagttggttccatttgttgttttctgtaaaacaaacatcaatttgtcactagaatctgtgatgcttgtatgtaaacaggtcctctatttatgtgagccatatatttcattttc

SEQ ID NO: 1091 - protein, 476 aa, Zea mays
  misc_feature (108)..(128): Pfam Name: IQ Pfam Description: IQ calmodulin-binding motif
  misc_feature (1)..(476): Ceres Clone ID no. 228069
  misc_feature (1)..(476): Bit score of 1148.6 for HMM based on sequences of Figure 22
  misc_feature (1)..(476): Functional Homolog Of SEQ ID NO. 1065
MGKKGKWFGAVKKVFSPESKEKKEERLRRKSAASNPAPVDLTPSTSLEVNVSVPPPPAPPPVPRQTDEVRVPEAEQEQSKHVTLEEAPAAAAAPAQASVLPPGAPTEELAAIKIQTAFRGYLARRALRALRGLVRLKSLVEGNSVKRQSASTLRCMQTLSRVQSQIRSRRAKMSEENQALQRQLLLKQELENFRMGENWDDSTQSKEQIEASLISRQEAAIRRERALAYAFSHQWKSTSRSANPMFVDPNNLQWGWSWLERWMAAKPWEGRNGTDKESNIDRGSVKNMSLNLGVGEGEITKAFNRRDSKPEKPSPPTPKPARPASRQSPSTPSARVAPIPARRKSSTPKNGLSQVDDDVRSVLSVQSERPRRHSIATTSTMRDDESLASSPSLPSYMVPTESARAKSRTATANGAETPEKGGSAGPVKKRLSFQGGAAAASPMRRHSGPPKVESAVKDIAAPPQPEALVANGGGSK

SEQ ID NO: 1092 - DNA, 2117 bp, Panicum virgatum
  misc_feature (1)..(2117): Ceres Clone ID no. 1806867
  misc_feature (1)..(2117): Encodes the peptide sequence at SEQ ID NO. 1093
gtcactctcgccactgctcccagctgttgcgacttgcgacctccgatcatccaaggctcctgcacccctgtcagtcctagctccagccaaaaatcgttggcttccgctgcctgctcctccgccttgcacctcccatgaccttccacgcgacatgattgcattgcaggcccctgcggagctcagtgtcctcccacgccgctgacgccttcttgttgcctccccgctgctgcgcacaaccgaaagggccttcctctcttcctttgcttccgcggaaagatttggcgatttgttcatctactaaagttgcatctctcttgtgcgtgtttgccaccgtggtcttgttatcatcgtccaacgttgggtcgtctgatagatatagatctgggccatctggtgatttgcttgttcctcttcagggtgattgtttcgaggagtgtggagtggagccatggggaagaagggcaagtggttcggcgcggtcaagaaagtgttcagccctgaatccaaggagaagaaggaggagaggcagaggaggaaatcagcagctagcaaccctactccacgagatctgaccccgtcgacctccttggaagtcaatgtttcggtgccaccccctccagctcctccggcccttcaccagattgaggaaatcagggcccctgaagctgagcaggagcagagcaagcacgtcaccgtagaggaggctcctgctgcccctgcacaggcgtcggtgctgccacctggtgtgccaagtgaagagcttgctgcaatcaagattcagactgccttccgaggttacctggcaaggagggcactgcgagcgctgcggggccttgttcgattgaaatcattggttgagggtgattcagttaggcgtcaatctgcaagcactcttcgctgtatgcagactctatcgcgggtgcagtcacaaatacgttctaggagagcaaagatgtctgaggagaaccaggcccttcagcgccagctcctactgaagcaggaactggagaatttcaggatgggtgagaactgggatgacagcactcaatccaaagagcaaatcgaggcaagcctaataagcaggcaagaggcagcgattagaagagaaagagcgcttgcatatgcattttcacatcagtggaagagcacttcgagatctgtcaacccaatgtttgtagacccaaacaacttgcagtggggctggagctggttggagcgctggatggctgcaaaaccttgggagggctgcaatggggctgataaggagagcaacattgaccgtggatctgttaagagcatgagcttgaaccttggagagggtgagatcacaaaagctttcaaccgccgggactcaaagccagaaaagccatcaccgccaactccaaaactgacccgtccagcctccaggcaatccccttcgacgccctctgctaaagtagcgccaatacctgctaggagaaaatccgccacgccaaagaatgggctttcacatgtggatgacgatgcgagaagtgtgttcagcgtgcagtctgagcgaccaaggaggcacagtatagccacctcgactgtgcaggacaatgagagtctcgcaagctccccatcactcccaagttacatggttcccacagaatctgcaagggcgaagtctcgtctccagggatcagcattgactaatggtgcagagacaccggagaaaggaagctctgctggaccggtcaagaaaaggttgtcatttcaaggtggaacagcggctgcctcaccaatgcgacggcattctggtcctcccaaggtggacagtgtgatgaaggatattgttgccccaccacagccagaggccttggtgatcaatggtggaagcaagtgactcataccaggaggggaaagcggattatgaatatatattttatcgatgaagaaaggttaacgtgatatcagctcaatgagtgatttgaattgttttcttacgaccacattgtttgctctataagattcgcagtacctgccagttgattccattcgttgtttctgtaaaacaagtatcggttcgtcactagaatcaatgaagtttgtatgtaaacaggtcttctatttatgtgagccatatatttcttcttccg

SEQ ID NO: 1093 - protein, 471 aa, Panicum virgatum
  misc_feature (104)..(124): Pfam Name: IQ Pfam Description: IQ calmodulin-binding motif
  misc_feature (1)..(471): Ceres Clone ID no. 1806867
  misc_feature (1)..(471): Bit score of 1152.0 for HMM based on sequences of Figure 22
  misc_feature (1)..(471): Functional Homolog Of SEQ ID NO. 1065
MGKKGKWFGAVKKVFSPESKEKKEERQRRKSAASNPTPRDLTPSTSLEVNVSVPPPPAPPALHQIEEIRAPEAEQEQSKHVTVEEAPAAPAQASVLPPGVPSEELAAIKIQTAFRGYLARRALRALRGLVRLKSLVEGDSVRRQSASTLRCMQTLSRVQSQIRSRRAKMSEENQALQRQLLLKQELENFRMGENWDDSTQSKEQIEASLISRQEAAIRRERALAYAFSHQWKSTSRSVNPMFVDPNNLQWGWSWLERWMAAKPWEGCNGADKESNIDRGSVKSMSLNLGEGEITKAFNRRDSKPEKPSPPTPKLTRPASRQSPSTPSAKVAPIPARRKSATPKNGLSHVDDDARSVFSVQSERPRRHSIATSTVQDNESLASSPSLPSYMVPTESARAKSRLQGSALTNGAETPEKGSSAGPVKKRLSFQGGTAAASPMRRHSGPPKVDSVMKDIVAPPQPEALVINGGSK

SEQ ID NO: 1094 - DNA, 1836 bp, Panicum virgatum
  misc_feature (1)..(1836): Ceres Clone ID no. 1897134
  misc_feature (1)..(1836): Encodes the peptide sequence at SEQ ID NO. 1095
atctgctgtctccaagctgtcccaagtcctctttcccctgacccctctaaaatctccccagcgacagcgagagagagagagagaggagggaggacgagcgcattcgcatcgtggcaacaggcaccaagggtgattgtttcgaggagcgtggagcggagccatggggaagaagggcaagtggttcggcgcggtcaagaaagtgttcagccctgaatccaaggagaagaaggaggagaggcagaggaggaaatcagcagctagcaaccctactccactagatctgaccccgtcgacctccttggaagtcaatgtttcggtgccaccccctccagctcctccggctcttcaccagattgaggaggtcaggatccctgaagctgagcaggagcagagcaagcacatcaccgtagaggaggcccctgctgcccctgcacaggcgtcggtgcttccacctggtgtgccaagtgaagagcttgctgcaatcaagatccagactgccttccgaggttacctggcaaggagggcactgcgagcgctgcggggccttgttcgattgaagtcattggttgagggtgattcagttaggcgtcaatctgcaagcactctgcgctgtatgcagactctatcgcgggtgcagtcacaaatacgttctaggagagcaaagatgtctgaggagaaccaggccctccagcgccagctcctactgaagcaggaactggagaatttcaggatgggtgagaactgggatgacagcactcaatccaaagagcaaatcgaggcgagcctaataagcaggcaagaggcagcgattagaagagaaagagcgcttgcatatgcattttcacatcagtggaagagcacgtcgaggtctgtcaacccaatgtttgtagacccaaacaacttgcagtgggactggagctggctggagcgctggatggctgcaaaaccttgggagggccgcaatgggactgataaggagagcaatgttgaccgtggatccgttaagagcatgagcttgaaccttggagagggtgagatcactaaagctttcaaccgccgggactcaaagccagaaaagccatccccgccaactccaaaactgacccgtccagcctccaggcaatccccttcgacgccctccgctaaagtagcgccaatacctgtgaggagaaaatccgtcacgccaaagaatgggctttcacatgtggatgacgatgtgagaagtgtgttcagtgtgcagtctgagcgaccaaggaggcacagtatagccacctcgactgtgcgggacgatgagagtctcgcaagctccccatcactcccaagttatatggttcccacagaatctgcaagggcgaagtctcgtctccagggatcagcattgaataatggtgcagagacaccagagaaaggaagctctgctggaccggtcaagaaaaggttgtcctttcaaggtggaacagcggctgcctcaccaatgcgacggcattctggtcctcccaaggtggggagtgcggtgaaggatattgttgccccaccacagccagaggccttggtgatcaatggtggaagcaagtgactcatgacaagtaccaggagggtaaagcggacaatgaatatatattttatccatgaagaaaggttaacgtgatatcagctctatgagtgatttgaattgttttccagttacgaccacattgtttgctctataagattcacagtacctgccagttgattccattcgttgtttctgtaaaacaagtaccggttcgtcactagaatcagtgatgtttgtatgtaaacaggtcttctatttatgtgagccatatatttcttctc

SEQ ID NO: 1095 - protein, 471 aa, Panicum virgatum
  misc_feature (104)..(124): Pfam Name: IQ Pfam Description: IQ calmodulin-binding motif
  misc_feature (1)..(471): Ceres Clone ID no. 1897134
  misc_feature (1)..(471): Bit score of 1165.4 for HMM based on sequences of Figure 22
  misc_feature (1)..(471): Functional Homolog Of SEQ ID NO. 1065
MGKKGKWFGAVKKVFSPESKEKKEERQRRKSAASNPTPLDLTPSTSLEVNVSVPPPPAPPALHQIEEVRIPEAEQEQSKHITVEEAPAAPAQASVLPPGVPSEELAAIKIQTAFRGYLARRALRALRGLVRLKSLVEGDSVRRQSASTLRCMQTLSRVQSQIRSRRAKMSEENQALQRQLLLKQELENFRMGENWDDSTQSKEQIEASLISRQEAAIRRERALAYAFSHQWKSTSRSVNPMFVDPNNLQWDWSWLERWMAAKPWEGRNGTDKESNVDRGSVKSMSLNLGEGEITKAFNRRDSKPEKPSPPTPKLTRPASRQSPSTPSAKVAPIPVRRKSVTPKNGLSHVDDDVRSVFSVQSERPRRHSIATSTVRDDESLASSPSLPSYMVPTESARAKSRLQGSALNNGAETPEKGSSAGPVKKRLSFQGGTAAASPMRRHSGPPKVGSAVKDIVAPPQPEALVINGGSK

SEQ ID NO: 1096 - protein, 466 aa, Vitis vinifera
  misc_feature (117)..(137): Pfam Name: IQ Pfam Description: IQ calmodulin-binding motif
  misc_feature (1)..(466): Public GI ID no. 157344055
  misc_feature (1)..(466): Bit score of 835.3 for HMM based on sequences of Figure 22
  misc_feature (1)..(466): Functional Homolog Of SEQ ID NO. 1065
MGKKGNWFSAVKKALSPEPKEKKDKTTPKSKKKWFGKHKNLDPVSSSTENAMPLPAPAPPIEDVKLTEAENEQSKHAYSVALATAVAAEAAVAAAHAAAEVVRLTTVTRFSGKSKEEVAAIKIQTAFRGYLARRALRALRGLVRLKSLIQGQSVKRQATTTLRCMQTLARVQSQIRARRIRMSEENLALQRQLQLKRDKELEKLRASMIGMIVYNLRSKLKQTYRASKRLQALAYAFSHQQTWKNSSKPANPTFMDPNNPHWGWSWLERWMAARPWESRSAMEKELNTDHASLKSTTSRAFSIGEISKAYARRDLNLDKKPSPTAQKPTGNPLQLLLPRHITGKTKPASPKGSGWGADDDSRSMLSIQSERYRRHSIAGSLVRDDESLASSPAVPSYMASTESTRARSRLPSPLGLEKNGTPEKASGSSAKKRLSFPASPAGPRRHSGPPRVETSSIKAISPAHRG

SEQ ID NO: 1097 - DNA, 2024 bp, Panicum virgatum
  misc_feature (1)..(2024): Ceres Clone ID no. 1727738
  misc_feature (1)..(2024): Encodes the peptide sequence at SEQ ID NO. 1098
gttctctctccctcgtcactctcgccactgctcccagctgttgcgacctccgatcatccaaggctcctgcacccctgtcagtcctagctccagccaaaaatcgttggcttccgctgcctgctcctccgccttgcacctcccatgaccttccacgcgacatgattgcattgcaggcccctgcggagctcagtgtcctcccacgccgctgacgccttcttgttgcctccccgctgctgcgcacaaccgaaagggccttcctctcttcctttgcttccgcggaaagatttggcgatttgttcatctactaaagttgcatctctcttggtgattgtttcgaggagtgtggagtggagccatggggaagaagggcaagtggttcggcgcggtcaagaaagtgttcagccctgaatccaaggagaagaaggaggagaggcagaggaggaaatcagcagctagcaaccctactccacgagatctgaccccgtcgacctccttggaagtcaatgtttcggtgccaccccctccagctcctccggcccttcaccagattgaggaaatcagggcccctgaagctgagcaggagcagagcaagcacgtcaccgtagaggaggctcctgctgcccctgcacaggcgtcggtgctgccacctggtgtgccaagtgaagagcttgctgcaatcaagattcagactgccttccgaggttacctggcaaggagggcactgcgagcgctgcggggccttgttcgattgaaatcattggttgagggtgattcagttaggcgtcaatctgcaagcactcttcgctgtatgcagactctatcgcgggtgcagtcacaaatacgttctaggagagcaaagatgtctgaggagaaccaggcccttcagcgccagctcctactgaagcaggaactggagaatttcaggatgggtgagaactgggatgacagcactcaatccaaagagcaaatcgaggcaagcctaataagcaggcaagaggcagcgattagaagagaaagagcgcttgcatatgcattttcacatcagtggaagagcacttcgagatctgtcaacccaatgtttgtagacccaaacaacttgcagtggggctggagctggttggagcgctggatggctgcaaaaccttgggagggctgcaatggggctgataaggagagcaacattgaccgtggatctgttaagagcatgagcttgaaccttggagagggtgagatcacaaaagctttcaaccgccgggactcaaagccagaaaagccatcaccgccaactccaaaactaacccgtccagcctccaggcaatccccttcgacgccctctgctaaagtagcgccaatacctgctaggagaaaatccgccacgccagagaatgggctttcacatgtggatgacgatgcgagaagtgtgttcagcgtgcagtctgagcgaccaaggaggcacagtatagccacctcgactgtgcaggacaatgagagtctcgcaagctccccatcactcccaagttacatggttcccacagaatctgcaagggcgaagtctcgtctccagggatcagcattgactaatggtgcagagacaccagagaaaggaagctctgctggaccggtcaagaaaaggttgtcatttcaaggtggaacagcggctgcctcaccaatgcgacggcattctggtcctcccaaggtggacagtgcggtgaaggatattgttgccccaccacagccagaggccttggtgatcaatggtggaagcaagtgactcataccaggaggggaaagcggattatgaatatatattttatcgatgaagaaaggttaacgtgatatcagctcaatgagtgatttgaattgttttcttacgaccacattgtttgctctataagattcgcagtacctgccagttgattccattcgttgtttctgtaaaacaagtatcggttcgtcactagaatcaatgaagtttgtatgtaaacaggtcttctatttatgtgagccatatatttcttcttctg

SEQ ID NO: 1098 - protein, 471 aa, Panicum virgatum
  misc_feature (104)..(124): Pfam Name: IQ Pfam Description: IQ calmodulin-binding motif
  misc_feature (1)..(471): Ceres Clone ID no. 1727738
  misc_feature (1)..(471): Bit score of 1151.6 for HMM based on sequences of Figure 22
  misc_feature (1)..(471): Functional Homolog Of SEQ ID NO. 1065
MGKKGKWFGAVKKVFSPESKEKKEERQRRKSAASNPTPRDLTPSTSLEVNVSVPPPPAPPALHQIEEIRAPEAEQEQSKHVTVEEAPAAPAQASVLPPGVPSEELAAIKIQTAFRGYLARRALRALRGLVRLKSLVEGDSVRRQSASTLRCMQTLSRVQSQIRSRRAKMSEENQALQRQLLLKQELENFRMGENWDDSTQSKEQIEASLISRQEAAIRRERALAYAFSHQWKSTSRSVNPMFVDPNNLQWGWSWLERWMAAKPWEGCNGADKESNIDRGSVKSMSLNLGEGEITKAFNRRDSKPEKPSPPTPKLTRPASRQSPSTPSAKVAPIPARRKSATPENGLSHVDDDARSVFSVQSERPRRHSIATSTVQDNESLASSPSLPSYMVPTESARAKSRLQGSALTNGAETPEKGSSAGPVKKRLSFQGGTAAASPMRRHSGPPKVDSAVKDIVAPPQPEALVINGGSK

SEQ ID NO: 1099 - DNA, 1876 bp, Gossypium hirsutum
  misc_feature (1)..(1876): Ceres Clone ID no. 1919901
  misc_feature (1)..(1876): Encodes the peptide sequence at SEQ ID NO. 1100
aacttttcttagttatcctctgcaaatgccaacctgttcttttattattattttccgccatttttgctctctttcaagcattttttttttgcctagatccacttctctctctttgatttttaattactgcatttttgttttaatacacaataagaacaactaagagatagaatgtgacttatcaatcttttaactgagatctgtgagaatttttctatgtaccaaggaattatttacagatgggaaaaaaaggtggctggctttctattgtgaagaaagctttgagccctgaatccaagaaatctcagcaccaaactccaaagccaaagaaaaaatggttcggaaaaagcaaaaatttgagccctgtgtctgtgcctgaagaaactgaagtgataactgaagatgcaaagctaaaagaagctgaaaacgaacaaagcaaacatgcctactctgtggctcttgccaccgctgtggcggccgaggcagcggtggcagctgctcaggcggctgctgaagttgtccgtctcacttctcagccgcgccatctggggaagtcaaaggaggaaatagctgctatcaggattcaaacagcatttcgtggatatttggctaggagggcactgcgagctttgagagggttggtaaggttgaaatcgttgatcagagggcaatccgtcaaacgccaagcaactacaacgttaagatgcatgcagactctagctcgtctgcagtctgagatttctgcaaggaggattagaatgtcagaagagaaccaggctcttcagcgccagcttcaacagaaatgccagaaagagctcgagaagttgagagctcccatgagagaagactggaacgatagtacacagtcgaaggagcagatcgaagcaagacaacaaaataagcaaggagctactatgaaaagggaaagagcattggcttatgcatactgtcaccagcgatcgtggaagaactgttctagatcagtgaatcaaacatttatggatccgagtaattcacactggggttggagttggttagagcgatggatggcagcccgaccatgggaagtccaaagcacaactgataacaatgaccgtggctcagtcaagagtatgggtgcttgttcgatatctataagtgaaatcagcagagcttattctcgaagagatcttaacaatgataacaaaccatctccaacacctcagaagtcaagtcgagttcctagccgccagtctccatcgactccaccttcaaaggcaccttcgatttcatcggtttctggtaaaacaagactgccaagtccgagaggaagtcaatggggagggtatgaagactcaaggagcatactcagtacccggtctgatcgttataggagacatagcattgcagggtcctcaatgagagacgatgagagccttacaagctcacctgcagttccaagttatatggcaccaacacagtccacaaaggccaggtcccacataccaagccccttaggaagtggcacaccagataggagagtggcagggtctgcaaagaaacggcttttgttcccagcatccccagccagtagtaggagacattcagagcctcctaaagtggacataagtgaggctagaaagaatcagcatgcaccaagcaatggaaggcaagtggcttggtgaagagtgcaacaaaagttagattgaataaacatggaagggttatttcaacttgaagttcttgtagtgtggttgtgattatctttttcttcctaggttttatgattattaattataaaagggttacttttttctgggtgagatttagtttattgtttgtggttgacaaacattcttaaaaatcttcaagtttagtttcaattcatgaaatttgt

SEQ ID NO: 1100 - protein, 474 aa, Gossypium hirsutum
  misc_feature (109)..(129): Pfam Name: IQ Pfam Description: IQ calmodulin-binding motif
  misc_feature (1)..(474): Ceres Clone ID no. 1919901
  misc_feature (1)..(474): Bit score of 775.7 for HMM based on sequences of Figure 22
  misc_feature (1)..(474): Functional Homolog Of SEQ ID NO. 1065
MGKKGGWLSIVKKALSPESKKSQHQTPKPKKKWFGKSKNLSPVSVPEETEVITEDAKLKEAENEQSKHAYSVALATAVAAEAAVAAAQAAAEVVRLTSQPRHLGKSKEEIAAIRIQTAFRGYLARRALRALRGLVRLKSLIRGQSVKRQATTTLRCMQTLARLQSEISARRIRMSEENQALQRQLQQKCQKELEKLRAPMREDWNDSTQSKEQIEARQQNKQGATMKRERALAYAYCHQRSWKNCSRSVNQTFMDPSNSHWGWSWLERWMAARPWEVQSTTDNNDRGSVKSMGACSISISEISRAYSRRDLNNDNKPSPTPQKSSRVPSRQSPSTPPSKAPSISSVSGKTRLPSPRGSQWGGYEDSRSILSTRSDRYRRHSIAGSSMRDDESLTSSPAVPSYMAPTQSTKARSHIPSPLGSGTPDRRVAGSAKKRLLFPASPASSRRHSEPPKVDISEARKNQHAPSNGRQVAW

SEQ ID NO: 1101 - protein, 430 aa, Arabidopsis thaliana
  misc_feature (108)..(128): Pfam Name: IQ Pfam Description: IQ calmodulin-binding motif
  misc_feature (1)..(430): Public GI ID no. 15231175
  misc_feature (1)..(430): Bit score of 534.9 for HMM based on sequences of Figure 22
  misc_feature (1)..(430): Functional Homolog Of SEQ ID NO. 1065
MGKSWFSAVKKALSPEPKQKKEQKPHKSKKWFGKSKKLDVTNSGAAYSPRTVKDAKLKEIEEQQSRHAYSVAIATAAAAEAAVAAAQAAAEVVRLSALSRFPGKSMEEIAAIKIQTAFRGYMARRALRALRGLVRLKSLVQGKCVRRQATSTLQSMQTLARVQYQIRERRLRLSEDKQALTRQLQQKHNKDFDKTGENWNDSTLSREKVEANMLNKQVATMRREKALAYAFSHQNTWKNSTKMGSQTFMDPNNPHWGWSWLERWMAARPNENHSLTPDNAEKDSSARSVASRAMSEMIPRGKNLSPRGKTPNSRRGSSPRVRQVPSEDSNSIVSFQSEQPCNRRHSTCGSIPSTRDDESFTSSFSQSVPGYMAPTQAAKARARFSNLSPLSSEKTAKKRLSFSGSPKTVRRFSGPPKLESNVTKKDTNLA

SEQ ID NO: 1102 - DNA, 1812 bp, Panicum virgatum
  misc_feature (1)..(1812): Ceres Clone ID no. 1747444
  misc_feature (1)..(1812): Encodes the peptide sequence at SEQ ID NO. 1103
agaggtccgtgcggtgggcggtggcttaccagagttaggtccttggcgccttcagtcgggtgaggaaggcttgcagccgagacattgaagacacagtaatagaacacaaaagaatgggtaagaagggaaagtggtttagtgctgtgaagaaagtcttcggctcctccgatcctgatggaaagcaagcaaaggctgagaaggcggacaagtcaaaatccagtaggagatggccatttggaaagtcgaggcactctgatccttctgcctcaacggtgtcagggactgctccagtagctcctttgccgccgccgccaccaatacaacttactcagccacactctcaggagattaaagatgtcaagccagttgaaacagacagtgagcagaacaagcatgcatactctgttgcccttgcatctgctgttgctgctgaagctgcagcagttgctgcccaggccgctgctgaggttgtccgcctcacagcagttactacggcagcaccaaaaatgcctgttacttcaagggaagaacttgcggccatcaagattcagaccgccttcagaggttatctggcaaggagagcattgcgcgcactaagagggctagttagattgaagtcacttgttgatggacatgccgtcaagcgccaaactgctcatactttgcattgcacacaaacgatgacaagagttcaagctcaaatctactctagaagggtgaaattggaggaggaaaaacaggctcttcaaaggcagctccaattgaaacatcaaagggaacttaagaaaatgaagattgatgaagactgggatcacagccatcaatccaaagaacaaattgaggccagcctagttatgaaacaagaagctgcgctaagacgagaaagagcactcgcatatgctttttctcatcagtggagaaattctggtcgaactataaccccaactttcacagaacctggtaatcctaactggggctggagctggatggaacgctggatgacagcaagaccttgggagagccgattggcagcatcagacaaggatcctaaagagcgttctctgacaaagaattccagcaccagtgctgttcgaatgtctgtaccccgtgccatctcaatccagaggccagcaacaccaaacaagtcaagccgtccaccaagccggcaatcaccttcaacaccgccatcgaaggcaccatctacctcaggaaagaccaggccggcaagtccaaggagcagctggctgtacaaggaagatgacctgaggagcatcacaagcatacgctctgaacgcccaaggaggcaaagcataggtggaggctcggtccgggatgatgcaagcctgactagcacaccacctctccccagttatatgcagtcgacagagtctgcgagagcaaagtctcgataccgcagcttattgactgagaaacttgagctttcagagagggcacctctggcccattcagttgttaagaagcgcctctccttcccagtcattgacaaaccgagcggtccaccggcagataagccaaaggaaagggtgagacgccattcagaccctccgaaagtcgatccggcaacactgaaggatgctcctgttgcctgatcaggcccttgtgattgttaggtttcatgctgttttaactccatgatgaaatttctaagattgttttctctgtgtaatgtatgatctgtccgggttgatttgagaattgagacaattctaactgtgtttgcagacatggttttctccctgtagattgacacgtgtgatgctaacagtgtgtgctgttggctttcaatgtacc

SEQ ID NO: 1103 - protein, 498 aa, Panicum virgatum
  misc_feature (139)..(159): Pfam Name: IQ Pfam Description: IQ calmodulin-binding motif
  misc_feature (1)..(498): Ceres Clone ID no. 1747444
  misc_feature (1)..(498): Bit score of 592.2 for HMM based on sequences of Figure 22
  misc_feature (1)..(498): Functional Homolog Of SEQ ID NO. 1065
MGKKGKWFSAVKKVFGSSDPDGKQAKAEKADKSKSSRRWPFGKSRHSDPSASTVSGTAPVAPLPPPPPIQLTQPHSQEIKDVKPVETDSEQNKHAYSVALASAVAAEAAAVAAQAAAEVVRLTAVTTAAPKMPVTSREELAAIKIQTAFRGYLARRALRALRGLVRLKSLVDGHAVKRQTAHTLHCTQTMTRVQAQIYSRRVKLEEEKQALQRQLQLKHQRELKKMKIDEDWDHSHQSKEQIEASLVMKQEAALRRERALAYAFSHQWRNSGRTITPTFTEPGNPNWGWSWMERWMTARPWESRLAASDKDPKERSLTKNSSTSAVRMSVPRAISIQRPATPNKSSRPPSRQSPSTPPSKAPSTSGKTRPASPRSSWLYKEDDLRSITSIRSERPRRQSIGGGSVRDDASLTSTPPLPSYMQSTESARAKSRYRSLLTEKLELSERAPLAHSVVKKRLSFPVIDKPSGPPADKPKERVRRHSDPPKVDPATLKDAPVA

SEQ ID NO: 1104 - DNA, 2185 bp, Panicum virgatum
  misc_feature (1)..(2185): Ceres Clone ID no. 2034697
  misc_feature (1)..(2185): Encodes the peptide sequence at SEQ ID NO. 1105
gggctcagggctttcggtggctgcctgcttgcttgcttgcttgctttagaggtggaagcttgcccttctcgcggtaaaatcggatcttttggggttttgcgcgccgctatttgattcttcttggctggcttcgcctgtggctttgttttgggggtttgctgggttggtttcttcgcgattgtggacgagggggtgcggtgggcagctgcgagagtttctctgggtctggggcaaatacactcttccggtctccctgtcgtttgcgattcgaccttctggtgagtttttgcgccagctaaacgatcgatggagttcaaatgtcgaagggtaggaagcgccacacgaagcttgcttgttgtgcaaaacaggcgcctttcttttgcttgcagccgagacattgaagacacagtaatagaacacaaaagaatgggtaagaagggaaagtggtttagtgctgtgaagaaagtcttcggctcctccgatccagatggaaagcaagcaaaggctgagaaggcggacaagtcaaaatccaggaggagatggccatttggaaagtcgaggcactctgatccttctgcctcaacggtgtcagggactgctccagtagctcctttgccgccgccgccaccaatacaacttactcagccacactctcaggagattaaagatgtcaagccagttgaaacagacagtgagcagaacaagcatgcatactctgttgcccttgcatctgctgttgctgctgaagctgcagcagttgctgcccaggccgctgctgaggttgtccgcctcacagcagttactacggcagcaccaaaaatgcctgttacttcaagggaagaacttgcggccatcaagattcagaccgccttcagaggttatctggcaaggagagcattgcgcgcactaagagggctagttagattgaagtcacttgttgatggacatgccgtcaagcgccaaactgctcatactttgcattgcacacaaacgatgacaagagttcaagctcaaatctactctagaagggtgaaattggaggaggaaaaacaggctcttcaaaggcagctccaattgaaacatcaaagggaacttgagaaaatgaagattgatgaagactgggatcacagccatcaatccaaagaacaaattgaggccagcctagttatgaaacaagaagctgcgctaagacgagaaagagcactcgcatatgcgttttctcatcagtggagaaattctggtcgaactataaccccaactttcacagaacctggtaatcctaactggggctggagctggatggaacgctggatgacagcaagaccttgggagagccgattggcagcatcagacaaggatcctaaagagcgttctctgacaaagaattccagcaccagtgctgttcgaatgtctgtaccccgtgccatctcaatccagaggccagcaacaccaaacaagtcaagccggccaccaagccggcaatcaccttcaacaccgccatcgaaggcaccatctacctcaggaaagaccaggccggcaagtccaaggagcagctggctgtacaaggaagatgacctgaggagcatcacaagcatacgctctgaacgcccaaggaggcagagcataggtggaggctcggtccgggatgatgcaagcctgactagcacaccacctctccccagttatatgcagtcgacagagtctgcgagagcaaagtctcgataccgcagcttattgactgagaaacttgagctttcagagagggcacctctggcccattcagttgttaataagcgcctctccttcccagtcattgacaaaccgagccgtccaccggcagataagccaaaggaaagggtgagacgccattcagaccctccgaaagtcgatccggcaacactgaaggatgctcctgttgcctgatcaggcccttgtgattgttaggtttcatgctgttttaactccatgatgaaatttctaagattgttttctctgtgtaatgtatgatctgtccgggttgatttgagaattgagacaattctaactgtgtttgcagacatggttttctccctgtagattgacacgtgtgatgctaacagtgtgtgctgttggctttcaatgtaccatataacggtttttgacagactttcttaacgtgtgaaaactgcaatatttagccattccg

SEQ ID NO: 1105 - protein, 498 aa, Panicum virgatum
  misc_feature (139)..(159): Pfam Name: IQ Pfam Description: IQ calmodulin-binding motif
  misc_feature (1)..(498): Ceres Clone ID no. 2034697
  misc_feature (1)..(498): Bit score of 587.6 for HMM based on sequences of Figure 22
  misc_feature (1)..(498): Functional Homolog Of SEQ ID NO. 1065
MGKKGKWFSAVKKVFGSSDPDGKQAKAEKADKSKSRRRWPFGKSRHSDPSASTVSGTAPVAPLPPPPPIQLTQPHSQEIKDVKPVETDSEQNKHAYSVALASAVAAEAAAVAAQAAAEVVRLTAVTTAAPKMPVTSREELAAIKIQTAFRGYLARRALRALRGLVRLKSLVDGHAVKRQTAHTLHCTQTMTRVQAQIYSRRVKLEEEKQALQRQLQLKHQRELEKMKIDEDWDHSHQSKEQIEASLVMKQEAALRRERALAYAFSHQWRNSGRTITPTFTEPGNPNWGWSWMERWMTARPWESRLAASDKDPKERSLTKNSSTSAVRMSVPRAISIQRPATPNKSSRPPSRQSPSTPPSKAPSTSGKTRPASPRSSWLYKEDDLRSITSIRSERPRRQSIGGGSVRDDASLTSTPPLPSYMQSTESARAKSRYRSLLTEKLELSERAPLAHSVVNKRLSFPVIDKPSRPPADKPKERVRRHSDPPKVDPATLKDAPVA

SEQ ID NO: 1106 - protein, 498 aa, Zea mays
  misc_feature (137)..(157): Pfam Name: IQ Pfam Description: IQ calmodulin-binding motif
  misc_feature (1)..(498): Public GI ID no. 194702278
  misc_feature (1)..(498): Bit score of 582.1 for HMM based on sequences of Figure 22
  misc_feature (1)..(498): Functional Homolog Of SEQ ID NO. 1065
MGKRGKWFSAVKKVFSSSDPDGKEAKAQKADKSKSKRRWPFGKSKHSEPSISTVPGTAPAVAPLPSPPATQPHSLEIKDVNPVETDSEQNKHAYSVALASAVAAEAAAVAAQAAAEVVRLTAVTTAAPKMPVSSREELAATKIQTAFRGYLARRALRALRGLVRLKSLVDGNAVKRQTAHTLQCTQAMTRVQTQIYSRRVKLEEEKQALQRQLQLKHQRELEKMKIDEDWDHSHQSKEQIEANLMMKQEAALRRERALAYAFSHQWRNSGRTITPTFTEPGNPNWGWSWMERWMTARPWESRLAAASDKDPKERAVTKNASTSAVRVPVSRAISIQRPATPNKSSRPPSRQSLSTPPSKTPSASGKARPASPRNSWLYKEDDLRSITSIRSERPRRQSTGGGSVRDDTSLTSTPPLPSYMQSTESARAKSRYRSLLLTEKLEVPERAPLAHSVVKKRLSFPVVEKPSVVPTEKPRERVRRHSDPPKVDPATLKDAPAA

SEQ ID NO: 1107 - DNA, 1497 bp, Sorghum bicolor
  misc_feature (1)..(1497): Ceres Annot ID no. 8669409
  misc_feature (1)..(1497): Encodes the peptide sequence at SEQ ID NO. 1108
atgggtaagaaaggaaagtggtttagtgcggtgaagaaagtcttcagctcctctggtacagatggaaaggaagcaaaggctgagaaagcagacaagtcaaaatccaagaggagatggccattcggaaaaacgaagaagcactccgagccttcgatctcaacggtggcagggactgctccggtagctccgttgccatcaccaccaccaactcagccccactctctggagattaaagatgtcaatccacttgaaacagacagtgagcagaacaagcatgcctactctgttgcgcttgcatctgctgtcgctgctgaagctgcagcggttgctgcccaggctgctgcggaggttgtccgcctcacagcagttaccacggctgcaccaaaaatgcctgttagttcaatggaagaacttgctgccaccaagattcagactgccttcaggggttatctggcaaggagagcattgcgggcactaagagggctagttagattgaagtcgcttgttgatggaaatgctgtcaaacgccaaaccgctcacaccttgcaatgcacacaaacaatgacaagagttcaaactcaaatctattctagaagggtgaagttggaggaggagaaacaggctcttcaaaggcagctccaattgaaacatcaaagagaacttgagaaaatgaagattgatgaagactgggatcacagccatcaatccaaagagcaaattgaggccaaccttatgatgaaacaggaagctgcaatgagacgagaaagagcccttgcatatgcattttctcaccagtggaggacttctggtcgaactataacccctacttttacggaacctgggaaccctaactggggctggagctggatggaacgctggatgaccgctagaccttgggagagccgattggtggcatcagacaaggatcctaaagaacgtgctctgacaaagaatccaagcaccattactgttcaagccgcatctgtaccccgtgccatctcaatccagagaccagctacaccaaacaagtcaagccggccaccaagccggcagtcaccttcaactccaccatcgaaggccccatcaacctcaggaaagaccaggccagcaagtccaaggggcaattggctgtacaaggaggatgacctgaggagcatcacaagcatccgctctgagcgcccaaggaggcagagcacaggtggaggaggctcagtccgggatgatgcaagcctgacgagcacaccacctctccccagttacatgcaatcgacagagtctgcaagggcgaagtctcgataccgcagtctactgactgagaagcttgaggttcctgagagagcacctttggtccactctgttgttaagaagcgcctgtcgttccctgtcgtcgataagccaagtgttgtgccgacagataagccaaaggaaagagtgagacgccattcagatcctccgaaggtcgatcctgcaacactgaaggatgtccctgctgcttga

SEQ ID NO: 1108 - protein, 498 aa, Sorghum bicolor
  misc_feature (137)..(157): Pfam Name: IQ Pfam Description: IQ calmodulin-binding motif
  misc_feature (1)..(498): Ceres Annot ID no. 8669409
  misc_feature (1)..(498): Bit score of 579.3 for HMM based on sequences of Figure 22
  misc_feature (1)..(498): Functional Homolog Of SEQ ID NO. 1065
MGKKGKWFSAVKKVFSSSGTDGKEAKAEKADKSKSKRRWPFGKTKKHSEPSISTVAGTAPVAPLPSPPPTQPHSLEIKDVNPLETDSEQNKHAYSVALASAVAAEAAAVAAQAAAEVVRLTAVTTAAPKMPVSSMEELAATKIQTAFRGYLARRALRALRGLVRLKSLVDGNAVKRQTAHTLQCTQTMTRVQTQIYSRRVKLEEEKQALQRQLQLKHQRELEKMKIDEDWDHSHQSKEQIEANLMMKQEAAMRRERALAYAFSHQWRTSGRTITPTFTEPGNPNWGWSWMERWMTARPWESRLVASDKDPKERALTKNPSTITVQAASVPRAISIQRPATPNKSSRPPSRQSPSTPPSKAPSTSGKTRPASPRGNWLYKEDDLRSITSIRSERPRRQSTGGGGSVRDDASLTSTPPLPSYMQSTESARAKSRYRSLLTEKLEVPERAPLVHSVVKKRLSFPVVDKPSVVPTDKPKERVRRHSDPPKVDPATLKDVPAA

SEQ ID NO: 1109 - DNA, 1503 bp, Oryza sativa
  misc_feature (1)..(1503): Ceres Annot ID no. 1161946
  misc_feature (1)..(1503): Encodes the peptide sequence at SEQ ID NO. 1110
atgggtaagaaaggaaattggttcagtgctgtcaagaaagtcttcagctcatccgatccagatgggagggaagctaagatcgagaaggcggacaagtcgagatccaggaggaaatggccatttggaaagtctaagaagtctgatccttggacctcaacagtggcagtgcctacctctacagcaccgcctccacagccgccaccgccaccgccaacacaccctatccagccacagcctgaggagatcaaagatgtcaaggctgttgaaactgacagtgaacagaacaagcatgcgtactctgttgcacttgcctctgctgttgctgcagaagctgctgccgtcgctgcccaggccgctgctgaggtggtccgcctcacaacagccaccacggctgtgccgaaatcgcctgttagttcaaaggatgagcttgccgctatcaagattcagactgccttcaggggttatctggcaagaagagcgctgcgagcacttagagggctagttagattgaagtcgctggttgatggaaacgccgtcaaacgacaaactgcgcacaccttgcattgcacacaaaccatgaccagagttcaaactcaaatatactctagaagggtgaagatggaggaggaaaaacaggctcttcaaaggcagctacaattaaagcatcagagggaacttgagaaaatgaagattgatgaagattgggatcatagccatcagtccaaggagcaggttgagaccagcctaatgatgaaacaagaagctgcgctaaggcgggaaagagctcttgcctatgcattttctcaccagtggaagaattctggccgaactataacacctaccttcacggatcaagggaatcctaactggggatggagctggatggaacgctggatgacatcaaggccttgggagagccgagtgatatcagataaggatcctaaggaccattattcaacaaagaatcccagcactagcgcttctcgtacttatgtaccccgcgcaatctcaatccagagacctgcaacaccaaacaagtcaagccgtccaccaagtcggcaatcgccatcaactcccccgtcaagggtcccctcagttaccggaaagatcagaccagcaagtccacgggatagctggctatataaggaggatgacttgaggagcatcacaagcatacgctctgaacgcccaaggaggcagagcacaggtggtgcctctgttcgggatgatgcgagcctaacaagcacaccagctctccccagctacatgcagtccacagagtctgcaagggcgaagtctcggtaccgcagtctattgactgacaggtttgaggttcctgagagagtacccctggtccattcttcaataaagaagcgcttatccttcccagtcgcagacaaaccaaatggtgagcatgcagataagctgatggaaagagggaggcgtcattcagaccctcctaaggtggatcctgcctcactgaaggatgttccggtttcataa

SEQ ID NO: 1110 - protein, 500 aa, Oryza sativa
  misc_feature (142)..(162): Pfam Name: IQ Pfam Description: IQ calmodulin-binding motif
  misc_feature (1)..(500): Ceres Annot ID no. 1161946
  misc_feature (1)..(500): Bit score of 620.7 for HMM based on sequences of Figure 22
  misc_feature (1)..(500): Functional Homolog Of SEQ ID NO. 1065
MGKKGNWFSAVKKVFSSSDPDGREAKIEKADKSRSRRKWPFGKSKKSDPWTSTVAVPTSTAPPPQPPPPPPTHPIQPQPEEIKDVKAVETDSEQNKHAYSVALASAVAAEAAAVAAQAAAEVVRLTTATTAVPKSPVSSKDELAAIKIQTAFRGYLARRALRALRGLVRLKSLVDGNAVKRQTAHTLHCTQTMTRVQTQIYSRRVKMEEEKQALQRQLQLKHQRELEKMKIDEDWDHSHQSKEQVETSLMMKQEAALRRERALAYAFSHQWKNSGRTITPTFTDQGNPNWGWSWMERWMTSRPWESRVISDKDPKDHYSTKNPSTSASRTYVPRAISIQRPATPNKSSRPPSRQSPSTPPSRVPSVTGKIRPASPRDSWLYKEDDLRSITSIRSERPRRQSTGGASVRDDASLTSTPALPSYMQSTESARAKSRYRSLLTDRFEVPERVPLVHSSIKKRLSFPVADKPNGEHADKLMERGRRHSDPPKVDPASLKDVPVS

SEQ ID NO: 1111 - DNA, 1222 bp, Zea mays
  misc_feature (1)..(1222): Ceres Clone ID no. 466497
  misc_feature (1)..(1222): Encodes the peptide sequence at SEQ ID NO. 1112
aggctagcccagcgctcggccctcggctccttaaggcttcatcttctcaagttccggccgtccatcgccgccgccggcctcggccggctcagttcctgcctgccagccaaaaattccacaccacccacccagagactgaggcgcgcggtggtgaagacgtgatcgaaagtcgaaaccaaaacgatatatagatggggcgcgggcgcggcaaggtggaggtgcgtcgcatcgagaacagcgtgagccggcaggtgaccttctcgaagcggcggcgcgggctggcgaagaaggcgcgggagctggccgtgctctgcgacgccgacgtcgcgctgctcgtcttctccgacaagggcagtctccacgacttcgccgcgcacggcagcatggagcgaatccttggccgatacgagaggtacttgctatgtgaagatagggacgatgtaacccaagactaccctgaagaatcgcaggggaacatgagctatgaccacatcaagttgaggtccaaactcgaagctataaagaagagccaaaggaatctcatgggggagcagctcgagtccctgacgttcagagaggtacagcagcttgagcaccggatagacagcgctctgaggaacgtcagatccaggaaggaccacatcttgctcaactcgatccaggagctccggaacaaggaaacttttctgatggaacaaaatggcattctagagaaggagaaggctgcagtgggggcatcatcatccctgcacaccaccaccagcaccgcagcagcttcttccacggcagcggcggcggcggcccttccaaacctgaacatctgtcccgacgactccgacgagccaggaatggcggcggcggcggggatcaggttgccgtggtggatgctccagccatctgccgtcagccaacggcaggaacagcactgaactgcttgtcttctcagatgatccacgctgcttgttccagctcgattctagtttctattagaactcgattcagctaaggcgggaatttgtgatctttctattgatctgccgttcttattggttgctagatcgattttatccttgtccttcttagtatctgaacctctgctgtgtcgtttgtcgtagttcttggtcgcaaaagctccggtttgcgtctctagtttggtttggttcctgtaaaatctgctgttgtccttcaatgagctgtgcaggccagttagatgattacttcc

SEQ ID NO: 1112 - protein, 245 aa, Zea mays
  misc_feature (11)..(61): Pfam Name: SRF-TF Pfam Description: SRF-type transcription factor (DNA-binding
  misc_feature (79)..(179): Pfam Name: K-box Pfam Description: K-box region
  misc_feature (1)..(245): Ceres Clone ID no. 466497
  misc_feature (1)..(245): Bit score of 600.1 for HMM based on sequences of Figure 14
  misc_feature (1)..(245): in Figure 14
MGRGRGKVEVRRIENSVSRQVTFSKRRRGLAKKARELAVLCDADVALLVFSDKGSLHDFAAHGSMERILGRYERYLLCEDRDDVTQDYPEESQGNMSYDHIKLRSKLEAIKKSQRNLMGEQLESLTFREVQQLEHRIDSALRNVRSRKDHILLNSIQELRNKETFLMEQNGILEKEKAAVGASSSLHTTTSTAAASSTAAAAAALPNLNICPDDSDEPGMAAAAGIRLPWWMLQPSAVSQRQEQH

SEQ ID NO: 1113 - DNA, 630 bp, Sorghum bicolor
  misc_feature (1)..(630): Ceres Annot ID no. 8721881
  misc_feature (1)..(630): Encodes the peptide sequence at SEQ ID NO. 1114
atgggtcgcggtcgcggcaaggtggaggtgcgtcggatcgacaacagcgtgagccggcaggtgactttctcgaagcggcggcgcgggctggccaagaaggcgcgggagctggccgtgctctgcgacgccgacgtcgcgctgctcatcttctccgacaagggcacgctccaccacttcgccgcgtacgccaggtacgggaacatgagctatgaccacgtcaagatgaggtccaaacttgaagctctacagaagagccaaaggaatctcatgggggagcaacttgagtccctgacattcagagaggtacagcagcttgagcaccagatagacagcgctctgaggaacatcagatcgaggaaggaaacatttctgatggaacaaaatagcattctagagaaggagaaggctgcactgggggcatcatccctgcacaccaccaacaccgcagattcctctacagcagtagcaacagctgcccttccaaacctcaacatctgtcccggcgacgactccgatgagccaggaagggcggcggcgccaccgccaccgggagcggcgatcagcttgccgtggtggatgctccagccaccacctgccgtcagccaacggcaagagcaggagcagcactga

SEQ ID NO: 1114 - protein, 209 aa, Sorghum bicolor
  misc_feature (11)..(61): Pfam Name: SRF-TF Pfam Description: SRF-type transcription factor (DNA-binding
  misc_feature (51)..(153): Pfam Name: K-box Pfam Description: K-box region
  misc_feature (1)..(209): Ceres Annot ID no. 8721881
  misc_feature (1)..(209): Bit score of 485.2 for HMM based on sequences of Figure 14
  misc_feature (1)..(209): Functional Homolog Of SEQ ID NO. 1112
  misc_feature (1)..(209): in Figure 14
MGRGRGKVEVRRIDNSVSRQVTFSKRRRGLAKKARELAVLCDADVALLIFSDKGTLHHFAAYARYGNMSYDHVKMRSKLEALQKSQRNLMGEQLESLTFREVQQLEHQIDSALRNIRSRKETFLMEQNSILEKEKAALGASSLHTTNTADSSTAVATAALPNLNICPGDDSDEPGRAAAPPPPGAAISLPWWMLQPPPAVSQRQEQEQH

SEQ ID NO: 1115 - protein, 233 aa, Oryza sativa subsp. japonica
  misc_feature (9)..(59): Pfam Name: SRF-TF Pfam Description: SRF-type transcription factor (DNA-binding
  misc_feature (78)..(180): Pfam Name: K-box Pfam Description: K-box region
  misc_feature (1)..(233): Public GI ID no. 115488672
  misc_feature (1)..(233): Bit score of 559.5 for HMM based on sequences of Figure 14
  misc_feature (1)..(233): Functional Homolog Of SEQ ID NO. 1112
  misc_feature (1)..(233): in Figure 14
MGRGKVQVRRIENEVSRQVTFSKRRPGLLKKAHEIAVLCDVDVAAIVFSAKGNLFHYASSHTTMERILEKYDRHELLSEGNNVIEEFPELEGSMSYDHIKLRGRIEALKKSQRNLMGQELDSLTLQDIQQLENQIDTSLNNIRSRKEKLLMEKNTILEKKITELETLHTCIRASPTKAAAPPACNTADAFVPNLNICCGDSGEPETVTAPLGWTSSNNGLPWWMLQSSSNGKS

SEQ ID NO: 1116 - protein, 236 aa, Pisum sativum
  misc_feature (75)..(174): Pfam Name: K-box Pfam Description: K-box region
  misc_feature (9)..(59): Pfam Name: SRF-TF Pfam Description: SRF-type transcription factor (DNA-binding
  misc_feature (1)..(236): Public GI ID no. 62132631
  misc_feature (1)..(236): Bit score of 615.2 for HMM based on sequences of Figure 14
  misc_feature (1)..(236): Functional Homolog Of SEQ ID NO. 1112
  misc_feature (1)..(236): in Figure 14
MGRGRVQLKRIENKINRQVTFSKRRCGLLKKAHEISVLCDAEVALIVFSNKGKLYEYSSDPCMERILERYERYSYAERQHVPNDQPQNENWIIEHAKLKARLEVIQKNQRNFMGEELDGLSMKELQNLEHQLDSALKQIRSRKNQVVYESISELQKKDKALQEKNNLLTKKIKEKEKALANFELHNDDMDLDSALVPQPLETPNIGCSPQDRGDNEGSQTQSNALLPPWMLRPIND

SEQ ID NO: 1117 - DNA, 1321 bp, Panicum virgatum
  misc_feature (1)..(1321): Ceres Clone ID no. 1820645
  misc_feature (1)..(1321): Encodes the peptide sequence at SEQ ID NO. 1118
acctcttcgttccctgcgcaccactcgagtcgagagccacctgatccttcgttccccgtcttcctctctcccggcacgttgctccttcgttaacgctcgagagcgggaggggttaggtgggcaagcggcggggatggggcgcgggccggtgcagctgcggcggatcgagaacaagattaaccgccaggtgaccttctccaagcgccggaacgggctgctgaagaaggcgcacgagatctccgtgctctgcgacgccgaggtcgcgcttatcgtcttctccaccaaggggaggctctacgagtactccagccatgaaagcatggaaggcatccttgagcgttaccaacgatactcgtttgaagaaagagcagtacttgatccaagtattgcagaccaggcaaactggggagatgaatatggcaggttaaaagccaaacttgatgcgctacagaagagtcagaggcaattgttaggagaacaactggattcactgaccattaaagaactccagcaactggagcaacaactggacagctctgtgaagcatataagatcaagaaagaatcagctcatgttttattcaatttctgagcttcagaaaaaggaggaatctcttacagatcaaaatggtgtcctgcaaaagctcatggaggcagagaaagagaaaaacaatgcattaatgaatgcacacctccgggagcagcaaaacggagcttcaacaagcttgccatcaccgccgctatcaacagttccggattccttgccaactctaaatattgggccgtgtcaacctagaggaggaacagtaggggagtctgaacctgaaccgtctcctgctcaagtaaacagcggcaagctgccaccatggatgctacgtagtgtcagtaacagatgagctgttcctgatacggttctgcggctgaactcaaaggcaacacaccgtcaccaacacccttcgatgacccaggcatccataccagcgtgatccatctcgatccagtgaataccagcatagtcactaataagaacaggtatcatcaaatgctttacagggttaataaagtctgaagctcctctgcaccatcatattgcgttttgttctcgcgtctactttctaccttttttattctccgatcgacaagctggtgtacatctaaaaaagaagcacggtgttagcatgtggttggaggtcctaccgctatgcttgtttcccctgcctgtgtatgctttaacggagatgtatgttgtcatgttttccgtgttttacactttaaacagaaggctcttctcccggtaagggtagaatcctggtcaaagtgcc

SEQ ID NO: 1118 - protein, 253 aa, Panicum virgatum
  misc_feature (75)..(174): Pfam Name: K-box Pfam Description: K-box region
  misc_feature (9)..(59): Pfam Name: SRF-TF Pfam Description: SRF-type transcription factor (DNA-binding
  misc_feature (1)..(253): Ceres Clone ID no. 1820645
  misc_feature (1)..(253): Bit score of 628.5 for HMM based on sequences of Figure 14
  misc_feature (1)..(253): Functional Homolog Of SEQ ID NO. 1112
  misc_feature (1)..(253): in Figure 14
MGRGPVQLRRIENKINRQVTFSKRRNGLLKKAHEISVLCDAEVALIVFSTKGRLYEYSSHESMEGILERYQRYSFEERAVLDPSIADQANWGDEYGRLKAKLDALQKSQRQLLGEQLDSLTIKELQQLEQQLDSSVKHIRSRKNQLMFYSISELQKKEESLTDQNGVLQKLMEAEKEKNNALMNAHLREQQNGASTSLPSPPLSTVPDSLPTLNIGPCQPRGGTVGESEPEPSPAQVNSGKLPPWMLRSVSNR

SEQ ID NO: 1119 - DNA, 1234 bp, Glycine max
  misc_feature (1)..(1234): Ceres Clone ID no. 522963
  misc_feature (1)..(1234): Encodes the peptide sequence at SEQ ID NO. 1120
gatagagttcattccatacacagaaagaagaacaacactaagaaagcagaatagggaaaaatacatcgatagaggaaaattaattgaagggtgctactactacgaccttctatatcattaatgattgaaattcgtgttggaattgtcttgtaggtgtagtagtgataataagagaggatcatatatatattagtagtgctagaaattaattgaagtgtgtaatagaatagagtgtgatagagagagatatggggagaggaagggtgcagttgaagaggatcgagaacaagatcaataggcaagtgacgttttcaaagagaaggtctggtttgctcaagaaagcacatgagatctctgtgctttgtgatgctgaagtggccctcatagtcttctccaccaaaggcaaactctttgagtactccagcgatccatgtatggaaagaattcttgaacggtatgagaggtattcatatgcagagaggcagcttgttgcaagtgatcaaccacaaactgaaaattggactctagaacatgcaaagctcaaagcaaggttggaagtcctacagaaaaatcaaaggaattttatgggacaagatttggagggcctaagtatcaaagagcttcaaaatttggaacatcaacttgatagtgctctaaaacacattagatcacggaagaaccaaatcatgcatgaatctatttcagagcttcataaaaaggataaggtcctacaggaacaaaataacactctcgcaaagaagataaaggagaaagagaaggcactagcccagcatgcacaaatggagcagcgtggtgatgaaatggatcttacttcctctgccctagtacctcatccattggagacatcaaacattagagagtcctcacaaataaggggtgaaggagataatgaaggaaccccaactccaacccgagcaaatgccattcttccatcttggatgcttcgtccttcaaatgaatagaagagtattaacgacctaaaattttaaattacatatgaatatggcgaatacaaagcttaccctataagatgtaaaatggtctatgtgttgaattgtgaacaccacccaatgagttcaattggaatatcatagatatgtaatgtgtctctgactactacatttcaaggatgctaagtaaattatatggtatggcctgtctagatatagatttgcaatacatatatagtgtcaattatgtatgcttggttctc

SEQ ID NO: 1120 - protein, 244 aa, Glycine max
  misc_feature (75)..(174): Pfam Name: K-box Pfam Description: K-box region
  misc_feature (9)..(59): Pfam Name: SRF-TF Pfam Description: SRF-type transcription factor (DNA-binding
  misc_feature (1)..(244): Ceres Clone ID no. 522963
  misc_feature (1)..(244): Bit score of 633.7 for HMM based on sequences of Figure 14
  misc_feature (1)..(244): Functional Homolog Of SEQ ID NO. 1112
  misc_feature (1)..(244): in Figure 14
MGRGRVQLKRIENKINRQVTFSKRRSGLLKKAHEISVLCDAEVALIVFSTKGKLFEYSSDPCMERILERYERYSYAERQLVASDQPQTENWTLEHAKLKARLEVLQKNQRNFMGQDLEGLSIKELQNLEHQLDSALKHIRSRKNQIMHESISELHKKDKVLQEQNNTLAKKIKEKEKALAQHAQMEQRGDEMDLTSSALVPHPLETSNIRESSQIRGEGDNEGTPTPTRANAILPSWMLRPSNE

SEQ ID NO: 1121 - protein, 245 aa, Eucalyptus globulus
  misc_feature (75)..(174): Pfam Name: K-box Pfam Description: K-box region
  misc_feature (9)..(59): Pfam Name: SRF-TF Pfam Description: SRF-type transcription factor (DNA-binding
  misc_feature (1)..(245): Public GI ID no. 11120557
  misc_feature (1)..(245): Bit score of 638.2 for HMM based on sequences of Figure 14
  misc_feature (1)..(245): Functional Homolog Of SEQ ID NO. 1112
  misc_feature (1)..(245): in Figure 14
MGRGRVQLKRIENKINRQVTFSKRRCGLLKKAHEISVLCDADVALIVFSTKGKLFEYATDCCMERILERYERYSYAESQVLTNNAETNGNWTLEHAKLKARMEILQKNQKNLMGEELDSLSLKELQNLEHQLDTALKNIRSRKIQLMCESISELQRKDKALQEQNNMLAKKVKEKEKALAQQTQWDNPQDDGLTSSSVILSQSLQPLNIGGPYHPSGIEEGAALGPPQHRNATLFPSWMLSHLQE

SEQ ID NO: 1122 - protein, 233 aa, Elaeis guineensis
  misc_feature (78)..(174): Pfam Name: K-box Pfam Description: K-box region
  misc_feature (9)..(59): Pfam Name: SRF-TF Pfam Description: SRF-type transcription factor (DNA-binding
  misc_feature (1)..(233): Public GI ID no. 33309870
  misc_feature (1)..(233): Bit score of 570.6 for HMM based on sequences of Figure 14
  misc_feature (1)..(233): Functional Homolog Of SEQ ID NO. 1112
  misc_feature (1)..(233): in Figure 14
MGRGRVQLKRIENEINRQVTFSKRRSGLLKKAHEISVLCDAEVAVVVFSTKGKLYEYSTDSSMEKILERYRQYSNAEKALAQGDPGPQGSWLHEFGELKSKVEALQKCQRHLMGEQLDSLALKELQQLEQRLESALRHIRSRKNQLLFDSIAELRRKEKSLQEQNCILEKRLVESSAGAQNEHPHCERQSQPRTSSSSPLPFLVTDSFPTLHVRSNQARGTSLPAWMLRHVSG

SEQ ID NO: 1123 - protein, 247 aa, Alpinia oblongifolia
  misc_feature (75)..(174): Pfam Name: K-box Pfam Description: K-box region
  misc_feature (9)..(59): Pfam Name: SRF-TF Pfam Description: SRF-type transcription factor (DNA-binding
  misc_feature (1)..(247): Public GI ID no. 154551049
  misc_feature (1)..(247): Bit score of 641.5 for HMM based on sequences of Figure 14
  misc_feature (1)..(247): Functional Homolog Of SEQ ID NO. 1112
  misc_feature (1)..(247): in Figure 14
MGRGRVQLKRIENKINRQVTFSKRRSGLLKKAHEISVLCDAEVAVIIFSSKGKLYEYSTDSSMEKILERYEQYCYAEKALISSELDCQENWHHEYGKLKAKMEALSKSQRHLMGEQLDTLSLKELQQLENQLDNSLKHIRSRKNQVLLDSISELQVKEKALQEQNKSLEKQILEKQKAKALTQQAHWEQAQTSSSSPPFILADANPTLNIGCYQGRATIEGEVEAVEGQARINNSMLPPWMLSHLNG

SEQ ID NO: 1124 - DNA, 717 bp, Sorghum bicolor
  misc_feature (1)..(717): Ceres Annot ID no. 8656632
  misc_feature (1)..(717): Encodes the peptide sequence at SEQ ID NO. 1125
atggggcgcggaccggtgcagctgcgccggatcgagaacaagatcaaccgccaggtgaccttctccaagcgccggaacgggctgctgaagaaggcccacgagatctccgttctctgcgatgcggaggtcgcgctcatcgtcttctccactaaggggaagctctacgagtactctagccattccagcatggaaggcattcttgagcgttaccagcgttactcatttgaagaaagagcagtacttgacccaactattgaagaccaggcaaattggggagatgaatatgtccggttaaaatccaaacttgatgcacttcagaagagtcaaaggcaactgttaggagaacaattggattcactaaccataaaagaactccagcaactggagcaacaattggacagttctttgaagcatattaggtcaagaaagaatcagctcatgttcgattcaatttccgagcttcagaaaaaggagaaagcacttacagaccaaaatggtgtcctgcaaaagctcatggaggcagagaaggagaaaaacaatgctttaatgaacgcacacctccgggagcagccaaatggagcatcaacaagctccccatcactgccatgtcaacctagaggagcaggaaaatctgagcctggtccgtctcctgctcctgcacaagcaaacagcggcaacctgccaccatggatgctccgcactgtcagtaacaggtga

SEQ ID NO: 1125 - protein, 238 aa, Sorghum bicolor
  misc_feature (75)..(174): Pfam Name: K-box Pfam Description: K-box region
  misc_feature (9)..(59): Pfam Name: SRF-TF Pfam Description: SRF-type transcription factor (DNA-binding
  misc_feature (1)..(238): Ceres Annot ID no. 8656632
  misc_feature (1)..(238): Bit score of 550.3 for HMM based on sequences of Figure 14
  misc_feature (1)..(238): Functional Homolog Of SEQ ID NO. 1112
MGRGPVQLRRIENKINRQVTFSKRRNGLLKKAHEISVLCDAEVALIVFSTKGKLYEYSSHSSMEGILERYQRYSFEERAVLDPTIEDQANWGDEYVRLKSKLDALQKSQRQLLGEQLDSLTIKELQQLEQQLDSSLKHIRSRKNQLMFDSISELQKKEKALTDQNGVLQKLMEAEKEKNNALMNAHLREQPNGASTSSPSLPCQPRGAGKSEPGPSPAPAQANSGNLPPWMLRTVSNR

SEQ ID NO: 1126 - DNA, 1305 bp, Zea mays
  misc_feature (1)..(1305): Ceres Clone ID no. 246416
  misc_feature (1)..(1305): Encodes the peptide sequence at SEQ ID NO. 1127
aaaaaaccgccccctcccttcctcttctcctagctctcttgcctgcgcaccactcgagtcgagactcgagaggcacctgatctttccttcccgtcttcctcccacacgtccccatcaccattgctgcgacgagagtgagcgggagagggtaggtggcgaggcggcggagatggggcgggggccggtgcagctgcgccggatcgagaacaagatcaaccgccaggtgaccttctccaagcgccggaacgggctgctgaagaaggcccacgagatctccgtgctctgcgacgcagaggtcgcgctcatcgtcttctccactaaggggaagctctacgagtactctagccattccagcatggaaggcattcttgagcgttaccagcgttactcatttgaagaaagggcagtacttaacccaagtattgaagaccaggcaaattggggagatgaatatgtccggttaaaatccaaacttgatgcacttcagaagagtcaaaggcagctgttaggagaacaattgagttcactgaccataaaagaactccagcaactggagcaacaactggacagttctttgaagcatattaggtcaagaaagaatcagctcatgttcgattcaatttccgcgcttcagaaaaaggagaaagcacttacagatcaaaacggtgtcctgcaaaagttcatggaggcagagaaggagaaaaacaaggctttgatgaacgcgcagctccgggagcagcaaaatggagcatcaacaagctccccatcactttcaccaccaatagttccagattccatgccaactctaaatatagggccatgtcaacatagaggggcagcagaatctgagtctgaaccgtctcctgctcctgcacaagcaaacaggggcaacctgccaccatggatgctccgcactgtcaagtaacaggtgaggtcttcccagtgtagttttgcagctgatctcgacagcaacacacctgtcaccgaaatgcttcggtgaccctagatatcaaccgatgcacgatccatctcgatcctgtgatcgaataccggcgtaggtactaccaataaagtcaggccccgtcaaatgctttacatggtgattgaagtctggagcttctcagcaccaccatatattgtgttcagttcctgtgtttattgccatagctaccctttttttctctgatctacgagctagacgtagctttgtgcttggagattccactactatgtttcctctgtcctgtgtatgctttaacggagatgcacgttgtacccgtggtaatatatataaatttgcgttgt

SEQ ID NO: 1127 - protein, 251 aa, Zea mays
  misc_feature (76)..(173): Pfam Name: K-box Pfam Description: K-box region
  misc_feature (9)..(59): Pfam Name: SRF-TF Pfam Description: SRF-type transcription factor (DNA-binding
  misc_feature (1)..(251): Ceres Clone ID no. 246416
  misc_feature (1)..(251): Bit score of 581.7 for HMM based on sequences of Figure 14
  misc_feature (1)..(251): Functional Homolog Of SEQ ID NO. 1112
MGRGPVQLRRIENKINRQVTFSKRRNGLLKKAHEISVLCDAEVALIVFSTKGKLYEYSSHSSMEGILERYQRYSFEERAVLNPSIEDQANWGDEYVRLKSKLDALQKSQRQLLGEQLSSLTIKELQQLEQQLDSSLKHIRSRKNQLMFDSISALQKKEKALTDQNGVLQKFMEAEKEKNKALMNAQLREQQNGASTSSPSLSPPIVPDSMPTLNIGPCQHRGAAESESEPSPAPAQANRGNLPPWMLRTVK

SEQ ID NO: 1128 - protein, 249 aa, Oryza sativa subsp. japonica
  misc_feature (9)..(59): Pfam Name: SRF-TF Pfam Description: SRF-type transcription factor (DNA-binding
  misc_feature (75)..(173): Pfam Name: K-box Pfam Description: K-box region
  misc_feature (1)..(249): Public GI ID no. 115473253
  misc_feature (1)..(249): Bit score of 550.4 for HMM based on sequences of Figure 14
  misc_feature (1)..(249): Functional Homolog Of SEQ ID NO. 1112
MGRGPVQLRRIENKINRQVTFSKRRNGLLKKAHEISVLCDADVALIVFSTKGKLYEFSSHSSMEGILERYQRYSFDERAVLEPNTEDQENWGDEYGILKSKLDALQKSQRQLLGEQLDTLTIKELQQLEHQLEYSLKHIRSKKNQLLFESISELQKKEKSLKNQNNVLQKLMETEKEKNNAIINTNREEQNGATPSTSSPTPVTAPDPIPTTNNSQSQPRGSGESEAQPSPAQAGNSKLPPWMLRTSHT

SEQ ID NO: 1129 - protein, 246 aa, Oryza sativa subsp. japonica
  misc_feature (75)..(174): Pfam Name: K-box Pfam Description: K-box region
  misc_feature (9)..(59): Pfam Name: SRF-TF Pfam Description: SRF-type transcription factor (DNA-binding
  misc_feature (1)..(246): Public GI ID no. 115455399
  misc_feature (1)..(246): Bit score of 516.9 for HMM based on sequences of Figure 14
  misc_feature (1)..(246): Functional Homolog Of SEQ ID NO. 1112
MGRGKVQLKRIENKINRQVTFSKRRSGLLKKANEISVLCDAEVALIIFSTKGKLYEYATDSCMDKILERYERYSYAEKVLISAESDTQGNWCHEYRKLKAKVETIQKCQKHLMGEDLESLNLKELQQLEQQLENSLKHIRSRKSQLMLESINELQRKEKSLQEENKVLQKELVEKQKVQKQQVQWDQTQPQTSSSSSSFMMREALPTTNISNYPAAAGERIEDVAAGQPQHVRIGLPPWMLSHING

SEQ ID NO: 1130 - protein, 249 aa, Oryza sativa
  misc_feature (9)..(59): Pfam Name: SRF-TF Pfam Description: SRF-type transcription factor (DNA-binding
  misc_feature (75)..(173): Pfam Name: K-box Pfam Description: K-box region
  misc_feature (1)..(249): Public GI ID no. 6175371
  misc_feature (1)..(249): Bit score of 546.1 for HMM based on sequences of Figure 14
  misc_feature (1)..(249): Functional Homolog Of SEQ ID NO. 1112
MGRGPVQLRRIENKINRQVTFSKRRNGLLKKAHEISVLCDADVALIVFSTKGKLYEFSSHSSMEGILERYQRYSFDERAVLEPNTEDQENWGDEYGILKSKLDALQKSQRQLLGEQLDTLTTKELQQLEHQLEYSLKHIRSKKNQLLFESISELQKKEKSLKNQNNVLQKLMETEKEKNNAIINTNREEQNGATPSTSSPTPVTAPDPIPTTNNSQSQPRGSGESEAQPSPAQAGNSKLPPWMLRTSHT

SEQ ID NO: 1131 - protein, 246 aa, Oryza sativa subsp. indica
  misc_feature (75)..(174): Pfam Name: K-box Pfam Description: K-box region
  misc_feature (9)..(59): Pfam Name: SRF-TF Pfam Description: SRF-type transcription factor (DNA-binding
  misc_feature (1)..(246): Public GI ID no. 158517760
  misc_feature (1)..(246): Bit score of 509.6 for HMM based on sequences of Figure 14
  misc_feature (1)..(246): Functional Homolog Of SEQ ID NO. 1112
MGRGKVQLKRIENTINRQVTFSKRRSGLLKKANEISVLCDAEVALIIFSTKGKLYKYATDSCMDKILERYERYSYAEKVLISAESDTQGNWCHEYRKLKAKVETIQKCQKHLMGEDLESLNLKELQQLEQQLENSLKHIRSRKSQLMLESINELQRKEKSLQEENKVLQKELVEKQKVQKQQVQWDQTQPQTSSSSSSFMMREALPTTNISNYPAAAGERIEDVAAGQPQHVRIGLPPWMLSHING

SEQ ID NO: 1132 - DNA, 1545 bp, Panicum virgatum
  misc_feature (1)..(1545): Ceres Clone ID no. 1815457
  misc_feature (1)..(1545): Encodes the peptide sequence at SEQ ID NO. 1133
gctttaaatccggcgcctcgccgcctccctcctcctccccgccccggccggtcaccccgcctgcctctctctctctccgccgccgcggccgtgacgtcatgcgctcgccggcgctgctgccgcctaccatccacaaccagccagccgtaggcttgtatctagccaatcagccctcgtaggtggcctgttttatagctgctgccgtcgttgtcgtcgcggctgaggcgacgtgaggattggttagagagggaaccaggatttggttgagaggaggcggcggcggcggcggcggcggcgatggggcgcgggaaggtgcagctgaagcggatcgagaacaagatcaaccgccaggtgaccttctccaagcgccgcgcggggctgctcaagaaggcgcacgagatctccgtgctctgcgacgccgaggtcgcgctcatcatcttctccacgaaggggaagctctacgagtacgccaccgacacaagtatggacaaaattcttgaacggtatgaacgctactcctatgcagaaaaggttctcatttcagcagaatctgaaactcagggcaactggtgccacgaatatagaatgctaaaggcgaaggttgagacaatacagaaatgtcaaaagcacctcatgggagaggatcttgaaactctgaatctcaaggagcttcagcaactagagcagcagctagagagttcactgaaacatatcagatccagaaagagccagcttatgatggagtcaatttcagagcttcaacggaaggagaagtccctgcaggaggagaacaagattctgcagaaggagctcgcagagaagcagaaagcccagcgacagcaagcgcaatgggaccagactcaacaacaaaccagctcgtcttcctcgtccttcatgatgagagaagctcccccagcaacaaatatcagctaccccgtggcagcaggcgggagggtggaggggccagcagcgcagccgcaggctcgcattgggctgccaccgtggatgcttagccacatcagcagctgaactgaaggctttcctctcgcccgtctcggtgtgcaagcccaaaatccagcaacgcaacggtagtatgctcacccggctgcgccaatgctccacttgatgcatcattatcgccgatcttgtcgtgatcgctaccagcagcagcagcagtaagcaggggtttatcataatttgagcagcatataagttccaatcttcgctgtgtatattttgcttttgttcatcaccatttccgctgaggggaccgtacgatgaataatttcccccatgtaatatataatatgcgcagcatgaatgtcaatcgagcggtttgtcaattgagtcctgtacaagttgcatcattgcttgttgtattcacaagacacctgtgcctccgcactcaatcctatctgtaggctttgattcttttatgtatcttctgccattctataatggccctgtttagatacgcttataatccgcttagggcatgagcaatgtattttacctatatcgatacacatgggtcatgtgtcagcc

SEQ ID NO: 1133 - protein, 243 aa, Panicum virgatum
  misc_feature (75)..(174): Pfam Name: K-box Pfam Description: K-box region
  misc_feature (9)..(59): Pfam Name: SRF-TF Pfam Description: SRF-type transcription factor (DNA-binding
  misc_feature (1)..(243): Ceres Clone ID no. 1815457
  misc_feature (1)..(243): Bit score of 526.0 for HMM based on sequences of Figure 14
  misc_feature (1)..(243): Functional Homolog Of SEQ ID NO. 1112
MGRGKVQLKRIENKINRQVTFSKRRAGLLKKAHEISVLCDAEVALIIFSTKGKLYEYATDTSMDKILERYERYSYAEKVLISAESETQGNWCHEYRMLKAKVETIQKCQKHLMGEDLETLNLKELQQLEQQLESSLKHIRSRKSQLMMESISELQRKEKSLQEENKILQKELAEKQKAQRQQAQWDQTQQQTSSSSSSFMMREAPPATNISYPVAAGGRVEGPAAQPQARIGLPPWMLSHISS

SEQ ID NO: 1134 - protein, 246 aa, Oryza sativa
  misc_feature (75)..(174): Pfam Name: K-box Pfam Description: K-box region
  misc_feature (9)..(59): Pfam Name: SRF-TF Pfam Description: SRF-type transcription factor (DNA-binding
  misc_feature (1)..(246): Public GI ID no. 7592642
  misc_feature (1)..(246): Bit score of 513.9 for HMM based on sequences of Figure 14
  misc_feature (1)..(246): Functional Homolog Of SEQ ID NO. 1112
MGRGKVQLKRIENKINRQVTFSKRRSGLLKKANEISVLCDAEVALIIFSTKGKLYEYATDSCMDKILERYERYSYAEKVLISAESDTQGNWCHEYRKLKAKVETIQKCQKHLMGEDLESLNLKELQQLEQQLENSLKHIRSRKSQLMLESINELQRKEKSLQEENKVLQKELVEKQKVQKQQLQWDQTQPQTISSSSSFMMREALPTTNISNYPAAAGERIEDVPAGQPQHVRIGLPPWMLSHING

SEQ ID NO: 1135 - DNA, 1252 bp, Zea mays
  misc_feature (1)..(1252): Ceres Clone ID no. 100955082
  misc_feature (1)..(1252): Encodes the peptide sequence at SEQ ID NO. 1136
tcctcccctcccctccgatcaagtcggggcaacgcgcatcactcgctttaaatccgcacctcccggccggtccccttatcacctcaccttctcctttgagtcctctctctccgccgccgcagctagctgtgacgttatgctctcgccggcgccatagcgccagcgcctaccgtctacaactatccagccttaggcttacctatcccgtcaatcaagcctctcgtaaggaacaaggaaggtagctagctagttctatagctgctgtcgtcgtcgtcatcggcggcggcggcgcctgttcttagaggataaggttgtcctagcggagagggagctagccaggatttcggttgagatcaagagggggagcaggcggcggcggcggcgatggggcgcgggaaggtgcagctgaagcggatcgagaacaagatcaaccgccaggtgaccttctccaagcgccgctcggggctgctcaagaaggcgcacgagatctccgtgctctgcgacgccgaggtcgcgctcatcatcttctccaccaaagggaagctctacgagtattccaccgattcatgtatggacaaaattcttgaccggtacgagcgctactcctatgcagaaaaggttcttatttcagcagaatctgaaactcagggcaattggtgccacgagtatagaaaactaaaggcgaaggtcgagacaatacaaaaatgtcaaaagcacctcatgggagaggatcttgaaacgttgaatctcaaagagcttcagcaactagagcagcagctggagagttcactgaaacatatcagaaccaggaagaaccaacttatgctcgagtcaatttcggagctccaacggaaggagaagtcgctgcaggaggagaacaaggttctgcagaaggagctcgcggagaagcagaaagcccagcggaagcaagtgcaatggggccaaacccaacagcagaccagttcgtcttcctcgtgcttcgtgataagggaagctgccccaacaacaaatatcagcatttttcctgtggcagcaggcgggaggttggtggaaggtgcagcagcgcagccacaggctcgcgttggactaccaccatggatgcttagccacctgagcagctgaaggtttcagcaactcttcccgtttatccgcctggtgcagtatagtatcatcgtgatcgcgagagcagcagcagtgggtttgccgtatctttttttaccaatgtatgtctatatatgtaagtatcaaatct

SEQ ID NO: 1136 - protein, 245 aa, Zea mays
  misc_feature (75)..(174): Pfam Name: K-box Pfam Description: K-box region
  misc_feature (9)..(59): Pfam Name: SRF-TF Pfam Description: SRF-type transcription factor (DNA-binding
  misc_feature (1)..(245): Ceres Clone ID no. 100955082
  misc_feature (1)..(245): Bit score of 516.9 for HMM based on sequences of Figure 14
  misc_feature (1)..(245): Functional Homolog Of SEQ ID NO. 1112
MGRGKVQLKRIENKINRQVTFSKRRSGLLKKAHEISVLCDAEVALIIFSTKGKLYEYSTDSCMDKILDRYERYSYAEKVLISAESETQGNWCHEYRKLKAKVETIQKCQKHLMGEDLETLNLKELQQLEQQLESSLKHIRTRKNQLMLESISELQRKEKSLQEENKVLQKELAEKQKAQRKQVQWGQTQQQTSSSSSCFVIREAAPTTNISIFPVAAGGRLVEGAAAQPQARVGLPPWMLSHLSS

SEQ ID NO: 1137 - protein, 246 aa, Oryza sativa
  misc_feature (75)..(174): Pfam Name: K-box Pfam Description: K-box region
  misc_feature (9)..(59): Pfam Name: SRF-TF Pfam Description: SRF-type transcription factor (DNA-binding
  misc_feature (1)..(246): Public GI ID no. 6606070
  misc_feature (1)..(246): Bit score of 507.0 for HMM based on sequences of Figure 14
  misc_feature (1)..(246): Functional Homolog Of SEQ ID NO. 1112
MGRGKVQLKRIENKINRQVTFSKRRSKLLKKANEISVLCDAEVALIIFSTKGKLYEYATDSCMDKILERYERYSYAEKVLISAESDTQGNWCHEYRKLKAKVETIQKCQKHLMGEDLESLNLKELQQLEQQLENSLKHIRSRKSQLMLESINELQRKEKSLQEENKVLQKELVEKQKVQKQQVQWDQTQPQTSSSSSSFMMREALPTTNISNYPAAAGERIEDVAAGQPQHERIGLPPWMLSHING

SEQ ID NO: 1138 - DNA, 1087 bp, Panicum virgatum
  misc_feature (1)..(1087): Ceres Clone ID no. 1908817
  misc_feature (1)..(1087): Encodes the peptide sequence at SEQ ID NO. 1139
gaggcgacgtgaggattggttagagagggaaccaggaggacttggttgagaggaggcggcgatggggcgcgggaaggtgcagctgaagcggatcgagaacaagatcaaccgccaggtgaccttctccaagcgccgctcggggttgctcaagaaggcgcacgagatctccgtgctctgcgacgccgaggtcgcactcatcatcttctccaccaaggggaagctctacgagtacgccacagacacatgtatggacaaaattcttgaacggtatgaacgctactcctatgcagaaaaggttctcgtttcagcagaatctgaaactcagggcaactggtgccatgaatatacaaagctaaaggcgaaggttgagacgatacagaaatgtcaaaagcacctcatgggagaggatcttgaaactctgaatctcaaggagcttcagcaactagagcagcagctagagagttcactgaaacatatcagatccagaaagagccagcttatgatggagtcaatttcggagcttcaacggaaggagaagtccctgcaggaggagaacaagattctgcagaaggagcccgcagagaagcagaaagctcagcgacagcaagcgcaatgggaccagaatcaacaacaaacaagctcgtcttcctcgtccttcatcatgagagaagctcccccagcaacaaatatcagcagctaccctgtgcctgtggcagcaggcgggagggtggagcgggcagcagcgcagccgcaggctctcattgggctgccagcgtggatgcttagccacatcagcagctgaactgaaggctttcctctcgcccgtgtcggtgcgcgagcccaaaaatccagcaacgcaacggtagcatgctcacccccggctgccccgcggctccacctgatgaattattatcgtcgatcttgtcgtgatcgccaccggcagcagtagcaggggtttatcataatttgagcagcatataagtaccaatcttcgctgtgtatattttgcttttgttcatcgccgtttccgctgagccgaccgtacgatgaataatttacccatgtaatatataatataatatgcgca

SEQ ID NO: 1139 - protein, 246 aa, Panicum virgatum
  misc_feature (75)..(174): Pfam Name: K-box Pfam Description: K-box region
  misc_feature (9)..(59): Pfam Name: SRF-TF Pfam Description: SRF-type transcription factor (DNA-binding
  misc_feature (1)..(246): Ceres Clone ID no. 1908817
  misc_feature (1)..(246): Bit score of 526.5 for HMM based on sequences of Figure 14
  misc_feature (1)..(246): Functional Homolog Of SEQ ID NO. 1112
MGRGKVQLKRIENKINRQVTFSKRRSGLLKKAHEISVLCDAEVALIIFSTKGKLYEYATDTCMDKILERYERYSYAEKVLVSAESETQGNWCHEYTKLKAKVETIQKCQKHLMGEDLETLNLKELQQLEQQLESSLKHIRSRKSQLMMESISELQRKEKSLQEENKILQKEPAEKQKAQRQQAQWDQNQQQTSSSSSSFIMREAPPATNISSYPVPVAAGGRVERAAAQPQALIGLPAWMLSHISS

SEQ ID NO: 1140 - protein, 250 aa, Elaeis guineensis
  misc_feature (75)..(174): Pfam Name: K-box Pfam Description: K-box region
  misc_feature (9)..(59): Pfam Name: SRF-TF Pfam Description: SRF-type transcription factor (DNA-binding
  misc_feature (1)..(250): Public GI ID no. 33309864
  misc_feature (1)..(250): Bit score of 585.6 for HMM based on sequences of Figure 14
  misc_feature (1)..(250): Functional Homolog Of SEQ ID NO. 1112
MGRGRVQLRRIENKINRQVTFSKRRSGLLKKAHEISVLCDAEVALIIFSTKGKLYEYATDSCMERILERYERYTYAEKALISSGPELQGNWCHEFGKLKAKVEALQKSQRHLMGEQLEPLNLKELQQLEQQLESSLKHIRTRKCQLMFESISELQKKEKSLQEQNKMLEKELMEKQKVKALNQQAPWEQQGPPQTSSSSPTSFLIGDSLPTLNIGTYQCSGNEHGEEAAQPQVRIGNSLLPPWMLSHLNG

SEQ ID NO: 1141 - protein, 245 aa, Zea mays
  misc_feature (75)..(174): Pfam Name: K-box Pfam Description: K-box region
  misc_feature (9)..(59): Pfam Name: SRF-TF Pfam Description: SRF-type transcription factor (DNA-binding
  misc_feature (1)..(245): Public GI ID no. 158954871
  misc_feature (1)..(245): Bit score of 509.8 for HMM based on sequences of Figure 14
  misc_feature (1)..(245): Functional Homolog Of SEQ ID NO. 1112
MGRGKVQLKRIENKINRQVTFSKRRSGLLKKAHEISVLCDAEVALIIFSTKGKLYEYSTDSCMDKILDRYERYSYAEKVLISVESETQGNWCHEYRKLKAKVETIQKCQKHLMGEDLETLNLKELQQLEQQLESSLKHIRTRKSQLMLESISELQRKEKSLQEENKVLQKELAEKQKAQRKQVQWGQTQQQTSSSSSCFMIREAAPTTNISIFPVAAGGRLVEGAAAQPQARVGLPPWMLSHLSS

SEQ ID NO: 1142 - protein, 244 aa, Triticum monococcum
  misc_feature (75)..(174): Pfam Name: K-box Pfam Description: K-box region
  misc_feature (9)..(59): Pfam Name: SRF-TF Pfam Description: SRF-type transcription factor (DNA-binding
  misc_feature (1)..(244): Public GI ID no. 30090030
  misc_feature (1)..(244): Bit score of 496.6 for HMM based on sequences of Figure 14
  misc_feature (1)..(244): Functional Homolog Of SEQ ID NO. 1112
MGRGKVQLKRIENKINRQVTFSKRRSGLLKKAHEISVLCDAEVGLIIFSTKGKLYEFSTESCMDKILERYERYSYAEKVLVSSESEIQGNWCHEYRKLKAKVETIQKCQKHLMGEDLESLNLKELQQLEQQLESSLKHIRSRKNQLMHESISELQKKERSLQEENKVLQKELVEKQKAHAAQQDQTQPQTSSSSSSFMLRDAPPAANTSIHPAAAGERAEDAAVQPQAPPRTGLPPWMVSHING

SEQ ID NO: 1143 - protein, 244 aa, Triticum aestivum
  misc_feature (75)..(174): Pfam Name: K-box Pfam Description: K-box region
  misc_feature (9)..(59): Pfam Name: SRF-TF Pfam Description: SRF-type transcription factor (DNA-binding
  misc_feature (1)..(244): Public GI ID no. 58422998
  misc_feature (1)..(244): Bit score of 496.5 for HMM based on sequences of Figure 14
  misc_feature (1)..(244): Functional Homolog Of SEQ ID NO. 1112
MGRGKVQLKRIENKINRQVTFSKRRSGLLKKAHEISVLCDAEVGLIIFSTKGKLYEFSTESCMDKILERYERYSYAEKVLVSSESEIQGNWCHEYRKLKAKVETIQKCQKHLMGEDLESLNLKELQQLEQQLESSLKHIRSRKNQLMHESISELQKKERSLQEENKVLQKELVEKQKAHVAQQDQTQPQTSSSSSSFMLRDAPPAANTSIHPAATGERAEDAAVQPQAPPRTGLPPWMVSHING

SEQ ID NO: 1144 - protein, 244 aa, Populus balsamifera subsp. trichocarpa
  misc_feature (75)..(175): Pfam Name: K-box Pfam Description: K-box region
  misc_feature (9)..(59): Pfam Name: SRF-TF Pfam Description: SRF-type transcription factor (DNA-binding
  misc_feature (1)..(244): Public GI ID no. 224118942
  misc_feature (1)..(244): Bit score of 561.7 for HMM based on sequences of Figure 14
  misc_feature (1)..(244): Functional Homolog Of SEQ ID NO. 1112
MGRGRIQLKRIENKINRQVTFSKRRSGLLKKAHEISVLCDAEVALIVFSTKGKLFEYATDSCMERILERYERYSYAERQLLANDDPENHGSWTLEYAKLKARVDVLQRNQRHFMGEDLDSLNIKELQNLEHQIDSALKHVRSRKNQLMYESISELQKKDKALQEQNNMLAKKVKEKEKAIIAQQASWEQQNPDLDSPTILRPQPMQPLNISSSHLATGIEEEPAPIQHRANALLPAWMLRYLNE

SEQ ID NO: 1145 - protein, 244 aa, Triticum turgidum
  misc_feature (75)..(174): Pfam Name: K-box Pfam Description: K-box region
  misc_feature (9)..(59): Pfam Name: SRF-TF Pfam Description: SRF-type transcription factor (DNA-binding
  misc_feature (1)..(244): Public GI ID no. 58422996
  misc_feature (1)..(244): Bit score of 496.8 for HMM based on sequences of Figure 14
  misc_feature (1)..(244): Functional Homolog Of SEQ ID NO. 1112
MGRGKVQLKRIENKINRQVTFSKRRSGLLKKAHEISVLCDAEVGLIIFSTKGKLYEFSTESCMDKILERYERYSYAEKVLVSSESEIQGNWCHEYRKLKAKVETIQKCQKHLMGEDLESLNLKELQQLEQQLESSLKHIRSRKNQLMHESISELQKKERSLQEENKVLQKELVEKQKAHAAQQDQTQPQTSSSSSSFMLRDAPPAANTSIHPAATGERAEDAAVQPQAPPRTGLPPWMVSHING

SEQ ID NO: 1146 - DNA, 1279 bp, Panicum virgatum
  misc_feature (1)..(1279): Ceres Clone ID no. 1757409
  misc_feature (1)..(1279): Encodes the peptide sequence at SEQ ID NO. 1147
ctattcattccccgcgcaccactcgagtcgagagccacctgatccttcgttccccgtcttcctctcccccggcacgtcgctgtcgccattgccgcgccgctcgagagcggaagggggtaggtggggaagcggcggggatggggcgcgggccggtgcagctgcggcggatcgagaacaagatcaaccgccaggtgaccttctccaagcgccggaacgggctgctgaagaaggcgcacgagatctccgtgctctgcgacgccgaggtcgcgctcatcgtcttctccaccaaggggaggctctacgagtactccagcaatgacagcatggaaggcattcttgagcgttaccaacgatactcgtttgaagaaagagcagtacttgatccaaatattggagaccaggcaaactggggagatgaatatggctggttaaagaccaaacttgatgcacttcagaagagtcagaggcaactgttaggagaacaactggattcacttaccgtaaaagaactccagcaactggagcaacaactggacagctctctgaagcatataagatcaagaaagaatcagctcatgtttgattcaatttctgagcttcagaaaaaggagaaatcacttacagatcaaaatggtgtcctgcaaaagctcatggaggcagagaaagagaaaaacaatgcattaatgaatgcacacctccgggagcagcaaaatggagcatcaacaagcttgccatcaccaccgccatcaacagttccagattccatgccaactctaaatattaggccgcgtcaacctagagaaggaacagtaggggagtctgaacctgaatcgtctcctgctcaagtgaacagcggcaagctgcctccatggatgctacgcagtgtcagtaacagatgagctgttcctgatacggttctgcggctgaactcggatggcaaacacaccgtcaccaacacccttcggtgacccaggcatccataccggctcgatccagtagatgccagcatagtcactaataataagatcaggtatcaagtgctttacagggtgaataaagtctgaagctcctctgcaccatcatattgcgttttgttctcgcgtctgctgtctacctttttttttttctccgatcgacaagctcgtggttggagatgtatgctgtatcatgtttttcgtgtttacacttttacgaaaacagaaggctcttctcctggtaagggttgagtcccgatcaaagtgtcaaatgcgtaattcggtatcttagcagtattaacagc

SEQ ID NO: 1147 - protein, 253 aa, Panicum virgatum
  misc_feature (75)..(174): Pfam Name: K-box Pfam Description: K-box region
  misc_feature (9)..(59): Pfam Name: SRF-TF Pfam Description: SRF-type transcription factor (DNA-binding
  misc_feature (1)..(253): Ceres Clone ID no. 1757409
  misc_feature (1)..(253): Bit score of 602.6 for HMM based on sequences of Figure 14
  misc_feature (1)..(253): Functional Homolog Of SEQ ID NO. 1112
MGRGPVQLRRIENKINRQVTFSKRRNGLLKKAHEISVLCDAEVALIVFSTKGRLYEYSSNDSMEGILERYQRYSFEERAVLDPNIGDQANWGDEYGWLKTKLDALQKSQRQLLGEQLDSLTVKELQQLEQQLDSSLKHIRSRKNQLMFDSISELQKKEKSLTDQNGVLQKLMEAEKEKNNALMNAHLREQQNGASTSLPSPPPSTVPDSMPTLNIRPRQPREGTVGESEPESSPAQVNSGKLPPWMLRSVSNR

SEQ ID NO: 1148 - protein, 244 aa, Triticum aestivum
  misc_feature (75)..(174): Pfam Name: K-box Pfam Description: K-box region
  misc_feature (9)..(59): Pfam Name: SRF-TF Pfam Description: SRF-type transcription factor (DNA-binding
  misc_feature (1)..(244): Public GI ID no. 30721847
  misc_feature (1)..(244): Bit score of 492.8 for HMM based on sequences of Figure 14
  misc_feature (1)..(244): Functional Homolog Of SEQ ID NO. 1112
MGRGKVQLKRIENKINRQVTFSKRRSGLLKKAHEISVLCDAEVGLIIFSTKGKLYEFSTESCMDKILERYERYSYAEKVLVSSESEIQGNWCHEYRKLKAKVETIQKCQKHLMGEDLESLNLKELQQLEQQLESSLKHIRSRKNQLMHESISELQKKERSLQEENKVLQKELVEKQKAQAAQQDQTQPQTSSSSSSFMMRDAPPAATTSIHPAASGERAEDAAVQPQAPPRTGLPLWMVSHING

SEQ ID NO: 1149 - protein, 244 aa, Dendrocalamus latiflorus
  misc_feature (75)..(174): Pfam Name: K-box Pfam Description: K-box region
  misc_feature (9)..(59): Pfam Name: SRF-TF Pfam Description: SRF-type transcription factor (DNA-binding
  misc_feature (1)..(244): Public GI ID no. 39843110
  misc_feature (1)..(244): Bit score of 501.9 for HMM based on sequences of Figure 14
  misc_feature (1)..(244): Functional Homolog Of SEQ ID NO. 1112
MGRGKVQLKRIENKINRQVTFSKRRSGLLKKAHEISVLCDAEVGLIIFSTKGKLYEYATDSCMDKILERYERYSYAEKVLISAESETQGNWCHEYRKLKAKVETIQKCQKHLMGEDLESLNLKELQQLEQQLESSVKHIRSRKSQLMLESISELQKKEKSLQEENKVLQKELVEKQQVHKRLVQWDQTQPQTSSSSSSFMMREALPTTNISIYAAAAGERAEDAAGQPQIHIGLPPWMVSHING

SEQ ID NO: 1150 - protein, 244 aa, Hordeum vulgare subsp. vulgare
  misc_feature (75)..(174): Pfam Name: K-box Pfam Description: K-box region
  misc_feature (9)..(59): Pfam Name: SRF-TF Pfam Description: SRF-type transcription factor (DNA-binding
  misc_feature (1)..(244): Public GI ID no. 58866601
  misc_feature (1)..(244): Bit score of 475.7 for HMM based on sequences of Figure 14
  misc_feature (1)..(244): Functional Homolog Of SEQ ID NO. 1112
MGRGKVQLKRIENKINRQVTFSKRRSGLLKKAHEISVLCDAEVGLIIFSTKGKLYEFSTESCMDKILERYERYSYAEKVLVSSESEIQGNWCHEYRKLKAKVETIQKCQKHLMGEDLESLNLKELQQLEQQLESSLKHIRARKNQLMHESISELQKKERSLQEENKVLQKELVEKQKAQAAQQDQTQPQTSSSSSSFMMRDAPPVADTSNHPAAAGERAEDVAVQPQVPLRTALPLWMVSHING

SEQ ID NO: 1151 - protein, 244 aa, Triticum aestivum
  misc_feature (75)..(174): Pfam Name: K-box Pfam Description: K-box region
  misc_feature (9)..(59): Pfam Name: SRF-TF Pfam Description: SRF-type transcription factor (DNA-binding
  misc_feature (1)..(244): Public GI ID no. 95981882
  misc_feature (1)..(244): Bit score of 491.1 for HMM based on sequences of Figure 14
  misc_feature (1)..(244): Functional Homolog Of SEQ ID NO. 1112
MGRGKVQLKRIENKINRQVTFSKRRSGLLKKAHEISVLCDAEVGLIIFSTRGKLYEFSTESCMDKILERYERYSYAEKVLVSSESEIQGNWCHEYRKLKAKVETIQKCQKHLMGEDLESLNLKELQQLEQQLESSLKHIRSRKNQLMHESISELQKKERSLQEENKVLQKELVEKQKAHVAQQDQTQPQTSSSSSSFMLRDAPPAANTSIHPAATGERAEDAAVQPQAPPRTGLPPWMVSHING

SEQ ID NO: 1152 - protein, 253 aa, Oryza sativa subsp. japonica
  misc_feature (75)..(174): Pfam Name: K-box Pfam Description: K-box region
  misc_feature (9)..(59): Pfam Name: SRF-TF Pfam Description: SRF-type transcription factor (DNA-binding
  misc_feature (1)..(253): Public GI ID no. 31712055
  misc_feature (1)..(253): Bit score of 502.4 for HMM based on sequences of Figure 14
  misc_feature (1)..(253): Functional Homolog Of SEQ ID NO. 1112
MGRGKVQLKRIENKINRQVTFSKRRSGLLKKANEISVLCDAEVALIIFSTKGKLYEYATDSCMDKILERYERYSYAEKVLISAESDTQGNWCHEYRKLKAKVETIQKCQKHLMGEDLESLNLKELQQLEQQLENSLKHIRSRKSQLMLESINELQRKEKSLQEENKVLQKENPCSFLQLVEKQKVQKQQVQWDQTQPQTSSSSSSFMMREALPTTNISNYPAAAGERIEDVAAGQPQHVRIGLPPWMLSHING

SEQ ID NO: 1153 - protein, 238 aa, Euptelea pleiosperma
  misc_feature (75)..(174): Pfam Name: K-box Pfam Description: K-box region
  misc_feature (9)..(59): Pfam Name: SRF-TF Pfam Description: SRF-type transcription factor (DNA-binding
  misc_feature (1)..(238): Public GI ID no. 110164923
  misc_feature (1)..(238): Bit score of 533.5 for HMM based on sequences of Figure 14
  misc_feature (1)..(238): Functional Homolog Of SEQ ID NO. 1112
MGRGRVQLKRIENKINRQVTFSKRRSGLLKKAHEISVLCDAEVALIVFSTKGKLFEYSTDSGMDMILDRYERYSSAERELVAHDPESQGSWSLEYAKLKAKLEVLQRNQRHFMGENVDSLSSKELQNLEQQLDSALKHIRTRKNHLMYESIAELQRKEKTLQEQNNQLEKKLKEKELTQQAHWEHQSSTSFLLSQTLPTLNIGGTYQVRGSGSEEEVAQPHARTNTLMPPWMLRHVNE

SEQ ID NO: 1154 - protein, 244 aa, Triticum aestivum
  misc_feature (75)..(174): Pfam Name: K-box Pfam Description: K-box region
  misc_feature (9)..(59): Pfam Name: SRF-TF Pfam Description: SRF-type transcription factor (DNA-binding
  misc_feature (1)..(244): Public GI ID no. 3688589
  misc_feature (1)..(244): Bit score of 486.3 for HMM based on sequences of Figure 14
  misc_feature (1)..(244): Functional Homolog Of SEQ ID NO. 1112
MGRGKVQLKRIENKINRQVTFSKRRSGLLKKAHEISVLCDAEVGLIIFSTKGKLYEFSTESCMDKILERYERYSYAEKVLVSSESEIQGNWCHEYRKLKAKVETIQKCQKHLMGEDLESLNLKELQQLEQQLESSLKHIRSRKNQLMHESISELQKKERSLQEENKVLQKELVEKQKAQAAQQDQTQPQTSSSSSSFMMRDAPPAAATSIHPAAAGERAGDAAVQPQAPPRTGLPLWMVSHING

SEQ ID NO: 1155 - protein, 245 aa, Lolium temulentum
  misc_feature (75)..(174): Pfam Name: K-box Pfam Description: K-box region
  misc_feature (9)..(59): Pfam Name: SRF-TF Pfam Description: SRF-type transcription factor (DNA-binding
  misc_feature (1)..(245): Public GI ID no. 4204232
  misc_feature (1)..(245): Bit score of 495.0 for HMM based on sequences of Figure 14
  misc_feature (1)..(245): Functional Homolog Of SEQ ID NO. 1112
MGRGKVQLKRIENKINRQVTFSKRRSGLLKKAHEISVLCDAEVGLIIFSTKGKLYEFATDSCMDKILERYERYSYAEKVLISTESEIQGNWCHEYRKLKAKVETIQRCQKHLMGEDLESLNLKELQQLEQQLESSLKHIRSRKSQLMHESISELQKKERSLQEENKILQKELIEKQKAHTQQAQLEQTQPQTSSSSSSFMMGEATPATNRSNPPAAASDRAEDATGQPPARTVLPPWMVSHLNNG

SEQ ID NO: 1156 - protein, 245 aa, Spinacia oleracea
  misc_feature (75)..(174): Pfam Name: K-box Pfam Description: K-box region
  misc_feature (9)..(59): Pfam Name: SRF-TF Pfam Description: SRF-type transcription factor (DNA-binding
  misc_feature (1)..(245): Public GI ID no. 194500619
  misc_feature (1)..(245): Bit score of 511.8 for HMM based on sequences of Figure 14
  misc_feature (1)..(245): Functional Homolog Of SEQ ID NO. 1112
MGRGRVQLKRIENKINRQVTFSKRRIGLLKKAHEISILCDADVGLIIFSTKGKLFEYASDSCMEKILERYERYSYAEKQLTTPDPESRVSWTLEHAKLKARLKILQKNQRNYMGEELDTLSLKELQNLEHQLDSALKHIRSKKNQVMHESISQLQKKDKALQEHNNMLIKKVKEKEKALAKQSETDQETYDLNSSGFLSQALPSLNTVGTCSSAVEDDQTTQQPSRTNNNSTIMPSWMLRHISEQ

SEQ ID NO: 1157 - DNA, 1186 bp, Gossypium hirsutum
  misc_feature (1)..(1186): Ceres Clone ID no. 1793949
  misc_feature (1)..(1186): Encodes the peptide sequence at SEQ ID NO. 1158
ctatctgcttttcatctccagcattcgttttaaagatcttggctagcaacccaaagcgataataagggaaccactgataaaagatacccagagagacttgtcatatttttacatatatcaccccttcttcttcttctttaatctctctattttttttctgggtttttctatttaagggtcgaaatttggaagaaaaagaaggggatatcagcatggggaggggtagggttcagttgaagagaattgaaaacaagatcaacaggcaagtcactttctcaaagagaaggtctggtttattgaagaaagcccatgaaatctctgtgctttgtgatgctgaagttgctttgattgttttctcaactaaagggaagctctttgaatactcatcagattcttgcatggagaggatcctcgaacggtatgaaagatattcttatgcagagaggcaacttgctgcaaatgaaaatgaacgaactggtagttggactttggaacatgcaaaacttaaagccaggatggaggtgttacaaagaaaccaaaggcattatatgggagaagatcttgagaatttgagtcttagagagcttcagaacttggagcaccaacttgattctgcccttaaacacatacgttcaagaaagaatcagctcatgtttgaatccatttccgagcttcagaaaaaggataaagcattacaagagcagaacaatgtccttgcaaagaaggtaaaggaaaaggagaaggagaaggaaaaggagaaggagaaggaaatgacccatcagccacaacaaaacaattgccaagattcatcctcaatgcttccacaaccactgcagtccttgaacatcagtgacacatatgaagcaaggagcaatggaagagaagagggtaatcctagtgcagcacaacatcgcaactccaatgtgctattgccaccgtggatgattcctcgtattgagtaattaaaacaagtaaaagtctctcctctaattagtatgcaatttaatgcatttacatataaaatatgtaaatatgtgtttatatatgcatgcgacaaactgatgtgtgacctgcgtctatgtgtaatcccagtgatgtaattatcaaggagggttttgttgatacgaattataatataatgtaaaatatgaatttaactacgaaatcatattatcagttcagcagg

SEQ ID NO: 1158 - protein, 249 aa, Gossypium hirsutum
  misc_feature (75)..(174): Pfam Name: K-box Pfam Description: K-box region
  misc_feature (9)..(59): Pfam Name: SRF-TF Pfam Description: SRF-type transcription factor (DNA-binding
  misc_feature (1)..(249): Ceres Clone ID no. 1793949
  misc_feature (1)..(249): Bit score of 519.4 for HMM based on sequences of Figure 14
  misc_feature (1)..(249): Functional Homolog Of SEQ ID NO. 1112
MGRGRVQLKRIENKINRQVTFSKRRSGLLKKAHEISVLCDAEVALIVFSTKGKLFEYSSDSCMERILERYERYSYAERQLAANENERTGSWTLEHAKLKARMEVLQRNQRHYMGEDLENLSLRELQNLEHQLDSALKHIRSRKNQLMFESISELQKKDKALQEQNNVLAKKVKEKEKEKEKEKEKEMTHQPQQNNCQDSSSMLPQPLQSLNISDTYEARSNGREEGNPSAAQHRNSNVLLPPWMIPRIE

SEQ ID NO: 1159 - protein, 245 aa, Lolium perenne
  misc_feature (75)..(174): Pfam Name: K-box Pfam Description: K-box region
  misc_feature (9)..(59): Pfam Name: SRF-TF Pfam Description: SRF-type transcription factor (DNA-binding
  misc_feature (1)..(245): Public GI ID no. 28630953
  misc_feature (1)..(245): Bit score of 502.9 for HMM based on sequences of Figure 14
  misc_feature (1)..(245): Functional Homolog Of SEQ ID NO. 1112
MGRGKVQLKRIENKINRQVTFSKRRSGLLKKAHEISVLCDAEVGLIIFSTKGKLYEFATDSCMDKILERYERYSYAEKVLISTESEIQGNWCHEYRKLKAKVETIQRCQKHLMGEDLESLNLKELQQLEQQLESSLKHIRARKNQLMHESISELQKKERSLQEENKILQKELIEKQKAHTQQAQWEQTQPQTSSSSSSFMMGEATPATNCSNPPAAASDRAEDATGQPSARTVLPPWMVSHINNG

SEQ ID NO: 1160 - protein, 245 aa, Zea mays
  misc_feature (75)..(174): Pfam Name: K-box Pfam Description: K-box region
  misc_feature (9)..(59): Pfam Name: SRF-TF Pfam Description: SRF-type transcription factor (DNA-binding
  misc_feature (1)..(245): Public GI ID no. 162458731
  misc_feature (1)..(245): Bit score of 499.6 for HMM based on sequences of Figure 14
  misc_feature (1)..(245): Functional Homolog Of SEQ ID NO. 1112
MGRGKVQLKRIENKINRQVTFSKRRSGLLKKAHEISVLCDAEVALIIFSTKGKLYEYSTDSCMDKILERYERYSYAEKVLISAEYETQGNWCHEYRKLKAKVETIQKCQKHLMGEDLETLNLKELQQLEQQLESSLKHIRTRKSQLMVESISALQRKEKSLQEENKVLQKELAEKQKDQRQQVQRDQTQQQTSSSSTSFMLREAAPTTNVSIFPVAAGGRVVEGAAAQPQARVGLPPWMLSHLSC

SEQ ID NO: 1161 - protein, 244 aa, Dendrocalamus latiflorus
  misc_feature (75)..(174): Pfam Name: K-box Pfam Description: K-box region
  misc_feature (9)..(59): Pfam Name: SRF-TF Pfam Description: SRF-type transcription factor (DNA-binding
  misc_feature (1)..(244): Public GI ID no. 39843112
  misc_feature (1)..(244): Bit score of 495.1 for HMM based on sequences of Figure 14
  misc_feature (1)..(244): Functional Homolog Of SEQ ID NO. 1112
MGRGKVQLKRIENKINRQVTFSKRRSGLLKKAHEISVLCDAEVGLIIFSTKGKLYEYATDSCMDKILERYERYSYAEKVLISAESETQGNWCHEYRKLKAKVETIQKCQKHLMGEDPESLNLKELQQLEQQLESSVKHIRSRKSQLMLESISELQKKEKSLQEENKVLQKELVEKQQVHKRLVQWDQTQPQTSSSSSSFMMREALPTTNISIYAAAAGERAEDAAGQPQIHIGLPPWMVSHING

SEQ ID NO: 1162 - DNA, 1294 bp, Zea mays
  misc_feature (1)..(1294): Ceres Clone ID no. 257029
  misc_feature (1)..(1294): Encodes the peptide sequence at SEQ ID NO. 1163
acccacaaacacacactccttcgcctcgcgccggccgtcgtcgcctccctccaccgaacgatccctcctcctcctcctcctcgcatcccaccccaccccaccttctccttaaagctacctgcctacccggcggttgccgccgccgcaatcgatcgaccggaagagaaagagcagctagctagctagcagatcggagcacggcaacaaggcgatggggcgcggcaaggtgcagctgaagcggatagagaacaagataaaccggcaggtgaccttctccaagcgccggaacggcctgctcaagaaggcgcacgagatctccgtcctctgcgacgccgaggtcgccgtcatcgtcttctcccccaagggcaagctctacgagtacgccacggactcccgcatggacaaaattcttgaacgctatgagcgatattcctatgctgaaaaggctcttatttcagctgaatctgaaagtgagggaaattggtgccacgaatacaggaaactgaaggccaaaattgagaccatacaaaaatgccacaagcacctgatgggagaggatctagagtctttgaatcccaaagagctccagcaactagagcagcagctggatagctcactgaagcacatcagatcaaggaagagccaccttatggccgagtctatttctgagctacagaagaaggagaggtcactgcaggaggagaacaaggctctgcagaaggaacttgcggagaggcagaaggccgtcgcgagccggcagcagcaggtgcagtgggaccagcagacacatgcccaggcccagacaagctcatcatcgtcctccttcatgatgaggcaggatcagcagggattgccgcctccacacaacatctgcttcccgccgttgacaatgggagatagaggtgaagagctggctgcggcggcggcggcgcagcagcagcagccactgccggggcaggcgcaaccgcagctccgcatcgcaggtctgccaccatggatgctgagccacctcaatgcataaggagagggtcgatgaacacatcgacctcctctctctctctctctcgtcatggatcatgacgtacgcgtaccatatggttgctgtgcctgcccccatcgatcgcgagcaatggcacgctcatgcaagtgatcattgctccccgttggttaaaccctagcctatgttcatggcgtcagcaactaagctaaactattgttatgtttgcaagaaagggtaaacccgctagctgtgtaatcttgtccagctatcatgtatgcttgttactgcccagtt

SEQ ID NO: 1163 - protein, 269 aa, Zea mays
  misc_feature (75)..(174): Pfam Name: K-box Pfam Description: K-box region
  misc_feature (9)..(59): Pfam Name: SRF-TF Pfam Description: SRF-type transcription factor (DNA-binding
  misc_feature (1)..(269): Ceres Clone ID no. 257029
  misc_feature (1)..(269): Bit score of 464.0 for HMM based on sequences of Figure 14
  misc_feature (1)..(269): Functional Homolog Of SEQ ID NO. 1112
MGRGKVQLKRIENKINRQVTFSKRRNGLLKKAHEISVLCDAEVAVIVFSPKGKLYEYATDSRMDKILERYERYSYAEKALISAESESEGNWCHEYRKLKAKIETIQKCHKHLMGEDLESLNPKELQQLEQQLDSSLKHIRSRKSHLMAESISELQKKERSLQEENKALQKELAERQKAVASRQQQVQWDQQTHAQAQTSSSSSSFMMRQDQQGLPPPHNICFPPLTMGDRGEELAAAAAAQQQQPLPGQAQPQLRIAGLPPWMLSHLNA

SEQ ID NO: 1164 - DNA, 1243 bp, Zea mays
  misc_feature (1)..(1243): Ceres Clone ID no. 100883955
  misc_feature (1)..(1243): Encodes the peptide sequence at SEQ ID NO. 1165
tccccctccgatccgtcgcggcagcgctcatcaccgctttaaatccgcctcctcccagcgtctccctcctcccggcctgtcccctcacctccctccccctatctctccaccgccgcagctagctgcgacgtcatgcactcgccggcgccaccgccaccgcatactatctacaattagccagccgtaggcttacctatcctgtgtcaagcaagcctctcgcaagcaacaaggaaggaagctagctagttttatagctgctgtcggcggcggcggctgaagcgacgtgcctgagctaggatttaggttgagatcaggagagggagaaggcggcggcgatggggcgcgggaaggtgcagctgaagcggatcgagaacaagatcaaccgccaggtgacattctccaagcgccgctcggggctactcaagaaggcgcacgagatctccgtgctctgcgacgccgaggtcgcgctcatcatcttctccaccaagggcaagctctacgagtactctaccgattcatgtatggacaaaattcttgaacggtatgagcgctactcctatgcagaaaaggttctcatttccgcagaatatgaaactcagggcaattggtggcatgaatatagaaaactaaaggcgaaggtcgagacaatacagaaatgtcaaaagcacctcatgggagaggatcttgaaactttgaatctcaaagagcttcagcaactagagcagcagctggagagttcactgaaacatatcagaacaaggaagagccagcttatggtcgagtcaatttcagcgctccaacggaaggagaagtcactgcaggaggagaacaaggttctgcagaaggagctcgcggagaagcagaaagaccagcggcagcaagtgcaacgggaccaaactcaacagcagaccagttcgtcttccacgtccttcatgttaagggaagctgccccaacaacaaatgtcagcatcttccctgtggcagcaggcgggagggtggtggaaggggcagcagcgcagccgcaggctcgcgttggactgccaccatggatgcttagccatctgagctgctgaaggtttgccctcaccgtcgcgatgtgatagcccaaaatccagcaagtcttccccggaccccggactgtccccgcttctccgcctggtgcagtatcgtcgtgatcgcgagaagcagcagcagcggtttgccgtattttttaccactgtgtataagtagcatatctgcaatg

SEQ ID NO: 1165 - protein, 245 aa, Zea mays
  misc_feature (75)..(174): Pfam Name: K-box Pfam Description: K-box region
  misc_feature (9)..(59): Pfam Name: SRF-TF Pfam Description: SRF-type transcription factor (DNA-binding
  misc_feature (1)..(245): Ceres Clone ID no. 100883955
  misc_feature (1)..(245): Bit score of 499.2 for HMM based on sequences of Figure 14
  misc_feature (1)..(245): Functional Homolog Of SEQ ID NO. 1112
MGRGKVQLKRIENKINRQVTFSKRRSGLLKKAHEISVLCDAEVALIIFSTKGKLYEYSTDSCMDKILERYERYSYAEKVLISAEYETQGNWWHEYRKLKAKVETIQKCQKHLMGEDLETLNLKELQQLEQQLESSLKHIRTRKSQLMVESISALQRKEKSLQEENKVLQKELAEKQKDQRQQVQRDQTQQQTSSSSTSFMLREAAPTTNVSIFPVAAGGRVVEGAAAQPQARVGLPPWMLSHLSC

SEQ ID NO: 1166 - protein, 276 aa, Hordeum vulgare subsp. vulgare
  misc_feature (75)..(174): Pfam Name: K-box Pfam Description: K-box region
  misc_feature (9)..(59): Pfam Name: SRF-TF Pfam Description: SRF-type transcription factor (DNA-binding
  misc_feature (1)..(276): Public GI ID no. 9367313
  misc_feature (1)..(276): Bit score of 469.1 for HMM based on sequences of Figure 14
  misc_feature (1)..(276): Functional Homolog Of SEQ ID NO. 1112
MGRGKVQLKRIENKINRQVTFSKRRNGLLKKAHEISVLCDAEVAVIVFSPKGKLYEYATDSSMDKILERYERYSYAEKALISAESESEGNWCHEYRKLKAKIETIQKCHKHLMGEDLDSLNLKELQQLEQQLESSLKHIRSRKSHLMMESISELQKKERSLQEENKALQKELVERQKAASRQQQLQQQQQQQQMQWEHQAQTQTHTHTQNQPQAQTSSSSSSFMMRDQQAHAPQQNICSYPPVTMGGEATAAAAAPEQQAQLRICLPPWMLSHLNA

SEQ ID NO: 1167 - protein, 274 aa, Triticum aestivum
  misc_feature (75)..(174): Pfam Name: K-box Pfam Description: K-box region
  misc_feature (9)..(59): Pfam Name: SRF-TF Pfam Description: SRF-type transcription factor (DNA-binding
  misc_feature (1)..(274): Public GI ID no. 95981890
  misc_feature (1)..(274): Bit score of 469.9 for HMM based on sequences of Figure 14
  misc_feature (1)..(274): Functional Homolog Of SEQ ID NO. 1112
MGRGKVQLKRIENKINRQVTFSKRRNGLLKKAHEISVLCDAEVAVIVFSPKGKLYEYATDSSMDKILERYERYSYAEKALISAESESEGNWCHEYRKLKAKIETIQKCHKHLMGEDLDSLNLKELQQLEQQLESSLKHIRSRKSHLMMESISELQKKERSLQEENKALQKELVERQKAAASRQQQQQQQQMQWEHQAQTQTHAHTQNQPQAQTSSSSSSFMMRDQQAHAPQQNICSYPPVTMGGEAAAAAAAPGQQAQLRIGGLPPWMLSHLNA

SEQ ID NO: 1168 - protein, 243 aa, Trochodendron aralioides
  misc_feature (75)..(174): Pfam Name: K-box Pfam Description: K-box region
  misc_feature (9)..(59): Pfam Name: SRF-TF Pfam Description: SRF-type transcription factor (DNA-binding
  misc_feature (1)..(243): Public GI ID no. 148540534
  misc_feature (1)..(243): Bit score of 547.8 for HMM based on sequences of Figure 14
  misc_feature (1)..(243): Functional Homolog Of SEQ ID NO. 1112
MGRGRVQLKRIENKINRQVTFSKRRSGLLKKAHEISVLCDAEVALIVFSTKGKLFEYSTDSSMERILERYERYSYAERELVAIDAESQGSWSLEYTKLKARFEVLQRNQRHFLGEDLGSLSLRELQNFEQQLDSALKLIRSRKSQLMYESISELQRKEKALQQQNNLLAEKLKEKKALAQQAHWEQGNQVQNPSTFLLPQSLPSLNISGTYQARGTGGEDEGSQPHNRTNTLMPPWMLRHMNE

SEQ ID NO: 1169 - protein, 255 aa, Malus x domestica
  misc_feature (75)..(174): Pfam Name: K-box Pfam Description: K-box region
  misc_feature (9)..(59): Pfam Name: SRF-TF Pfam Description: SRF-type transcription factor (DNA-binding
  misc_feature (1)..(255): Public GI ID no. 78127315
  misc_feature (1)..(255): Bit score of 529.0 for HMM based on sequences of Figure 14
  misc_feature (1)..(255): Functional Homolog Of SEQ ID NO. 1112
MGRGRVQLKRIENKINRQVTFSKRRSGLMKKAHEISVLCDAEVALIIFSTKGKLFEYSNDSCMERILERYERYSYTERQLLANDNESTGSWTLEHAKLKARVEVLQRNQRHYMGEDLQSLSLKELQNLEQQLDSALKHIRSRKNQVMYESISELQKKDKALQEQNNLLAKKVKEKENAVAQQAQLEHVQEQRLNSSSSLLPRALQSLNFGSGSNYQAIRSSEGIPGDNQQYGDETPTPHRPNMLLPAWMLRHLNE

SEQ ID NO: 1170 - protein, 255 aa, Malus x domestica
  misc_feature (75)..(174): Pfam Name: K-box Pfam Description: K-box region
  misc_feature (9)..(59): Pfam Name: SRF-TF Pfam Description: SRF-type transcription factor (DNA-binding
  misc_feature (1)..(255): Public GI ID no. 3947985
  misc_feature (1)..(255): Bit score of 517.3 for HMM based on sequences of Figure 14
  misc_feature (1)..(255): Functional Homolog Of SEQ ID NO. 1112
MGRGRVQLKRIENKINRQVTFSKRRSGLMKKAHEISVLCDAEVALIIFSTKGKLFEYSNDSCMERILERYERYSYTERQLLANDNESTGSWTLEHAKLKARVEVLQRNQRHYMGEDLQSLSLKELQNLEQQLDSALKHIRSRKNQVMYESISELQKKDKALQEQNNLLAKKVKEKENAVAQQAQLEHVQEQRLNSSSSLLPRALQSLNFGSGSNYQAIRSSEGIPGDNQQYGDETPTPHRPNMLLPAWIVRHLNE

SEQ ID NO: 1171 - protein, 261 aa, Lolium perenne
  misc_feature (75)..(174): Pfam Name: K-box Pfam Description: K-box region
  misc_feature (9)..(59): Pfam Name: SRF-TF Pfam Description: SRF-type transcription factor (DNA-binding
  misc_feature (1)..(261): Public GI ID no. 28630955
  misc_feature (1)..(261): Bit score of 462.7 for HMM based on sequences of Figure 14
  misc_feature (1)..(261): Functional Homolog Of SEQ ID NO. 1112
MGRGKVQLKRIENKINRQVTFSKRRNGLLKKAHEISVLCDAEVAVVVFSPKGKLYEYATDSSMDKILERYERYSYAEKALISAESESEGNWCHEYRKLKAKIETIQKCHKHLMGEDLECLNLKELQQLEQQLESSLKHIRSRKSHLMMESISELQKKERSLQEENKALQKELVERQKAARQQQQEQWDRQTQTQQAQNQPQAQTSSSSSSFMMRDQQAHAQQNICYPPVTMGGEAVAAAPGQQGQLRIGGLPPWMLSHLNA

SEQ ID NO: 1172 - protein, 261 aa, Lolium temulentum
  misc_feature (75)..(174): Pfam Name: K-box Pfam Description: K-box region
  misc_feature (9)..(59): Pfam Name: SRF-TF Pfam Description: SRF-type transcription factor (DNA-binding
  misc_feature (1)..(261): Public GI ID no. 4204234
  misc_feature (1)..(261): Bit score of 459.9 for HMM based on sequences of Figure 14
  misc_feature (1)..(261): Functional Homolog Of SEQ ID NO. 1112
MGRGKVQLKRIENKINRQVTFSKRRNGLLKKAHEISVLCDAEVAVVVFSPKGKLYEYATDSSMDKILERYERYSYAEKALISAESESEGNWCHEYRKLKAKIETIQKCHKHLMGEDLECLNLKELQQLEQQLESSLKHIRSRKSHLMMESISELQKKERSLQEENKALQKELVERQKAARQQQQEQWDRQTQTQQAQNQPQAQTSSSSSSFMMRDQQAHAQQNICYPLVTMGGEAVAAAPGQQGQLRIGGLPPWMLSHLNA

SEQ ID NO: 1173 - protein, 238 aa, Carica papaya
  misc_feature (76)..(175): Pfam Name: K-box Pfam Description: K-box region
  misc_feature (9)..(59): Pfam Name: SRF-TF Pfam Description: SRF-type transcription factor (DNA-binding
  misc_feature (1)..(238): Public GI ID no. 157674589
  misc_feature (1)..(238): Bit score of 496.9 for HMM based on sequences of Figure 14
  misc_feature (1)..(238): Functional Homolog Of SEQ ID NO. 1112
MGRGRVQLKRIENKINRQVTFSKRRSGLLKKAHEISVLCDAEVALIVFSTKGKLFEYSTDSCMERILERYERYSYTDQRQTVTNEIGPNGNWNLQYAKLKARIEVLQRNERHFLGEDLDSLSLKELQSLEHQLDSALKHVRSRKNQLMLESISELQKRDKALQEQNNALAKKVKEWEKELAQQAQITWEPHAPALHPSSNIRSYPPMSNGEDEEGNVAQQRATGSTLLPPWMLGQINE

SEQ ID NO: 1174 - protein, 255 aa, Prunus dulcis
  misc_feature (75)..(174): Pfam Name: K-box Pfam Description: K-box region
  misc_feature (9)..(59): Pfam Name: SRF-TF Pfam Description: SRF-type transcription factor (DNA-binding
  misc_feature (1)..(255): Public GI ID no. 63094571
  misc_feature (1)..(255): Bit score of 521.4 for HMM based on sequences of Figure 14
  misc_feature (1)..(255): Functional Homolog Of SEQ ID NO. 1112
MGRGRVQLKRIENKINRQVTFSKRRSGLLKKAQEISVLCDAEVALIVFSTKGKLFEYSTDSCMERILERYERYSYSEKQLLANDHESTGSWTLEHAKLKARVEVLQRNCSHFMGEDLQSLSLKELQNLEQQLDSAPKHIRSRKNQVMYESISELQKKDKALQEQNNLLAKKVKEKEKALAPQAESWEQQVQNQGLDCSSTLLPEALQSLNFGSGSNYQGIRNDGAGGDHEDENETPTASRPNTLLPPWMLRHLNE

SEQ ID NO: 1175 - protein, 245 aa, Houttuynia cordata
  misc_feature (75)..(174): Pfam Name: K-box Pfam Description: K-box region
  misc_feature (9)..(59): Pfam Name: SRF-TF Pfam Description: SRF-type transcription factor (DNA-binding
  misc_feature (1)..(245): Public GI ID no. 33342030
  misc_feature (1)..(245): Bit score of 488.6 for HMM based on sequences of Figure 14
  misc_feature (1)..(245): Functional Homolog Of SEQ ID NO. 1112
MGRGRVQMKRIENKINRQVTFSKRRMGLLKKAHEISVLCDADVALIVFSTKGKLYEYATDSSMTKILERYERYSFAEREFALADNESEGAWSLEFGKLKARVEALQKTHRHYLGEDLDSLKVKELQHLEQQLDSALKHVRLRKNQVIQETISELQKKEKALQEQNNMLEKKVQEKQKAKAQQTRWENQSQNQNSAPFLFSLPLPNLNMGTYHQENGTEIREQEAARPLAHSNSQMPAWMLRHASE

SEQ ID NO: 1176 - protein, 241 aa, Vitis vinifera
  misc_feature (75)..(174): Pfam Name: K-box Pfam Description: K-box region
  misc_feature (9)..(59): Pfam Name: SRF-TF Pfam Description: SRF-type transcription factor (DNA-binding
  misc_feature (1)..(241): Public GI ID no. 225423412
  misc_feature (1)..(241): Bit score of 510.6 for HMM based on sequences of Figure 14
  misc_feature (1)..(241): Functional Homolog Of SEQ ID NO. 1112
MGRGRVQLKRIENKINRQVTFSKRRTGLLKKAHEISVLCDAEVALIVFSTKGKLFEYSTDSCMEKILDRYERYSYAERQLTATDPESQGNWSLEYSKLKAKIELLQRSQRHFLGEDLDSLSLKELQNLEQQLDTALKHIRSRKNQLMYESISELQRKEKAMQEQNNMLAKEIKEKEKTVAQQTHWEQQNHGLNTSSFLLPQQLPCLNMGGTYQGEAHGARRNELDLTLEPIYPSHLGCFTT

SEQ ID NO: 1177 - protein, 245 aa, Sinofranchetia chinensis
  misc_feature (75)..(174): Pfam Name: K-box Pfam Description: K-box region
  misc_feature (9)..(59): Pfam Name: SRF-TF Pfam Description: SRF-type transcription factor (DNA-binding
  misc_feature (1)..(245): Public GI ID no. 110164939
  misc_feature (1)..(245): Bit score of 528.3 for HMM based on sequences of Figure 14
  misc_feature (1)..(245): Functional Homolog Of SEQ ID NO. 1112
MGRGRVQLKRIENKINRQVTFSKRKTGLLKKAHEISVLCDADVALIVFSTKGKLYEYSTESGMDRILEKYERYSYAERELVATDSESQGNWPLEYTKLKAKIEVLQKNQRHFMGQELNSMSFKELQNLEQQLDTALKQIRSKRNQLMNESISELQKKEKALQEQNNQLGKKLKEKEKTLAQLAHWEHPNQGQNSPSFLLSQTLPSLNIGGPSQTRGSGCEEERTRRPETRPNTLLPPWMLRHINQ

SEQ ID NO: 1178 - protein, 255 aa, Malus x domestica
  misc_feature (75)..(174): Pfam Name: K-box Pfam Description: K-box region
  misc_feature (9)..(59): Pfam Name: SRF-TF Pfam Description: SRF-type transcription factor (DNA-binding
  misc_feature (1)..(255): Public GI ID no. 78127313
  misc_feature (1)..(255): Bit score of 512.3 for HMM based on sequences of Figure 14
  misc_feature (1)..(255): Functional Homolog Of SEQ ID NO. 1112
MGRGRVQLKRIENKINRQVTFSKRTSGLLKKAHEISVLCDAEVALIVFSTKGKLFEYSTDSCMERILERYERYSHAERQLLANDNESTGNWTLEHAKLKARVEVLQRNQSHYMGEDLQILSFQELQNLEQQLDSALRRIRSRKNQVMYESISELQKKDKALQEQNNLLAKNVKEKEKAVTSQAQLDHAQKQSLDSSSTLLPQELQYLNFSRSNYHQAIRSSNGISGDNQQDGDETATPHRPNTLLPPWMLRHLNE

SEQ ID NO: 1179 - DNA, 813 bp, Sorghum bicolor
  misc_feature (1)..(813): Ceres Annot ID no. 8643934
  misc_feature (1)..(813): Encodes the peptide sequence at SEQ ID NO. 1180
atggggcgcggcaaggtgcagctcaagcggatagagaacaagataaaccggcaggtgaccttctccaagcgccgcaacgggctgctcaagaaggcgcacgagatctccgtcctctgcgacgccgaggtcgccgtcatcgtcttctcccccaagggcaagctctatgagtacgccaccgactcccgcatggacaaaattctcgaacgttatgagcgatattcctatgctgaaaaggctcttatttcagctgaatctgaaagtgagggaaactggtgccacgaatacaggaaactgaaggccaaaattgagaccattcaaaaatgccacaagcacctgatgggagaggatctagagtctttgaatcccaaagagctccaacaactagagcagcagctggagagctcactgaagcacatcagatcaagaaagagccaccttatggctgagtctatttctgaactacagaagaaggagaggtcactgcaggaggagaacaaggctctacagaaggaacttgcggagaggcagaaggcggccgcgagcaggcagcagcagcaggtgcagtgggaccagcagacacagacccaggcccagacaagctcatcatcgtcctccttcatgatgaggcaggatcagcagggtctgccgcctccacaaaacatatgcttcccgccgctgataatcggagagagaggtgaagaggtggctgcggcggcgcagcagcagcagccaccaccagggcaggcgcagcagcaagcgcagctccgcatcgcaggtctgccgccatggatgctgagccacctcaatgcataa

SEQ ID NO: 1180 - protein, 270 aa, Sorghum bicolor
  misc_feature (75)..(174): Pfam Name: K-box Pfam Description: K-box region
  misc_feature (9)..(59): Pfam Name: SRF-TF Pfam Description: SRF-type transcription factor (DNA-binding
  misc_feature (1)..(270): Ceres Annot ID no. 8643934
  misc_feature (1)..(270): Bit score of 457.4 for HMM based on sequences of Figure 14
  misc_feature (1)..(270): Functional Homolog Of SEQ ID NO. 1112
MGRGKVQLKRIENKINRQVTFSKRRNGLLKKAHEISVLCDAEVAVIVFSPKGKLYEYATDSRMDKILERYERYSYAEKALISAESESEGNWCHEYRKLKAKIETIQKCHKHLMGEDLESLNPKELQQLEQQLESSLKHIRSRKSHLMAESISELQKKERSLQEENKALQKELAERQKAAASRQQQQVQWDQQTQTQAQTSSSSSSFMMRQDQQGLPPPQNICFPPLIIGERGEEVAAAAQQQQPPPGQAQQQAQLRIAGLPPWMLSHLNA

SEQ ID NO: 1181 - protein, 245 aa, Ziziphus jujuba
  misc_feature (75)..(177): Pfam Name: K-box Pfam Description: K-box region
  misc_feature (9)..(59): Pfam Name: SRF-TF Pfam Description: SRF-type transcription factor (DNA-binding
  misc_feature (1)..(245): Public GI ID no. 196166890
  misc_feature (1)..(245): Bit score of 467.5 for HMM based on sequences of Figure 14
  misc_feature (1)..(245): Functional Homolog Of SEQ ID NO. 1112
MGRGRVQLKRIENKINRQVTFSKKRAGLLKKAHEISVLCDAEVALIVFSHKGKLFEYATDSCMEKILERYERYSYAERQLVASVSEPEAVQGNWTLEFSRLKAKIELLQRNRRHYFGEDLDSLNLKELQNLEQQLDTALKQIRSRKNQLMYNSISELQRKEKAMQEQNNLLAKEIKEKEKLVAQQMQWEQQNHCPASSSFLLPQPLPCLNIGGNYQEVEAPEMRRNELDLTLEPLYTCHLGCFAA

SEQ ID NO: 1182 - protein, 244 aa, Hordeum vulgare subsp. vulgare
  misc_feature (75)..(174): Pfam Name: K-box Pfam Description: K-box region
  misc_feature (9)..(59): Pfam Name: SRF-TF Pfam Description: SRF-type transcription factor (DNA-binding
  misc_feature (1)..(244): Public GI ID no. 9367309
  misc_feature (1)..(244): Bit score of 455.8 for HMM based on sequences of Figure 14
  misc_feature (1)..(244): Functional Homolog Of SEQ ID NO. 1112
MGRRKVQLKRIENKINRQVTFSKRRSGLLKKAHEISVLYDAEVGLIIFSTKGKLYEFSTESCMDKILERYERYSYAEKVLVSSESEIQGNWCHEYRKLKAKVETIQKCQKHLMGEDLESLNLKELQQLEQQLESSLKHIRARKNQLMHESISELQKKERSLQEENKVLQKELVEKQKAQAAQQDQTQPQTSSSSSSFMMRDAPPVADTSNHPAAAGERAEDVAVQPQVPLRTALPLWMVSHING

SEQ ID NO: 1183 - protein, 247 aa, Dendrobium grex Madame Thong-In
  misc_feature (75)..(174): Pfam Name: K-box Pfam Description: K-box region
  misc_feature (9)..(59): Pfam Name: SRF-TF Pfam Description: SRF-type transcription factor (DNA-binding
  misc_feature (1)..(247): Public GI ID no. 6467974
  misc_feature (1)..(247): Bit score of 524.1 for HMM based on sequences of Figure 14
  misc_feature (1)..(247): Functional Homolog Of SEQ ID NO. 1112
MGRGRVQLKRIENKINRQVTFSKRRSGLLKKAHEISVLCDAEVALIVFSNKGKLYEYSTDSSMEKILERYERYSYAERALFSNEANPQADWRLEYNKLKARVESLQKSQRHLMGEQLDSLSIKELQRLEQQLESSLKFIRSRKTQLILHSISELQKMEKILLEQNKTLEKEIIAKEKAKALVQHAPWEKQNQSQYSSALPPVISDSVPTPTSRTFQARANEEESPQPQLRVSNTLLPPWMLSHMNGQ

SEQ ID NO: 1184 - protein, 239 aa, Persea americana
  misc_feature (75)..(174): Pfam Name: K-box Pfam Description: K-box region
  misc_feature (9)..(59): Pfam Name: SRF-TF Pfam Description: SRF-type transcription factor (DNA-binding
  misc_feature (1)..(239): Public GI ID no. 89152252
  misc_feature (1)..(239): Bit score of 505.2 for HMM based on sequences of Figure 14
  misc_feature (1)..(239): Functional Homolog Of SEQ ID NO. 1112
MGRGRVQLKRIENKINRQVTFSKRRMGLLKKAHEISVLCDAEVALIIFSTKGKLYEYATDSSMSKILERYERYSYAERELVLPGQASEGNWCQEYGKLKARVEALQRNLRHFMGEDLDSLSVRELQQLEQQLDVALRHVRSRKIQVMFDSISELQTKEKALQEQNIMLEKKLQEKEKAAAQQAHRHSPSLLLPTPLPTLNIGSYTHSSSVGVAAEEEVGARPLARTNSLVPPWMLRHIN

SEQ ID NO: 1185 - protein, 242 aa, Daucus carota subsp. sativus
  misc_feature (75)..(174): Pfam Name: K-box Pfam Description: K-box region
  misc_feature (9)..(59): Pfam Name: SRF-TF Pfam Description: SRF-type transcription factor (DNA-binding
  misc_feature (1)..(242): Public GI ID no. 22091473
  misc_feature (1)..(242): Bit score of 463.4 for HMM based on sequences of Figure 14
  misc_feature (1)..(242): Functional Homolog Of SEQ ID NO. 1112
MGRGKVQLKRIENKINRQVTFSKRRGGLLKKAHEISVLCDAEVALIVFSNKGKLFEYSTDSSMEEILERYERYSYAERQVIANDPESTGNWTLEYTKLKARIDLLQRDHRHYMGEDLDSLTLKEIQNLEQQLDTALKHIRSRKNQLIFESISDLQKKEKAIQEENGKLTKKIKEREKTMVQQAQWEKQNPSPNLSTFLMPQENPFLNIGGTFQGESSQGMTRNDLDLTLEPNHYPCNLRCFA

SEQ ID NO: 1186 - protein, 246 aa, Petunia x hybrida
  misc_feature (75)..(174): Pfam Name: K-box Pfam Description: K-box region
  misc_feature (9)..(59): Pfam Name: SRF-TF Pfam Description: SRF-type transcription factor (DNA-binding
  misc_feature (1)..(246): Public GI ID no. 6634708
  misc_feature (1)..(246): Bit score of 544.4 for HMM based on sequences of Figure 14
  misc_feature (1)..(246): Functional Homolog Of SEQ ID NO. 1112
MGRGRVQMKRIENKINRQVTFSKRRSGLLKKAHEISVLCDAEVGLIVFSTKGKLFEYATDSCMERILERYERYSYAERQLVSTDHSSPGSWNLEHAKLKARIEVVQRNQRHYMGEDLDSLSMKDLQNLEQQLDSSLKHIRSRKNQLMHESISELQKKDKSLQEQNNLLSKKVKEREKELAQQTQWEQQNNHHEINSSSSFVLPQPLDSPHLGEAYQSTVDNGEVEGASQQQPANTMPPWMLRHLNG

SEQ ID NO: 1187 - protein, 244 aa, Betula pendula
  misc_feature (75)..(174): Pfam Name: K-box Pfam Description: K-box region
  misc_feature (9)..(59): Pfam Name: SRF-TF Pfam Description: SRF-type transcription factor (DNA-binding
  misc_feature (1)..(244): Public GI ID no. 1483232
  misc_feature (1)..(244): Bit score of 584.0 for HMM based on sequences of Figure 14
  misc_feature (1)..(244): Functional Homolog Of SEQ ID NO. 1112
MGRGRVQLKRIENKINRQVTFSKRRSGLLKKAHEISVLCDAEVALIVFSTKGKLFEYSTDSCMERILERYERYSYADRQLLANDLEQNGSWTLEHAKLKARIEVLQRNQKHFVGEDLDSLSLKELQNLEQQLDSALKHIRSRKNQLMYESISELQRKDKALQEQNNVLAKKVKEKEKELAQQAQWEQQSHTLDSVPSLLPQPLQSSLNIGGSQQARGNGRVDEGTPPHRANALLPPWMLRHLNQ

SEQ ID NO: 1188 - protein, 244 aa, Crocus sativus
  misc_feature (75)..(174): Pfam Name: K-box Pfam Description: K-box region
  misc_feature (9)..(59): Pfam Name: SRF-TF Pfam Description: SRF-type transcription factor (DNA-binding
  misc_feature (1)..(244): Public GI ID no. 33391153
  misc_feature (1)..(244): Bit score of 458.6 for HMM based on sequences of Figure 14
  misc_feature (1)..(244): Functional Homolog Of SEQ ID NO. 1112
MGRGRVELKRIENTINRQVTFSKRRGGLLKKANEISVLCDADVAIIIFSTKGKLSEYSTDARMESILERYDRYSCAERDIVAPDPDSQESWRDEYGRLKAKLEALQTSQRHLMGAQLDMLSAKELQQLEQQLENALKNIRSRKNQLLFDSISELLKKEKTLTTQNKDMEMKLIEKKKVKSMARQGQQYTESSSPPSLLIQDPFPSLTIGINPASGSSEEDNEARLLPPVNRNRLPPWMVRSANE

SEQ ID NO: 1189 - DNA, 1202 bp, Glycine max
  misc_feature (1)..(1202): Ceres Clone ID no. 467075
  misc_feature (1)..(1202): Encodes the peptide sequence at SEQ ID NO. 1190
gacagaaagaagaaccaccaagaaagaagcataggggaaaatacatcgatagagagaaattgaagggtgctacgtccttctattgtattaatgattgaaattcgtgtgggaattgtcttgttggtgtggtagagataataagagaggatcatagtagtgctagaaattgaagtgtgtaatagaatagtgatagagagagagagatatggggagaggaagggtgcagttgaagaggatcgagaacaagatcaataggcaagtgacgttctcaaagagaaggtctggtttgctcaagaaagcacatgagatctctgtgcattgtgatgctgaagtggccctcatagtcttctccaccaaaggcaaactctttgagtactccagcgatccctgtatggaaaaaattcttgaacggtatgagaggtattcatatgcagagaggcagcttgttgcaagtgatcaaccactaactgaaaattggactctggaacatgcaaagctgaaagcaaggttggaagtcctacagaaaaatcaaagggtttgcctgttattttgcaggaattttatgggacaagatttggagggcctaagtatcaaagagcttcagaatttggagcatcagcttgaaagtgctctcaaacacattagatcacggaagaaccaactgatgtatgaatctatttcagagcttcataaaaaggataaggccctacaagaacaaaacaacactctcgctaagaagataaaggagaaagagaaggcactagcccaacaggcacaactggagcgacttggtgatgaagtggatctgacttcctctgcccttgttccccaaccactggtgacatcaaacattagaacctcctcacaaatcagaggtgaaggagataacgaaggaaccccaactccaacccaagctaatgccattcttccaccttggatgcttcgtcctacaaatgaatagaatactatttaattaatgacataaagttttaatcaaattaaatatgaatatggccaatacaaagctcaccctacaagatgtaaaatggtctagtgtgttgatttgggaatggcacccggtgacttgatcagttggaatatcaacgatatgtaatatgtctgtgactaccacatttcaaggatgcttagtaaattatatggtatggcctgtctatacaggcctacaatacatatatagtgtc

SEQ ID NO: 1190 - protein, 251 aa, Glycine max
  misc_feature (75)..(181): Pfam Name: K-box Pfam Description: K-box region
  misc_feature (9)..(59): Pfam Name: SRF-TF Pfam Description: SRF-type transcription factor (DNA-binding
  misc_feature (1)..(251): Ceres Clone ID no. 467075
  misc_feature (1)..(251): Bit score of 589.5 for HMM based on sequences of Figure 14
  misc_feature (1)..(251): Functional Homolog Of SEQ ID NO. 1112
MGRGRVQLKRIENKINRQVTFSKRRSGLLKKAHEISVHCDAEVALIVFSTKGKLFEYSSDPCMEKILERYERYSYAERQLVASDQPLTENWTLEHAKLKARLEVLQKNQRVCLLFCRNFMGQDLEGLSIKELQNLEHQLESALKHIRSRKNQLMYESISELHKKDKALQEQNNTLAKKIKEKEKALAQQAQLERLGDEVDLTSSALVPQPLVTSNIRTSSQIRGEGDNEGTPTPTQANAILPPWMLRPTNE

SEQ ID NO: 1191 - protein, 245 aa, Nicotiana sylvestris
  misc_feature (75)..(174): Pfam Name: K-box Pfam Description: K-box region
  misc_feature (9)..(59): Pfam Name: SRF-TF Pfam Description: SRF-type transcription factor (DNA-binding
  misc_feature (1)..(245): Public GI ID no. 5070142
  misc_feature (1)..(245): Bit score of 543.9 for HMM based on sequences of Figure 14
  misc_feature (1)..(245): Functional Homolog Of SEQ ID NO. 1112
MGRGRVQLKRIENKINRQVTFSKRASGLLKKAHEISVLCDAEVGLIVFSTKGKLFEYSTDSCMERILERYERYSYAERQLTATDDETPGSWTLEHAKLKARLEVLQRNQRHYAGEDLDSLSMKELQNLEHQLDSALKHIRSRKNQLMHESISELQKKDKALQEQNNNLSKQVKEREKELAQQTQWEQQSHDHLNSSSFVLTQPLSSLHLGEAYPTAGDNGEVEGSSRQQQQNTVMPPWMLRHLNG

SEQ ID NO: 1192 - DNA, 1241 bp, Glycine max
  misc_feature (1)..(1241): Ceres Clone ID no. 480529
  misc_feature (1)..(1241): Encodes the peptide sequence at SEQ ID NO. 1193
tattaatgattgaaattcgtgtgggaattgtcttgttggtgtggtagagataataagagaggatcatagtagtgctagaaattgaagtgtgtaatagaatagtgatagagagagagagatatggggagaggaagggtgcagttgaagaggatcgagaacaagatcaataggcaagtgacgttctcaaagagaaggtctggtttgctcamgaaagcacatgagatctctgtgcmttgtgatgctgaagtggccctcatagtcttctccaccaaaggcaaactctttgagtactccagcgatccctgtatggaaaaaattcttgaacggtatgagaggtattcatatgcasagaggcagcttgttgcaagtgatcaaccactaactgaaaattggactctggaacatgcaaagctgaaagcaaggttggaagtcctacagaaaaatcaaaggaattttatggsacaagatttggagggcctaagtatcaaasagcttcagaatttggagcatcagcttgaaagtgctctcaaacacattagatcacggaagaaccaactgatgtatgaatctatttcagagcttcataaaaaggataaggccctacaagaacaaaacaacactctcgctaagaagataaaggagaaagagaaggcactagcccaacaggcacaactggagcgacttggtgatgaagtggatctgacttcctctgcccttgttccccaaccactggtgacatcaaacattagaacctcctcacaaatcagaggtgaaggagataacgaaggaaccccaactccaacccaagctaatgccattcttccaccttggatgcttcgtcctacaaatgaatagaatactatttaattaatgacataaagttttaatcaaattaaatatgaatatggccaatacaaagctcaccctacaagatgtaaaatggtctagtgtgttgatttgggaatggcacccggtgacttgatcagttggaatatcaacgatatgtaatatgtctgtgactaccacatttcaaggatgcttagtaaattatatggtatggcctgtctatacaggcctacaatacatatatagtgtcaattatgtatgtttggttcttatcaaaagtttaagttgtgctagaaactacgatattgggcgatgttagatccctcaaaatctatgattttttacaacagaaatattaaattttgtatgaactaatggttttatctaagtgttac

SEQ ID NO: 1193 - protein, 244 aa, Glycine max
  misc_feature (75)..(174): Pfam Name: K-box Pfam Description: K-box region
  misc_feature (9)..(59): Pfam Name: SRF-TF Pfam Description: SRF-type transcription factor (DNA-binding
  misc_feature (1)..(244): Ceres Clone ID no. 480529
  misc_feature (1)..(244): Bit score of 582.8 for HMM based on sequences of Figure 14
  misc_feature (1)..(244): Functional Homolog Of SEQ ID NO. 1112
  misc_feature (30)..(30): Xaa is any aa, unknown, or other
  misc_feature (38)..(38): Xaa is any aa, unknown, or other
  misc_feature (77)..(77): Xaa is any aa, unknown, or other
  misc_feature (114)..(114): Xaa is any aa, unknown, or other
  misc_feature (124)..(124): Xaa is any aa, unknown, or other
MGRGRVQLKRIENKINRQVTFSKRRSGLLXKAHEISVXCDAEVALIVFSTKGKLFEYSSDPCMEKILERYERYSYAXRQLVASDQPLTENWTLEHAKLKARLEVLQKNQRNFMXQDLEGLSIKXLQNLEHQLESALKHIRSRKNQLMYESISELHKKDKALQEQNNTLAKKIKEKEKALAQQAQLERLGDEVDLTSSALVPQPLVTSNIRTSSQIRGEGDNEGTPTPTQANAILPPWMLRPTNE

SEQ ID NO: 1194 - protein, 245 aa, Nicotiana tabacum
  misc_feature (75)..(174): Pfam Name: K-box Pfam Description: K-box region
  misc_feature (9)..(59): Pfam Name: SRF-TF Pfam Description: SRF-type transcription factor (DNA-binding
  misc_feature (1)..(245): Public GI ID no. 27373049
  misc_feature (1)..(245): Bit score of 544.1 for HMM based on sequences of Figure 14
  misc_feature (1)..(245): Functional Homolog Of SEQ ID NO. 1112
MGRGRVQLKRIENKINRQVTFSKRRSGLLKKAHEISVLCDAEVGLIVFSTKGKLFEYSTDSCMERILERYERYSYAERQLTATDHETPGSWTLEHAKLKARFEVLQRNQRHYAGEDLDSLSMKELQNLEHQVDSALKHIRSRKNQLMHESISELQKKDKALQEQNNKLSKQVKEREKELAQQTQWEQQSHDHLNSSTFVLSQPLSSLHLGEAYSTAGDNGEVEGSSRQQQQNTVMPPWMLRHLNN

SEQ ID NO: 1195 - protein, 250 aa, Hydrangea macrophylla
  misc_feature (75)..(174): Pfam Name: K-box Pfam Description: K-box region
  misc_feature (9)..(59): Pfam Name: SRF-TF Pfam Description: SRF-type transcription factor (DNA-binding
  misc_feature (1)..(250): Public GI ID no. 197244651
  misc_feature (1)..(250): Bit score of 527.8 for HMM based on sequences of Figure 14
  misc_feature (1)..(250): Functional Homolog Of SEQ ID NO. 1112
MGRGRVQLKRIENKINRQVTFSKRRSGLLKKAHEISVLCDAEVALIVFSTKGKLFEYATDTCMERILERYERYSYSERQLKATDLESQGSWTLEHAKLKARVEVLQRSQRHYMGEDLDTLGLKELQNLEHQIDNALKHMRTRKNQLMYESISALQKKDKGLQEHNNLLAKKVKEKKKENEKEMAQQTQWDQHQSHGLNSSPFILSQPLHSLNIGGGCQEGTSGEVEGTPNQLDDQTNTVMPAWMLHHISG

SEQ ID NO: 1196 - protein, 241 aa, Lotus japonicus
  misc_feature (75)..(174): Pfam Name: K-box Pfam Description: K-box region
  misc_feature (9)..(59): Pfam Name: SRF-TF Pfam Description: SRF-type transcription factor (DNA-binding
  misc_feature (1)..(241): Public GI ID no. 60100338
  misc_feature (1)..(241): Bit score of 467.3 for HMM based on sequences of Figure 14
  misc_feature (1)..(241): Functional Homolog Of SEQ ID NO. 1112
MGRGRVQLKRIENKINRQVTFSKRRAGLLKKAHEISVLCDAEVALIVFSHKGKLFEYATDSCMEKILERYERYAYAERQLVANDSESQGNWTIEYTRLKAKIDLLQRNHRHYMGEDLGSMSLKELQSLEQQLDTALKHIRTRRNQLMYESISELQKKEKVIQEQNNMLAKKIKEKEKIAAQQQHAQWDHPNHGVNAPFLMQQPLPTLNMGGNYREDHAPDVGRNELDLTLEPLYSCHLGCF

SEQ ID NO: 1197 - protein, 247 aa, Capsicum annuum
  misc_feature (75)..(174): Pfam Name: K-box Pfam Description: K-box region
  misc_feature (9)..(59): Pfam Name: SRF-TF Pfam Description: SRF-type transcription factor (DNA-binding
  misc_feature (1)..(247): Public GI ID no. 14518447
  misc_feature (1)..(247): Bit score of 543.5 for HMM based on sequences of Figure 14
  misc_feature (1)..(247): Functional Homolog Of SEQ ID NO. 1112
MGRGRVQLRRIENKINRQVTFSKRRSGLLKKAHEISVLCDAEVGLIVFSSKGKLFEYSTDSCMERILERYERYSYAERQLNATDVETPGSWTLEHAKLKARLEVLQRNQRHYAGEDLDSLSMKELQNLEQQLDSALKHIRSRKNQLMHESISELQKKDKALQEQNNNLSKQMKEREKQLAQQHTPWEQQNHDHLNSSSFGLPHPFNNNHLGEVYPTAGDNGEVEGSSRQQQQNAAVMPPWMLRHLNG

SEQ ID NO: 1198 - protein, 248 aa, Antirrhinum majus
  misc_feature (75)..(174): Pfam Name: K-box Pfam Description: K-box region
  misc_feature (9)..(59): Pfam Name: SRF-TF Pfam Description: SRF-type transcription factor (DNA-binding
  misc_feature (1)..(248): Public GI ID no. 16052
  misc_feature (1)..(248): Bit score of 449.3 for HMM based on sequences of Figure 14
  misc_feature (1)..(248): Functional Homolog Of SEQ ID NO. 1112
MGRGKVQLKRIENKINRQVTFSKRRGGLLKKAHELSVLCDAEVALIVFSNKGKLFEYSTDSCMDRILEKYERYSFAERQLVSNEPQSPANWTLEYSKLKARIELLQRNHRHYMGEDLDSMSLKEIQSLEQQLDTALKNIRTRKNQLLYDSISELQHKEKAIQEQNTMLAKKIKEKEKEIAQQPQWEHHRHHTNASIMPPPPQYSMAPQFPCINVGNTYEGEGANEDRRNELDLTLDSLYSCHLGCFAA

SEQ ID NO: 1199 - protein, 245 aa, Nicotiana tabacum
  misc_feature (75)..(174): Pfam Name: K-box Pfam Description: K-box region
  misc_feature (9)..(59): Pfam Name: SRF-TF Pfam Description: SRF-type transcription factor (DNA-binding
  misc_feature (1)..(245): Public GI ID no. 4102111
  misc_feature (1)..(245): Bit score of 535.7 for HMM based on sequences of Figure 14
  misc_feature (1)..(245): Functional Homolog Of SEQ ID NO. 1112
MGRGRVQLKRIENKINRQVTFSKRRSGLLKKAHEISVLCDAEVGLIVFSTKGKLFEYSTDSCMERILERYERYSYAERQLTATDHETPGSWTLEHAKLKGRLEVLQRNQGHYAGEDLDSLCMKELQNLEHQLDSALKHIRSRKNQLMHESISELQKKDEALQEQNNNLSKQVKEGEKELAQQTQWEQQSHDHLNSSSFVLTQPLSSLHLGEAYPTAGDNGELEGSSRQQQQNTVMPPWMLRHLNG

SEQ ID NO: 1200 - protein, 250 aa, Solanum tuberosum
  misc_feature (75)..(174): Pfam Name: K-box Pfam Description: K-box region
  misc_feature (9)..(59): Pfam Name: SRF-TF Pfam Description: SRF-type transcription factor (DNA-binding
  misc_feature (1)..(250): Public GI ID no. 3913001
  misc_feature (1)..(250): Bit score of 493.3 for HMM based on sequences of Figure 14
  misc_feature (1)..(250): Functional Homolog Of SEQ ID NO. 1112
MGRGRVQLKRIENKINRQVTFSKRRSGLLKKAHEISVLCDAEVGLIVFSTKGKLFEYANDSCMERLLERYERYSFAERQLVPTDHTSPGSWTLEHAKLKARLEVLQRNQKHYVGEDLESLNMKELQNLEHQLDSALKHIRSRKNQLMHESISVLQKQDRALQEQNNQLSKKVKEREKEVAQQNQWDQQNHEINSSTFVLPQQLDSPHLGEAYQNTNVVDNGEVEGGNSSQQQGAANNTVMPQWMLRHLNG

SEQ ID NO: 1201 - protein, 248 aa, Misopates orontium
  misc_feature (75)..(174): Pfam Name: K-box Pfam Description: K-box region
  misc_feature (9)..(59): Pfam Name: SRF-TF Pfam Description: SRF-type transcription factor (DNA-binding
  misc_feature (1)..(248): Public GI ID no. 82734203
  misc_feature (1)..(248): Bit score of 457.8 for HMM based on sequences of Figure 14
  misc_feature (1)..(248): Functional Homolog Of SEQ ID NO. 1112
MGRGKVQLKRIENKINRQVTFSKRRGGLLKKAHEISVLCDAEVALIVFSNKGKLFEYSTDSCMDRILEKYERYSFAERQLVSNEPQSPANWTLEYSKLKARIELLQRNHRHYMGEDLDSMSLKELQSLEQQLDTALKNIRSRKNQLLYDSISDLQRKEKAIQEQNTMLAKKIKEKEKELAQQPQWEHHRHHTNASIMPPPPQYSMAPQFPCINVGNTYEGEGANEDRRNELDLTLDSLYSCHLGCFAA

SEQ ID NO: 1202 - protein, 244 aa, Nicotiana tabacum
  misc_feature (75)..(175): Pfam Name: K-box Pfam Description: K-box region
  misc_feature (9)..(59): Pfam Name: SRF-TF Pfam Description: SRF-type transcription factor (DNA-binding
  misc_feature (1)..(244): Public GI ID no. 106636058
  misc_feature (1)..(244): Bit score of 518.2 for HMM based on sequences of Figure 14
  misc_feature (1)..(244): Functional Homolog Of SEQ ID NO. 1112
MGRGRVQLKRIENKINRQVTFSKRRSGLLKKAHEISVLCDAEVGLIVFSTKGKLFEYATDSCMERILERYERYSYAERQLVATTDHSCPGSWTLEHAKLKARLEVLQRNQRHYTGEDLDSLSTKELQNLEHQLDSALKHIRSSKNQLMHESISELQKKDKALQEQNNQLCKKVKEREKELAQQNQREQQNQELNSPSFIFQQQLDSPNLGEAYQSTAEENGEVEGGSQQQTANTVMPPWMIRHL

SEQ ID NO: 1203 - DNA, 729 bp, Arabidopsis thaliana
  misc_feature (1)..(729): Ceres Annot ID no. 857111
  misc_feature (1)..(729): Encodes the peptide sequence at SEQ ID NO. 1204
atgggaagaggtagggttcagctgaagaggatagagaacaagatcaataggcaagttactttctcaaagagaaggtctggtttgctcaagaaagctcatgagatctctgttctctgcgatgctgaggttgctctcatcgtcttctcttccaaaggcaaactcttcgaatattccaccgactcttgcatggagaggatacttgaacgctatgatcgctatttatattcagacaaacaacttgttggccgagacgtttcacaaagtgaaaattgggttctagaacatgctaagctcaaggcaagagttgaggtacttgagaagaacaaaaggaattttatgggggaagatcttgattcgttgagcttgaaggagctccaaagcttggagcatcagctcgatgcagctatcaagagcattaggtcaagaaagaaccaagctatgttcgaatccatatctgcgctccagaagaaggataaagccttgcaagatcacaacaattcgcttctcaaaaagattaaggagagggagaagaaaacgggtcagcaagaaggacaattagtccaatgctccaactcttcttcagttcttctgcctcaatactgcgtaacctcctccagagatggctttgtggagagagttgggggagagaacggtggtgcatcgtcgttgacggaaccaaactctctgcttccggcttggatgttacgtcctaccactacgaacgagtag

SEQ ID NO: 1204 - protein, 242 aa, Arabidopsis thaliana
  misc_feature (75)..(174): Pfam Name: K-box Pfam Description: K-box region
  misc_feature (9)..(59): Pfam Name: SRF-TF Pfam Description: SRF-type transcription factor (DNA-binding
  misc_feature (1)..(242): Ceres Annot ID no. 857111
  misc_feature (1)..(242): Bit score of 463.8 for HMM based on sequences of Figure 14
  misc_feature (1)..(242): Functional Homolog Of SEQ ID NO. 1112
MGRGRVQLKRIENKINRQVTFSKRRSGLLKKAHEISVLCDAEVALIVFSSKGKLFEYSTDSCMERILERYDRYLYSDKQLVGRDVSQSENWVLEHAKLKARVEVLEKNKRNFMGEDLDSLSLKELQSLEHQLDAAIKSIRSRKNQAMFESISALQKKDKALQDHNNSLLKKIKEREKKTGQQEGQLVQCSNSSSVLLPQYCVTSSRDGFVERVGGENGGASSLTEPNSLLPAWMLRPTTTNE

SEQ ID NO: 1205 - protein, 240 aa, Magnolia praecocissima
  misc_feature (9)..(59): Pfam Name: SRF-TF Pfam Description: SRF-type transcription factor (DNA-binding
  misc_feature (75)..(172): Pfam Name: K-box Pfam Description: K-box region
  misc_feature (1)..(240): Public GI ID no. 16549085
  misc_feature (1)..(240): Bit score of 478.0 for HMM based on sequences of Figure 14
  misc_feature (1)..(240): Functional Homolog Of SEQ ID NO. 1112
MGRGRVQLKRIENKINRQVTFSKRRMGLLKKAHEISVLCDAEVAVIVFSTKGKLYEYSTDSRMSRILERYERYSYAERELVLSGPESEGSWCLEYGKLKAKVESLQRNLRHFTGEDLDTLSLKELQQLEHQLDAALKHIRSRRPIMLIHCGASKKEKSLREQNNMLEKEIQEKEKAMAQQAQWEQQNQSQSSHPSWLASPLPTLNIGTYHQGNEVEEEGARPPARTNSLMPPWMLRHVNE

SEQ ID NO: 1206 - protein, 257 aa, Silene latifolia subsp. alba
  misc_feature (75)..(174): Pfam Name: K-box Pfam Description: K-box region
  misc_feature (9)..(59): Pfam Name: SRF-TF Pfam Description: SRF-type transcription factor (DNA-binding
  misc_feature (1)..(257): Public GI ID no. 602908
  misc_feature (1)..(257): Bit score of 495.5 for HMM based on sequences of Figure 14
  misc_feature (1)..(257): Functional Homolog Of SEQ ID NO. 1112
MGRGRVQLKRIENKINRQVTFSKRRTGLLKKAHEISVLCDADVGLIVFSTKGKLFEYATDSCMEKILERYERYSYAERQLTAPDPDSHVSWTLEHAKLKARLEILQKNHRHYMGEDLDTLSLKELQNFEHQLDTALKHIRSKKNQLMYESIHELQKKDKALQEHNNTLSKKVKEKEKEKEKEKAIADQQAQWVQQNQELNPSAFFSSQVLPALNIRGNYETGSSVIVNEVAQTQNRSNSSNNNSLVPSWMLNHLAEQ

SEQ ID NO: 1207 - protein, 245 aa, Petunia x hybrida
  misc_feature (75)..(175): Pfam Name: K-box Pfam Description: K-box region
  misc_feature (9)..(59): Pfam Name: SRF-TF Pfam Description: SRF-type transcription factor (DNA-binding
  misc_feature (1)..(245): Public GI ID no. 6606306
  misc_feature (1)..(245): Bit score of 523.4 for HMM based on sequences of Figure 14
  misc_feature (1)..(245): Functional Homolog Of SEQ ID NO. 1112
MGRGRVQLKRIENKINRQVTFSKRRSGLLRKAHEISVLCDAEVGLIVFSTKGKLFEYSTDSCMERILERYERYSYAERQLSGATDNDTPGSWTLEHAKLKARLEVLQRNQKHYAGEDLDSLSMKELQNLEQQLDSALKQIRSRKNQLMHESISELQKKDKALQEQNNKLSKQVKEREKELAQQSQWEPQSHDLNSSSFVLSQPLNSLHLGEAYPSAGDNGEVEGSSRQQPPNTVMPPWMLRHLNG

SEQ ID NO: 1208 - DNA, 1128 bp, Arabidopsis thaliana
  misc_feature (1)..(1128): Ceres Clone ID no. 25591
  misc_feature (1)..(1128): Encodes the peptide sequence at SEQ ID NO. 1209
acattcatcaacacaaaagatacccagagagacataagaaagaaagagagagagagatactttggtcatttcagggttgtcgtttctctctcttgttcttgagattttgaagagagagagatatgggaagaggtagggttcagctgaagaggatagagaacaagatcaataggcaagttactttctcaaagagaaggtctggtttgctcaagaaagctcatgagatctctgttctctgcgatgctgaggttgctctcatcgtcttctcttccaaaggcaaactcttcgaatattccaccgactcttgcatggagaggatacttgaacgctatgatcgctatttatattcagacaaacaacttgttggccgagacgtttcacaaagtgaaaattgggttctasaacatgctaagctcaaggcaagagttgaggtacttgagaagaacaaaaggamttttatgggggaagatcttgattcgttgagcttgaaggagcttcaaagcttggagcatcagctcgatgcagctatcaagagcattaggtcaagaaagaaccaagctatgttcgaatccatatctgcgctccagaagaaggataaagccttgcaagatcacaacaattcgcttctcaaaaagattaaggagagggagaagaaaacgggtcagcaagaaggacaattagtccaatgctccaactcttcttcagttcttctgcctcaatactgcgtaacctcctccagagatggctttgtggagagagttgggggagagaacggtggtgcatcgtcgttgacggaaccaaactctctgcttccggcttggatgttacgtcctaccactacgaacgagtagaactatctcactctttataatataatgataatataattaatgtttaatattttcataacattcagcatttttttggtgacttatactcattactaataccgatatgttttagctagtcatattatatgtatgatggaactccgttgtcgagacgtatgtacgtaagctatcattagattcactgcgtcttaagaacaaagattcatatcttggtaatgatttctcatgaataattaatgtaacttttactttttaaaaaaaaaaagcaaactaaatt

SEQ ID NO: 1209 - protein, 242 aa, Arabidopsis thaliana
  misc_feature (75)..(174): Pfam Name: K-box Pfam Description: K-box region
  misc_feature (9)..(59): Pfam Name: SRF-TF Pfam Description: SRF-type transcription factor (DNA-binding
  misc_feature (1)..(242): Ceres Clone ID no. 25591
  misc_feature (1)..(242): Bit score of 454.5 for HMM based on sequences of Figure 14
  misc_feature (1)..(242): Functional Homolog Of SEQ ID NO. 1112
  misc_feature (94)..(94): Xaa is any aa, unknown, or other
  misc_feature (111)..(111): Xaa is any aa, unknown, or other
MGRGRVQLKRIENKINRQVTFSKRRSGLLKKAHEISVLCDAEVALIVFSSKGKLFEYSTDSCMERILERYDRYLYSDKQLVGRDVSQSENWVLXHAKLKARVEVLEKNKRXFMGEDLDSLSLKELQSLEHQLDAAIKSIRSRKNQAMFESISALQKKDKALQDHNNSLLKKIKEREKKTGQQEGQLVQCSNSSSVLLPQYCVTSSRDGFVERVGGENGGASSLTEPNSLLPAWMLRPTTTNE

SEQ ID NO: 1210 - protein, 242 aa, Castanea mollissima
  misc_feature (74)..(173): Pfam Name: K-box Pfam Description: K-box region
  misc_feature (9)..(58): Pfam Name: SRF-TF Pfam Description: SRF-type transcription factor (DNA-binding
  misc_feature (1)..(242): Public GI ID no. 73537279
  misc_feature (1)..(242): Bit score of 451.4 for HMM based on sequences of Figure 14
  misc_feature (1)..(242): Functional Homolog Of SEQ ID NO. 1112
MGRGRVQLKRIENKYRQVTYSKRRSGLLKKAHEISVLCDAEVALIVFSTKGKLFEYSSDSSMETILERYERYSFAERQLVATDSESQGGWCMEFPKLTARVEVLQRNIRNFMGEDLDPLSFRELQNLEQQIDAGLKRIRTRKNQLMHESVMELQKKEKSLQEQNSVLAKKLKENEKNIPEQAHQEQPSLGLLSLPQQPMPSTLSLPSLTIGGAFQERAVDEDAGVQTRPTLMPPWMLRHVNG

SEQ ID NO: 1211 - protein, 250 aa, Zea mays
  misc_feature (11)..(61): Pfam Name: SRF-TF Pfam Description: SRF-type transcription factor (DNA-binding
  misc_feature (79)..(179): Pfam Name: K-box Pfam Description: K-box region
  misc_feature (1)..(250): Bit score of 598.9 for HMM based on sequences of Figure 14
  misc_feature (1)..(250): Functional Homolog Of SEQ ID NO. 1112
MGRGRGKVEVRRIENSVSRQVTFSKRRRGLAKKARELAVLCDADVALLVFSDKGRLHDFAAHGSMERILGRYERYLLCEDRDDVTQDYPEESQGNMSYDHIKLRSKLEAIKKSQRNLMGEQLESLTFREVQQLEHRIDSALRNVRSRKDHILLNSIQELRNKETFLMEQNGILEKEMIKKKKAAVGASSSLHTTTSTAAASSTAAAAAALPNLNICPDDSDEPGMAAAAGIRLPWWMLQPSAVSQRQEQH

SEQ ID NO: 1212 - protein, 245 aa, Zea mays
  misc_feature (11)..(61): Pfam Name: SRF-TF Pfam Description: SRF-type transcription factor (DNA-binding
  misc_feature (79)..(179): Pfam Name: K-box Pfam Description: K-box region
  misc_feature (1)..(245): Bit score of 600.5 for HMM based on sequences of Figure 14
  misc_feature (1)..(245): Functional Homolog Of SEQ ID NO. 1112
MGRGRGKVEVRRIENSVSRQVTFSKRRRGLAKKARELAVLCDADVALLVFSDKGRLHDFAAHGSMERILGRYERYLLCEDRDDVTQDYPEESQGNMSYDHIKLRSKLEAIKKSQRNLMGEQLESLTFREVQQLEHRIDSALRNVRSRKDHILLNSIQELRNKETFLMEQNGILEKEKAAVGASSSLHTTTSTAAASSTAAAAAALPNLNICPDDSDEPGMAAAAGIRLPWWMLQPSAVSQRQEQH

SEQ ID NO: 1213 - protein, 231 aa, Zea mays
  misc_feature (11)..(61): Pfam Name: SRF-TF Pfam Description: SRF-type transcription factor (DNA-binding
  misc_feature (79)..(178): Pfam Name: K-box Pfam Description: K-box region
  misc_feature (1)..(231): Bit score of 558.5 for HMM based on sequences of Figure 14
  misc_feature (1)..(231): Functional Homolog Of SEQ ID NO. 1112
MGRGRGKVEVRRIENSVSRQVTFSKRRRGLAKKARELAVLCDADVALLVFSDKGRLHDFAAHGSMERILGRYERYLLCEDRDDVTQDYPEESQGNMSYDHIKLRSKLEAIKKSQRNLMGEQLESLTFREVQQLEHRIDSALRNVRSRKETFLMEQNGILEKEKAAVGASSSLHTTTSTAAASSTAAAAAALPNLNICPDDSDEPGMAAAAGIRLPWWMLQPSAVSQRQEQH

SEQ ID NO: 1214 - DNA, 2154 bp, Panicum virgatum
  misc_feature (1)..(2154): Ceres Clone ID no. 1769374
  misc_feature (1)..(2154): Encodes the peptide sequence at SEQ ID NO. 1215
gccacccatcggaaaccaaaaccatccctttctctcttctccctctccctcctgcaatctcaagacgtgatggggactccgcagcgggtcctcctcgcgccgtgggcgctgctggcggtggtggcgctgcagctcgccggtgcctcgcatgtcatccactggagcctcgaggccgaggcggcgccgccgccgtcggtgccggcatccattgtcagccccctgctcaagacggggtaccatttccagccgcccaggaactggatcaacgatccgaacgctccgatgtactacaaggggtggtaccacctgttctaccagtacaaccccaagggcgcggtgtggggcaacatcgtgtgggcgcactcggtgtcgcgcgacctcatcaactggatcgcgctggagcccgccatctaccccagcatcccctccgaccagttcggctgctggtccggctcggcgacgctcctccccgacggcacgccggcgatcacctacacggggatcagccggtccgacatcaactaccaggtgcagaacgtcgcgttccccaagaacgcctccgacccgctgctccgggagtgggtgaagccggcggagctgaacccgatcgccgtgccggagggcggcatcaacgcgacgcagttccgcgacccgacgacggcgtggtacgccgacgggcactggcggatgctcgtcggcggcgtgcgcggcggcgcccgcgggctggcgttcgtgtaccggagccgggacttccggcggtggcgccgcgccaggaaaccgctgcactcggcggcgacggggatgtgggagtgcccggacttcttcccggtgtccggtgccgggctggagaacgggctcgacacctccgaggccggccccaagtacgtgctcaagaacagcctggacctcacccggtacgactactacaccgtgggcagctacgaccggcgcagggaccggtacgtgccggacgaccccgccggcgacgagcggcgccgccgctacgactacggcaacttctacgcgtccaagacgttctacgacccggcgaagcggcggcgcgtgctgctcggctgggccaacgagtccgacagcgtgcccgacgacaaggccaagggctgggccggcatccatgcgatcccgaggaagatctggctggaccccagcgggaagcagctgctgcagtggccggtcgaggaggtggagaagctcaggggcaagcccgtcagcgtcgccggcaaggtcgtcaagcccggccagcatttcgaggtcacgggcctcgcaacttaccaggctgacgtggaggtgagcttcgaggtgtcgagcctggacagggcggagcccttcgacgccgcgtacgccaacgacgcgcagaagctgtgcggcgtcaagggcgccgacgccaagggcggggtggggcccttcggcctgtgggtgctggcctctgccgacctgcaggagaagacggccgtcttcttcagagtcttcaaggacggatacggcaagcccaaggtgctcatgtgcaccgaccccacaaagtcgtctcttagtccagatctgtacaagccgacctttgcgggcttcgtcgacaccgacatttcgagcgggaagatcactctcaggagcttgatcgaccgatccgtggtggagagcttcggagcaggaggccggacttgcatcctctcaagagtctacccctccatcgctgtcggcaaagacgctcacctttacgtcttcaacaatggggaggcggacatcaaggtgtcgcacctgactgcctgggagatgaagaaaccgctcatgaacggcgcctgagaagtcactgatgggaacgacgtctgggagatgaagaaactactggtgatgaacggcgcctaagaaaccattgatgaccttattcgttttctttgacacggctgcttcgcagttgattgtcgttgttgacgtccttcattattgatcaagaagtgacagtttgggtcgttacttctgatagattcttcttcttcttatttgtgtatgtgtacacgtgggggggttttttcgtgctcagctgttgagggaaagggagaaattgattatgcttcttcttgtactatatgagttatcagatgatgaataacttgtatgatgaataaaagctgctaattttac

SEQ ID NO: 1215 - protein, 601 aa, Panicum virgatum
  misc_feature (57)..(374): Pfam Name: Glyco_hydro_32N Pfam Description: Glycosyl hydrolases family 32 N termi
  misc_feature (415)..(533): Pfam Name: Glyco_hydro_32C Pfam Description: Glycosyl hydrolases family 32 C termi
  misc_feature (1)..(601): Ceres Clone ID no. 1769374
  misc_feature (1)..(601): Bit score of 1277.9 for HMM based on sequences of Figure 10
  misc_feature (1)..(601): in Figure 10
MGTPQRVLLAPWALLAVVALQLAGASHVIHWSLEAEAAPPPSVPASIVSPLLKTGYHFQPPRNWINDPNAPMYYKGWYHLFYQYNPKGAVWGNIVWAHSVSRDLINWIALEPAIYPSIPSDQFGCWSGSATLLPDGTPAITYTGISRSDINYQVQNVAFPKNASDPLLREWVKPAELNPIAVPEGGINATQFRDPTTAWYADGHWRMLVGGVRGGARGLAFVYRSRDFRRWRRARKPLHSAATGMWECPDFFPVSGAGLENGLDTSEAGPKYVLKNSLDLTRYDYYTVGSYDRRRDRYVPDDPAGDERRRRYDYGNFYASKTFYDPAKRRRVLLGWANESDSVPDDKAKGWAGIHAIPRKIWLDPSGKQLLQWPVEEVEKLRGKPVSVAGKVVKPGQHFEVTGLATYQADVEVSFEVSSLDRAEPFDAAYANDAQKLCGVKGADAKGGVGPFGLWVLASADLQEKTAVFFRVFKDGYGKPKVLMCTDPTKSSLSPDLYKPTFAGFVDTDISSGKITLRSLIDRSVVESFGAGGRTCILSRVYPSIAVGKDAHLYVFNNGEADIKVSHLTAWEMKKPLMNGAEVTDGNDVWEMKKLLVMNGA

SEQ ID NO: 1216 - DNA, 1746 bp, Sorghum bicolor
  misc_feature (1)..(1746): Ceres Annot ID no. 8679388
  misc_feature (1)..(1746): Encodes the peptide sequence at SEQ ID NO. 1217
atggggactcggcaacgggtcctcgcgccatgggcggtgctgctgctcaccgcgctgcagctcgccggtgcctcccatgttgtcgtccaccggagcctggaggccgaggcggcggcggcaccgccgtcggtgccggcctccattgtcagccccctgctcaggacagggtaccatttccagccgccaatgaactggatcaacgaccccaacgctccgatgtactacaagggatggtatcacctgttctaccagtacaaccccaagggcgcagtatggggcaacatcgtgtgggctcactccatatcacgcgacctcatcaactggatcgcgctggagcccgccatctacccgagcatcccctccgaccagtacggctgctggtcgggctcggcgacgatgctgcaagacggcacgccggcgatcctctacactgggatcaaccgcccggacatcaactaccaggtgcaggtgctcgccttccccaagaacgcgtcggacccgctgctccgggagtgggagaagccggcggcgtacaacccggtggcggcgccggtgggcggcatcaacgcgacgcagttccgcgacccgacgacggcgtggtacgccgacgggcactggcggatgctggtgggcagcgtgcgggacacccggggcatggcgatcgtgtaccggagccgggacttccggcgctggacgaaagccaagcacccgctgcactcggcgctgacggggatgtgggagtgcccggacttcttcccggtgtccggcccggcgctccaggacggggtcgacacctccgacgccggcgccaagtacgtgctcaagaacagcctcgacctcacgcggtacgactactacaccatcgggtcgtatgataagaggaaggaccggtactacccggataatccgaacggcgactaccaccggctccggtacgactacggcaacttctacgcgtccaagacgttctatgatccggcgaagcggcggcgggtgctcctcgggtgggctaacgagtccgacagcgtccccgacgacaaggccaagggatgggccggcatccatgcgatcccaaggaagatctggctggatcccagcgggaagcagctgctgcagtggcccatcgaggaggtcgagaagctcagagggaaggccgtcactgtgggcggcaaggtggtgaagcccggcgagcattttgaggtcacaggcatcgcaacttaccaggctgatgtggaggtgagcttcgagatctcgagcttggacaaggcggagcccttcgacccggcgtacgacaacgacgcgcagaagctgtgcggcgtcaagggcgccgacgtcaagggcggcgtagggcccttcggcctgtgggtgttggcctctgccgacctgcaggagaagacggccgtcttcttcagagtcttcaaggacggctacggcaagcccaaggtgctcatgtgcaccgaccccaccaagtcatcgcttagtccagatctgtacaagccgaccttcgccggcttcgtcgacactgacatttcaagcgggaagattgctcttagaagcttgatcgatcggtccgtggtcgagagcttcggcgaaaaaggaaggacttgcatcctgtcacgggtctacccgtccatcgccattggaaaggaggctcacctctacgttttcaacaacggtgacgtggacgtcaaggtgtcaagcctgacagcatgggagatgaagaagccgctgatgaacggcgcctaa

SEQ ID NO: 1217 - protein, 581 aa, Sorghum bicolor
  misc_feature (58)..(374): Pfam Name: Glyco_hydro_32N Pfam Description: Glycosyl hydrolases family 32 N termi
  misc_feature (415)..(533): Pfam Name: Glyco_hydro_32C Pfam Description: Glycosyl hydrolases family 32 C termi
  misc_feature (1)..(581): Ceres Annot ID no. 8679388
  misc_feature (1)..(581): Bit score of 1277.3 for HMM based on sequences of Figure 10
  misc_feature (1)..(581): Functional Homolog Of SEQ ID NO. 1215
  misc_feature (1)..(581): in Figure 10
MGTRQRVLAPWAVLLLTALQLAGASHVVVHRSLEAEAAAAPPSVPASIVSPLLRTGYHFQPPMNWINDPNAPMYYKGWYHLFYQYNPKGAVWGNIVWAHSISRDLINWIALEPAIYPSIPSDQYGCWSGSATMLQDGTPAILYTGINRPDINYQVQVLAFPKNASDPLLREWEKPAAYNPVAAPVGGINATQFRDPTTAWYADGHWRMLVGSVRDTRGMAIVYRSRDFRRWTKAKHPLHSALTGMWECPDFFPVSGPALQDGVDTSDAGAKYVLKNSLDLTRYDYYTIGSYDKRKDRYYPDNPNGDYHRLRYDYGNFYASKTFYDPAKRRRVLLGWANESDSVPDDKAKGWAGIHAIPRKIWLDPSGKQLLQWPIEEVEKLRGKAVTVGGKVVKPGEHFEVTGIATYQADVEVSFEISSLDKAEPFDPAYDNDAQKLCGVKGADVKGGVGPFGLWVLASADLQEKTAVFFRVFKDGYGKPKVLMCTDPTKSSLSPDLYKPTFAGFVDTDISSGKIALRSLIDRSVVESFGEKGRTCILSRVYPSIAIGKEAHLYVFNNGDVDVKVSSLTAWEMKKPLMNGA

SEQ ID NO: 1218 - protein, 590 aa, Zea mays
  misc_feature (58)..(377): Pfam Name: Glyco_hydro_32N Pfam Description: Glycosyl hydrolases family 32 N termi
  misc_feature (418)..(542): Pfam Name: Glyco_hydro_32C Pfam Description: Glycosyl hydrolases family 32 C termi
  misc_feature (1)..(590): Public GI ID no. 162460472
  misc_feature (1)..(590): Bit score of 1257.0 for HMM based on sequences of Figure 10
  misc_feature (1)..(590): Functional Homolog Of SEQ ID NO. 1215
  misc_feature (1)..(590): in Figure 10
MGTRPRGVVLAPWAVVLVLVLALRLAGASHVIHRSLEAEAAPSVPASIVSPLLRTGYHFQPPMNWINDPNAPLYYKGWYHLFYQYNPKGAVWGNIVWAHSVSRDLINWVALEPAIYPSIPSDKYGCWSGSATILEDGTPAILYTGIDRADINYQVQVLALPKDASDPLLREWEKPEEYNPVATPAAGGINATQFRDPTTAWRHAGHWRMLVGSVRGARGMALVYRSRDFRKWTKAKHPLHSAALTGMWECPDFFPVSGPGLQAGLDTSAPGTKYVLKSSLDLTRYDYYTIGSYDGGKDRYYPDDPAGDYHHRRRYDYGNYYASKTFYDPVERRRVLLGWANESDSVPDDKAKGWAGIHAIPRKIWLDPTGKQLLQWPIHEVEKLRGKAVSVDAKLVKPGDHFEVTGIATYQADVEVSFELELEAGTSLLEKAEAFDPAYDDDAQKLCGVKGADARGGVGPFGLWVLASADLQERTAVFFRVFRDGHGKPKVLMCTDPTKSSLSPDLYKPTFAGFVDADISSGKITLRSLIDRSVVESFGAGGKTCILSRVYPSIAVGKDAHLYVFNNGEVDVTVSGLTAWEMKKPLMNGA

SEQ ID NO: 1219 - protein, 576 aa, Bambusa oldhamii
  misc_feature (53)..(369): Pfam Name: Glyco_hydro_32N Pfam Description: Glycosyl hydrolases family 32 N termi
  misc_feature (410)..(528): Pfam Name: Glyco_hydro_32C Pfam Description: Glycosyl hydrolases family 32 C termi
  misc_feature (1)..(576): Public GI ID no. 82470028
  misc_feature (1)..(576): Bit score of 1304.5 for HMM based on sequences of Figure 10
  misc_feature (1)..(576): Functional Homolog Of SEQ ID NO. 1215
  misc_feature (1)..(576): in Figure 10
MGAQQWALGPWALLLLVQLAGASHVVHRSLEAAAAPASVPASIVSPLLRTGYHFQPPMNWINDPNGPMYYKGWYHLFYQYNPKGAVWGNIVWAHSVSRDLINWIALEAAIKPDIPSDQYGCWSGSATILPDGTPAIVYTGIDRPDINYQVQNIAFPKDKSDPLLREWVKPGYNPIIVPEPGMNVTQFRDPTTAWFADGHWRMLIGGLRDTRGMAYVYRSRDFRHWVRAKHPLHSALTGMWECPDFFPVPKSGQNGLDTSEFGDKVKYVLKSSLDLTRYDYYTIGTYNNKTERYVPDDPNGDYHRLRYDYGNFYASKTFFDPAKRRRVLLGWANESDSVPDDKAKGWAGIHAIPRKIWLDPSGKQLLQWPIEEVEQLRGKPVSVGDKVVKSGEHFEVTGLGSYQADVEVSFEVSSLDKAEPFDPAFSNDAQKLCGIKGADEKGGVGPFGLWVLASANLEEKTAVFFRVFKDGYGKHVVLMCTDPTKSSLSPDLYKPTFAGFVDTDISSGKISLRSLIDRSVVESFGARGKTCILSRVYPSIAIGQNAHLYVFNNGEADIKVSHLTAWEMKKPLMNGA

SEQ ID NO: 1220 - protein, 577 aa, Oryza sativa subsp. indica
  misc_feature (53)..(369): Pfam Name: Glyco_hydro_32N Pfam Description: Glycosyl hydrolases family 32 N termi
  misc_feature (410)..(529): Pfam Name: Glyco_hydro_32C Pfam Description: Glycosyl hydrolases family 32 C termi
  misc_feature (1)..(577): Public GI ID no. 158513202
  misc_feature (1)..(577): Bit score of 1256.4 for HMM based on sequences of Figure 10
  misc_feature (1)..(577): Functional Homolog Of SEQ ID NO. 1215
  misc_feature (1)..(577): in Figure 10
MGTRLLALAPWLLLLLLQLAGASHVVHRSLEAEQAPSSVPASIVSPLLRTGYHFQPPMNWINDPNGPLYYKGWYHLFYQYNPKGAVWGNIVWAHSVSQDLINWIALEPAIKPDIPSDQYGCWSGSATILPDGTPAILYTGIDRPNINYQVQNIAFPKNASDPLLREWVKPAYNPVATPEPGMNATQFRDPTTAWYADGHWRMLVGGLKGARRGLAYLYRSRDFKTWVRAKHPLHSALTGMWECPDFFPLQAPGLQAGLDTSVPSSKYVLKNSLDLTRYDYYTVGIYNKVTERYVPDNPAGDYHRLRYDYGNFYASKTFFDPVKHRRILLGWANESDSVTYDKAKGWAGIHAIPRKVWLDPSGKQLLQWPIEELEKLRGKSVSVSDKVVKPGEHFQVTGLGTYQADVEVSLEVSGLEKAEALDPAFGDDAERLCGAKGADVRGGVVFGLWVLASAGLEEKTAVFFRVFKPAGHGAKPVVLMCTDPTKSSLSPDLYKPTFAGFVDTDISSGKISLRSLIDRSVVESFGAGGKTCILSRVYPSMAIGDKAHLYVFNNGEADIKISHLKAWEMKKPLMNGA

SEQ ID NO: 1221 - protein, 583 aa, Lolium perenne
  misc_feature (53)..(376): Pfam Name: Glyco_hydro_32N Pfam Description: Glycosyl hydrolases family 32 N termi
  misc_feature (417)..(535): Pfam Name: Glyco_hydro_32C Pfam Description: Glycosyl hydrolases family 32 C termi
  misc_feature (1)..(583): Public GI ID no. 71153895
  misc_feature (1)..(583): Bit score of 1272.2 for HMM based on sequences of Figure 10
  misc_feature (1)..(583): Functional Homolog Of SEQ ID NO. 1215
  misc_feature (1)..(583): in Figure 10
MGNPKWVLAPWAVLLLLQLASASHHARLSLETEAASPSVPASIVSPLLRTGYHFQPPMNWINDPNGPLYYKGWYHLFYQYNPKGAVWGNIIWAHSVSRDLINWIALEPAISPTIPTDQYGVWSGSTTILHDGTPAILYTGIDRPSVNYQIQNIALPKNASDPLLREWYKPGYNPIAVPVEGINATQFRDPTTAWFAGRHWRMLVGGLRPGTLRGEAILYRSRDFKHWVRAKHPLHSALTGMWECPDFFPVGKAGVEKGLDTSEYGAAAGVEKHVLKNSLDLTRYDYYTIGTYDNVKERYVPDNPTGDVYQRLQYDYGNFYASKTFFDPVKQRRILLGWANESDSVAHDKAKGWAGIQAIPRKIWLDPSGKQLVQWPVEELEKLRGKPVNVGDKVVKPGQHFEVTGLQSYQSDVEVSFEVSSLDKAEPFDPAYSNDAQKLCGIKGADVKGGVGPFGLWVLSSADLAEKTAVFFRVFKDGYGKPIVLMCSDPTKSSLTPDLYKPTFAGFVDTDISSGKISLRSLIDRSVVESFGAGGKTCILSRVYPSMALGKDAHLHVFNNGETDIKVSKLTAWEMKRPLMNGA

SEQ ID NO: 1222 - DNA, 2011 bp, Triticum aestivum
  misc_feature (1)..(2011): Ceres Clone ID no. 696222
  misc_feature (1)..(2011): Encodes the peptide sequence at SEQ ID NO. 1223
atccctgtctcccccctccctcttaactgcaagcaagcaatgggggctcccaaatgggtggttgcgccattggcgctgctgctcctcctgcagctcgccggcgcgtcccatgacgtccgacggagccttgaggccgaggcggcgacgccgtccgtgccggcctccattcttagccccctgctccggacgggctaccacttccaaccccccatgaactggatcaacgatccgaatggtccgctctactacaagggatggtaccacctgttctaccagtacaaccccaagggcgcggtgtggggcaacatcatctgggcgcactcggtgtcgcgcgacctcatcaactggatggccctcgaccccgccatcaagcccagcattccgaccgaccagtacggcgtctggtccggctcggcgacgatcctgcccaacggcacggtggcgatgctctacaccggcatcgaccgcccgggcaccaactaccagatccagaacatcgccttccccaaggacccctccgacccgctgctccgcgagtgggtcaagcccggctacaaccccatcgccgtccccgaggccggcatcaacgccacgcagttccgcgacccgaccaccgcctggcacgccggcgatggcctctggcgcatgctcgtgggcgggctcaagcccggcacgctccgcggcatggccatcctgtaccggagcagggacttcaagcactgggtccgcgccaagcacccgctccactcggccctcaccggcatgtgggagtgccccgacttcttccccgtgcgcgagcccgggaagacggacggcctcgacacctccgagttcggcccgcgctacaagtacgtgctcaagaacagcctcgacctcacccgctacgactactacaccgtgggcacctacaacaaccgcacggagcggtacgtgcccgacaaccccaccggcgacgtctaccagcggctccagtacgactacggcaacttctacgcgtccaagaccttctacgacccggccaagaaccgccgcgtgctgctgggctgggccaacgagtccgacagcgtcgcgcacgacaacgccaagggatgggccggcatccacgcgatcccgaggaagatatggctggaccccagcggcaagcagctgctgcagtggcccgtggaggagctggaccagctgaggggcaaggctgtcagcgtgggtgacaagctcgtcaagcccggccagcactttgaggtcactggcctgcagtcctaccagtctgacgtggaggtgagcttcgaggtgtcgagcctggacaaggcggagccgttcgatccggcctacgccaacgacgcgcagaagctctgcgggatgaagaacgccgacgtcaagggcggggtggggcccttcggcctctgggtcctggcctctgacaacctggccgagaagaccgccgtgttcttcagagtcttcaaggatgggcatggcaagcctctcgtcctcatgtgcagtgaccccaccaagtcatctctcaccccgggtctatacaagccgacttttgccgggtttgtcgacaccgacatttcgtccgggaagatctctctgagaagcttgatcgaccgatcggtggttgagagcttcggcgccggagggaagacctgcatcctatcgagagtgtacccatccatggcgatcgggaaagacgcacacctttatgtgttcaacaacggggtgaccgatatcaaggtgtccaaactaacggcgtgggagatgaaaaaaccaatgatgaatggtgcctaagtagtatataccgtatatgttttctcatgagtttaagtttttgttgaatgccattcgacatcgatgcacaccacgcaactgattgctcgtcttaatgaagacctctttgagtagaagtggttagagaaatttgttgtacaattgataatttctgtcacgtgttgtacgaataaacatgatgatcccacgctgaagacaataaagaccttaatgaatttcttctttc

SEQ ID NO: 1223 - protein, 581 aa, Triticum aestivum
  misc_feature (53)..(374): Pfam Name: Glyco_hydro_32N Pfam Description: Glycosyl hydrolases family 32 N termi
  misc_feature (415)..(533): Pfam Name: Glyco_hydro_32C Pfam Description: Glycosyl hydrolases family 32 C termi
  misc_feature (1)..(581): Ceres Clone ID no. 696222
  misc_feature (1)..(581): Bit score of 1276.8 for HMM based on sequences of Figure 10
  misc_feature (1)..(581): Functional Homolog Of SEQ ID NO. 1215
  misc_feature (1)..(581): in Figure 10
MGAPKWVVAPLALLLLLQLAGASHDVRRSLEAEAATPSVPASILSPLLRTGYHFQPPMNWINDPNGPLYYKGWYHLFYQYNPKGAVWGNIIWAHSVSRDLINWMALDPAIKPSIPTDQYGVWSGSATILPNGTVAMLYTGIDRPGTNYQIQNIAFPKDPSDPLLREWVKPGYNPIAVPEAGINATQFRDPTTAWHAGDGLWRMLVGGLKPGTLRGMAILYRSRDFKHWVRAKHPLHSALTGMWECPDFFPVREPGKTDGLDTSEFGPRYKYVLKNSLDLTRYDYYTVGTYNNRTERYVPDNPTGDVYQRLQYDYGNFYASKTFYDPAKNRRVLLGWANESDSVAHDNAKGWAGIHAIPRKIWLDPSGKQLLQWPVEELDQLRGKAVSVGDKLVKPGQHFEVTGLQSYQSDVEVSFEVSSLDKAEPFDPAYANDAQKLCGMKNADVKGGVGPFGLWVLASDNLAEKTAVFFRVFKDGHGKPLVLMCSDPTKSSLTPGLYKPTFAGFVDTDISSGKISLRSLIDRSVVESFGAGGKTCILSRVYPSMAIGKDAHLYVFNNGVTDIKVSKLTAWEMKKPMMNGA

SEQ ID NO: 1224 - protein, 568 aa, Hordeum vulgare subsp. vulgare
  misc_feature (32)..(353): Pfam Name: Glyco_hydro_32N Pfam Description: Glycosyl hydrolases family 32 N termi
  misc_feature (395)..(519): Pfam Name: Glyco_hydro_32C Pfam Description: Glycosyl hydrolases family 32 C termi
  misc_feature (1)..(568): Public GI ID no. 26986190
  misc_feature (1)..(568): Bit score of 1181.4 for HMM based on sequences of Figure 10
  misc_feature (1)..(568): Functional Homolog Of SEQ ID NO. 1215
  misc_feature (1)..(568): in Figure 10
  misc_feature (106)..(106): Xaa is any aa, unknown, or other
MSSTRPTSWRRRRRRPLCRLRFSTPSLSTGYHFRPIKNWINDPNAPMYYKGWYHLFYQYNPKGAVWGNIVWAHSVSRDLINWVALETAIQPSIKSDKYGCWSGSAXILRDGTPAIMYTGIDRADINYEVQNIAFPKNKSDPLLREWVKPRGNPIIVPEGGINATQFRDPTTAWYADGHWRLLIGALSGASRGVAYVYRSRDFMRWTRVRKPLHSAPTGMWECPDLYPVTADGRHRHKGLDTSVVSGPRVKHVLKNSLDLRRYDYYTVGTYDRKTERYVPDNPAGDEHHLRYDYGNFYASKTFYDPVKRRRILWGWANESDAAVDDVAKGWAGIQAIPRKVWLDPSGRQLMQWPVEELEALRGKRPVSIKNRVVKRGEHVEVTGLRTSQADVEVSFEVASIDGAEALDPALANDAQKLCSMRGAHVEGGVGPFGLWVLASSKLEEKTAVFFRVFKAARNINSTNNKPVVLMCSDPTMSSLNPNLYKPTFAGFVDTDIAKGKISLRSLIDRSVVESFGAGGRTCILSRVYPTLALGKNARLHVFNNGKVDIKVSELTAWEMKKPALMNGA

SEQ ID NO: 1225 - protein, 586 aa, Musa acuminata
  misc_feature (62)..(379): Pfam Name: Glyco_hydro_32N Pfam Description: Glycosyl hydrolases family 32 N termi
  misc_feature (420)..(538): Pfam Name: Glyco_hydro_32C Pfam Description: Glycosyl hydrolases family 32 C termi
  misc_feature (1)..(586): Public GI ID no. 27802647
  misc_feature (1)..(586): Bit score of 1264.0 for HMM based on sequences of Figure 10
  misc_feature (1)..(586): Functional Homolog Of SEQ ID NO. 1215
  misc_feature (1)..(586): in Figure 10
MGMGRPSGAWSTPWLVVVLVHWLLCATERRRGAVVEASHVEFASLQSVPASVVDNRLRTGYHFQPPRNWINDPNGPMYFNGVYHLFYQYNPNGSVWGNIVWAHSVSTDLVNWIALDPAIRPSKPFDINGCWSGSATVLPGNRPVIVYTGIDPQQRQLQNVAYPKDLSDPYLREWVKPDYNPVIAPGDGINASAFRDPTTAWRGPGTHWKLVVGSKWNRRGKAILYRSRDFVHWVKAKHPLHTVKDTGMWECPDFYPVAVKGRRGLDTSAYGDGVKHVLKVSLDLRKYEYYTLGKYYHYQDKYVPDNTSADDHTGLRYDYGNFYASKTFFDPKKQRRILWGWAKESDAEDVDVAKGWAGIQAIPRTIWLDSSGRQLIQWPIEELESLRGKHVVVEHKKVSGGNSFEVEGINSSQADVEVAFEVSGLEKAEAFDPSWATDAEALCGQKRADVKGGVGPFGLLVLASAKMEEKTAVFFRIFKAEHKHVVLMCHDPSRSSMRPNLYRPTFAGYVDVDIAKTGKISLRSLIDHSVVESFGAEGKTCITSRVYPSLAIGKDAHLFVFNNGSADVKVSELKAWEIRRPLMNGS

SEQ ID NO: 1226 - protein, 592 aa, Daucus carota
  misc_feature (64)..(384): Pfam Name: Glyco_hydro_32N Pfam Description: Glycosyl hydrolases family 32 N termi
  misc_feature (426)..(545): Pfam Name: Glyco_hydro_32C Pfam Description: Glycosyl hydrolases family 32 C termi
  misc_feature (1)..(592): Public GI ID no. 18324
  misc_feature (1)..(592): Bit score of 1277.6 for HMM based on sequences of Figure 10
  misc_feature (1)..(592): Functional Homolog Of SEQ ID NO. 1215
  misc_feature (1)..(592): in Figure 10
MGVTIRNRNYDHGSLPFLQSLLAILLVTTTTLHINGVEAFHEIHYNLQSVGAENVKQVHRTGYHFQPKQNWINDPNGPMYYKGVYHLFYQYNPKGAVWGNIVWAHSVSTDLINWTPLEPAIFPSKPFDKYGCWSGSATILPGNKPVILYTGIVEGPPKNVQVQNYAIPANLSDPYLRKWIKPDNNPLVVANNGENATAFRDPTTAWLDKSGHWKMLVGSKRNRRGIAYLYRSKDFIKWTKAKHPIHSQANTGMWECPDFFPVSLKGLNGLDTSVTGESVKHVLKVSLDLTRYEYYTVGTYLTDKDRYIPDNTSVDGWAGLRYDYGNFYASKTFFDPSKNRRILWGWANESDSTAHDVAKGWAGIQLIPRTLWLDPSGKQLMQWPIEELETLRGSKVKFSRKQDLSKGILVEVKGITAAQADVEVTFSFKSLAKREPFDPKWLEYDAEKICSLKGSTVQGGVGPFGLLTLASEKLEEYTPVFFRVFKVQNTHKVLMCSDATRSSLKEGLYRPSFAGFVDVDLATDKKISLRSLIDNSVVESFGAKGKTCISSRVYPTLAVYENAHLYVFNNGSETITVENLDAWSMKKPLRMN

SEQ ID NO: 1227 - protein, 584 aa, Populus alba x Populus grandidentata
  misc_feature (57)..(374): Pfam Name: Glyco_hydro_32N Pfam Description: Glycosyl hydrolases family 32 N termi
  misc_feature (415)..(533): Pfam Name: Glyco_hydro_32C Pfam Description: Glycosyl hydrolases family 32 C termi
  misc_feature (1)..(584): Public GI ID no. 166079160
  misc_feature (1)..(584): Bit score of 1290.8 for HMM based on sequences of Figure 10
  misc_feature (1)..(584): Functional Homolog Of SEQ ID NO. 1215
  misc_feature (1)..(584): in Figure 10
MDKLLGTALLKFLPVLPLFALLFVLSNNGVEASHKIYLRYQSLSVDKVKQIHRTGYHFQPPKNWINDPNGPLYYKGLYHLFYQYNPKGAVWGNIVWAHSVSKDLINWESLEPAIYPSKWFDNYGCWSGSATILPNGEPVIFYTGIVDGNNRQIQNYAVPANSSDPYLREWVKPDDNPIVYPDPSVNASAFRDPTTAWRVGGHWRILIGSKKRDRGIAYLYRSLDFKKWFKAKHPLHSVQGTGMWECPDFFPVSLSGEEGLDTSVGGSNVRHVLKVSLDLTRYEYYTIGTYDEKKDRYYPDEALVDGWAGLRYDYGNFYASKTFFDPSKNRRILWGWANESDSVQQDMNKGWAGIQLIPRRVWLDPSGKQLLQWPVAELEKLRSHNVQLRNQKLYQGYHVEVKGITAAQADVDVTFSFPSLDKAEPFDPKWAKLDALDVCAQKGSKAQGGLGPFGLLTLASEKLEEFTPVFFRVFKAADKHKVLLCSDARSSSLGEGLYKPPFAGFVDVDLTDKKLTLRSLIDHSVVESFGAGGRTVITSRVYPIIAVFEKAHLFVFNNGSETVTVESLDAWSMKMPVMNVPVKS

SEQ ID NO: 1228 - protein, 572 aa, Vitis vinifera
  misc_feature (53)..(369): Pfam Name: Glyco_hydro_32N Pfam Description: Glycosyl hydrolases family 32 N termi
  misc_feature (410)..(526): Pfam Name: Glyco_hydro_32C Pfam Description: Glycosyl hydrolases family 32 C termi
  misc_feature (1)..(572): Public GI ID no. 157346189
  misc_feature (1)..(572): Bit score of 1280.0 for HMM based on sequences of Figure 10
  misc_feature (1)..(572): Functional Homolog Of SEQ ID NO. 1215
  misc_feature (1)..(572): in Figure 10
MKGGSRLLWFLFSLCCYCVIINNNGVEGSHKIHHEYQCVPDTKVRQVHRTGYHFQPPRNWINDPNGPMYYNGIYHLFYQYNPKGAVWGNIVWAHSVSRNLIDWEALEPAIYPSKPFDINGCWSGSATILPGNKPAILYTGIDTQQRQVQNIAFPANLSDPYLRKWVKPDSNPLVVPDVGMNASTFRDPTTAWRVNGHWRMLVGARKKHRGIVYLYRSRDFMTWIKSKHPLHSAQNTGMWECPDFFPVSLYSERGLDTSVTGKNVRHVLKVSLDRTRYEYYTIGRYYPEIDRYIPGNTSADGWSGLRYDYGNFYASKTFFDAEQKRRILWGWANESDTADNDTAKGWAGIQTIPRTLWLDKGKKQLLQWPIEELNTLRGQKIQVRNQELKIGENVEITGITAAQADVEVTFSLPSLDKAEEFDPSWVNAQDLCGMKGSTVQGGVGPFGLLTLASEHLEEYTPVFFRIFKAKGKHVVLMCSDAKSSSLRTELYKPSFAGFVDVDLKDGMLSLRSLIDHSVVESFGAGGKTCITSRVYPTLAVSKKAHLYAFNNGTEAVTIKKLNAWTMHRPQMN

SEQ ID NO: 1229 - DNA, 1752 bp, Solanum lycopersicum
  misc_feature (1)..(1752): Ceres Annot ID no. 1100195
  misc_feature (1)..(1752): Encodes the peptide sequence at SEQ ID NO. 1230
atggattattcatctaataaaagttctcgttgggctttgccagttatcttagtttgcttttttgtaattttattatccaataatgttgtttttgcttctcataaagtttttattcacttgcaatctcaaaatgccgtaaatgttcatactgttcatcgaactggttatcattttcagcccgaaaaacattggatcaatgatcccaatgcaccaatgtatttcaatggagtgtatcatctattctaccagtacaacccaaatggttcagtatggggtaacattgtttgggctcattccgtttcaaaagacttgatcaattggatcaatttagaacctgcaatttacccatcaaagccatttgatcaattcggtacctggtctggatcagcaaccatcctacctggtaacaagccagtcatcttgtacaccggaatcatagatgccaaccaaacccaagtccaaaactacgcaatcccagctaacttatccgatccatatctccgcgaatggatcaagccagacaacaacccattaattatagccgatgaaagtatcaacaagaccaagtttcgtgacccaacaacagcatggatgggtaaagacgggcattggagaatcgtcatgggaagtttgaggaaacacagcaggggcttagctataatgtataggagcaaagactttatgaaatgggtcaaggctaaacacccacttcactcaactaacggcactggaaactgggaatgccctgatttttacccagtttcatcgaaaggtactgatgggttggatcaatacggtgaggaacacaagtacgtgctgaagaacagtatggatcttactcgatttgagtattatacacttggaaaatacgatacgaaaaaagataggtacgttccagatccagattctgtcgatagtttgaagggattgagactcgattacggtaacttctacgcatcgaagtcattctacgatccaagcaaaaatcgaagggttatctggggttggtctaatgaatcagatatattcccagaggatgataatgcgaagggatgggctgggattcaattgattcctcgtaaagtatggcttgatccaagtggtaagcagttggttcaatggcctgtggaggaactagaaaccctaagaactcaaaaggttcaattgagcaacaagaagatgaacaatggggagaagattgaagttacaggaatcacaccagcacaggctgatgttgaagtgacattctcatttgcaagtttggataaggcagagtcatttgatcctaaatggaatgatatgtatgcacaagatgtttgtggactcaagggtgcagatgttcaaggtgggcttgggccatttggtcttgctacattagctactgaaaacttggaagaaaacacaccggttttcttccgagttttcaaagcacaccaaaactacaaggttctcttgtgttctgacgctaaaaggtcaactcttaagttcaatgaaacaatgtacaaagcttcatttgctggatttgttgatgttgatttggctgacaagaaattgtcactcagaagcttgattgataattcagttatagaaacttttggtgctggtggaaagacatgtataacatcgagggtttatccaacattggcaattaacgacgaggcacatttattcgcgtttaacaacgggacggagccagtcacaattgagagtttggatgcatggagtatgggcaaagctaagatacaatattga

SEQ ID NO: 1230 - protein, 583 aa, Solanum lycopersicum
  misc_feature (57)..(375): Pfam Name: Glyco_hydro_32N Pfam Description: Glycosyl hydrolases family 32 N termi
  misc_feature (416)..(536): Pfam Name: Glyco_hydro_32C Pfam Description: Glycosyl hydrolases family 32 C termi
  misc_feature (1)..(583): Ceres Annot ID no. 1100195
  misc_feature (1)..(583): Bit score of 1252.4 for HMM based on sequences of Figure 10
  misc_feature (1)..(583): Functional Homolog Of SEQ ID NO. 1215
  misc_feature (1)..(583): in Figure 10
MDYSSNKSSRWALPVILVCFFVILLSNNVVFASHKVFIHLQSQNAVNVHTVHRTGYHFQPEKHWINDPNAPMYFNGVYHLFYQYNPNGSVWGNIVWAHSVSKDLINWINLEPAIYPSKPFDQFGTWSGSATILPGNKPVILYTGIIDANQTQVQNYAIPANLSDPYLREWIKPDNNPLIIADESINKTKFRDPTTAWMGKDGHWRIVMGSLRKHSRGLAIMYRSKDFMKWVKAKHPLHSTNGTGNWECPDFYPVSSKGTDGLDQYGEEHKYVLKNSMDLTRFEYYTLGKYDTKKDRYVPDPDSVDSLKGLRLDYGNFYASKSFYDPSKNRRVIWGWSNESDIFPEDDNAKGWAGIQLIPRKVWLDPSGKQLVQWPVEELETLRTQKVQLSNKKMNNGEKIEVTGITPAQADVEVTFSFASLDKAESFDPKWNDMYAQDVCGLKGADVQGGLGPFGLATLATENLEENTPVFFRVFKAHQNYKVLLCSDAKRSTLKFNETMYKASFAGFVDVDLADKKLSLRSLIDNSVIETFGAGGKTCITSRVYPTLAINDEAHLFAFNNGTEPVTIESLDAWSMGKAKIQY

SEQ ID NO: 1231 - protein, 580 aa, Nicotiana tabacum
  misc_feature (55)..(373): Pfam Name: Glyco_hydro_32N Pfam Description: Glycosyl hydrolases family 32 N termi
  misc_feature (414)..(534): Pfam Name: Glyco_hydro_32C Pfam Description: Glycosyl hydrolases family 32 C termi
  misc_feature (1)..(580): Public GI ID no. 551259
  misc_feature (1)..(580): Bit score of 1272.0 for HMM based on sequences of Figure 10
  misc_feature (1)..(580): Functional Homolog Of SEQ ID NO. 1215
  misc_feature (1)..(580): in Figure 10
MEFLRNSSLWSLQILLLGVFVFVSNNGGVDASHKVYMHLQSTSSNVKNVHRTGYHFQPPKNWINDPNGPMYYNGVYHLFYQYNPKGAVWGNIVWAHSVSTDLINWIPLEPAIYPSKIFDKFGTWSGSATILPGNKPIILYTGIIDANRTQVQNYAIPANLSDPYLRKWIKPDNNPLIVADMSINKTQFRDPTTAWMGRDGHWRILVGSVKNHRGKVILYRSKDFMKWTKAKHPLHTATNTGNWECPDFFPVSLKHTNGLDTSYRGEYTKHVLKVSLDVTRFEYYTVGTYDTRKDRYIPDNTSVDGWKGLRLDYGNYYASKSFFDPSKNRRIMLGWANESDTVDDDVRKGWAGVHPIPRKLWLDPSGKQLVQWPVEELETLRKKKVQLSNHKLYKGEMIEVKGITVAQADVEVTFSFASLDKAEPFDPSWADLYAQDVCAIKGSTVQGGRGPFGLITLASKNLEEYTLVFFRVFKAQDKYKVLMCSDASRSTLKNETTMYKPSFGGYVDVDLADKKLSLRSLIDNSVVESFGAGGKTCITSRVYPTLAIFDKAHLFAFNNGTEAITIETLNAWSMADAKLH

SEQ ID NO: 1232 - DNA, 2038 bp, Arabidopsis thaliana
  misc_feature (1)..(2038): Ceres Clone ID no. 1148635
  misc_feature (1)..(2038): Encodes the peptide sequence at SEQ ID NO. 1233
gagttctttctcaaaaactatttacacatcaaaaataaaatcaaaataaattgttgtgatcataaagttctcttgcaccaatgagtgctccaaaatttggttatgtattactattgattgtattaatcaatataagcaataatggcgtcgatgcatttcacaaagttttcaagaaattgcaatcaaaatcgacatcattggagtcagtaagtcctcttcacagaaccgcttatcactttcaacctccccgccattggatcaatgatccgaatgctccaatgctctacaagggagtttaccatctcttctaccaatacaatcccaaaggtgcggtttggggtaacattgtgtgggctcactcggtttctaaggacttgatcaattgggaagcccttgaaccagccatttacccatccaaatggttcgacatcaacggtacatggtccggttcagctacccacgtaccgggaaaaggaccggttatcctctacaccggcatcaccgagaaccagactcaaattcaaaactacgccattccacaagatctttccgacccatacctcaagacatggataaagccagacgataaccccatcgtaaaacccgataatggcgagaacggatccgctttccgtgacccgaccacggcttggttcaacaaaaaagatgggtattggagaatgcttgttggctcaaagagaaagaacagaggaattgcttatatgtacaagagccgtgacttcaaaaaatgggtcaaaagcaaacgtcctatccactcaagaaagaaaaccggtatgtgggaatgtcccgatttcttcccggtatccgtaaccgacaagaaaaacggtttggacttcagctacgacggtccaaacgccaagcatgtgttgaaggttagtttggacttgaccagatacgagtactacactcttggaacgtatgacaccaagaaggatcgttacaggccagacggttacactcctgacgattgggatggtttgagatttgattatggtaactactatgcgtcaaagacattctttgatgacaagacgaacagaagaattctttgggggtgggccaatgaatccgacaccgttcaagatgataccgtgaagggttgggccggaattcagcttatcccaagaacaatcttgcttgactctagcggtaagcaactcgtgttttggcctattgaagagattgagtcaatgagaggaaagaatgtccaaatgaccaaccagaaaatggagatgggccaacgctttgaggtccaaggaatcactcctgctcaggtggatgtggatgtgacattcaacgttggaagtctagagaaggccgaaaagttcgacgaaagcttcgcaactaaaccactagagttatgtaacttgaaaggttcgaatgtgaatggtggagttggtccttttggtttgatcacgttggctacatctgacttagaagaatacactcctgttttctttagagtcttcaaagatgccgcatccaacaagcctaaggttctcatgtgctctgacgccaagccttcgagtctcaaaaaagacaccgggactgacgccaaggagaggatgtacaaaccatcgtttgctggttttgtggatgtcggtctccttgacggaaagatctctctaaggagtttgattgatcactcggttgtggagagctttggagcaaaaggaaagacagtgataacatctagagtgtatccgacaaaagcagtaggagaaaaagctcatttgtttgtctttaacaacggctcacaacctgtgaccgtagagagcctcaatgcatggaacatgcagaagcctctgaagatgaaccaaggtgcaaagtgatcacatcattctttaattttttcgttgacaaatttaattcattcgttaaaacagagagtctgtcacaatatattgtagaaaaaaggaacctattgtgtttcttttacaatcaatacaatttgtacatagtttatcactactaacaatgtattgatcttatattttattaatgaaacacgtctcct

SEQ ID NO: 1233 - protein, 590 aa, Arabidopsis thaliana
  misc_feature (52)..(371): Pfam Name: Glyco_hydro_32N Pfam Description: Glycosyl hydrolases family 32 N termi
  misc_feature (412)..(539): Pfam Name: Glyco_hydro_32C Pfam Description: Glycosyl hydrolases family 32 C termi
  misc_feature (1)..(590): Ceres Clone ID no. 1148635
  misc_feature (1)..(590): Bit score of 1226.9 for HMM based on sequences of Figure 10
  misc_feature (1)..(590): Functional Homolog Of SEQ ID NO. 1215
  misc_feature (1)..(590): in Figure 10
MSAPKFGYVLLLIVLINISNNGVDAFHKVFKKLQSKSTSLESVSPLHRTAYHFQPPRHWINDPNAPMLYKGVYHLFYQYNPKGAVWGNIVWAHSVSKDLINWEALEPAIYPSKWFDINGTWSGSATHVPGKGPVILYTGITENQTQIQNYAIPQDLSDPYLKTWIKPDDNPIVKPDNGENGSAFRDPTTAWFNKKDGYWRMLVGSKRKNRGIAYMYKSRDFKKWVKSKRPIHSRKKTGMWECPDFFPVSVTDKKNGLDFSYDGPNAKHVLKVSLDLTRYEYYTLGTYDTKKDRYRPDGYTPDDWDGLRFDYGNYYASKTFFDDKTNRRILWGWANESDTVQDDTVKGWAGIQLIPRTILLDSSGKQLVFWPIEEIESMRGKNVQMTNQKMEMGQRFEVQGITPAQVDVDVTFNVGSLEKAEKFDESFATKPLELCNLKGSNVNGGVGPFGLITLATSDLEEYTPVFFRVFKDAASNKPKVLMCSDAKPSSLKKDTGTDAKERMYKPSFAGFVDVGLLDGKISLRSLIDHSVVESFGAKGKTVITSRVYPTKAVGEKAHLFVFNNGSQPVTVESLNAWNMQKPLKMNQGAK

SEQ ID NO: 1234 - protein, 577 aa, Oryza sativa subsp. japonica
  misc_feature (53)..(369): Pfam Name: Glyco_hydro_32N Pfam Description: Glycosyl hydrolases family 32 N termi
  misc_feature (410)..(529): Pfam Name: Glyco_hydro_32C Pfam Description: Glycosyl hydrolases family 32 C termi
  misc_feature (1)..(577): Public GI ID no. 115446509
  misc_feature (1)..(577): Bit score of 1248.7 for HMM based on sequences of Figure 10
  misc_feature (1)..(577): Functional Homolog Of SEQ ID NO. 1215
MGTRLLALAPWLLLLLLQLAGASHVVHRSLEAEQAPSSVPASIVSPLLRTGYHFQPPMNWINDPNGPLYYKGWYHLFYQYNPKGAVWGNIVWAHSVSQDLINWIALEPAIKPDIPSDQYGCWSGSATILPDGTPAILYTGIDRPNINYQVQNIAFPKNASDPLLREWVKPAYNPVATPEPGMNATQFRDPTTAWYADGHWRMLVGGLKGARLGLAYLYRSRDFKTWVRAKHPLHSALTGMWECPDFFPLQAPGLQAGLDTSVPSSKYVLKNSLDLTRYDYYTVGIYNKVTERYVPDNPAGDYHRLRYDYGNFYASKTFFDPVKHRRILLGWANESDSVTYDKAKGWAGIHAIPRKVWLDPSGKQLLQWPIEELETLRGKSVSVFDKVVKPGEHFQVTGLGTYQADVEVSLEVSGLEKAEALDPAFGDDAERLCGAKGADVRGGVVFGLWVLASAGLEEKTAVFFRVFKPAGHGAKPVVLMCTDPTKSSLSPDLYKPTFAGFVDTDISSGKISLRSLIDRSVVESFGAGGKTCILSRVYPSMAIGDKAHLYVFNNGEADIKISHLKAWEMKKPLMNGA

SEQ ID NO: 1235 - protein, 577 aa, Oryza sativa subsp. japonica
  misc_feature (53)..(369): Pfam Name: Glyco_hydro_32N Pfam Description: Glycosyl hydrolases family 32 N termi
  misc_feature (410)..(529): Pfam Name: Glyco_hydro_32C Pfam Description: Glycosyl hydrolases family 32 C termi
  misc_feature (1)..(577): Public GI ID no. 20196210
  misc_feature (1)..(577): Bit score of 1245.6 for HMM based on sequences of Figure 10
  misc_feature (1)..(577): Functional Homolog Of SEQ ID NO. 1215
MGTRLLALAPWLLLLLLQLAGASHVVHRSLEAEQAPSSVPASIVSPLLRTGYHFQPPMNWINDPNGPLYYKGWYHLFYQYNPKGAVWGNIVWAHSVSQDLINWIALEPAIKPDIPSDQYGCWSGSATILPDGTPAILYTGIDRPNINYQVQNIAFPKNASDPLLREWVKPAYNPVATPEPGMNATQFRDPTTAWYADGHWRMLVGGLKGARLGLAYLYRSRDFKTWVRAKHPLHSALTGMWECPDFFPLQAPGLQAGLDTSVPSSKYVLKNSLDLTRYDYYTVGIYNKVTERYVPDNPAGDYHRLRYDYGNFYASKTFFDPVKHRRILLGWANESDSVTYDKAKGWAGIHAIPRKVWLDPSGKQLLQWPIEELETLRGKSVSVFDKVVKPGEHFQVTGLGTYQADVEVSLEVSGLEKAEALDPAFGDNAERLCGAKGADVRGGVVFGLWVLASAGLEEKTAVFFRVFKPAGHGAEPVVLMCTDPTKSSLSPDLYKPTFAGFVDTDISSGKISLRSLIDRSVVESFGAGGKTCILSRVYPSMAIGDKAHLYVFNNGEADIKISHLKAWEMKKPLMNGA

SEQ ID NO: 1236 - protein, 574 aa, Oryza sativa subsp. indica
  misc_feature (53)..(366): Pfam Name: Glyco_hydro_32N Pfam Description: Glycosyl hydrolases family 32 N termi
  misc_feature (407)..(526): Pfam Name: Glyco_hydro_32C Pfam Description: Glycosyl hydrolases family 32 C termi
  misc_feature (1)..(574): Public GI ID no. 125539762
  misc_feature (1)..(574): Bit score of 1235.6 for HMM based on sequences of Figure 10
  misc_feature (1)..(574): Functional Homolog Of SEQ ID NO. 1215
MGTRLLALAPWLLLLLLQLAGASHVVHRSLEAEQAPSSVPASIVSPLLRTGYHFQPPMNWINGPLYYKGWYHLFYQYNPKGAVWGNIVWAHSVSQDLINWIALEPAIKPDIPSDQYGCWSGSATILPDGTPAILYTGIDRPNINYQVQNIAFPKNASDPLLREWVKPAYNPVATPEPGMNATQFRDPTTAWYADGHWRMLVGGLKGARRGLAYLYRSRDFKTWVRAKHPLHSALTGMWECPDFFPLQAPGLQAGLDTSVPSSKYVLKNSLDLTRYDYYTVGIYNKVTERYVPDNPAGDYHRLRYDYGNFYASKTFFDPVKHRRILLGWANESDSVTYDKAKGWAGIHAIPRKVWLDPSGKQLLQWPIEELEKLRGKSVSVSDKVVKPGEHFQVTGLGTYQADVEVSLEVSGLEKAEALDPAFGDDAERLCGAKGADVRGGVVFGLWVLASAGLEEKTAVFFRVFKPAGHGAKPVVLMCTDPTKSSLSPDLYKPTFAGFVDTDISSGKISLRSLIDRSVVESFGAGGKTCILSRVYPSMAIGDKAHLYVFNNGEADIKISHLKAWEMKKPLMNGA

SEQ ID NO: 1237 - protein, 586 aa, Bambusa oldhamii
  misc_feature (54)..(376): Pfam Name: Glyco_hydro_32N Pfam Description: Glycosyl hydrolases family 32 N termi
  misc_feature (418)..(538): Pfam Name: Glyco_hydro_32C Pfam Description: Glycosyl hydrolases family 32 C termi
  misc_feature (1)..(586): Public GI ID no. 82470026
  misc_feature (1)..(586): Bit score of 1200.8 for HMM based on sequences of Figure 10
  misc_feature (1)..(586): Functional Homolog Of SEQ ID NO. 1215
MRVLGRVAWAWLVLLLLQLAGASHVVYQNLETEAAAVETVPPSIVDSQLRTGYHFQPLKNWINDPNAPMYYKGWYHLFYQYNPKGAVWGNIVWAHSVSRDLINWVSLKPAIEPSIKSDKYGCWSGSATMTLDGTPAIMYTGVNRPDVNYQVQNVAFPKNKSDPLLQEWDKPGHNPVIVPEGGINATQFRDPTTAWHADGHWRLLVGSVVTGGSRGVAYVYRSRDFRLWTRVRRPLHSAPTGMWECPDFYPVTADGRQHGLDTSVMANDKRPVKHVLKNSLDLRRYDYYTVGTYDREAERFVPDDPAGDEHHLRYDYGNFYASKTFYDPAKRRRILWGWANESDTAVDDVAKGWAGIQAIPRKVWLDPSGKQLVQWPIEEVESLRGKRPVSLKDRVVRPGEHVEVTGLQTAQADVEVSFEVPSLEGAEALDEALAYDAQKLCSVRGADVKGGVGPFGLWVLASAKLEERTAVFFRVFRAARGSNKPVVLMCTDPTKSSRNPNLYQPTFAGFVDTDITNGKISLRSLIDRSVVESFGAGGKTCILSRVYPSLAIGKNAHLYVFNNGKADIKVTQLTAWEMKKPLMNGA

SEQ ID NO: 1238 - protein, 598 aa, Oryza sativa subsp. indica
  misc_feature (59)..(384): Pfam Name: Glyco_hydro_32N Pfam Description: Glycosyl hydrolases family 32 N termi
  misc_feature (426)..(549): Pfam Name: Glyco_hydro_32C Pfam Description: Glycosyl hydrolases family 32 C termi
  misc_feature (1)..(598): Public GI ID no. 158563895
  misc_feature (1)..(598): Bit score of 1180.1 for HMM based on sequences of Figure 10
  misc_feature (1)..(598): Functional Homolog Of SEQ ID NO. 1215
MGVLGSRVAWAWLVQLLLLQQLAGASHVVYDDLELQAAAATADGVPPSIVDSELRTGYHFQPPKNWINDPNAPMYYKGWYHLFYQYNPKGAVWGNIVWAHSVSRDLINWVALKPAIEPSIRADKYGCWSGSATMMADGTPVIMYTGVNRPDVNYQVQNVALPRNGSDPLLREWVKPGHNPVIVPEGGINATQFRDPTTAWRGADGHWRLLVGSLAGQSRGVAYVYRSRDFRRWTRAAQPLHSAPTGMWECPDFYPVTADGRREGVDTSSAVVDAAASARVKYVLKNSLDLRRYDYYTVGTYDRKAERYVPDDPAGDEHHIRYDYGNFYASKTFYDPAKRRRILWGWANESDTAADDVAKGWAGIQAIPRKVWLDPSGKQLLQWPIEEVERLRGKWPVILKDRVVKPGEHVEVTGLQTAQADVEVSFEVGSLEAAERLDPAMAYDAQRLCSARGADARGGVGPFGLWVLASAGLEEKTAVFFRVFRPAARGGGAGKPVVLMCTDPTKSSRNPNMYQPTFAGFVDTDITNGKISLRSLIDRSVVESFGAGGKACILSRVYPSLAIGKNARLYVFNNGKAEIKVSQLTAWEMKKPVMMNGA

SEQ ID NO: 1239 - protein, 598 aa, Oryza sativa subsp. japonica
  misc_feature (59)..(384): Pfam Name: Glyco_hydro_32N Pfam Description: Glycosyl hydrolases family 32 N termi
  misc_feature (426)..(549): Pfam Name: Glyco_hydro_32C Pfam Description: Glycosyl hydrolases family 32 C termi
  misc_feature (1)..(598): Public GI ID no. 115458296
  misc_feature (1)..(598): Bit score of 1180.4 for HMM based on sequences of Figure 10
  misc_feature (1)..(598): Functional Homolog Of SEQ ID NO. 1215
MGVLGSRVAWAWLVQLLLLQQLAGASHVVYDDLELQAAATTADGVPPSIVDSELRTGYHFQPPKNWINDPNAPMYYKGWYHLFYQYNPKGAVWGNIVWAHSVSRDLINWVALKPAIEPSIRADKYGCWSGSATMMADGTPVIMYTGVNRPDVNYQVQNVALPRNGSDPLLREWVKPGHNPVIVPEGGINATQFRDPTTAWRGADGHWRLLVGSLAGQSRGVAYVYRSRDFRRWTRAAQPLHSAPTGMWECPDFYPVTADGRREGVDTSSAVVDAAASARVKYVLKNSLDLRRYDYYTVGTYDRKAERYVPDDPAGDEHHIRYDYGNFYASKTFYDPAKRRRILWGWANESDTAADDVAKGWAGIQAIPRKVWLDPSGKQLLQWPIEEVERLRGKWPVILKDRVVKPGEHVEVTGLQTAQADVEVSFEVGSLEAAERLDPAMAYDAQRLCSARGADARGGVGPFGLWVLASAGLEEKTAVFFRVFRPAARGGGAGKPVVLMCTDPTKSSRNPNMYQPTFAGFVDTDITNGKISLRSLIDRSVVESFGAGGKACILSRVYPSLAIGKNARLYVFNNGKAEIKVSQLTAWEMKKPVMMNGA

SEQ ID NO: 1240 - protein, 598 aa, Oryza sativa subsp. indica
  misc_feature (59)..(384): Pfam Name: Glyco_hydro_32N Pfam Description: Glycosyl hydrolases family 32 N termi
  misc_feature (426)..(549): Pfam Name: Glyco_hydro_32C Pfam Description: Glycosyl hydrolases family 32 C termi
  misc_feature (1)..(598): Public GI ID no. 33694260
  misc_feature (1)..(598): Bit score of 1172.3 for HMM based on sequences of Figure 10
  misc_feature (1)..(598): Functional Homolog Of SEQ ID NO. 1215
MGVLGSRVAWAWLVQLLLLQQLAGASHVVYDDLELQAAATTADGVPPSIVDSELRTGYHFQPPKNWINDPNAPMYYKGWYHLFYQYNPKGAVWGNIVWAHSVSRDLINWVALKPAIEPSIRADKYGCWSGSATMMADGTPVIMYTGVNRPDVNYQVQNVALPRNGSDPLLREWVKPGHNPVIVPEGGINATQFRDPTTAWRGADGHWRLLVGSLAGQSRGVAYVYRSRDFRRWTRAAQPLHSAPTGMWECPDFYPVTADGRREGVDTSSAVVDAAASARVKYVLKNSLDLRRYDYYTVGTYDRKAERYVPDDPAGDEHHIRYDYGNFYASKTFYDPAKRRRILWGWANESDTAADDVAKGWAGIQAIPRKVWLDPSGKQLLQWPIEEVERLRGKWPVILKDRVVKPGEHVEVTGLQTAQADVEVSFEVGSLEAAERLDPAVAYDAQRLCSARGADARGGVGPFGLWVLASAGLEEKTAVFFRVFRPAARGGGAGKPVVLMRTDPTKSSRNPNMYQPTFAGFVDTDITNGKISLRSLIDRSVVESFGAGGKACILSRVYPSLAIGKNARLYVFNNGKAEIKVSQLTAWEMKKPVMMNGA

SEQ ID NO: 1241 - protein, 595 aa, Oryza sativa subsp. japonica
  misc_feature (59)..(381): Pfam Name: Glyco_hydro_32N Pfam Description: Glycosyl hydrolases family 32 N termi
  misc_feature (423)..(546): Pfam Name: Glyco_hydro_32C Pfam Description: Glycosyl hydrolases family 32 C termi
  misc_feature (1)..(595): Public GI ID no. 38346326
  misc_feature (1)..(595): Bit score of 1159.7 for HMM based on sequences of Figure 10
  misc_feature (1)..(595): Functional Homolog Of SEQ ID NO. 1215
MGVLGSRVAWAWLVQLLLLQQLAGASHVVYDDLELQAAATTADGVPPSIVDSELRTGYHFQPPKNWINAPMYYKGWYHLFYQYNPKGAVWGNIVWAHSVSRDLINWVALKPAIEPSIRADKYGCWSGSATMMADGTPVIMYTGVNRPDVNYQVQNVALPRNGSDPLLREWVKPGHNPVIVPEGGINATQFRDPTTAWRGADGHWRLLVGSLAGQSRGVAYVYRSRDFRRWTRAAQPLHSAPTGMWECPDFYPVTADGRREGVDTSSAVVDAAASARVKYVLKNSLDLRRYDYYTVGTYDRKAERYVPDDPAGDEHHIRYDYGNFYASKTFYDPAKRRRILWGWANESDTAADDVAKGWAGIQAIPRKVWLDPSGKQLLQWPIEEVERLRGKWPVILKDRVVKPGEHVEVTGLQTAQADVEVSFEVGSLEAAERLDPAMAYDAQRLCSARGADARGGVGPFGLWVLASAGLEEKTAVFFRVFRPAARGGGAGKPVVLMCTDPTKSSRNPNMYQPTFAGFVDTDITNGKISLRSLIDRSVVESFGAGGKACILSRVYPSLAIGKNARLYVFNNGKAEIKVSQLTAWEMKKPVMMNGA

SEQ ID NO: 1242 - DNA, 1776 bp, Sorghum bicolor
  misc_feature (1)..(1776): Ceres Annot ID no. 8752603
  misc_feature (1)..(1776): Encodes the peptide sequence at SEQ ID NO. 1243
atgagggtggttggaatggttgcttgggcatgcatatggctgctgctcctgcagctcgccggggcttctcatgtcgtctacgatgagaacctcgaggtggaggcggcggcagccgccgtgccgccctccattgtcgaccccctgctgaggacagggtaccatttccagcctcgcaagaactggatcaatgctccattgtactacaaggggtggtaccacatcttctaccaatacaaccccaaaggcgccgtgtggggcaacatcgtgtggggccactcggtgtcgcgagacctcatcaactgggtggccctgaagccggcgatcgagcccagcatcccgtccgacaagtacggctgctggtcagggtcggcgaccacgctccccgacggcacgccggcgatcatgtacacgggcgtgaaccgtcccgacgtgaactaccaggtgcagaacatcgcgtaccctcggaacaagtcggacccgctgctccgggagtgggtgaagccctcgcacaacccgatcatcgtccccaaggccggcgtcaacgcgacgcagttccgggaccccaccacggcgtggcgccacgccgacggcggcggccactggcggctgctcatcggcagcctggagggcgccgcccgcggcgtggcgtacgtgtaccggagccgcgacttcaagcggtggacgcgggtccggcggccgctgcactcggcggccacggggatgtgggagtgcccggacttctacccgctcagcacggccggccggcgcatgggtgtcgagacgtcgtcgtcgtcggcggcggcggcgggctctcgccgtcgtcaggcgaacaagtacgtgctgaagaacagcctggacctgcggcggtacgactactacaccatcggcacgtacgacccggcggcggagcggtacgtgccggacgaccccgccggcgacgagcgccacctgcggtacgactacggcaacttctacgcgtccaagacgttctacgacccggcgaagcggcggcggatcctgtggggctgggccaacgagtccgacaccgccgccgacgacgtcgccaaagggtgggctgggattcaggcgattccgaggacggtgtggctggatcccagcgggaagcagctgctgcagtggcctatcgaggaagtggaggcgctcagaggcaagtcggtcactctcaagaacagggtgatcaagccaggacagcacgtcgaggtgaccgggatacaaacggcacaggctgacgtggaggtgagcttcgaggtgccgagcctggcgggagcggaggcgctggacgacccggcgctcgccggcgacgcgcagcggctgtgcggcgccaggggcgccgccgtggagggcggcgtcggaccgttcgggctctgggtgctggcctccgccaaccgggaggagaggaccgccgtgttcttcagggtgttcaggcccgcgcgcggcggcggcaagccggtggtgctcatgtgcaccgacccctgcaagtcatctctggacccgaacctgtaccagccgacgtttgcaggttttgtggacacagacatttctaacggcaagatctctctgagaagcctgatcgaccggtcggttgttgagagctttggagccgggggcaagacgtgcatcctctccagggtctacccgtcgctcgccatcggcaagaacgcccgcctctacgtgttcaacaacgggaaggcggacgtcaaggtgtccagtctcaccgcatgggagatgaagaagccactcatgaatggagcttga

SEQ ID NO: 1243 - protein, 591 aa, Sorghum bicolor
  misc_feature (54)..(381): Pfam Name: Glyco_hydro_32N Pfam Description: Glycosyl hydrolases family 32 N termi
  misc_feature (422)..(543): Pfam Name: Glyco_hydro_32C Pfam Description: Glycosyl hydrolases family 32 C termi
  misc_feature (1)..(591): Ceres Annot ID no. 8752603
  misc_feature (1)..(591): Bit score of 1149.3 for HMM based on sequences of Figure 10
  misc_feature (1)..(591): Functional Homolog Of SEQ ID NO. 1215
MRVVGMVAWACIWLLLLQLAGASHVVYDENLEVEAAAAAVPPSIVDPLLRTGYHFQPRKNWINAPLYYKGWYHIFYQYNPKGAVWGNIVWGHSVSRDLINWVALKPAIEPSIPSDKYGCWSGSATTLPDGTPAIMYTGVNRPDVNYQVQNIAYPRNKSDPLLREWVKPSHNPIIVPKAGVNATQFRDPTTAWRHADGGGHWRLLIGSLEGAARGVAYVYRSRDFKRWTRVRRPLHSAATGMWECPDFYPLSTAGRRMGVETSSSSAAAAGSRRRQANKYVLKNSLDLRRYDYYTIGTYDPAAERYVPDDPAGDERHLRYDYGNFYASKTFYDPAKRRRILWGWANESDTAADDVAKGWAGIQAIPRTVWLDPSGKQLLQWPIEEVEALRGKSVTLKNRVIKPGQHVEVTGIQTAQADVEVSFEVPSLAGAEALDDPALAGDAQRLCGARGAAVEGGVGPFGLWVLASANREERTAVFFRVFRPARGGGKPVVLMCTDPCKSSLDPNLYQPTFAGFVDTDISNGKISLRSLIDRSVVESFGAGGKTCILSRVYPSLAIGKNARLYVFNNGKADVKVSSLTAWEMKKPLMNGA

SEQ ID NO: 1244 - DNA, 2012 bp, Zea mays
  misc_feature (1)..(2012): Ceres Clone ID no. 483472
  misc_feature (1)..(2012): Encodes the peptide sequence at SEQ ID NO. 1245
atccttctagcttcgatctctatatacctctgtatgtgagtgaggccaatgagagccctcgtagtcgtaagtttcgcttcggcgtgcttgctgctgctgttgcagctcgcaggagcgtcgcatgtcgtctacaactacaaggacctcgaagccgaggctgctgcggcgacggaccaggtgccgccgtccatcgtcaaccccctgctcaggacggggtaccacttccagccccccaagaactggatcaatgatcccaacgcgcccatgtactacaaggggtggtaccatttcttctaccaatacaatcccaagggcgccgtatggggcaacatcgtgtgggcgcactcggtgtcgcgagacctcatcaactgggtggcgctagagccggcgctcagaccaagcatcccgggcgacaggtacggctgctggtccgggtcggcgacggtgctgcccgacggcggcggcccggtgatcatgtacacgggcgtggaccacccggacatcaactaccaggtccagaacgtggcgtacccgaagaacgtgtcggacccgctgctccgggagtgggtgaagccctcgcacaaccccgtcatcgtccccgagggcggcatcaacgcgacgcagttccgcgacccgaccacggcctggcgcggccccggccccgagcagtggcggctgctcgtcggcagcgcggcggggtcgtcgtcgccccgcggcgtggcgtacgtgtaccgcagccgcgacttccggcggtggaggcgggtgcggcggccgctgcactcggcggccacggggatgtgggagtgccccgacttctacccggtgagcaagggcggcgcgccgcgcgcggggctcgagacgtccgtgccgcccggcccaagggtcaagcacgtgctcaagaacagcctcgacctccggcggtacgactactacaccgtgggcacgtaccacccgagggccgagcggtacgtgccggacgaccccgccggcgacgagcaccgcctgcgctacgactacggcaacttctacgcgtccaagacgttctacgacccggccaagcggcgccgcatcctgtggggctgggctaacgagtccgacaccgccgccgacgatgtggccaaaggctgggctggaatccaggcgattccaaggacggtgtggctggaccccagcgggaagcagctgttgcagtggcctatcgaggaggtggaggcgctgagagcaaagtcggtcactctcaagaacaggttaatcaaggcaggacatcacgtcgaggtaaccgggatacaaacggcacaggctgacgtggaggtgagcttcgaggtgtcgccgtcggccctggccggtgccgagacgctggacccggcgctggcctacgacgcggagaggctgtgcggcgtgaagcgcgcggacgtgcggggcggcgtggggccgttcgggctgtgggtgctggcctccgccaaccgcaaggagagaaccgcggtgttcttcagggtgttcaagcccgccgccggcagcgacaagcccgtggtgctcatgtgcaccgaccctaccaagtcgtccctgaacccgaacctgtaccgcccgacatttgcaggatttgtcgacacggacatctcgaacggcaagatatccctgagaagcctgatcgaccggtcggtcgtggagagcttcggagccgggggcaagacctgcatcctctccagggtctacccgtcgctggccatcggcaaggacgctcgcctctacgtgttcaacaacgggagggcgcacgtcaaggtgtcccgtctcaccgcgtgggagatgaagaagccggtcatgaacggggcctgaagatcttgaataaataatatcacccatgcatgacatatagtggcgcctgaggaatctttccttttttaaaacatattttagatgtcgtttattaagagttgattgtccatactaaagggcgccccgttatatgttacaatggtaccagctgcacttctagtaacaaagacaaattgact

SEQ ID NO: 1245 - protein, 594 aa, Zea mays
  misc_feature (58)..(383): Pfam Name: Glyco_hydro_32N Pfam Description: Glycosyl hydrolases family 32 N termi
  misc_feature (424)..(546): Pfam Name: Glyco_hydro_32C Pfam Description: Glycosyl hydrolases family 32 C termi
  misc_feature (1)..(594): Ceres Clone ID no. 483472
  misc_feature (1)..(594): Bit score of 1173.1 for HMM based on sequences of Figure 10
  misc_feature (1)..(594): Functional Homolog Of SEQ ID NO. 1215
MRALVVVSFASACLLLLLQLAGASHVVYNYKDLEAEAAAATDQVPPSIVNPLLRTGYHFQPPKNWINDPNAPMYYKGWYHFFYQYNPKGAVWGNIVWAHSVSRDLINWVALEPALRPSIPGDRYGCWSGSATVLPDGGGPVIMYTGVDHPDINYQVQNVAYPKNVSDPLLREWVKPSHNPVIVPEGGINATQFRDPTTAWRGPGPEQWRLLVGSAAGSSSPRGVAYVYRSRDFRRWRRVRRPLHSAATGMWECPDFYPVSKGGAPRAGLETSVPPGPRVKHVLKNSLDLRRYDYYTVGTYHPRAERYVPDDPAGDEHRLRYDYGNFYASKTFYDPAKRRRILWGWANESDTAADDVAKGWAGIQAIPRTVWLDPSGKQLLQWPIEEVEALRAKSVTLKNRLIKAGHHVEVTGIQTAQADVEVSFEVSPSALAGAETLDPALAYDAERLCGVKRADVRGGVGPFGLWVLASANRKERTAVFFRVFKPAAGSDKPVVLMCTDPTKSSLNPNLYRPTFAGFVDTDISNGKISLRSLIDRSVVESFGAGGKTCILSRVYPSLAIGKDARLYVFNNGRAHVKVSRLTAWEMKKPVMNGA

SEQ ID NO: 1246 - DNA, 1827 bp, Sorghum bicolor
  misc_feature (1)..(1827): Ceres Annot ID no. 8752602
  misc_feature (1)..(1827): Encodes the peptide sequence at SEQ ID NO. 1247
atgagagcgctagcaggagcaaggcttcttgcttggtcatggctggcggtactgctgctgccggtggtggtgcagctggctggagcctcccatgtcgtctacgaggaagagaagctcgcggtggaggcggcggcggtgccgccgtccatcgtccacccgctgctgagaaccggctaccacttccagcctcccaagaactggatcaatgctccgttctactacaaggggtggtaccatttcttctaccagtacaaccccaaaggcgctgtatggggcaacatcgtatgggcgcactcggtctcacgcgacctcatcaactggatggcattagagccggcgatcaagcccagcatcccctccgacaagtacggctgctggtcgggctcggcgacgaccatgcccgacggcacgccggtgatcatgtacaccggcatcgaccgccccaacaccaactaccaggtccagaacgtcgcctaccctcggaacaagtccgacccgctgctccgggagtgggtgaagccgtcctacaacccggtcatcgtgccggaaggcggcatcaacgcgacgcagttccgcgacccgaccacggcctggcgcgccaccgccggcggcgacggccactggcggctgctcatcggcagcgtgaggacgacgacgacgacgggggccacggcgccgccccggggcgtggcgtatgtgtaccggagccgcgacttcaggcggtggacgcgggtccggcggccgctgcactcggcggcgacggggatgtgggagtgcccggacttctacccggtgagcagcgacgaggacggccgccgccggcgcgtggggctcgagacgtccgtgccgtcgggcgcaagggtgaagcacgtgctcaagaacagcctcgacctgcggcggtacgactactacaccgtcggcacgtacgaccgggacgccgagcggtacgtgccggacgaccccgccggcgacgacgacggcgagcgccgcctgcggtacgactacggcaacttctacgcgtccaagacgttctacgacccggcgaagcggcggcggatcctgtggggctgggccaacgagtccgacaccgccgccgacgatgtcgccaaagggtgggccgggattcaggcgattccgaggacggtgtggctggaccccagcgggaagcagctgctgcagtggcccgtcgaggaggtagaggcgctcagaggcaaggcggtcactctcaagaacagggtaatcaagccaggacagcacgtcgaggtgaccgggatacaaacagcacaggctgacgtggaggtgagcttcgaggtgtcgccgtcggccctggcgggagcggagcggctggacccggcgctcgccgacgacgccgagaggctgtgcggcgtcaagcgcgccgacgtgaagggcggcgtgggtccgttcgggctgtgggtgctggcctccgccaacctcaaggagagaaccgcggtgttcttcagggtgttcaaggccgccgccggcagcagcaacaacaagcccgtcgtgctcatgtgcaccgaccctaccaagtcgtctctgaacccaaacctgtaccgcccgacatttgccggttttgttgacacggacatttcaaatgggaagatatcgctgagaagcttgatcgaccgctcggtggtggagagctttggagccgggggcaagacgtgcatcctgtccagggtctacccgtcgctcgccatcggcaacaacgcgcgcctctacgtgttcaacaacgggaaggcggacgtcagggtgtcccgtctcactgcatgggagatgaagaagccactcatgaatggcgcatga

SEQ ID NO: 1247 - protein, 608 aa, Sorghum bicolor
  misc_feature (60)..(395): Pfam Name: Glyco_hydro_32N Pfam Description: Glycosyl hydrolases family 32 N termi
  misc_feature (436)..(560): Pfam Name: Glyco_hydro_32C Pfam Description: Glycosyl hydrolases family 32 C termi
  misc_feature (1)..(608): Ceres Annot ID no. 8752602
  misc_feature (1)..(608): Bit score of 1177.7 for HMM based on sequences of Figure 10
  misc_feature (1)..(608): Functional Homolog Of SEQ ID NO. 1215
MRALAGARLLAWSWLAVLLLPVVVQLAGASHVVYEEEKLAVEAAAVPPSIVHPLLRTGYHFQPPKNWINAPFYYKGWYHFFYQYNPKGAVWGNIVWAHSVSRDLINWMALEPAIKPSIPSDKYGCWSGSATTMPDGTPVIMYTGIDRPNTNYQVQNVAYPRNKSDPLLREWVKPSYNPVIVPEGGINATQFRDPTTAWRATAGGDGHWRLLIGSVRTTTTTGATAPPRGVAYVYRSRDFRRWTRVRRPLHSAATGMWECPDFYPVSSDEDGRRRRVGLETSVPSGARVKHVLKNSLDLRRYDYYTVGTYDRDAERYVPDDPAGDDDGERRLRYDYGNFYASKTFYDPAKRRRILWGWANESDTAADDVAKGWAGIQAIPRTVWLDPSGKQLLQWPVEEVEALRGKAVTLKNRVIKPGQHVEVTGIQTAQADVEVSFEVSPSALAGAERLDPALADDAERLCGVKRADVKGGVGPFGLWVLASANLKERTAVFFRVFKAAAGSSNNKPVVLMCTDPTKSSLNPNLYRPTFAGFVDTDISNGKISLRSLIDRSVVESFGAGGKTCILSRVYPSLAIGNNARLYVFNNGKADVRVSRLTAWEMKKPLMNGA

SEQ ID NO: 1248 - DNA, 1596 bp, Sorghum bicolor
  misc_feature (1)..(1596): Ceres Annot ID no. 8752608
  misc_feature (1)..(1596): Encodes the peptide sequence at SEQ ID NO. 1249
atgtactacaaagggtggtaccatttcttctaccagtacaatcctaagggcgccgtgtggaacaacatcgtatgggcgcactcggtgtcacgagatctcatcaactgggtggcactaccgacggccctcagacctagcatcccgtccgacaggtacggctgctggtcgggctcggcgaccgtgcttcccgacggcacgccggtgatcatgtacaccggcatcaaccaccccgacatcaactaccaggtccagaacgtggcctaccctcggaacaagtccgatccactgctccgcgagtgggtgaagccctcgcacatgaaccccatcatcgtgccggagcgcgacatcaacgtgacacagttccgcgacccgaccacggcgtggcgcgccgccgccgacggccagtggcggctgctcatcggcagcgcgacggacggcggctcacgcggcgcagcgtacgtgtaccggagccgcgacttccggcggtggacgcgagtccggcggccgctgcactcggcgccggccacggggatgtgggagtgcccggacttctacccggtgagcagcgacgacgacggccgccgccggcgcgtcgggctcgagacgtccgttccgtcgggcccaagggtgaagcacgtgctcaagaacagcctcgacctccggcggtacgactactacaccgtcggcacgtaccaccggagagccgagcggtacgtgccggacgaccccgccggcgacggcgacggcgagcgccgcgtgcggtacgactacggcaacttctacgcgtccaagacgttctacgacccggcgaagcggcggcggatcctgtggggttgggccaacgagtccgacaccgccgccgacgatgtcgccaaagggtgggccgggattcaggcgattccgaggacggtgtggctggaccccagcgggaagcagctgctgcagtggcctatcgaggaggtggaggcgctcagaggcaaggcggtcactctcgggaagacgataatcaaggcagggcaccatgtcaaggtgaccgggatacagacggcacaggctgacgtggaggtgagcttcgaggtgtcgccgtcggccctggcgggagcggagcggctggacccggcgctcgccgacgacgccgagaggctgtgcggcgtcaagcgcgccgacgtgaagggcggcgtgggtccgttcgggctgtgggtgctggcctccgccaacctcaaggagaggaccgcggtgttcttcagggtgttcaaggccgccgccggcagcagcaacaagcacgtcgtgctcatgtgcaccgaccctaccaagtcgtctctgaacccaaacctgtaccgcccgacgtttgcaggttttgttgacacggacatttcaaatgggaagatatcgctgagaaccttgatcgacaggtcggttgttgagagctttggagctggaggcaaaacgtgcatcctctccagggtgtacccgtcgcttgccatcggcaacaaggctcacctctacgtgttcaacaacgggagggcggacgtcaaggtgtcccgtctcatcgcatgggagatgaagaagccggtcatgaacggggccaagatctag

SEQ ID NO: 1249 - protein, 531 aa, Sorghum bicolor
  misc_feature (1)..(317): Pfam Name: Glyco_hydro_32N Pfam Description: Glycosyl hydrolases family 32 N termi
  misc_feature (358)..(481): Pfam Name: Glyco_hydro_32C Pfam Description: Glycosyl hydrolases family 32 C termi
  misc_feature (1)..(531): Ceres Annot ID no. 8752608
  misc_feature (1)..(531): Bit score of 994.6 for HMM based on sequences of Figure 10
  misc_feature (1)..(531): Functional Homolog Of SEQ ID NO. 1215
MYYKGWYHFFYQYNPKGAVWNNIVWAHSVSRDLINWVALPTALRPSIPSDRYGCWSGSATVLPDGTPVIMYTGINHPDINYQVQNVAYPRNKSDPLLREWVKPSHMNPIIVPERDINVTQFRDPTTAWRAAADGQWRLLIGSATDGGSRGAAYVYRSRDFRRWTRVRRPLHSAPATGMWECPDFYPVSSDDDGRRRRVGLETSVPSGPRVKHVLKNSLDLRRYDYYTVGTYHRRAERYVPDDPAGDGDGERRVRYDYGNFYASKTFYDPAKRRRILWGWANESDTAADDVAKGWAGIQAIPRTVWLDPSGKQLLQWPIEEVEALRGKAVTLGKTIIKAGHHVKVTGIQTAQADVEVSFEVSPSALAGAERLDPALADDAERLCGVKRADVKGGVGPFGLWVLASANLKERTAVFFRVFKAAAGSSNKHVVLMCTDPTKSSLNPNLYRPTFAGFVDTDISNGKISLRTLIDRSVVESFGAGGKTCILSRVYPSLAIGNKAHLYVFNNGRADVKVSRLIAWEMKKPVMNGAKI

SEQ ID NO: 1250 - protein, 586 aa, Oryza sativa subsp. japonica
  misc_feature (51)..(377): Pfam Name: Glyco_hydro_32N Pfam Description: Glycosyl hydrolases family 32 N termi
  misc_feature (418)..(537): Pfam Name: Glyco_hydro_32C Pfam Description: Glycosyl hydrolases family 32 C termi
  misc_feature (1)..(586): Public GI ID no. 115458294
  misc_feature (1)..(586): Bit score of 1118.5 for HMM based on sequences of Figure 10
  misc_feature (1)..(586): Functional Homolog Of SEQ ID NO. 1215
MATARARAALVFVALLQMAAVVVVRASHVVYPELQSLEAKHVDGKLRTGYHFQPPKHWINDPNGPMYYKGLYHLFYQYNPKGAVWGNIEWAHSVSTDLIDWTALEPGIYPSKTFDEKGCWSGSATVLPSGVPVIMYTGIDPDERQVQNVAYPVNLSDPYLREWYKPDYNPIINPDGGINASAFRDPTTAWYGPDGHWRLLVGSKVNMKGLAVLYRSRDFKKWVKAHHPLHSAHTGMWECPDFFPVAVAGGSRHYRRGVDTAELHDAAVAEEVKYVLKVSLDLTRYEYYTVGWYDHATDRYVPDAAFPDNDYGLRYDYGDFYASKSFYDPAKRRRIVWGWANESDTVPDDRRKGWAGIQAIPRKLWLSADGKQLVQWPVEELKALRAKHVNVTDKVIKKGNYFEVTGFKSVQSDVDMAFAIKDLSKAEEFDPAWRTDAEALCKKLGSDVDGGVGPFGLWALASGDLKERTAVFFRVFKANDSSHVVLMCNDPTRSSYESKIYRPTFAGFVDVDIAKNKQIALRTLIDHSVVESFGARGKTCILTRVYPRKAVGDDAHLFVFNNGESDVKVTNLDAWEMKTPKMNAEE

SEQ ID NO: 1251 - protein, 586 aa, Oryza sativa subsp. indica
  misc_feature (51)..(377): Pfam Name: Glyco_hydro_32N Pfam Description: Glycosyl hydrolases family 32 N termi
  misc_feature (418)..(537): Pfam Name: Glyco_hydro_32C Pfam Description: Glycosyl hydrolases family 32 C termi
  misc_feature (1)..(586): Public GI ID no. 33694264
  misc_feature (1)..(586): Bit score of 1108.9 for HMM based on sequences of Figure 10
  misc_feature (1)..(586): Functional Homolog Of SEQ ID NO. 1215
MATARARAALVFVALLQMAAVVVVRASHVVYPELQSLEAKHVDGKLRTGYHFQPPKHWINDPNGPMYYKGLYHLFYQYNPKGAVWGNIKWAHSVSTDLIDWTALEPGIYPSKTFDEKGCWSGSATVLPSGVPVIMYTGIDPDERQVQNVAYLVNLSDPYLREWHKPDYNPIVNPDGGINASAFRDPTTAWYGPDGHWRLLVGSKVNMKGLAVLYRSRDFKKWVKAHHPLHSAHTGMWECPDFFPVAVAGGSRHYRRGVDTAELHDAAVAEEVKYVLKVSLDLTRYEYYTVGWYDHATDRYVPDAAFPDNDYGLRYDYGDFYASKSFYDPAKRRRIVWGWANESDTVPDDRRKGWAGIQAIPRKLWLSADGKQLVRWPVEELKALRAKHVNVTDKVIKKGNYFEVTGFKSVQSDVDMAFAIKDLSKAEEFDPAWRTDAEALCKKLGSDVDGGVGPFGLWALASGDLKERTAVFFRVFKANDSSHVVLMCNDPTRSSYESKIYRPTFAGFVDVDIAKNKQIALRTLIDHSVVESFGARGKTCILTRVYPRKAVGDDAHLFVFNNGESDVKVTNLDAWEMKTPKMNAEE

SEQ ID NO: 1252 - protein, 583 aa, Oryza sativa subsp. japonica
  misc_feature (51)..(374): Pfam Name: Glyco_hydro_32N Pfam Description: Glycosyl hydrolases family 32 N termi
  misc_feature (415)..(534): Pfam Name: Glyco_hydro_32C Pfam Description: Glycosyl hydrolases family 32 C termi
  misc_feature (1)..(583): Public GI ID no. 38346325
  misc_feature (1)..(583): Bit score of 1097.6 for HMM based on sequences of Figure 10
  misc_feature (1)..(583): Functional Homolog Of SEQ ID NO. 1215
MATARARAALVFVALLQMAAVVVVRASHVVYPELQSLEAKHVDGKLRTGYHFQPPKHWINGPMYYKGLYHLFYQYNPKGAVWGNIEWAHSVSTDLIDWTALEPGIYPSKTFDEKGCWSGSATVLPSGVPVIMYTGIDPDERQVQNVAYPVNLSDPYLREWYKPDYNPIINPDGGINASAFRDPTTAWYGPDGHWRLLVGSKVNMKGLAVLYRSRDFKKWVKAHHPLHSAHTGMWECPDFFPVAVAGGSRHYRRGVDTAELHDAAVAEEVKYVLKVSLDLTRYEYYTVGWYDHATDRYVPDAAFPDNDYGLRYDYGDFYASKSFYDPAKRRRIVWGWANESDTVPDDRRKGWAGIQAIPRKLWLSADGKQLVQWPVEELKALRAKHVNVTDKVIKKGNYFEVTGFKSVQSDVDMAFAIKDLSKAEEFDPAWRTDAEALCKKLGSDVDGGVGPFGLWALASGDLKERTAVFFRVFKANDSSHVVLMCNDPTRSSYESKIYRPTFAGFVDVDIAKNKQIALRTLIDHSVVESFGARGKTCILTRVYPRKAVGDDAHLFVFNNGESDVKVTNLDAWEMKTPKMNAEE

SEQ ID NO: 1253 - DNA, 1740 bp, Sorghum bicolor
  misc_feature (1)..(1740): Ceres Annot ID no. 8632838
  misc_feature (1)..(1740): Encodes the peptide sequence at SEQ ID NO. 1254
atggcgatcaggacttgggcatcggtggttttcctgctactcgcgctcctgtcgtcgtcgtcctcgtgccgtgcggcagaggcgccgtcgccgtcgccgtccgccgacgccgacctcgccgtcggcgacgcgcaccgcaccggctaccacttccagcctcccaagaactggatcaacgatcctaatggcgtgatgtactacaagggcgtgtaccacctgttctaccagtacaaccccaagggcgcggtgtggggcaacatcgtgtgggcgcacgccgtgtcgacggacctcgtcgactgggtcatgctgccgccggcgatctacccgacggcgccgttcgacgtcaacggctgctggtcaggctccgcgaccgtgctgcccgacggcacgccggtgatcatgtacaccggcattgacggcgagaaccggcaggtgcagaacgtcgcgtaccccaaggacctctccgacccgtacctccgagagtgggtcaagcccgactacaaccccgtcatcgcgccggggccagggatgaacgccaccgcgttccgtgacccgacgacggcgtggcagggccccgacgggctctggcgcctggtgatcgggaccaaggacaaccaccggggcctcgccatgctgtaccgcagcagggacttcaagcgttgggcgccggcgcgtcgtgcgctgcactccggcgacaccggcatgtgggagtgcccggacttctatcccgtgaactccgcgggcgtcggtgtcagcggcagcggcggcaggaagcacgtgctcaaggtgagcctcgacttgacacggttcgagtactacacgttcggcgagtacgacgacgccaccgacacgtacgttccggacgcggcgatcgccgacggcaacgacgggctccggtacgactacggcaacttctacgcgtccaagacgttcctcgacacggcgaagcagcggcgcatcctgtgggggtgggccaacgagtcggactccaccgccgacgacctccgcaagggctgggccggcgtgcaggcggtcccgaggaaggtctggctggcgccggacggcaagcagctggtgcagtggccggtcgccgagatcgagtccctccgtggcaaccacgtcaacgtcacggacacgctcgtcaaggccgggcagcacttcgaggtgtcggggctcgcgtcgccggcgcaggccgacgtggaggcggcgttccaggtgatggacctggacaaggccgagccgttcgacccggcgtggcgcggcgcggacgcggagacggtgtgcgcggcgcggggcgcggaagccaagggcggcgtcggcccgttcgggctgtgggtgctcgcgtccgacgacctcaaggaacggaccgccgtgttcttcagggtgttcaagggcggcggcggcggcgacggcggcaagcacgtcgtgctcatgtgcaacgacccctccatgtcgtcgcacgccgacaacctctacaagccgaccttcgccggcttcgtcgacgtcgaagtcgctcagaccggtggcaagatccctctaaggactctgattgaccactcggttgtggagagcttcggggcgcacggcaagacttgcatcctgtcgagggtgtacccgaccaaggccgtcggcgacaaggcacggctctacgtgttcaacaacggcgagtcggacgtcaaggtcacccacctgaatgcgtacgagatgcggtcggctaagatcaccgctgacgtgaagtag

SEQ ID NO: 1254 - protein, 579 aa, Sorghum bicolor
  misc_feature (50)..(362): Pfam Name: Glyco_hydro_32N Pfam Description: Glycosyl hydrolases family 32 N termi
  misc_feature (404)..(529): Pfam Name: Glyco_hydro_32C Pfam Description: Glycosyl hydrolases family 32 C termi
  misc_feature (1)..(579): Ceres Annot ID no. 8632838
  misc_feature (1)..(579): Bit score of 1057.0 for HMM based on sequences of Figure 10
  misc_feature (1)..(579): Functional Homolog Of SEQ ID NO. 1215
MAIRTWASVVFLLLALLSSSSSCRAAEAPSPSPSADADLAVGDAHRTGYHFQPPKNWINDPNGVMYYKGVYHLFYQYNPKGAVWGNIVWAHAVSTDLVDWVMLPPAIYPTAPFDVNGCWSGSATVLPDGTPVIMYTGIDGENRQVQNVAYPKDLSDPYLREWVKPDYNPVIAPGPGMNATAFRDPTTAWQGPDGLWRLVIGTKDNHRGLAMLYRSRDFKRWAPARRALHSGDTGMWECPDFYPVNSAGVGVSGSGGRKHVLKVSLDLTRFEYYTFGEYDDATDTYVPDAAIADGNDGLRYDYGNFYASKTFLDTAKQRRILWGWANESDSTADDLRKGWAGVQAVPRKVWLAPDGKQLVQWPVAEIESLRGNHVNVTDTLVKAGQHFEVSGLASPAQADVEAAFQVMDLDKAEPFDPAWRGADAETVCAARGAEAKGGVGPFGLWVLASDDLKERTAVFFRVFKGGGGGDGGKHVVLMCNDPSMSSHADNLYKPTFAGFVDVEVAQTGGKIPLRTLIDHSVVESFGAHGKTCILSRVYPTKAVGDKARLYVFNNGESDVKVTHLNAYEMRSAKITADVK

SEQ ID NO: 1255 - protein, 586 aa, Zea mays
  misc_feature (49)..(375): Pfam Name: Glyco_hydro_32N Pfam Description: Glycosyl hydrolases family 32 N termi
  misc_feature (414)..(536): Pfam Name: Glyco_hydro_32C Pfam Description: Glycosyl hydrolases family 32 C termi
  misc_feature (1)..(586): Public GI ID no. 162461901
  misc_feature (1)..(586): Bit score of 1060.7 for HMM based on sequences of Figure 10
  misc_feature (1)..(586): Functional Homolog Of SEQ ID NO. 1215
MGMAALLLVWALLHCAGTVTMVRASHAVYPELQSLEAEKVDETSRTGYHFQPPKHWINDPNGPMYYKGLYHLFYQYNPKGAVWGNIVWAHSVSTDLIDWTALAPGIYPSRQFDVKGCWSGSATVLPSGVPVVMYTGIDPDEHQVQNVAYPKNLSDPFLREWVKPDYNPIIAPDSGVNASAFRDPTTAWYGPDRHWRLLVGSKVGGKGLAVLYRSRDFRRWVKAHHPLHSGLTGMWECPDFFPVAVHGGGRHYRRGVDTAELHDRALAEEVKYVLKVSLDLTRYEYYTVGTYDHATDRYTPDAGFRDNDYGLRYDYGDFYASKSFYDPAKRRRVLWGWANESDTVPDDRRKGWAGIQAIPRKLWLSPRGKQLIQWPVEEVKALRAKHVNVSDKVVKSGQYFEVTGFKSSDVEVEFAIGDLSKAERFNPRWLTDPQALCKKRGARETGEVGPFGLWVLAAGDLTERTAVFFRVFRANSSSSSRLVVLMCNDPTNSTFEAQVYRPTFASFVNVDIARTKTIALRTLIEPSVVESFGAGGRTCILTRVYPKKALGDNAHLFVFNHGEVDVKVTRLDAWEMRTPKMNVPAQ

SEQ ID NO: 1256 - DNA, 1758 bp, Sorghum bicolor
  misc_feature (1)..(1758): Ceres Annot ID no. 8752594
  misc_feature (1)..(1758): Encodes the peptide sequence at SEQ ID NO. 1257
atggggactacgggtatggcggcggcgctgttgcttgtggcggttctgctgcactgcacgggcacggccatggtgcgggcgtcgcacactgtgtatccagagctccagtcgttggaggtggagaaggttgatgagatgtcgcgcaccgggtaccacttccagcctccaaagcactggatcaacggaccaatgtactacaaggggctgtaccatctcttctaccagtacaaccccaagggcgcggtgtggggcaacatcgagtgggcgcactcggtgtcaaccgacctgatcgactggacggcactagaccccgggatctacccgtccaagaacttcgacatcaagggctgctggtcaggctccgccaccgtgctccccagcggcatgccgatcgtcatgtacacgggcatcgaccccaacgatcaccaggtgcagaacctggcctaccccaagaacctctccgacccgttcctccgcgagtgggtcaagcccgactacaaccccatcatctcccccgacagcggcatcaacgccagcgccttccgcgacccgaccaccgcctggctcggccccgacaagcactggcgcctgctggtcggcagcagggtcgacgacaagggcctcgccgtgctgtaccggagccgggacttcaagcgctgggtcaaggcgcaccacccgctccactcgggcctcacggggatgtgggagtgcccggacttcttccccgtcgccgtccacggcggcagccgccaccaccgccgcggcgtcgacaccgccgagctgcacgacagggcgctcgccgaggaggtcaagtacgtgctcaaggtcagcctggacatgacgcgctacgagtactacaccgtggggtcctacgaccacgccacggaccgctacacccccgacgccggcttccgcgacaacgactacggcctccgctacgactacggcgacttctacgcgtccaagtcgttctacgatccggccaagcgccgccgcatcctctggggctgggctaacgagtcggacaccgtccccgatgaccgcagaaagggctgggccggcattcaggcgataccgaggaagctgtggctgtcgccgggcgggaagcagctgatccagtggccggtggaggaggtcaaggcgctgcgcgggaagcacgtgaacgtcagtgaccaggtcgtcaagggagggcagtacttcgaggtcgacggcttcaagtccgtgcagtcggacgtggaggtgacgttcgcggtcgacgacctgagcaaggcggagcagttcaacccaaagtggttcactgacccacaaaggctgtgcaagaagcggggcgcccgggagaagggcgaggtgggcccgttcgggctgtgggtgctggccgccggcgacctcacggagaggacggccgtcttcttcagggtgttcaggaccaacaccagcaggctcgtcgtactcatgtgcaacgaccctaccaactccacgttcgaggcgcaggtctaccgccccaccttcgccagcttcgtcaaccacgacatcgccaaaaccaaaaccatcgcactcaggacactgatcgaccactccgtggtggagagcttcggggccggcggaaggacgtgcatcttgtcgagggtgtacccgaagaaggccctgggcgacaacgcgcacctctttgtgttcaaccacggcgaggtggacgtcaaggtcgcgaagctggacgcctgggagatgaggacgccgaagatgaacgcgccggcgcagtag

SEQ ID NO: 1257 - protein, 585 aa, Sorghum bicolor
  misc_feature (52)..(375): Pfam Name: Glyco_hydro_32N Pfam Description: Glycosyl hydrolases family 32 N termi
  misc_feature (416)..(535): Pfam Name: Glyco_hydro_32C Pfam Description: Glycosyl hydrolases family 32 C termi
  misc_feature (1)..(585): Ceres Annot ID no. 8752594
  misc_feature (1)..(585): Bit score of 1071.0 for HMM based on sequences of Figure 10
  misc_feature (1)..(585): Functional Homolog Of SEQ ID NO. 1215
MGTTGMAAALLLVAVLLHCTGTAMVRASHTVYPELQSLEVEKVDEMSRTGYHFQPPKHWINGPMYYKGLYHLFYQYNPKGAVWGNIEWAHSVSTDLIDWTALDPGIYPSKNFDIKGCWSGSATVLPSGMPIVMYTGIDPNDHQVQNLAYPKNLSDPFLREWVKPDYNPIISPDSGINASAFRDPTTAWLGPDKHWRLLVGSRVDDKGLAVLYRSRDFKRWVKAHHPLHSGLTGMWECPDFFPVAVHGGSRHHRRGVDTAELHDRALAEEVKYVLKVSLDMTRYEYYTVGSYDHATDRYTPDAGFRDNDYGLRYDYGDFYASKSFYDPAKRRRILWGWANESDTVPDDRRKGWAGIQAIPRKLWLSPGGKQLIQWPVEEVKALRGKHVNVSDQVVKGGQYFEVDGFKSVQSDVEVTFAVDDLSKAEQFNPKWFTDPQRLCKKRGAREKGEVGPFGLWVLAAGDLTERTAVFFRVFRTNTSRLVVLMCNDPTNSTFEAQVYRPTFASFVNHDIAKTKTIALRTLIDHSVVESFGAGGRTCILSRVYPKKALGDNAHLFVFNHGEVDVKVAKLDAWEMRTPKMNAPAQ

SEQ ID NO: 1258 - protein, 584 aa, Triticum aestivum
  misc_feature (47)..(373): Pfam Name: Glyco_hydro_32N Pfam Description: Glycosyl hydrolases family 32 N termi
  misc_feature (414)..(533): Pfam Name: Glyco_hydro_32C Pfam Description: Glycosyl hydrolases family 32 C termi
  misc_feature (1)..(584): Public GI ID no. 3342240
  misc_feature (1)..(584): Bit score of 1056.1 for HMM based on sequences of Figure 10
  misc_feature (1)..(584): Functional Homolog Of SEQ ID NO. 1215
MASAAAPLIVSLLCCTALAVHAAHVVYPELQSLEATEVDKELRTGYHFQPPKHWINDPNGPMYYKGLYHLFYQYNPKGAVWGNIIWAHSVSTDLVDWVALEPGIYPSKPFDINGCWSGSATILPNGVPVIMYTGIEPKETPSAERRVPGQPLRPFLRKWVKPDYNPIINPDHGINASAFRDPTTAWYGPDGHWRLVVGSKENMRGIAVLYRSRDFRRWIKAHHSLHAGLTGMWECPDFYPVAVAGGRRHHRSGVDTRELHDSTVAAEVKYVLKVSLDVTRYEYYTIGWYDHAKDRYTPDLDFPDNDYGLRYDYGDFYASKSFYDPVKKRRVLWGWANESDTVPDDRNKGWAGIQAIPRKIFLSRSGRQLIQWPVEEIKSLRAKHVNVSNKAVKGGEYFKIDGFKSVQSDVEAAFVIKNLEKAEKFDTAWQTDAQGLCKKLNSHVKGGVGPFGLWLLASDDLKERTAVFFRVFKNNDTSYVVLMCNDPTRSSYESLIYRPTFAGFVNVDITKTKKIALRTLIDQSVVESFGAGGKTCILTRVYPRKAVGDNAHLFVFNNGESDIKLTNLRAWEMKTPTMNKRLGQ

SEQ ID NO: 1259 - protein, 580 aa, Populus alba x Populus grandidentata
  misc_feature (52)..(369): Pfam Name: Glyco_hydro_32N Pfam Description: Glycosyl hydrolases family 32 N termi
  misc_feature (410)..(529): Pfam Name: Glyco_hydro_32C Pfam Description: Glycosyl hydrolases family 32 C termi
  misc_feature (1)..(580): Public GI ID no. 166079162
  misc_feature (1)..(580): Bit score of 1232.6 for HMM based on sequences of Figure 10
  misc_feature (1)..(580): Functional Homolog Of SEQ ID NO. 1215
MMVMPHTLPVLALFALLFVLSNNGAEASHKIYSRYQNLSVENVNQVHRTGYHFQPPRHWINDPNAPMYYKGLYHLFYQYNPKGAVWGNIVWAHSVSKDLINWESLEPAIYPSKWFDYYGCWSGSATVLPNGEPVILYTGIVDKNNSQIQNYAVPANLSDPYLREWVKPDDNPIVNPDANVNGSAFRDPTTAWWADGHWRILIGSRRKQRGVAYLYRSKDFKKWVKAKHPLHSVQGTGMWECPDFFPVSLSGKNGLDPSVMGQNVKHVLKVSLDMTRYEYYTMGTYNKKKDKYFPDEGLVDGWAGLRLDYGNFYASKTFFDPSTNRRVLWGWANESDDPQKDKDKGWAGIQLIPRKVWLDPSGKQLLQWPVAELEKLRGHNVQLRNQKLNQGNHVEVKVITAAQADVDVTFSFPSLDKAEPFDPKWAKLDALDVCDQKGSKDPGGLGPFGLLTLASKNLEEFTPVFFRVFKAAADKHKVLLCSDARSSSLGKGLYKPSFAGFVDVDLTGKKLSLRSLIDHSVVESFGVGGRIAISSRVYPTIAVSEKAHLYVFNNGSETITVENLNAWSMNTPVMNVPIKS

SEQ ID NO: 1260 - DNA, 1728 bp, Populus balsamifera subsp. trichocarpa
  misc_feature (1)..(1728): Ceres Annot ID no. 1475229
  misc_feature (1)..(1728): Encodes the peptide sequence at SEQ ID NO. 1261
atggctatgccacacactctctcagttcttgctctgtttgctttgctttttgtgctaactaataatggagccgaggcttctcataagatttattctgagtatcagactcttagtgttgagaacgtgaaccaagtccatagaactgggtatcactttcagcctccaaggcactggatcaacgcgcctatgtactacaaggggctataccatctattctaccaatacaaccccaaaggtgcagtgtggggtaacattgtttgggctcattcagtttcgaaggatttgatcaattgggaatcccttgagcctgcaatctacccttctaaatggtttgataattatggatgttggtctggctcagcgacggtccttccaaatggtgagcctgttatattctacacgggtattgtggataaaaataacagtcagattcaaaactacgcagtacccgcaaacttgtcagatccatatcttcgtgaatgggttaagcctgatgataatccgatagtgaacccggatgctaacgtaaatggtagtgcattccgtgatccaaccactgcttggtgggctgatgggcattggaggattttgataggcagcaggaggaaacatagaggggttgcatatttgtacaggagtaaagattttaagaaatgggtcaaggctaagcatccgttacattcagttcagggtacaggtatgtgggaatgcccagatttttaccccgtttcattatccggcgaaaacgggttggatccttcagttatgggacaaaatgtgaaacatgtattgaaggttagcctagatatgacaagatacgaatactatacaatgggtacatacgataagaagaaggacaagtattttcctgatgagggcttagttgatggttgggctggtctcaggttagattatggaaacttttatgcttctaagacgttctttgacccaagcacaaataggaggattttgtggggttgggctaatgagtctgatgatcctcagaaagataaggacaaagggtgggcaggaattcagttgattccaaggaaggtgtggctagatcctagtggaaagcaattgctacagtggcctgttgcagaattagagaaattgagagggcacaatgttcaactgagcaatcaaatgcttgaccaaggcaaccatgttgaagttaaagtcatcactgctgctcaggctgatgttgatgtaaccttttctttctcaagcttggacaaagctgagccttttgatcctaaatgggctaagctcgatgcacttgatgtatgtgcccaaaagggttccaaagatcctggtggactggggccctttggactcttgacattagcttcagaaaatcttgaagaattcactcctgtcttctttagagtatttaaagcagcagacaagcataaagttctcctgtgctctgatgcaaggagctcttccttaggtaaagaactatataaaccatcttttgctggatttgttgatgttgatttaaccgacaagaaactttcgctcagaagtttgattgatcactctgttgtagagagttttggagctggaggaagaattgccatctcatctagggtttatccaactattgcagtctttgaaaatgctcatttatacgtgttcaacaatggcagcgagaccatcacagtggagaatcttaatgcttggagcatgaacacgcctgtcatgaatgttcctgtaaagagttga

SEQ ID NO: 1261 - protein, 575 aa, Populus balsamifera subsp. trichocarpa
  misc_feature (51)..(365): Pfam Name: Glyco_hydro_32N Pfam Description: Glycosyl hydrolases family 32 N termi
  misc_feature (406)..(524): Pfam Name: Glyco_hydro_32C Pfam Description: Glycosyl hydrolases family 32 C termi
  misc_feature (1)..(575): Ceres Annot ID no. 1475229
  misc_feature (1)..(575): Bit score of 1221.9 for HMM based on sequences of Figure 10
  misc_feature (1)..(575): Functional Homolog Of SEQ ID NO. 1215
MAMPHTLSVLALFALLFVLTNNGAEASHKIYSEYQTLSVENVNQVHRTGYHFQPPRHWINAPMYYKGLYHLFYQYNPKGAVWGNIVWAHSVSKDLINWESLEPAIYPSKWFDNYGCWSGSATVLPNGEPVIFYTGIVDKNNSQIQNYAVPANLSDPYLREWVKPDDNPIVNPDANVNGSAFRDPTTAWWADGHWRILIGSRRKHRGVAYLYRSKDFKKWVKAKHPLHSVQGTGMWECPDFYPVSLSGENGLDPSVMGQNVKHVLKVSLDMTRYEYYTMGTYDKKKDKYFPDEGLVDGWAGLRLDYGNFYASKTFFDPSTNRRILWGWANESDDPQKDKDKGWAGIQLIPRKVWLDPSGKQLLQWPVAELEKLRGHNVQLSNQMLDQGNHVEVKVITAAQADVDVTFSFSSLDKAEPFDPKWAKLDALDVCAQKGSKDPGGLGPFGLLTLASENLEEFTPVFFRVFKAADKHKVLLCSDARSSSLGKELYKPSFAGFVDVDLTDKKLSLRSLIDHSVVESFGAGGRIAISSRVYPTIAVFENAHLYVFNNGSETITVENLNAWSMNTPVMNVPVKS

SEQ ID NO: 1262 - DNA, 1755 bp, Populus balsamifera subsp. trichocarpa
  misc_feature (1)..(1755): Ceres Annot ID no. 1528678
  misc_feature (1)..(1755): Encodes the peptide sequence at SEQ ID NO. 1263
atggctatgccaaacactctctcagttcttgctttgtttgctttgttttttgtgctaagtaacaatggagccgaggcttctcataagatttatcctcagtttcagactcttagtgttgagaacgtgaatcaagtccatagaaccgggtatcactttcagcctcctaggaactggatcaacgcacctatgtactacaaggggctataccatctattctaccaatacaaccccaaaggcgcagtgtggggtaacattgtttgggctcattcagtttcaaaggatttgatcaattgggaatcccttgagcctgcactctacccttctaaatggtttgataattatggatgttggtctggttcagcgacaatccttccaaacggtgagcctgttatattctacacgggtattgccgataaaaataacagtcagatccaaaactacgcagtacccgcaaacttgtcggatccatatcttcgtgaatgggttaagcccgatgataatccgatagtgaacccggatgttagtgtaaacggtagcgcgttccgtgatccgaccactgcttggtgggctgatgggcattggaggattttgataggcagcaggaggaaccatgtaggggtggcatatttgtacaggagtagggatttgaagaaatgggccaagaccaaacacccgttacattcagttcagcgtacaggtatgtgggaatgcccagattttttccctgtttcatcattcggtgaaaatgggctggatccttcagttaatggacaaaatgtgaaacatgcattgaaggttagcttagacttgacaagatacgagtactatacactgggtacttacgataataagaaggaaaagtattttcctgatgagggcttagttgatggttgggctggtcttaggttagattatggaaacttttatgcttctaagacattctttgacccaagtacgaataggaggattttgtggggctgggttaatgagtctgatgctgttcaacaagatacggacaaagggtgggcaggaattctgttgattccaaggaaggtgtggctagatcctagtggaaagcaattgctacagtggcctgttgcagaattagagaaattgagagggcacaatgttcaactgagcaatcaaatgcttgaccaaggcaatcatgttgaagttaaagtcatcactgctgctcaggctgatgttgatgtaaccttttctttctcaagcttggacaaagctgagccttttgatcctaaatgggctaagcttgatgcacttgatgtatgtgcccaaaagggttccaaagctcctggtggacttgggccctttggactcctgacattagcttcagaaaatcttgaagaattcactcctgtcttctttagagtatttaaagcagtagacaagcataaagttctgttgtgctctgatgcaaggagctcttccctaggtgaagaactatataaaccatcttttgctggatttgttgatgttgatttaactgacaagaaactttcgctcagaagtttgattgatcactctgttgtagagagttttggagctggaggaagaactgccatcacatccagggtttatccaaccattgcagtctttgaaaaggctcacttgtacgtgttcaacaatggcagcgagaccatcacagtggagaatcttaatgcttggagtatgaacttacctgtgatgaatgtccctataaagaaccgagggggagagaatccacgcaatgaataa

SEQ ID NO: 1263 - protein, 584 aa, Populus balsamifera subsp. trichocarpa
  misc_feature (51)..(365): Pfam Name: Glyco_hydro_32N Pfam Description: Glycosyl hydrolases family 32 N termi
  misc_feature (406)..(524): Pfam Name: Glyco_hydro_32C Pfam Description: Glycosyl hydrolases family 32 C termi
  misc_feature (1)..(584): Ceres Annot ID no. 1528678
  misc_feature (1)..(584): Bit score of 1208.4 for HMM based on sequences of Figure 10
  misc_feature (1)..(584): Functional Homolog Of SEQ ID NO. 1215
MAMPNTLSVLALFALFFVLSNNGAEASHKIYPQFQTLSVENVNQVHRTGYHFQPPRNWINAPMYYKGLYHLFYQYNPKGAVWGNIVWAHSVSKDLINWESLEPALYPSKWFDNYGCWSGSATILPNGEPVIFYTGIADKNNSQIQNYAVPANLSDPYLREWVKPDDNPIVNPDVSVNGSAFRDPTTAWWADGHWRILIGSRRNHVGVAYLYRSRDLKKWAKTKHPLHSVQRTGMWECPDFFPVSSFGENGLDPSVNGQNVKHALKVSLDLTRYEYYTLGTYDNKKEKYFPDEGLVDGWAGLRLDYGNFYASKTFFDPSTNRRILWGWVNESDAVQQDTDKGWAGILLIPRKVWLDPSGKQLLQWPVAELEKLRGHNVQLSNQMLDQGNHVEVKVITAAQADVDVTFSFSSLDKAEPFDPKWAKLDALDVCAQKGSKAPGGLGPFGLLTLASENLEEFTPVFFRVFKAVDKHKVLLCSDARSSSLGEELYKPSFAGFVDVDLTDKKLSLRSLIDHSVVESFGAGGRTAITSRVYPTIAVFEKAHLYVFNNGSETITVENLNAWSMNLPVMNVPIKNRGGENPRNE

SEQ ID NO: 1264 - protein, 592 aa, Daucus carota
  misc_feature (65)..(383): Pfam Name: Glyco_hydro_32N Pfam Description: Glycosyl hydrolases family 32 N termi
  misc_feature (424)..(543): Pfam Name: Glyco_hydro_32C Pfam Description: Glycosyl hydrolases family 32 C termi
  misc_feature (1)..(592): Public GI ID no. 2500928
  misc_feature (1)..(592): Bit score of 1179.1 for HMM based on sequences of Figure 10
  misc_feature (1)..(592): Functional Homolog Of SEQ ID NO. 1215
MLIRCFHIKMALVTCFHSMLFLSAVVFIFSLDVNIRGVEASHQVFPELQSVSAVNVQLVHRTGYHFQPKKHWINDPNGPMYYKGFYHLFYQYNPKGAVWGNIVWAHSISKDLINWVALEPAIFPSKPFDKYGCWSGSATVLPGGKPVIMYTGIVTPSPVNTQVQNFAVPANYSDPYLREWIKPDNNPIVRARSENSSSFRDPTTAWFDGVHWKILVGSRRKHRGIAYLYRSRNFLKWTKAKHPLHSKDRTGMWECLDFYPVAPKGMNGLDTSVTGQDIKHVLKVSLYSTRYEYYTVGEYDRDNDIYVPDNTSVDGWAGLRYDYGNFYASKTFFDPDKQRRILWGWANESDSKQDDVQKGWAGIQLIPRKLWLDPNGKQLIQWPIEEIQLLRGQNVHMGSQVLNTGEHIEVKGVTAAQADVDATFSFKSLDRAEWFDPNWAKLDALDVCDWMGSTVRGGLGPFGFLTLASEKLEEYTPVFFRVFKTKDKLKVLMCSDAKRSSTTAEGLYKPPFAGYVDVDLSDKKISLRSLIDNSVVESFGAHGRTCITSRVYPKIAIYNNAHVFVFNNGTEAITIDSLDAWSMKAPSLMNNN

SEQ ID NO: 1265 - DNA, 1752 bp, Solanum lycopersicum
  misc_feature (1)..(1752): Ceres Annot ID no. 1139380
  misc_feature (1)..(1752): Encodes the peptide sequence at SEQ ID NO. 1266
atggattattcatctaataaaagttctcgttgggctttgccagttatcttagtttgcttttttgtaattttattatccaataatgttgtttttgcttctcataaagtttttattcacttgcaatctcaaaatgctgtaaatgttcatactgttcatcgaactggttatcattttcagcccgaaaaacattggatcaatgatcccaatgcaccaatgtatttcaatggagtgtatcatctattctaccagtacaacccaaatggttcagtatggggtaacattgtttgggctcattccgtttcaaaagacttgatcaattggatcaatttagaacctgcaatttacccatcaaagccatttgatcaattcggtacctggtctggatcagcaaccatcctacctggtaacaagccagtcatcttgtacaccggaatcatagatgccaaccaaacccaagtccaaaactacgcaatcccagctaacttatccgatccatatctccgcgaatggatcaagccagacaacaacccattaattatagccgatgaaagtatcaacaagaccaagtttcgtgacccaacaacagcatggatgggtaaagacgggcattggagaatcgtcatgggaagtttgaggaaacacagcaggggcttagctataatgtataggagcaaagactttatgaaatgggtcaaggctaaacacccacttcactcaactaacggcactggaaactgggaatgccctgatttttacccagtttcatcgaaaggtactgatgggttggatcaatacggtgaggaacacaagtacgtgctgaagaacagtatggatcttactcgatttgagtattatacacttggaaaatacgatacgaaaaaagataggtacgttccagatccagattctgtcgatagtttgaagggattgagactcgattacggtaacttctacgcatcgaagtcattctacgatccaagcaaaaatcgaagggttatctggggttggtctaatgaatcagatatattcccagaggatgataatgcgaagggatgggctgggattcaattgattcctcgtaaagtatggcttgatccaagtggtaagcagttggttcaatggcctgtggaggaactagaaaccctaagaactcaaaaggttcaattgagcaacaagaagatgaacaatggggagaagattgaagttacaggaatcacaccagcacaggctgatgttgaagtgacattctcatttgcaagtttggataaggcagagtcatttgatcctaaatggaatgatatgtatgcacaagatgtttgtggactcaagggtgcagatgttcaaggtgggcttgggccatttggtcttgctacattagctactgaaaacttggaagaaaacacaccggttttcttccgagttttcaaagcacagcaaaactacaaggttctcttgtgttctgacgctaaaaggtcaactcttaagttcaatgaaacaatgtacaaagcttcatttgctggatttgttgatgttgatttggctgacaagaaattgtcactcagaagcttgattgataattcagttatagaaacttttggtgctggtggaaagacatgtataacatcgagggtttatccaacattggcaattaacgacgaggcacatttattcgcgtttaacaacggaacggagccaatcacaattgagagtttggatgcatggagtatgggcaaagctaagatacaatattga

SEQ ID NO: 1266 - protein, 583 aa, Solanum lycopersicum
  misc_feature (57)..(375): Pfam Name: Glyco_hydro_32N Pfam Description: Glycosyl hydrolases family 32 N termi
  misc_feature (416)..(536): Pfam Name: Glyco_hydro_32C Pfam Description: Glycosyl hydrolases family 32 C termi
  misc_feature (1)..(583): Ceres Annot ID no. 1139380
  misc_feature (1)..(583): Bit score of 1252.6 for HMM based on sequences of Figure 10
  misc_feature (1)..(583): Functional Homolog Of SEQ ID NO. 1215
MDYSSNKSSRWALPVILVCFFVILLSNNVVFASHKVFIHLQSQNAVNVHTVHRTGYHFQPEKHWINDPNAPMYFNGVYHLFYQYNPNGSVWGNIVWAHSVSKDLINWINLEPAIYPSKPFDQFGTWSGSATILPGNKPVILYTGIIDANQTQVQNYAIPANLSDPYLREWIKPDNNPLIIADESINKTKFRDPTTAWMGKDGHWRIVMGSLRKHSRGLAIMYRSKDFMKWVKAKHPLHSTNGTGNWECPDFYPVSSKGTDGLDQYGEEHKYVLKNSMDLTRFEYYTLGKYDTKKDRYVPDPDSVDSLKGLRLDYGNFYASKSFYDPSKNRRVIWGWSNESDIFPEDDNAKGWAGIQLIPRKVWLDPSGKQLVQWPVEELETLRTQKVQLSNKKMNNGEKIEVTGITPAQADVEVTFSFASLDKAESFDPKWNDMYAQDVCGLKGADVQGGLGPFGLATLATENLEENTPVFFRVFKAQQNYKVLLCSDAKRSTLKFNETMYKASFAGFVDVDLADKKLSLRSLIDNSVIETFGAGGKTCITSRVYPTLAINDEAHLFAFNNGTEPITIESLDAWSMGKAKIQY

SEQ ID NO: 1267 - protein, 583 aa, Daucus carota
  misc_feature (58)..(376): Pfam Name: Glyco_hydro_32N Pfam Description: Glycosyl hydrolases family 32 N termi
  misc_feature (417)..(536): Pfam Name: Glyco_hydro_32C Pfam Description: Glycosyl hydrolases family 32 C termi
  misc_feature (1)..(583): Public GI ID no. 2500929
  misc_feature (1)..(583): Bit score of 1164.9 for HMM based on sequences of Figure 10
  misc_feature (1)..(583): Functional Homolog Of SEQ ID NO. 1215
MARTKILVFSSDSSLFLLSIFSFIFLNINGVDSTHRVFPELQSISAVDVKLVHRTGYHFQPQKHWINDPNGPMFYKGYYHLFYQYNPKGSVWGNIVWAHSVSKDLINWIALEPAIFPSKPFDQYGCWSGSATILPGNKPVILYTGIVSPDPENAQVQNYAVPANYSDPFLREWVKPDNNPLVGVHTENPSAFRDPTTAWFDGGHWKMLVGSSRKHRGIAYLYRSKDFKKWKRSPHPIHTKAETGMWECPDFYPVSPRSEDGLDNSKMGRGIKHVLKVSLNSTRYEYYTIGRYNRVRDFYVPDNTSVDGWAGLRYDYGNFYASKTFYDPIKKRRILWGWANESDSQIDDVQKGWAGIQLIPRRIWLDPSGRQLVQWPIEEVEGLRGSELHMRNQKLDMGVHVEVTGITAAQADVDATFSFKSLDKAESFDPEWINLDAQDVCDSMGSTIQGGLGPFGLLTLASKDLEEYTPVFFRIFKAEDQKLKVLMCSDAKRSSLAEGLYKPSFRGFVDVDLSDKKISLRSLIDNSVVESFGAQRKNLISSRVYPTLAIYNNAHLFVFNNGTEPITVDNLDAWSMNSPSEMN

SEQ ID NO: 1268 - protein, 590 aa, Arabidopsis thaliana
  misc_feature (52)..(371): Pfam Name: Glyco_hydro_32N Pfam Description: Glycosyl hydrolases family 32 N termi
  misc_feature (412)..(539): Pfam Name: Glyco_hydro_32C Pfam Description: Glycosyl hydrolases family 32 C termi
  misc_feature (1)..(590): Public GI ID no. 719270
  misc_feature (1)..(590): Bit score of 1219.7 for HMM based on sequences of Figure 10
  misc_feature (1)..(590): Functional Homolog Of SEQ ID NO. 1215
MSAPKFGYVLLLIVLINISNNGVDAFHKVFKKLQSKSTSLESVSPLHRTAYHFQPPRHWINDPNAPMLYKGVYHLFYQYNPKGAVWGNIVWAHSVSKDLINWEALEPAIYPSKWFDINGTWSGSATHVPGKGPVILYTGITENQTQIQNYAIPQDLSDPYLKTWIKPDDNPIVKPDNGENGSAFRDPTTAWFNKKDGYWRMLVGSKRKNRGIAYMYKSRDFKKWVKSKRPIHSRKKTGMWECPDFFPVSVTDKKNRLDFSYDGPNAKHVLKVSLDLTRYEYYTLGTYDTKKDRYRPDGYTPDGWDGLRFDYGNYYASKTFFDDKTNRRILWGWANESDTVQDDTVKGWAGIQLIPRTILLDSSGKQLVFWPIEEIESLRGKNVQMTNQKMEMGQRFEVQGITPAQVDVDVTFNVGNLEKAEKFDESFATKPLELCNLKGSNVNGGVGPFGLITLATSDLEEYTPVFFRVFKDAASNKPKVLMCSDAKPSSLKKDTGTDAKERMYKPSFAGFVDVGLLDGKISLRSLIDHSVVESFGAKGKTVITSRVYPTKAVGEKAHLFVFNNGSQPVTVESLNAWNMQKPLKMNQGAK

SEQ ID NO: 1269 - protein, 582 aa, Carica papaya
  misc_feature (59)..(376): Pfam Name: Glyco_hydro_32N Pfam Description: Glycosyl hydrolases family 32 N termi
  misc_feature (417)..(534): Pfam Name: Glyco_hydro_32C Pfam Description: Glycosyl hydrolases family 32 C termi
  misc_feature (1)..(582): Public GI ID no. 16225878
  misc_feature (1)..(582): Bit score of 1158.9 for HMM based on sequences of Figure 10
  misc_feature (1)..(582): Functional Homolog Of SEQ ID NO. 1215
MSTASKFYSVLTSTLFCYLAVITFIGTAINGVEASHRIYPQFQSLSVDIVDQIHRTAYHFQPPKHWINDPNAPMYYNGVYHLFYQYNPKGAVWGNIVWAHSVSTDLINWIPLKPAIVPSEPFDIKGCWSGSATVLPNNIPIILYTGLDSNETQLQNYAVPANISDPHLENWIKPANNPLVAPDHTVNRTAFRDPTTAWLGSDGWWRMLVGSKNKRRGIAHLYKSKDFMNWVKAKHPIHSRPDTGMWECPDFFPVPKSGENGLDVGITGRDVRHVLKVSLDLTRYEYYTIGRYYPEIDRYIPYDTLVDGWAGLRPDYGNFYASKSFFDPKTNRRILWGWANESDSRQDDVDKGWAGIQTIPRKVWLDPSGKQLRLWPVEEVEKLRKDPVLMENTAVELGQHVEVTGVTAAQCDVEVSFTIPSLEKAEPFDPEWVNAQDLCAPMGAKKQGGVGPFGLLTLASEDLEEATPVFFRVFKADTKYVVLMCSDASSSSLKEGLYKPSFAGFVNVDIEAEKRISLRSLIDHSVVESFGAGGKTCITSRVYPTKAVDGEAHLFVFNNGTEAVHVEKLSAWSMNRPLRMNN

SEQ ID NO: 1270 - protein, 581 aa, Solanum tuberosum
  misc_feature (55)..(373): Pfam Name: Glyco_hydro_32N Pfam Description: Glycosyl hydrolases family 32 N termi
  misc_feature (414)..(534): Pfam Name: Glyco_hydro_32C Pfam Description: Glycosyl hydrolases family 32 C termi
  misc_feature (1)..(581): Public GI ID no. 7162116
  misc_feature (1)..(581): Bit score of 1225.1 for HMM based on sequences of Figure 10
  misc_feature (1)..(581): Functional Homolog Of SEQ ID NO. 1215
MDYSSNSRWALPVILVCFFIVLLSNNVVFASHKVFIHLQSQNAVNVQTVHRTGYHFQPEKHWINDPNAPMYFNGVYHLFYQYKPNGSVWGNIVWAHSVSKDLINWINLEPAIYPSKPFDQFGTWSGSATILPGNKPVILYTGIVDANQTQVQNYAIPANLSDPYLREWIKPDNNPLIVADASINKTKFRDPTTAWMGKDGHWRIVMGSLRKHSRGLAIMYRSKDFMKRVKAKHPLHSTNGTGNWECPDFFPVALKGTNGIDQYGEEYKYVLKNSMDLTRFEYYTLGKYDTKKDRYVPDVGSIDSWKGLRFDYGNFYASKTFYDTSKNRRVIWGWSNESDIFPEDDNAKGWAGIQLIPRKVWLDPSGKQLIQWPVEELETLRTQKVQLSNKKLNNGEKVEVTGITPAQADVEVIFSFASLDKAESFDSSWTDMYAQDVCGLKGADVQGGLGPFGLATLATENLEENSPVFFRVFKAQQNYKVLLCSDAKRSTLKFNETMYKVSFAGFVDVDLADKKLSLRSLIDNSVIESFGAGGKTCITSRVYPTLAINEKAHLFAFNNGTEPITIETLDAWSMGKAKIQY

SEQ ID NO: 1271 - protein, 575 aa, Vicia faba var. minor
  misc_feature (51)..(371): Pfam Name: Glyco_hydro_32N Pfam Description: Glycosyl hydrolases family 32 N termi
  misc_feature (412)..(529): Pfam Name: Glyco_hydro_32C Pfam Description: Glycosyl hydrolases family 32 C termi
  misc_feature (1)..(575): Public GI ID no. 861155
  misc_feature (1)..(575): Bit score of 1151.9 for HMM based on sequences of Figure 10
  misc_feature (1)..(575): Functional Homolog Of SEQ ID NO. 1215
MISLTNCLCLIVFILVCVLCNNGVEAFHDIYPGLQSISAPSVNKLHRTGFHFQPNRNWINDPNGPMYYRGIYHLFYQYNPKGAVWGNIVWGHSVSKDLINWKELEPALFPSKPFDKYGCWSGSATILPGKGPVILYTGVVDKQSNEVQCIAIPANASVPLLTNWGKPDRLNPILTADHRMNGSVFRDPTTAWFGKDGHWRILIGGKTGDTGVAYLYRSKNFLKWIRAKHPIHSAKRTGMWECPDFYPVSLEGKNGLDLSMMMGNNVKHVLKNSLDITRYEYYTIGTYLQNQDKYIPDKTSEDGWGGLRYDYGNFYASKSFFDPTKNRRIIWGWANESDTKEDDVKKGWAGIQAIPRTVWLDSSRRQLRQWPVEELNRLRGKQVEMKNRKLKKGGYLEVKGITASQADVEVTFSFSSLDKAEAFDPNWENAEDLCAQKGSKVRGGVGPFGLLTLASKKLEEYTSVFFRVFKAANKHKILMCSDAKSSSLNRELYKPSFAGFVNVDLGNNKKLSLRSLIDHSVVESFGVGGKTNILSRVYPTLALKEKAHLFVFNNGTEHITVENLKAWSMKTASRN

SEQ ID NO: 1272 - protein, 571 aa, Medicago truncatula
  misc_feature (52)..(368): Pfam Name: Glyco_hydro_32N Pfam Description: Glycosyl hydrolases family 32 N termi
  misc_feature (409)..(525): Pfam Name: Glyco_hydro_32C Pfam Description: Glycosyl hydrolases family 32 C termi
  misc_feature (1)..(571): Public GI ID no. 87240831
  misc_feature (1)..(571): Bit score of 1176.8 for HMM based on sequences of Figure 10
  misc_feature (1)..(571): Functional Homolog Of SEQ ID NO. 1215
MVLSKVVTIFVAVLSISLLLINNGVEAFHKVYPHLQSVSAISVSEVHRTGYHFQPPRNWINGPMYYNGYYHLFYQYNPKGSVWGNIVWAHSVSKDLINWKALEPAIYPSKPFDKYGCWSGSATIVPGKGPVILYTGIIDEKNTQVQVYAIPEDPTDPLLRKWIKPDAINPIVIAGQGVNGSAFRDPTTAWMGKDGRWRMLVGSRRKHRGMAYLYRSRDFVKWVRAKHPIHSKTTTGMWECPDFYPVSLKGKVGLDTSIEGNHVKHVLKNSLDMTRFEYYTLGTYLTDKDKYIPSNTSEDGWGGLRYDYGNFYASKSFFDQSKNRRILWGWANESDSQDDDVKKGWAGIQAIPRTVWLDPTERQLVQWPVEELNVLREKEVSMNNQKLEKGNHVEVAGITAAQADVEVTFSFSSLDKAEAYDPSWVNAQDLCSQKGSKVQGGVGPFGLLTLASENLAEFTPVFFRVFKAPSKHVVLLCSDATSSSLTSNLYKPSFAGFVDVDFATKKLSLRSLIDHSVVESFGEGGKTNILSRVYPVLAVANQANLFVFNNGTEPIIVENLKAWSMKSAELI

SEQ ID NO: 1273 - DNA, 1626 bp, Populus balsamifera subsp. trichocarpa
  misc_feature (1)..(1626): Ceres Annot ID no. 1475230
  misc_feature (1)..(1626): Encodes the peptide sequence at SEQ ID NO. 1274
atggtaagccaattcaacaagaacctgattggtttcatggccaattcaacaacacctatgtactacaaggggctataccatctattctaccaatacaaccccaaaggcgcagtgtggggtaacattgtttgggctcattcagtttcaaaggatttgatcaattgggaatcccttgagcctgcactctacccttctaaatggtttgataattatggatgttggtctggttcagcgacaatccttccaaacggtgagcctgttatattctacacgggtattgccgataaaaataacagtcagatccaaaactacgcagtacccgcaaacttgtcggatccatatcttcgtgaatgggttaagcccgatgataatccgatagtgaacccggatgttagtgtaaacggtagcgcgttccgtgatccgaccactgcttggtgggctgatgggcattggaggattttgataggcagcaggaggaaccatgtaggggtggcatatttgtacaggagtagggatttgaagaaatgggccaagaccaaacacccgttacattcagttcagcgtacaggtatgtgggaatgcccagattttttccctgtttcatcattcggtgaaaatgggctggatccttcagttaatggacaaaatgtgaaacatgcattgaaggttagcttagacttgacaagatacgagtactatacactgggtacttacgataataagaaggaaaagtattttcctgatgagggcttagttgatggttgggctggtcttaggttagattatggaaacttttatgcttctaagacattctttgacccaagtacgaataggaggattttgtggggctgggttaatgagtctgatgctgttcaacaagatacggacaaagggtgggcaggaattctgttgattccaaggaaggtgtggctagatcctagtggaaagcaattgctacagtggcctgttgcagaattagagaaattgagagggcacaatgttcaactgagcaatcaaatgcttgaccaaggcaatcatgttgaagttaaagtcatcactgctgctcaggctgatgttgatgtaaccttttctttctcaagcttggacaaagctgagccttttgatcctaaatgggctaagcttgatgcacttgatgtatgtgcccaaaagggttccaaagctcctggtggacttgggccctttggactcctgacattagcttcagaaaatcttgaagaattcactcctgtcttctttagagtatttaaagcagtagacaagcataaagttctgttgtgctctgatgcaaggagctcttccctaggtgaagaactatataaaccatcttttgctggatttgttgatgttgatttaactgacaagaaactttcgctcagaagtttgattgatcactctgttgtagagagttttggagctggaggaagaactgccatcacatccagggtttatccaaccattgcagtctttgaaaaggctcacttgtacgtgttcaacaatggcagcgagaccatcacagtggagaatcttaatgcttggagtatgaacttacctgtgatgaatgtccctataaagaaccgagggggagagaatccacgcaatgaataa

SEQ ID NO: 1274 - protein, 529 aa, Populus balsamifera subsp. trichocarpa
  misc_feature (6)..(310): Pfam Name: Glyco_hydro_32N Pfam Description: Glycosyl hydrolases family 32 N termi
  misc_feature (351)..(469): Pfam Name: Glyco_hydro_32C Pfam Description: Glycosyl hydrolases family 32 C termi
  misc_feature (1)..(529): Ceres Annot ID no. 1475230
  misc_feature (1)..(529): Bit score of 1055.1 for HMM based on sequences of Figure 10
  misc_feature (1)..(529): Functional Homolog Of SEQ ID NO. 1215
MANSTTPMYYKGLYHLFYQYNPKGAVWGNIVWAHSVSKDLINWESLEPALYPSKWFDNYGCWSGSATILPNGEPVIFYTGIADKNNSQIQNYAVPANLSDPYLREWVKPDDNPIVNPDVSVNGSAFRDPTTAWWADGHWRILIGSRRNHVGVAYLYRSRDLKKWAKTKHPLHSVQRTGMWECPDFFPVSSFGENGLDPSVNGQNVKHALKVSLDLTRYEYYTLGTYDNKKEKYFPDEGLVDGWAGLRLDYGNFYASKTFFDPSTNRRILWGWVNESDAVQQDTDKGWAGILLIPRKVWLDPSGKQLLQWPVAELEKLRGHNVQLSNQMLDQGNHVEVKVITAAQADVDVTFSFSSLDKAEPFDPKWAKLDALDVCAQKGSKAPGGLGPFGLLTLASENLEEFTPVFFRVFKAVDKHKVLLCSDARSSSLGEELYKPSFAGFVDVDLTDKKLSLRSLIDHSVVESFGAGGRTAITSRVYPTIAVFEKAHLYVFNNGSETITVENLNAWSMNLPVMNVPIKNRGGENPRNE

SEQ ID NO: 1275 - protein, 587 aa, Arabidopsis thaliana
  misc_feature (52)..(368): Pfam Name: Glyco_hydro_32N Pfam Description: Glycosyl hydrolases family 32 N termi
  misc_feature (409)..(536): Pfam Name: Glyco_hydro_32C Pfam Description: Glycosyl hydrolases family 32 C termi
  misc_feature (1)..(587): Public GI ID no. 4886267
  misc_feature (1)..(587): Bit score of 1204.3 for HMM based on sequences of Figure 10
  misc_feature (1)..(587): Functional Homolog Of SEQ ID NO. 1215
MSAPKFGYVLLLIVLINISNNGVDAFHKVFKKLQSKSTSLESVSPLHRTAYHFQPPRHWINAPMLYKGVYHLFYQYNPKGAVWGNIVWAHSVSKDLINWEALEPAIYPSKWFDINGTWSGSATHVPGKGPVILYTGITENQTQIQNYAIPQDLSDPYLKTWIKPDDNPIVKPDNGENGSAFRDPTTAWFNKKDGYWRMLVGSKRKNRGIAYMYKSRDFKKWVKSKRPIHSRKKTGMWECPDFFPVSVTDKKNGLDFSYDGPNAKHVLKVSLDLTRYEYYTLGTYDTKKDRYRPDGYTPDGWDGLRFDYGNYYASKTFFDDKTNRRILWGWANESDTVQDDTVKGWAGIQLIPRTILLDSSGKQLVFWPIEEIESLRGKNVQMTNQKMEMGQRFEVQGITPAQVDVDVTFNVGNLEKAEKFDESFATKPLELCNLKGSNVNGGVGPFGLITLATSDLEEYTPVFFRVFKDAASNKPKVLMCSDAKPSSLKKDTGTDAKERMYKPSFAGFVDVGLLDGKISLRSLIDHSVVESFGAKGKTVITSRVYPTKAVGEKAHLFVFNNGSQPVTVESLNAWNMQKPLKMNQGAK

SEQ ID NO: 1276 - protein, 584 aa, Lycopersicon pennellii
  misc_feature (57)..(376): Pfam Name: Glyco_hydro_32N Pfam Description: Glycosyl hydrolases family 32 N termi
  misc_feature (417)..(538): Pfam Name: Glyco_hydro_32C Pfam Description: Glycosyl hydrolases family 32 C termi
  misc_feature (1)..(584): Public GI ID no. 7414364
  misc_feature (1)..(584): Bit score of 1197.4 for HMM based on sequences of Figure 10
  misc_feature (1)..(584): Functional Homolog Of SEQ ID NO. 1215
MELFMKNSSLWGLKFYLFCLFIVLLNINRVFASHNIFLDLQSSSAISVKNVHRTRFHFQPPKHWINDPNAPMYYNGVYHLFYQYNPKGSVWGNIIWAHSVSKDLINWIHLEPAIYPSKKFDKYGTWSGSSTILPNNKPVIIYTGVVDSYNNQVQNYAIPANLSDPFLRKWIKPNNNPLIVPDNSINRTEFRDPTTAWMGQDGLWRILIGSMRKHRGMALLYRSRDFMKWIKAQHPLHSSTNTGNWECPDFFPVSLNSTNGLDVSYRGKNVKYVLKNSLDVARFDYYTIGMYHTKIDRYIPNNNSIDGWKGLRIDYGNFYASKTFYDPSRNRRVIWGWSNESDVLPDDDIKKGWAGIQGIPRQVWLDLSGKQLVQWPIEELETLRKQKVQLNNKKLSKGEMFEVKGISASQADVEVLFSFSSLNKAEQFDPRWADLYAQDVCAIKGSTIQGGLGPFGLATLASKNLEEYTPVFFRVFKAQKNYKILMCSDARRSTMRQNEAMYKPSFAGYVDVDLVDMKKLSLRSLIDHSVVESFGAGGKTCITSRVYPSLAIYDNAHLFVFNNGSETITIETLNAWSMGACKMN

SEQ ID NO: 1277 - DNA, 2079 bp, Arabidopsis thaliana
  misc_feature (1)..(2079): Ceres Annot ID no. 861091
  misc_feature (1)..(2079): Encodes the peptide sequence at SEQ ID NO. 1278
atcacattctctccttattcaacttaaatactacacggccaaaaacatttaacaaacgccactcagatcctgagtctttggatcaatggctatttcaaatgttatttctgtcttattattattgcttgtactaatcaatttaagcaatcaaaatatcaaaggaattgatgcatttcatcagatttacgaagaattgcaatctgaatcagtcgagtcagtgaatcatcttcacagacctagttttcactttcaacctccaaagcattggattaacgatccaaatggtccagtatactacaaaggtctctaccatctcttctaccaatataacaccaaaggtgcggtttggggtaatattatatgggcccattcggtttctaaagacttggttaactgggaggctcttgaaccggctcttagtccttcaaaatggttcgacatcggaggtacatggtccggttcaataacaatcgtaccgggaaaaggaccgattatcctctataccggtgttaaccagaacgaaactcagttgcaaaactatgcaatcccagaggacccatcagacccatacctaaggaaatggattaaaccggacgataacccgattgcaatcccagactatacaatgaacggttcagcattccgtgacccgacaaccgcttggttctccaaagacgggcattggagaaccgtggtagggtcaaaaagaaagcgtagaggaattgcttacatctacagaagccgagatttcaagcattgggtcaaagctaagcacccggttcactctaaacagtcaaccggtatgtgggaatgtcctgatttcttcccggtttccttaaccgatttccgaaacggtttggacttggattacgtcggtccaaacaccaagcatgtgttgaaggttagcttggacattacccggtacgagtattacacgcttggtaaatacgatcttaagaaggaccggtacataccggacggtaatactcccgatggttgggagggtttaagattcgattacggtaatttctacgcttccaagacattctttgactacaaaaagaacagaagaatcttatggggttgggctaatgaatctgacaccgttgaagatgatattttgaagggttgggctggtcttcaggtgattccaagaacggtgctccttgattcaagcaagaagcaacttgtgttttggcctgttgaagagatagagtcattaagaggtaactacgtccgaatgaacaatcatgacatcaagatgggtcaacgcatagaagtcaaaggaatcactcctgctcaagccgatgtggaagtaacgttctatgttggaagtctagagaaagctgagatattcgatccgagtttcacgtggaaaccattggaattgtgtaacattaaaggctcgaatgtgagaggcggtgtaggaccttttggtctgatcacattagcgactcctgatttggaagagtacactcctgtcttctttagagtcttcaacgacactaaaactcataagcctaaagttctcatgtgctccgatgctagaccgtcgtcgttaaagcaagacacgggtttactcgcaaaagataggatgtataaaccatcgtttgctggttttgtggatgttgatatggctgatggaaggatctctctaaggagtttgattgatcattcagtagtagagagctttggagcattaggtaaaacggtgataacatcaagagtgtatccagtgaaagcagtaaaagagaatgcacatttgtatgtctttaacaatggaacacaaactgtgaccatagagagtctcaatgcttggaatatggatcgtcctctgcaaatgaatgatggagctctttaatttagctcttctctctatagtttagctataccgtcttctctctttctcactttttcttatattttcatcttcagtatagtaactgagagatactgtgaaattaggaagaaaaatgtgggagtttctgtgtttacgaacaatttggttgtgatgtccatactttatgtatcgactgttgtatctttctgtctttagtctctcaataaaaataagtttag

SEQ ID NO: 1278 - protein, 591 aa, Arabidopsis thaliana
  misc_feature (54)..(372): Pfam Name: Glyco_hydro_32N Pfam Description: Glycosyl hydrolases family 32 N termi
  misc_feature (413)..(540): Pfam Name: Glyco_hydro_32C Pfam Description: Glycosyl hydrolases family 32 C termi
  misc_feature (1)..(591): Ceres Annot ID no. 861091
  misc_feature (1)..(591): Bit score of 1152.8 for HMM based on sequences of Figure 10
  misc_feature (1)..(591): Functional Homolog Of SEQ ID NO. 1215
MAISNVISVLLLLLVLINLSNQNIKGIDAFHQIYEELQSESVESVNHLHRPSFHFQPPKHWINDPNGPVYYKGLYHLFYQYNTKGAVWGNIIWAHSVSKDLVNWEALEPALSPSKWFDIGGTWSGSITIVPGKGPIILYTGVNQNETQLQNYAIPEDPSDPYLRKWIKPDDNPIAIPDYTMNGSAFRDPTTAWFSKDGHWRTVVGSKRKRRGIAYIYRSRDFKHWVKAKHPVHSKQSTGMWECPDFFPVSLTDFRNGLDLDYVGPNTKHVLKVSLDITRYEYYTLGKYDLKKDRYIPDGNTPDGWEGLRFDYGNFYASKTFFDYKKNRRILWGWANESDTVEDDILKGWAGLQVIPRTVLLDSSKKQLVFWPVEEIESLRGNYVRMNNHDIKMGQRIEVKGITPAQADVEVTFYVGSLEKAEIFDPSFTWKPLELCNIKGSNVRGGVGPFGLITLATPDLEEYTPVFFRVFNDTKTHKPKVLMCSDARPSSLKQDTGLLAKDRMYKPSFAGFVDVDMADGRISLRSLIDHSVVESFGALGKTVITSRVYPVKAVKENAHLYVFNNGTQTVTIESLNAWNMDRPLQMNDGAL

SEQ ID NO: 1279 - DNA, 2082 bp, Arabidopsis thaliana
  misc_feature (1)..(2082): Ceres Clone ID no. 118038
  misc_feature (1)..(2082): Encodes the peptide sequence at SEQ ID NO. 1280
atcacattctctccttattcaacttaaatactacacggccaaaaacatttaacaaacgccactcagatcctgagtctttggatcaatggctatttcaaatgttatttctgtcttattattattgcttgtactaatcaatttaagcaatcaaaatatcaaaggaattgatgcatttcatcagatttacgaagaattgcaatctgaatcagtcgagtcagtgaatcatcttcacagacctagttttcactttcaacctccaaagcattggattaacgatccaaatggtccagtatactacaaaggtctctaccatctcttctaccaatataacaccaaaggtgcggtttggggtaatattatatgggcccattcggtttctaaagacttggttaactgggaggctcttgaaccggctcttagtccttcaaaatggttcgacatcggaggtacatggtccggttcaataacaatcgtaccgggaaaagtaccgattatcctctataccggtgttaaccagaacgaaactcagttgcaaaactatgcaatcccagaggaccgatcagacccatacctaaggaaatggattaaaccggacgataacccgattgcaatcccagactatacaatgaacggttcagcattccgtgacccgacaaccgcttggttctccaaagacgggcattgragaaccgtggtagggtcaaaaagaaagcgtagaggaattgcttacatctacagaagccgagatttcaagcattgggtcaaagctaagcacccggttcactctaaacagtcaaccggtatgtgggaatgtcctgatttcttcccggtttccttaaccgatttccgaaacggtttggacttggattacgtcggtccaaacaccaagcatgtgttgaaggttagcttggacattacccggtacgagtattacacgcttggtaaatacgatcttaagaaggaccggtacataccggacggtaatactcccgatggttgggagggtttaagattcgattacggtaatttctacgcttccaagacattctttgactacaaaaagaacagaagaatcttatggggttgggctaatgaatctgacaccgttgaagatgatattttgaagggttgggctggtcttcaggtgattccaagaacggtgctccttgattcaagcaagaagcaacttgtgttttggcctgttgaagagatagagtcattaagaggtaactacgtccgaatgaacaatcatgacatcaagatgggtcaacgcatagaagtcaaaggaatcactcctgctcaagccgatgtggaagtaacgttctatgttggaagtctagagaaagctgagatattcgatccgagtttcacgtggaaaccattggaattgtgtaacattaaaggctcgaatgtgagaggcggtgtaggaccttttggtctgatcacattagcgactcctgatttggaagagtacactcctgtcttctttagagtcttcaacgacactaaaactcataagcctaaagttctcatgtgctccgatgctagaccgtcgtcgttaaagcaagacacgggtttactcgcaaaagataggatgtataaaccatcgtttgctggttttgtggatgttgatatggctgatggaaggatctctctaaggagtttgattgatcattcagtagtagagagctttggagcattaggtaaaacggtgataacatcaagagtgtatccagtgaaagcagtaaaagagaatgcacatttgtatgtctttaacaatggaacacaaactgtgaccatagagagtctcaatgcttggaatatggatcgtcctctgcaaatgaatgatggagctctttaatttagctcttctctctatagtttagctataccgtcttctctctttctcactttttcttatattttcatcttcagtatagtaactgagagatactgtgaaattaggaagaaaaatgtgggagtttctgtgtttacgaacaatttggttgtgatgtccatactttatgtatcgactgttgtatctttctgtctttagtctctcaataaaaataagtttagacc

SEQ ID NO: 1280 - protein, 591 aa, Arabidopsis thaliana
  misc_feature (54)..(372): Pfam Name: Glyco_hydro_32N Pfam Description: Glycosyl hydrolases family 32 N termi
  misc_feature (413)..(540): Pfam Name: Glyco_hydro_32C Pfam Description: Glycosyl hydrolases family 32 C termi
  misc_feature (1)..(591): Ceres Clone ID no. 118038
  misc_feature (1)..(591): Bit score of 1146.3 for HMM based on sequences of Figure 10
  misc_feature (1)..(591): Functional Homolog Of SEQ ID NO. 1215
  misc_feature (200)..(200): Xaa is any aa, unknown, or other
MAISNVISVLLLLLVLINLSNQNIKGIDAFHQIYEELQSESVESVNHLHRPSFHFQPPKHWINDPNGPVYYKGLYHLFYQYNTKGAVWGNIIWAHSVSKDLVNWEALEPALSPSKWFDIGGTWSGSITIVPGKVPIILYTGVNQNETQLQNYAIPEDRSDPYLRKWIKPDDNPIAIPDYTMNGSAFRDPTTAWFSKDGHXRTVVGSKRKRRGIAYIYRSRDFKHWVKAKHPVHSKQSTGMWECPDFFPVSLTDFRNGLDLDYVGPNTKHVLKVSLDITRYEYYTLGKYDLKKDRYIPDGNTPDGWEGLRFDYGNFYASKTFFDYKKNRRILWGWANESDTVEDDILKGWAGLQVIPRTVLLDSSKKQLVFWPVEEIESLRGNYVRMNNHDIKMGQRIEVKGITPAQADVEVTFYVGSLEKAEIFDPSFTWKPLELCNIKGSNVRGGVGPFGLITLATPDLEEYTPVFFRVFNDTKTHKPKVLMCSDARPSSLKQDTGLLAKDRMYKPSFAGFVDVDMADGRISLRSLIDHSVVESFGALGKTVITSRVYPVKAVKENAHLYVFNNGTQTVTIESLNAWNMDRPLQMNDGAL

SEQ ID NO: 1281 - DNA, 1539 bp, Solanum lycopersicum
  misc_feature (1)..(1539): Ceres Annot ID no. 8462885
  misc_feature (1)..(1539): Encodes the peptide sequence at SEQ ID NO. 1282
atgtatttcaatggagtgtatcatctattctaccagtacaacccaaatggttcagtatggggtaacattgtttgggctcattccgtttcaaaagacttgatcaattggatcaatttagaacctgcaatttacccatcaaagccatttgatcaattcggtacctggtctggatcagcaaccatcctacctggtaacaagccagtcatcttgtacaccggaatcatagatgccaaccaaacccaagtccaaaactacgcaatcccagctaacttatccgatccatatctccgcgaatggatcaagccagacaacaacccattaattatagccgatgaaagtatcaacaagaccaagtttcgtgacccaacaacagcatggatgggtaaagacgggcattggagaatcgtcatgggaagtttgaggaaacacagcaggggcttagctataatgtataggagcaaagactttatgaaatgggtcaaggctaaacacccacttcactcaactaacggcactggaaactgggaatgccctgatttttacccagtttcatcgaaaggtactgatgggttggatcaatacggtgaggaacacaagtacgtgctgaagaacagtatggatcttactcgatttgagtattatacacttggaaaatacgatacgaaaaaagataggtacgttccagatccagattctgtcgatagtttgaagggattgagactcgattacggtaacttctacgcatcgaagtcattctacgatccaagcaaaaatcgaagggttatctggggttggtctaatgaatcagatatattcccagaggatgataatgcgaagggatgggctgggattcaattgattcctcgtaaagtatggcttgatccaagtggtaagcagttggttcaatggcctgtggaggaactagaaaccctaagaactcaaaaggttcaattgagcaacaagaagatgaacaatggggagaagattgaagttacaggaatcacaccagcacaggctgatgttgaagtgacattctcatttgcaagtttggataaggcagagtcatttgatcctaaatggaatgatatgtatgcacaagatgtttgtggactcaagggtgcagatgttcaaggtgggcttgggccatttggtcttgctacattagctactgaaaacttggaagaaaacacaccggttttcttccgagttttcaaagcacagcaaaactacaaggttctcttgtgttctgacgctaaaaggtcaactcttaagttcaatgaaacaatgtacaaagcttcatttgctggatttgttgatgttgatttggctgacaagaaattgtcactcagaagcttgattgataattcagttatagaaacttttggtgctggtggaaagacatgtataacatcgagggtttatccaacattggcaattaacgacgaggcacatttattcgcgtttaacaacggaacggagccaatcacaattgagagtttggatgcatggagtatgggcaaagctaagatacaatattga

SEQ ID NO: 1282 - protein, 512 aa, Solanum lycopersicum
  misc_feature (1)..(304): Pfam Name: Glyco_hydro_32N Pfam Description: Glycosyl hydrolases family 32 N termi
  misc_feature (345)..(465): Pfam Name: Glyco_hydro_32C Pfam Description: Glycosyl hydrolases family 32 C termi
  misc_feature (1)..(512): Ceres Annot ID no. 8462885
  misc_feature (1)..(512): Bit score of 1041.8 for HMM based on sequences of Figure 10
  misc_feature (1)..(512): Functional Homolog Of SEQ ID NO. 1215
MYFNGVYHLFYQYNPNGSVWGNIVWAHSVSKDLINWINLEPAIYPSKPFDQFGTWSGSATILPGNKPVILYTGIIDANQTQVQNYAIPANLSDPYLREWIKPDNNPLIIADESINKTKFRDPTTAWMGKDGHWRIVMGSLRKHSRGLAIMYRSKDFMKWVKAKHPLHSTNGTGNWECPDFYPVSSKGTDGLDQYGEEHKYVLKNSMDLTRFEYYTLGKYDTKKDRYVPDPDSVDSLKGLRLDYGNFYASKSFYDPSKNRRVIWGWSNESDIFPEDDNAKGWAGIQLIPRKVWLDPSGKQLVQWPVEELETLRTQKVQLSNKKMNNGEKIEVTGITPAQADVEVTFSFASLDKAESFDPKWNDMYAQDVCGLKGADVQGGLGPFGLATLATENLEENTPVFFRVFKAQQNYKVLLCSDAKRSTLKFNETMYKASFAGFVDVDLADKKLSLRSLIDNSVIETFGAGGKTCITSRVYPTLAINDEAHLFAFNNGTEPITIESLDAWSMGKAKIQY

SEQ ID NO: 1283 - protein, 524 aa, Arabidopsis thaliana
  misc_feature (1)..(305): Pfam Name: Glyco_hydro_32N Pfam Description: Glycosyl hydrolases family 32 N termi
  misc_feature (346)..(473): Pfam Name: Glyco_hydro_32C Pfam Description: Glycosyl hydrolases family 32 C termi
  misc_feature (1)..(524): Public GI ID no. 79314823
  misc_feature (1)..(524): Bit score of 1034.6 for HMM based on sequences of Figure 10
  misc_feature (1)..(524): Functional Homolog Of SEQ ID NO. 1215
MLYKGVYHLFYQYNPKGAVWGNIVWAHSVSKDLINWEALEPAIYPSKWFDINGTWSGSATHVPGKGPVILYTGITENQTQIQNYAIPQDLSDPYLKTWIKPDDNPIVKPDNGENGSAFRDPTTAWFNKKDGYWRMLVGSKRKNRGIAYMYKSRDFKKWVKSKRPIHSRKKTGMWECPDFFPVSVTDKKNGLDFSYDGPNAKHVLKVSLDLTRYEYYTLGTYDTKKDRYRPDGYTPDGWDGLRFDYGNYYASKTFFDDKTNRRILWGWANESDTVQDDTVKGWAGIQLIPRTILLDSSGKQLVFWPIEEIESLRGKNVQMTNQKMEMGQRFEVQGITPAQVDVDVTFNVGNLEKAEKFDESFATKPLELCNLKGSNVNGGVGPFGLITLATSDLEEYTPVFFRVFKDAASNKPKVLMCSDAKPSSLKKDTGTDAKERMYKPSFAGFVDVGLLDGKISLRSLIDHSVVESFGAKGKTVITSRVYPTKAVGEKAHLFVFNNGSQPVTVESLNAWNMQKPLKMNQGAK

SEQ ID NO: 1284 - protein, 564 aa, Glycine max
  misc_feature (45)..(362): Pfam Name: Glyco_hydro_32N Pfam Description: Glycosyl hydrolases family 32 N termi
  misc_feature (403)..(518): Pfam Name: Glyco_hydro_32C Pfam Description: Glycosyl hydrolases family 32 C termi
  misc_feature (1)..(564): Public GI ID no. 33636090
  misc_feature (1)..(564): Bit score of 979.7 for HMM based on sequences of Figure 10
  misc_feature (1)..(564): Functional Homolog Of SEQ ID NO. 1215
MAMSTILLLTFFSFIYGSAATHHVYRNLQSLSSDSSNQPYRTAYHFQPPKNWINDPNGPLRYAGLYHLFYQYNPKGAVWGNIVWAHSVSKDLVNWTPLDPAIFPSQPSDINGCWSGSTTLLPGNKPVILYTGIDLLNQQVQNLAQPKNLSDPFLREWVKSPKNPLMAPTSANKINSSSFRDPTTAWLGKDGHWRVLVGSKRRTRGIAILYRSKDFVNWVQAKHPLYSILGSGMWECPDFFPVLNNDQLGVDTSVNGYDVRHVLKVSLDDKKHDYYMIGSYNAAKDAFIPDEESNEFVLRYDYGKYYASKTFFDDGKKRRILLGWANESSSVAADIKKGWSGIHTIPRALWLHKSGKQLVQWPVVEVEKLRAYPVNLPPQVLKGGKLLPINGVTATQADVEISFEVSNLREAEVLDYWTDPQILCSKKGSSIKSGLGPFGLLVFASEGLQEYTSVFFRIFRHQHKYLVLLCSDQSRSSLNKDNDLTSYGTFVDVDPLHEKLSLRTLIDHSVVESFGGEGRACITARVYPTLAINDEAQLYAFNNGTADVNITKLNAWSMKKAQIN

SEQ ID NO: 1285 - protein, 582 aa, Pisum sativum
  misc_feature (51)..(373): Pfam Name: Glyco_hydro_32N Pfam Description: Glycosyl hydrolases family 32 N termi
  misc_feature (414)..(529): Pfam Name: Glyco_hydro_32C Pfam Description: Glycosyl hydrolases family 32 C termi
  misc_feature (1)..(582): Public GI ID no. 3152880
  misc_feature (1)..(582): Bit score of 955.9 for HMM based on sequences of Figure 10
  misc_feature (1)..(582): Functional Homolog Of SEQ ID NO. 1215
MAISSIFLLSLFSLIYVIPIEATHHVYQTLETLSSHHSSKSNHQPYRTAYHFQPLKNWINDPNGPMRYGGFYHLFYQYNPKGAVWGNIVWAHSVSKDLVNWTPLDHAIHPSQPSDIKGCWSGSATILPGGKPAILYTGIDPNNHQVQNIAIPKNMSDPLLREWKKSPKNPLMEPTIANKINSSSFRDPTTSWLGKDGFWRVLIGSKIDTKGMAILYKSKNFVDWVEAKHPLHSAEGTGMWECPDFYPVLDKNLLRTGVDTSRNGDDDVRHVLKVSLDDTKHDHYLIGSYDVVKDVFVPENGFEDNGFVLRYDYGKYYASKTFFDDGKNRRILLGWVNESSSVADDVKKGWSGIHTIPREIWLHESGKQLVQWPVKEIENLRMNPVNWPTKVIKGGERISITGVDSVQADVEISFEISDLGKVESLRKWIDPQLLCSQKGAGVKGGVGPFGLLVFASQGLKEYTAVFFRIFKYQDKNLVLMCSDQSRSSLNKDNDMTSYGTFVDVDPLHEKLSLRTLIDHSVVESFGGEGRACVTARVYPTLAIHDKAMLYAFNNGTSAVKITSLSAWSMKKAKDQLKLTSEY

SEQ ID NO: 1286 - protein, 577 aa, Fragaria x ananassa
  misc_feature (53)..(372): Pfam Name: Glyco_hydro_32N Pfam Description: Glycosyl hydrolases family 32 N termi
  misc_feature (413)..(532): Pfam Name: Glyco_hydro_32C Pfam Description: Glycosyl hydrolases family 32 C termi
  misc_feature (1)..(577): Public GI ID no. 4205115
  misc_feature (1)..(577): Bit score of 960.9 for HMM based on sequences of Figure 10
  misc_feature (1)..(577): Functional Homolog Of SEQ ID NO. 1215
MIFSLWQFCLLSLLLSFGVIELQASHHVYSNLQTTQLASTHPQAKDPYRTGYHFQPRKNWINDPNGPLIYKGIYHLFYQYNPSSVVWGNIVWAHSTSTDLVNWIPHEAAIYPSILSDINGCWSGSVTILPSGKPAILYTGINPDKEQVQNLAFPKNLSDPFLREWVKVPQNPLMAPTQANQINASSFRDPTTAWLGPDKRWRLIIGSKRNHRGLAILYRSKDFMHWTKAKHPLYSTPKNGMWECPDFFPVSKTKLLGLDTSAIGPDVKHVLKVSLDNTRKEYYTIGTYNVSKDIYIPDDGSIESDSGLRYDYGKFYASKTFFDSAKNRRILWGWINESSSVSGDIKKGWSGLQAIPRTIVLDKSRKQLVQWPVVELEKLRTNEVKLPSTLLKGGSLHEVIGVTAAQADVDVAFEISDLKKAEVMDPSWTNAQLLCSKKGTSVKGALGPFGLLAFVSKDLKEKTAIFYRIFKSHNNNNKYVVLMCSDQSRSSLNPDNDMTTYGTFVNVDPLHEKLSLRSLIDHSIVESFGGKGKECITARVYPTLAVDGDTHLYAFNYGSESVKIAGSAWSMKTAKIN

SEQ ID NO: 1287 - DNA, 2055 bp, Panicum virgatum
  misc_feature (1)..(2055): Ceres Clone ID no. 1789943
  misc_feature (1)..(2055): Encodes the peptide sequence at SEQ ID NO. 1288
atcatctctctctcctcctccatggccctcatgctccgcccttgggcctttcttctcttccttgcactgctctcctacgatgaatctggtcttcagagcacgaggaatggagttgcacaggccacgcagagggtcttcctgtatccgcagtctcccaaggtctcctctattgtgagcaccaagtacaggactgcctaccacttccagcctcccaagaactggatcaacgatccaaatgggccaatgtactacaatggtatctatcaccaattctaccagtacaatccaaacggttcactctggggtaacatagtttggggccactcggtctcaacagatctcatcaactggatccggcttgagccagcaatagaacaaacaactccgagcgacataaacggttgttggactggttcagccacaatcctcaagggcggtcggcctgttatcatatacactggtgctgacacagagaagcgtcaagtccaaaacattgtgtttccaaagaacgtgtctgatccatacctgaaggaatggatcaaaccagacaacaaccccttgatccaaccggttggtcaaggattgaactcagaccaatttagagatccgacaaccagttggattggaccagatgggctgtggagaatagcaattggggctgagctgaacggctacagtgcagcacttttgtacaagagtgaggattttgtgaactggactagagttgatcacccactgtactcttccaatgcctccaccatgtgggagtgcccagatttctttgcagtattacccggaaagaacagtggattggacttgtctgcagctatcccgaatggtgctaagcatgtcctcaaaatgagcttggataattgtgacaagtacatggttggtgtttatgatctcaaaagcgatacattcgtcccagataccgtacttgatgaccgaagattgtggtcaaggattgactacggcaattactatgcttctaagtcgttcttcgattcgaagaggggcaggaggattatatggggttggaccaatgagacagatagttcgtcagatgatgttgccaaaggttgggcaggaatccatgcgatccccaggactatatggttagatagcaacagtaagcaattgctgcaatggccagttgaagagatcgagtcgcttcgaagagaagaagtcagccaccaaggcttggagctgaatcagggggatctgtttgagattaagggaattgatactttacaggcagatgtggagatagattttgagcttacatccatagatagtgctggtccttttgatccttcctggcttttggacatcgagaagcattgtcgggaagcaggtgcatcggttcatggtgatgtgggcccatttggacttgtggttcttgcgtctgataacatggaagagcacacttctgtatacttcagagtttacaaatcacaagagaagtacatgattcttatgtgctcggatctgagaaaatcatccttgagaccagagctgtacacacctgcctatggaggcttctttgaatttgacctcgagaaggaaaagacaatatctttgagaactttgattgatcgctctgcggtggagagctttggtggcggtggcaagctctgcatcatggccagggtttaccccgtgacggttatcaatggcggcactcggatgtatgcgttcaacaatggaaccagcaccgtcaaagtgcctcagctgaaggcatggagcatgaggagagcacaagtgaatgtgaagatgggataagcatgttactatacatcatttagcaataacaaacccttttgaccatattgggggagtgcatgagttacttcaaggcgtcatgctatcctacttgcaagcttatcctttagctcctggaaagaaaagaagggggacacaatactaaacaccagatgactgacatcagattatgtaattcatttgctagaaggaaaggaaacagagattattgtttagtactagtgattagaagaacaaacaattccatcgttcaagtggaagtattttatagac

SEQ ID NO: 1288 - protein, 586 aa, Panicum virgatum
  misc_feature (60)..(377): Pfam Name: Glyco_hydro_32N Pfam Description: Glycosyl hydrolases family 32 N termi
  misc_feature (418)..(536): Pfam Name: Glyco_hydro_32C Pfam Description: Glycosyl hydrolases family 32 C termi
  misc_feature (1)..(586): Ceres Clone ID no. 1789943
  misc_feature (1)..(586): Bit score of 905.4 for HMM based on sequences of Figure 10
  misc_feature (1)..(586): Functional Homolog Of SEQ ID NO. 1215
MALMLRPWAFLLFLALLSYDESGLQSTRNGVAQATQRVFLYPQSPKVSSIVSTKYRTAYHFQPPKNWINDPNGPMYYNGIYHQFYQYNPNGSLWGNIVWGHSVSTDLINWIRLEPAIEQTTPSDINGCWTGSATILKGGRPVIIYTGADTEKRQVQNIVFPKNVSDPYLKEWIKPDNNPLIQPVGQGLNSDQFRDPTTSWIGPDGLWRIAIGAELNGYSAALLYKSEDFVNWTRVDHPLYSSNASTMWECPDFFAVLPGKNSGLDLSAAIPNGAKHVLKMSLDNCDKYMVGVYDLKSDTFVPDTVLDDRRLWSRIDYGNYYASKSFFDSKRGRRIIWGWTNETDSSSDDVAKGWAGIHAIPRTIWLDSNSKQLLQWPVEEIESLRREEVSHQGLELNQGDLFEIKGIDTLQADVEIDFELTSIDSAGPFDPSWLLDIEKHCREAGASVHGDVGPFGLVVLASDNMEEHTSVYFRVYKSQEKYMILMCSDLRKSSLRPELYTPAYGGFFEFDLEKEKTISLRTLIDRSAVESFGGGGKLCIMARVYPVTVINGGTRMYAFNNGTSTVKVPQLKAWSMRRAQVNVKMG

SEQ ID NO: 1289 - protein, 567 aa, Beta vulgaris
  misc_feature (44)..(363): Pfam Name: Glyco_hydro_32N Pfam Description: Glycosyl hydrolases family 32 N termi
  misc_feature (404)..(521): Pfam Name: Glyco_hydro_32C Pfam Description: Glycosyl hydrolases family 32 C termi
  misc_feature (1)..(567): Public GI ID no. 21322514
  misc_feature (1)..(567): Bit score of 910.6 for HMM based on sequences of Figure 10
  misc_feature (1)..(567): Functional Homolog Of SEQ ID NO. 1215
MASCLKSQKQVILLLVSVLLAYGVSELQAARSPPTNQPYRTAYHFQPRKNWINDPNGPMLYKGVYHLFYQYNPNGVIWGPPVWGHSTSKDLVNWVPQPLTMEPEMAANINGSWSGSATILPGNKPAILFTGLDPKYEQVQVLAYPKDTSDPNLKEWFLAPQNPVMFPTPQNQINATSFRDPTTAWRLPDGVWRLLIGSKRGQRGLSLLFRSRDFVHWVQAKHPLYSDKLSGMWECPDFFPVYANGDQMGVDTSIIGSHVKHVLKNSLDITKHDIYTIGDYNIKKDAYTPDIGYMNDSSLRYDYGKYYASKTFFNDAKKERILLGWANESSSVEDDIKKGWSGIHTIPRKIWLDKLGKQLIQWPIANIEKLRQNPVNIFRKVLKKGSQIEVSGITAAQADAEISFKIKDLKNVEKFDASWTSPQLLCSKKGASVKGGLGPFGLLTLASKGLEEYTAVFFRIFKAYDNKFVVLMCSDQSRSSLNPTNDKTTYGTFVDVNPIREGLSLRVLIDHSVVESFGAKGKNVITARVYPTLAINEKAHLYVFNRGTSNVEITGLTAWSMKKANIA

SEQ ID NO: 1290 - DNA, 1915 bp, Arabidopsis thaliana
  misc_feature (1)..(1915): Ceres Annot ID no. 867594
  misc_feature (1)..(1915): Encodes the peptide sequence at SEQ ID NO. 1291
caaaagaaacagaacaacaatggcgaaattaaatcgttccaacattggtctctcactgttactatctatgttcctcgcaaactttatcaccgatcttgaagcttcttctcatcaagatctcaaccaaccgtaccggaccggttatcactttcaacctctcaaaaattggatgaacgatcctaatggaccaatgatatacaaaggaatataccatcttttttaccaatataacccatacggtgccgtttgggatgtgagaatcgtgtggggacactccacgtcagttgacttagtcaactggatttcacaacctccagcttttaatccatctcagccgtcagatatcaacggttgttggtcaggctccgtcacgattctaccaaacggcaaacctgtgatcctctacaccggcattgaccaaaacaaaggtcaagtccaaaacgtcgccgttccggttaacatctctgatccttatctccgagaatggtcaaaaccgccgcaaaatcctctaatgacaactaacgcggttaacggaattaacccggaccggtttcgtgatccgaccaccgcgtggcttggacgtgacggagaatggcgagtaatcgtcggaagctcgacggacgatcgacgaggattagcgattctttacaaaagcagagatttcttcaactggacgcaatcaatgaagcctttacattacgaagacttaaccggaatgtgggaatgtcctgattttttcccggtttcgataaccggatcggacggtgtagaaacgtcgtcggttggtgagaatgggattaagcatgtgcttaaagtgagtttgattgagacattgcatgattattacacgattgggagttatgatcgtgagaaagatgtttacgtaccggatcttgggtttgtgcaaaacgaatcagctccgaggttagattacgggaaatattacgcgtcgaaaacgttttacgatgatgttaaaaaacgaaggatcttgtggggttgggttaatgaatcgtctccagctaaagatgatattgagaagggttggtctggtcttcagtcatttccgaggaaaatatggctcgatgaatcaggaaaggaattgctacagtggccgattgaagagattgagacattgcgtgggcaacaagtcaactggcaaaagaaagttctcaaagcaggatctactctccaagttcatggtgtcactgctgcgcaggcagatgttgaggtatcgttcaaggtgaaggaattggaaaaggcggatgtgattgaaccgagttggaccgatccacaaaagatatgtagtcagggagatttatcggttatgtcgggtttaggaccatttggtttgatggttttggcatccaatgacatggaagagtacacgtccgtttacttcagaattttcaagtcaaatgacgatactaacaagaagactaaatacgtggtgttgatgtgcagtgaccaaagcagatcatcgttaaatgatgaaaatgataaatcaacctttggtgcttttgttgcgatagacccttctcaccaaacaatttctcttaggactttgattgatcactcgatagtggagagttatggtggaggaggcagaacatgtataacctcaagagtgtatccaaaattggcaatcggagaaaatgcaaatctgtttgtcttcaacaaaggcactcaaagtgttgatatcttgaccctaagtgcttggagtttaaagtctgctcaaatcaatggcgacttaatgtcaccatttattgagcgtgaagagtcacgctcacctaatcatcagttttgaatgaaaaatattttacattgtacgggtaaaacgaaatatataagagattattacatattaagagatattaacattcttattttaccattcacttccaaatttgaagatttt

SEQ ID NO: 1291 - protein, 594 aa, Arabidopsis thaliana
  misc_feature (43)..(365): Pfam Name: Glyco_hydro_32N Pfam Description: Glycosyl hydrolases family 32 N termi
  misc_feature (406)..(528): Pfam Name: Glyco_hydro_32C Pfam Description: Glycosyl hydrolases family 32 C termi
  misc_feature (1)..(594): Ceres Annot ID no. 867594
  misc_feature (1)..(594): Bit score of 908.8 for HMM based on sequences of Figure 10
  misc_feature (1)..(594): Functional Homolog Of SEQ ID NO. 1215
MAKLNRSNIGLSLLLSMFLANFITDLEASSHQDLNQPYRTGYHFQPLKNWMNDPNGPMIYKGIYHLFYQYNPYGAVWDVRIVWGHSTSVDLVNWISQPPAFNPSQPSDINGCWSGSVTILPNGKPVILYTGIDQNKGQVQNVAVPVNISDPYLREWSKPPQNPLMTTNAVNGINPDRFRDPTTAWLGRDGEWRVIVGSSTDDRRGLAILYKSRDFFNWTQSMKPLHYEDLTGMWECPDFFPVSITGSDGVETSSVGENGIKHVLKVSLIETLHDYYTIGSYDREKDVYVPDLGFVQNESAPRLDYGKYYASKTFYDDVKKRRILWGWVNESSPAKDDIEKGWSGLQSFPRKIWLDESGKELLQWPIEEIETLRGQQVNWQKKVLKAGSTLQVHGVTAAQADVEVSFKVKELEKADVIEPSWTDPQKICSQGDLSVMSGLGPFGLMVLASNDMEEYTSVYFRIFKSNDDTNKKTKYVVLMCSDQSRSSLNDENDKSTFGAFVAIDPSHQTISLRTLIDHSIVESYGGGGRTCITSRVYPKLAIGENANLFVFNKGTQSVDILTLSAWSLKSAQINGDLMSPFIEREESRSPNHQF

SEQ ID NO: 1292 - protein, 555 aa, Pisum sativum
  misc_feature (51)..(373): Pfam Name: Glyco_hydro_32N Pfam Description: Glycosyl hydrolases family 32 N termi
  misc_feature (414)..(529): Pfam Name: Glyco_hydro_32C Pfam Description: Glycosyl hydrolases family 32 C termi
  misc_feature (1)..(555): Public GI ID no. 2500930
  misc_feature (1)..(555): Bit score of 875.4 for HMM based on sequences of Figure 10
  misc_feature (1)..(555): Functional Homolog Of SEQ ID NO. 1215
MAISSIFLLSLFSLIYVIPIEATHHVYQTLETLSSHHSSKSNHQPYRTAYHFQPLKNWINDPNGPMRYGGFYHLFYQYNPKGAVWGNIVWAHSVSKDLVNWTPLDHAIHPSQPSDIKGCWSGSATILPGGKPAILYTGIDPNNHQVQNIAIPKNMSDPLLREWKKSPKNPLMEPTIANKINSSSFRDPTTSWLGKDGFWRVLIGSKIDTKGMAILYKSKNFVDWVEAKHPLHSAEGTGMWECPDFYPVLDKNLLRTGVDTSRNGDDDVRHVLKVSLDDTKHDHYLIGSYDVVKDVFVPENGFEDNGFVLRYDYGKYYASKTFFDDGKNRRILLGWVNESSSVADDVKKGWSGIHTIPREIWLHESGKQLVQWPVKEIENLRMNPVNWPTKVIKGGERISITGVDSVQADVEISFEISDLGKVESLRKWIDPQLLCSQKGAGVKGGVGPFGLLVFASQGLKEYTAVFFRIFKYQDKNLVLMCSDQSRSSLNKDNDMTSYGTFVDVDPLHEKLSLRTLIDHSVVESFGGEGRACVTARVYPTLAIHDKAMLKLTSEY

SEQ ID NO: 1293 - protein, 573 aa, Chenopodium rubrum
  misc_feature (44)..(365): Pfam Name: Glyco_hydro_32N Pfam Description: Glycosyl hydrolases family 32 N termi
  misc_feature (408)..(526): Pfam Name: Glyco_hydro_32C Pfam Description: Glycosyl hydrolases family 32 C termi
  misc_feature (1)..(573): Public GI ID no. 2597853
  misc_feature (1)..(573): Bit score of 863.5 for HMM based on sequences of Figure 10
  misc_feature (1)..(573): Functional Homolog Of SEQ ID NO. 1215
MASYKLPKQVILLLVSLLFFCYGVVELQAAQSPPSNQPYRTAYHFQPRKNWINDPNGPMLFKGIYHLFYQYNPNGVKLRGPPVWGHSTSKDLVNWMPQPLTMEPEMAANINGSWSGSATILPGNKPAILFTGLDPNYEQVQVLAYPKDLNDPYLKEWFLAPKNPVMFPTPQNQINATSYRDPTTAWMLPDGNWRVLIGKSKRRQRGLSLLYRSRDFVHWVKAKHPLYSYERSGMWECPDFFPVYKNGNTMGIDTSVIGPNIKHVLKVSLDVSKHDVYTIGGYDTKKDAYTPDVGFMNDSSLRYDYGKYYASKTFYDGAKKERILLGWANESSSEEDDAKKGWSGIHTIPRTIWLDKSGNQLIQWPISNIEKLRQKSPVFKLYGKLIKGGSLNEVSGITAAQADVEISFKIKDLENVEKFDASWTNPQLLCSQKGGSVKGGLGPFGLMTFQASKGLEEYTAVFFRIFKAYDNKYVVLMCSDQSRSSLNPTNDKTTYGSFVDVNPVREDLSLRVLIDHSVVESFGAKRKECVTARVYPTLAINEKACNLYVFNNGKSDVEITGLTAWSMKKASIA

SEQ ID NO: 1294 - protein, 578 aa, Campanula rapunculoides
  misc_feature (50)..(366): Pfam Name: Glyco_hydro_32N Pfam Description: Glycosyl hydrolases family 32 N termi
  misc_feature (407)..(523): Pfam Name: Glyco_hydro_32C Pfam Description: Glycosyl hydrolases family 32 C termi
  misc_feature (1)..(578): Public GI ID no. 53127612
  misc_feature (1)..(578): Bit score of 876.4 for HMM based on sequences of Figure 10
  misc_feature (1)..(578): Functional Homolog Of SEQ ID NO. 1215
MKKSFIFISLLLALCYSLLVLHHGFVDAADADSSVHLSLPSDQPYRTGYHFQPPQNWMNDPNGPMYYKGVYHFFYQYNPNGPLFGDIMIWGHSVSYDLVNWIHIDPAIYPTDPADINSCFSGSATFLPGYKPVMLYTGLDTEKRQVQNLAVPKNLSDPFLREWVKHKANPIMTTPEGVKADDFRDPSTAWLGYDGKWRVLVGSKKNDLGVAYLYQSKDFVKWERFDYPLMSMMETSTWECPDFFPVSVSSTNGLDTSGVINPGVKHVVKVGFNGIDWYTIGTLSERDNYVPENGLKGNSLDMRYDYGKFYASKSFYDNAKQRRVLWGWISEADAQEDDVARGWSGLQAVPRSVWLDRNGKQLVQWPVEEIEKLRENEVKFSNKELEGGSLFEVEGITASQADVKISFKLSNLEEAEELDPSWTDPQLLCSEMGVSSKGKYGPFGLLALASDDLTEQTAIFFRVFSSHGKYVVLMCSDQRRSSISNNVEKTTYGTFVDIDPKHEEISLRSLIDHSIIESFGAEGKSCITARVYPRLAINKDAHLYTFNYGSESVMISELNAWSMKNAHMIVDETLSSAA

SEQ ID NO: 1295 - protein, 581 aa, Lolium perenne
  misc_feature (54)..(371): Pfam Name: Glyco_hydro_32N Pfam Description: Glycosyl hydrolases family 32 N termi
  misc_feature (412)..(530): Pfam Name: Glyco_hydro_32C Pfam Description: Glycosyl hydrolases family 32 C termi
  misc_feature (1)..(581): Public GI ID no. 70780260
  misc_feature (1)..(581): Bit score of 841.1 for HMM based on sequences of Figure 10
  misc_feature (1)..(581): Functional Homolog Of SEQ ID NO. 1215
MAQAWAFFLLALFSFSSYVSRIFLCSRNGEGSFLCARAPEVPSIVSDRYRTAYHFQPPKNWMNDPNGPMYYNGIYHLFFQHNPNGPQWGDIVWGHSVSTDLVDWIILEPAIEPDTPGDIKGCWSGSATILFGGQPVIMYTGGDVENHQVQNIALPKNRPDLYLREWTKAGNNPVLQPVGPGMNPGEFRDPTTGWIGPDGLWRIGIGAEVNGYSAALLYKSEDFLNWNRVDHPLYSSSASTMWECLDFFAVLPGSNGGLDLSAATPKGAKHVLKFSEDQCDKYMIGVYDLERDAFVPDTVLDDRRLLPRIDYGNYYASKSFFDSKNRRRIIWGWTNESDSSSDDIAKGWAGIYAIPRKIWLDRDGKQLLQWPVEEIDSLRRNEISYQGLDLEKGDLYEIKGVDTLQADVEIDFELTSIDDADSFDPSWLLDPEKHCREAGASVHGGIGPFGLVILASSDMEEHTVVHFRVYKSQKEYMILMCSDIRRSSLRQGLYTPAYGGFFEFDLEKERKISLRTLIDRSAVESFGGGGRVCIIARVYPEAIIDDGKAQMYVFNNGSTTVRVPHLRAWSMMTAQVNLKKG

SEQ ID NO: 1296 - protein, 576 aa, Coffea canephora
  misc_feature (51)..(369): Pfam Name: Glyco_hydro_32N Pfam Description: Glycosyl hydrolases family 32 N termi
  misc_feature (410)..(527): Pfam Name: Glyco_hydro_32C Pfam Description: Glycosyl hydrolases family 32 C termi
  misc_feature (1)..(576): Public GI ID no. 112383512
  misc_feature (1)..(576): Bit score of 944.5 for HMM based on sequences of Figure 10
  misc_feature (1)..(576): Functional Homolog Of SEQ ID NO. 1215
MASFYLWLMCLCWMVVLGHGILEAEASHGVYRNLASLQPASPSQTYRTSYHFQPPKNWMNDPNGPTVYRGLYHLFYQYNPLGPDWGNIVWAHSTSKDLINWNPHKAAIFPSQKGDVNGCWSGSTTMLRGENPAILYTGIDPKSQQVQNLAVPRNLSDPYLIEWVKSPYNPLMTPTPENKIDSSSFRDPTTAWLGPDGRWRVIVGNKLNRRGKALLYRSKDFVRWTKAQHPLYSIQGTGMWECPDFYPVSSSPIGLDTSTIGEGVKHVLKVSLDDTKHDQYAIGTYVHSKDVFVPNAGAAEKFSGLRYDYGKSYASKTFYDSLKKRRILWGWINESLSREDYIAQGWSGVQAIPRLVWLDKSGKQLVQWPISEIETLRQKKVGYPLTLLKSGSTLEVQGIKAAQADVDVSFQVAPQLEQADALDPSWTDPQLLCSQKGASVRGGTGPFGLKVLASKDLQEYTAVFFRIFKARNKYVVLMCSDQSRSSLNEKPDKTTYGAFLDVDPLHEELSLRSLIDHSIVESFGGKGKACITSRVYPTKALGNEARLYVFNYGKANVAISSMNAWTMKNASINRKN

SEQ ID NO: 1297 - protein, 599 aa, Hordeum vulgare
  misc_feature (68)..(385): Pfam Name: Glyco_hydro_32N Pfam Description: Glycosyl hydrolases family 32 N termi
  misc_feature (426)..(544): Pfam Name: Glyco_hydro_32C Pfam Description: Glycosyl hydrolases family 32 C termi
  misc_feature (1)..(599): Public GI ID no. 38141533
  misc_feature (1)..(599): Bit score of 830.9 for HMM based on sequences of Figure 10
  misc_feature (1)..(599): Functional Homolog Of SEQ ID NO. 1215
MAQAWAFLLLPALALASYASHLLLPAYITTPLCGGGDGARSFFLCAQAPKDQDQDPSPASTMYKTAFHFQPAKNWMNDPSGPMYFNGIYHEFYQYNLNGPIFGDIVWGHSVSTDLVNWIGLEPALVRDTPSDIDGCWTGSVTILPGGKPVIIYTGGNIDQHQTQNIAFPKNRSDPYLREWIKAANNPVLRPDEPGMNVIEFRDPTTGWIGPDGHWRMAVGGELNGYSAALLYKSEDFLNWTKVDHPPYSHNGSNMWECPDFFAALPGNNGGLDLSAAIPQGAKHALKMSVDSVDKYMIGVYDLQRDAFVPDNVVDDRRLWLRMDYGTFYASKSFFDSKKGRRIVWGWSGETDSPSDDLAKGWAGLHTIPRTIWLAADGKQLLQWPVEEIESLRTNEINHQGLELNKGDLFEIKEVDAFQADVEIDFELASIDEAEPFDPSWLLDPEKHCGEAGASVPGGIGPFGLVILASDNMDEHTEVYFRVYKSQEKYMVLMCSDLRRSSLRPGLEKPAYGGFFEFDLAKERKISLRTLIDRSAVESFGGGGRVCITSRVYPAVLANVGRAHIYAFNNGNAMVRVPQLSAWTMRKAQVNVEKGWSAI

SEQ ID NO: 1298 - protein, 556 aa, Beta vulgaris
  misc_feature (44)..(363): Pfam Name: Glyco_hydro_32N Pfam Description: Glycosyl hydrolases family 32 N termi
  misc_feature (404)..(521): Pfam Name: Glyco_hydro_32C Pfam Description: Glycosyl hydrolases family 32 C termi
  misc_feature (1)..(556): Public GI ID no. 18072861
  misc_feature (1)..(556): Bit score of 858.3 for HMM based on sequences of Figure 10
  misc_feature (1)..(556): Functional Homolog Of SEQ ID NO. 1215
  misc_feature (555)..(555): Xaa is any aa, unknown, or other
MASCLKSRKQVILLLVSVLLAYGVSELQAARSPPTNQPYRTAYHFQPRKNWINDPNGPMLYKGVYHLFYQDNPNGVIWGPPVWGHSPSKDLVNWVPQPLTMEPEMAANINGSWSGSATILPGNKPAILFTGLDPKYEQVQVLAYPKDTSDPNLKEWFLAPQNPVMFPTPQNQINATSFRDPTTAWRLPDGVWRLLIGSKRGQRGLSLLFRSRDFVHWVQAKHPLYSDKLSGMWECPDFFPVYANGDQMGVDTSIIGSHVKHVLKNSLDIPKHDIYTIGDYNIKKDAYPPDIGYMNDSSLRYDYGKYYASKPFFADAKKERILLGWANESSSVEDDIKKGWSGIHTIPRKIWLDKLGKQLIQWPIANIEKLRQKPVNIYRKVLKGGSQIEVSGITAAQADVEISFKIKDLKNVEKFDASWTSPQLLCSKKGASVKGGLGPFGLLTLASKGLEEYTAVFFRIFKAYDNKFVVLMCSDQSRSSLNPTNDKTTYGTFVDVNPIREGLSLRVLIDHSVVESFGAKGKNVITARVYPTLAINEKAHLYVFNRGTSNVENGXS

SEQ ID NO: 1299 - protein, 565 aa, Asparagus officinalis
  misc_feature (50)..(359): Pfam Name: Glyco_hydro_32N Pfam Description: Glycosyl hydrolases family 32 N termi
  misc_feature (400)..(519): Pfam Name: Glyco_hydro_32C Pfam Description: Glycosyl hydrolases family 32 C termi
  misc_feature (1)..(565): Public GI ID no. 160625677
  misc_feature (1)..(565): Bit score of 845.9 for HMM based on sequences of Figure 10
  misc_feature (1)..(565): Functional Homolog Of SEQ ID NO. 1215
MASIFPGLGWILGFSFICSSLFEIYRRHLLYQDPIAKNFIASELYRTAYHFQPTQHWMNDPNAPMYYNGVYHLFYQHNPDAATWTANISWGHSVSADLVHWTGLELALTPSDPFDISGCWSGSATILPGSKPVILYTGLDTVSRQVQNIAYPKNLSDPFLREWIKPRYNPVIEPHGRIDAALFRDPSTAWLGRDGSWRLTVGTVIDGNGLAMLYKSKDFVKWVPAENPLYYTNGSGMWECVDFFPLGEARGVTKYMLKVSMFDVSYDYYALGTYDEEGGVFTRDDASSTDYRTWPMIDYGRVYASKTFLDEAKQRRILWGWSNESNSIADDVAKGWAGIQTVPRVLSLDTDGKRLVQWPIEELESLRGEQIHLQDIELETGSQVEVRGLKVSQADVEVEFELQSLIGAEPFDANWIVDPPKLCREKGAYANHGGIGPFGLLVLAADNLEENTAVYFRVFRAEGSYKVLMCADQRRSSKRSELYKPASGGFVDIDIKKERKISLRTLIDHSVVESFGGGGRTCITSRVYPTILLNDNTHLYAFNYGTETVKISELKAWNMAQAQIS

SEQ ID NO: 1300 - protein, 581 aa, Cichorium intybus
  misc_feature (50)..(368): Pfam Name: Glyco_hydro_32N Pfam Description: Glycosyl hydrolases family 32 N termi
  misc_feature (409)..(526): Pfam Name: Glyco_hydro_32C Pfam Description: Glycosyl hydrolases family 32 C termi
  misc_feature (1)..(581): Public GI ID no. 13940209
  misc_feature (1)..(581): Bit score of 848.8 for HMM based on sequences of Figure 10
  misc_feature (1)..(581): Functional Homolog Of SEQ ID NO. 1215
MKKSLSSFIVLCFLVIILETGRVKATSRNLNDVIMLANQQIEQPYRTGYHFQPPSNWMNDPNGPMLYQGVYHFFYQYNPYAATFGDVIIWGHAVSYDLVNWIHLDPAIYPTQEADSKSCWSGSATILPGNIPAMLYTGSDSKSRQVQDLAWPKNLSDPFLREWVKHPKNPLITPPEGVKDDCFRDPSTAWLGPDGVWRIVVGGDRDNNGMAFLYQSTDFVNWKRYDQPLSSADATGTWECPDFYPVPLNSTNGLDTSVYGGSVRHVMKAGFEGHDWYTIGTYSPDRENFLPQNGLSLTGSTLDLRYDYGQFYASKSFFDDAKNRRVLWAWVPETDSQADDIEKGWAGLQSFPRALWIDRNGKQLIQWPVEEIEELRQNQVNLQNKNLKPGSVLEIHGIAASQADVTISFKLEGLKEAEVLDTTLVDPQALCNERGASSRGALGPFGLLAMASKDLKEQSAIFFRVFQNQLGRYSVLMCSDLSRSTVRSNIDTTSYGAFVDIDPRSEEISLRNLIDHSIIESFGAGGKTCITSRIYPKFVNNEEAHLFVFNNGTQNVKISEMSAWSMKNAKFVVDQSVKSAA

SEQ ID NO: 1301 - protein, 563 aa, Asparagus officinalis
  misc_feature (48)..(357): Pfam Name: Glyco_hydro_32N Pfam Description: Glycosyl hydrolases family 32 N termi
  misc_feature (398)..(517): Pfam Name: Glyco_hydro_32C Pfam Description: Glycosyl hydrolases family 32 C termi
  misc_feature (1)..(563): Public GI ID no. 160625675
  misc_feature (1)..(563): Bit score of 839.1 for HMM based on sequences of Figure 10
  misc_feature (1)..(563): Functional Homolog Of SEQ ID NO. 1215
MVSPSASLLSSLRWLFGFLFFSSSMVEIPPAENFSNPLASTQFRTAYHFQPTHYWMNDPNAPMYYDGVYHLFYQYNPNGATWTAYMSWGHSVSTDLVHWTGLELALTPSDPFDISGCWSGSATILPGNKPVVLYTGLDTVGRQVQNIAYPKNLSDPFLREWIKPNYNPVIEPHQKINAALFRDPSTAWLGKDGSWRLTVGTLIDEGGLAIVYKSKDFMKWVPAENPLYYTNGSGMWECVDFFPLKEIQGATKYLLKVSMYDTLHDYYVMGTYDEERDIFIKDDASSDDCRMWPMIDYGRLYASKTFVDEAKQRRILWAWSNETSSVADNVAKGWAGIQTVPRVLSVDTDGKRLIQWPIEEIESLRREQIHLQDIELKTGSQVEVRGLKVSQADVEVEFEFQNLTGAEPFDANWVVDPPKLCREKDAYANHGGIGPFGLLVLAADNLEENTAVYFRVFRAEGSYKVLMCADQRRSSKKSELYKPASGGFVDIDVKKDGKISLRTLIDHSVVESFGGGGRACITSRVYPTILLNDNTHLYAFNYGTETVKISELKAWNMAPAQIS

SEQ ID NO: 1302 - protein, 581 aa, Cichorium intybus
  misc_feature (50)..(368): Pfam Name: Glyco_hydro_32N Pfam Description: Glycosyl hydrolases family 32 N termi
  misc_feature (409)..(526): Pfam Name: Glyco_hydro_32C Pfam Description: Glycosyl hydrolases family 32 C termi
  misc_feature (1)..(581): Public GI ID no. 4127662
  misc_feature (1)..(581): Bit score of 843.7 for HMM based on sequences of Figure 10
  misc_feature (1)..(581): Functional Homolog Of SEQ ID NO. 1215
MKKSLSSFIVLCFLVIILETGRVKATSRNLNDVIMLANQQIEQPYRTGYHFQPPSNWMNDPNGPMLYQGVYHFFYQYNPYAATFGDVIIWGHAVSYDLVNWIHLDPAIYPTQEADSKSCWSGSATILPGNIPAMLYTGSDSKSRQVQDLAWPKNLSDPFLREWVKHPKNPLITPPEGVKDDCFRDPSTAWLGPDGVWKIVVGGDRDNNGMAFLYQSTDFVNWKRYDQPLSSADATGTWECPDFYPVPLNSTNGLDTSVYGGSVRHVMKAGFEGHDWYTIGTYSPDRENFLPQNGLSLTGSTLDLRYDYGQFYASKSFFDDAKNRRVLWAWVPETDSQADDIEKGWAGLQSFPRALWIDRNGKQLIQWPVEEIEELRQNQVNLQNKNLKPGSVLEIHGIAAPQADVTISFKLEGLKEAEVLDTTLVDPQALCNERSASSRGALGPFGLLAMASKDLKEQSAIFFRVFQNQLGRYSVLMCSDLSRSTVRSNIDTTSYGAFVDIDPRSEEISLRNLIDHSIIESFGAGGKTCITSRIYPKFVNNEEAHLFVFNNGTQNVKISEMSAWSMKNAKFVVDQSVKSAA

SEQ ID NO: 1303 - protein, 581 aa, Cichorium intybus
  misc_feature (50)..(368): Pfam Name: Glyco_hydro_32N Pfam Description: Glycosyl hydrolases family 32 N termi
  misc_feature (409)..(526): Pfam Name: Glyco_hydro_32C Pfam Description: Glycosyl hydrolases family 32 C termi
  misc_feature (1)..(581): Public GI ID no. 13940211
  misc_feature (1)..(581): Bit score of 841.3 for HMM based on sequences of Figure 10
  misc_feature (1)..(581): Functional Homolog Of SEQ ID NO. 1215
MKKSLSSFIALCFLVIVLETGRVKATSRDLNDVILLANQQIQQPYRTGYHFQPPSNWMNDPNGPMLYQGVYHFFYQYNPYAATFGDVIIWAHAVSYDLVNWIHLDPAIYPTQEADSKSCWSGSATILPGNIPAMLYTGSDSKSRQVQDLAWPKNLSDPFLREWVKHPKNPLIIPPEGVKDDCFRDPSTAWRGPDGVWRIVVGGDRDNNGMSLLYQSTDFVNWKRYDQPLSSAIATGTWECPDFYPVPLNSTNGLDTSVYGGSVRHVMKAGFEGHDWYTIGTYSPDRENFLPQNGLSLTGSTLDLRYNYGQFYASKSFFDDAKNRRVLWAWVPETDAPEDDIEKGWAGLQSFPRALWIDRSGKQLIQWPIEEIEELRQNEVNLQNKNLKPGSVLEIHGITASQADVTISFKLEELKDAEVLDTTSVDPQVLCNERGASSRGAIGPFGLLAMASKDLKEQSAIFFRVFQNQLGRYSVLMCSDLSRSTVRSNIDTTSYGAFVDIDPKSEEISLRNLIDHSIIESFGAGGKTCITSRIYPQFVNNEEAHLFAFNNGTQNVKISKMSAWSMKNAAFVVDQNVKSAA

SEQ ID NO: 1304 - protein, 582 aa, Vernonia herbacea
  misc_feature (50)..(366): Pfam Name: Glyco_hydro_32N Pfam Description: Glycosyl hydrolases family 32 N termi
  misc_feature (407)..(524): Pfam Name: Glyco_hydro_32C Pfam Description: Glycosyl hydrolases family 32 C termi
  misc_feature (1)..(582): Public GI ID no. 162793818
  misc_feature (1)..(582): Bit score of 852.2 for HMM based on sequences of Figure 10
  misc_feature (1)..(582): Functional Homolog Of SEQ ID NO. 1215
  misc_feature (262)..(262): Xaa is any aa, unknown, or other
MNKPLSSFLTLCLLVLVHGPGHFDATRQNLKDIISLPTQIIEQPYRTGYHFQPPSNWMNDPNGPMLYNGVYHFFYQYNPYAATFGDVIVWGHAVSYDLVNWIHLDPAIYPTHEADAKSCWSGSATILPGNIPAMLYTGSDSHSRQVQDLAWPKNRSDPFLREWVKYTGNPLITAPEGVNDDCFRDPSTAWQGPDGVWRIVVGADRDNNGMAFLYQSTDFVNWKRYEQPLSSADLTGTWECPDVYPVPLNSTNGLDTSVYGGXVKHVMKAGFGGHDWYTIGTYTPDRENFLPQNEVDRKYYGPEVRYGNFYASKSFFDDAKNRRVLWGWIPESDSQEDDIQKGWAGLQSFPRALWIDRSGMQLIQWPVDEIEKLRLNEVNLQNKNLKPGSVLEIQGITASQADVTISFKLENLKEAEVLDTSLTDPQALCNERGASSQGVFGPFGLLAMASKDLKEQTAIFFRVFQNQNGRYSVLMCSDLSRSTVKSNIDTTSFGAFVDINPRYNEISLRNLIDHSIIESFGAEGKTCITSRVYPKFVNYEEAHLYAFNNGTQSVKISRMSAWSMKSAEFIIDQTVKSATMEK

SEQ ID NO: 1305 - protein, 578 aa, Saccharum officinarum
  misc_feature (54)..(371): Pfam Name: Glyco_hydro_32N Pfam Description: Glycosyl hydrolases family 32 N termi
  misc_feature (412)..(530): Pfam Name: Glyco_hydro_32C Pfam Description: Glycosyl hydrolases family 32 C termi
  misc_feature (1)..(578): Bit score of 1215.4 for HMM based on sequences of Figure 10
  misc_feature (1)..(578): Functional Homolog Of SEQ ID NO. 1215
MGTRQRVLAPWAVLLLALQVAGASHVIHRSLEAEAAPPSVPASIVSPLLRTGYHFQPPMNWINDPNAPMYYKGWYHLFYQYNPKGAVWGNIVWAHSVSRDLINWIALDPAIYPSIPSDQYGCWSGSATMLKDGTPAILYTGINRPDINYQVQVLAFPKNASDPLLREWEKPAAYNPVAAPVGGINATQFRDPTTAWYADGHWRMLVGSVRDTRGMALVYRSRDFRTWRKAKHPLHFALTGMCGVPGLLSGVRAGARGRARHLRRRGPKYVLKSSLDLTRYDYYTIGSYQRRKDRYYPDNPNGDYHRLRYNYGNFYASKTFYDPANRRRVLLGWANKSDSVPDDKAKGWAGIHAIPRKIWLDPSGKQLLQWPIEEVEKLRGKPVSVGSKLVKPGEHFEVTGVATYQADVEVTFEVSSLEKAEAFDPAYGNDAQKLCGVKGADVKGGVGPFGLWVLASADLQEKTAVFFRVFKDGYGKPKVLMCTDPTKSSLSPDLYKPTFAGFVDTDISSGKIALRSLIDRSVVESFGAGGKTCILSRVYPSIAVGKDAHLYVFNNGEVDVKVSSLTAWEMKKPLMNGA

SEQ ID NO: 1306 - protein, 640 aa, Zea mays
  misc_feature (107)..(427): Pfam Name: Glyco_hydro_32N Pfam Description: Glycosyl hydrolases family 32 N termi
  misc_feature (468)..(592): Pfam Name: Glyco_hydro_32C Pfam Description: Glycosyl hydrolases family 32 C termi
  misc_feature (1)..(640): Bit score of 1250.8 for HMM based on sequences of Figure 10
  misc_feature (1)..(640): Functional Homolog Of SEQ ID NO. 1215
  misc_feature (255)..(255): Xaa is any aa, unknown, or other
MEITYSNSQPASRLERAVFPYKTAPTRPVPGRANPIQTVPCPSLPRNAAMGTRPRGVVLAPWAVVLVLVLALRLAGASHVIHRSLEAEAAPSVPASIVSPLLRTGYHFQPPMNWINDPNAPLYYKGWYHLFYQYNPKGAVWGNIVWAHSVSRDLINWVALEPAIYPSIPSDKYGCWSGSATILEDGTPAILYTGIDRPDINYQVQVLALPKDASDPLLREWEKPEEYNPVATPAAGGINATQFRDPTTAWRHAGXHWRMLVGSVRGARGMALVYRSRDFRTWTKAKHPLHSAALTGMWECPDFFPVSGPGLQAGLDTSAPGRKYVLKSSLDLTRYDYYTIGSYDGGKDRYYPDDPAGDYHHRRRYDYGNYYASKTFYDPVERRRVLLGWANESDSVPDDKAKGWAGIHAIPRKIWLDPTGKQLLQWPIHEVEKLRGKAVSVDAKLVKPGDHFEVTGIATYQADVEVSFELELEAGTSLLEKAEAFDPAYDDDAQKLCGVKGADARGGVGPFGLWVLASADLQERTAVFFRVFRDGHGKPKVLMCTDPTKSSLSPDLYKPTFAGFVDADISSGKITLRSLIDRSVVESFGAGGKTCILSRVYPSIAVGKDAHLYVFNNGEVDVTVSGLTAWEMKKPLMNGA

SEQ ID NO: 1307 - protein, 639 aa, Zea mays
  misc_feature (107)..(426): Pfam Name: Glyco_hydro_32N Pfam Description: Glycosyl hydrolases family 32 N termi
  misc_feature (467)..(591): Pfam Name: Glyco_hydro_32C Pfam Description: Glycosyl hydrolases family 32 C termi
  misc_feature (1)..(639): Bit score of 1256.3 for HMM based on sequences of Figure 10
  misc_feature (1)..(639): Functional Homolog Of SEQ ID NO. 1215
MEITYSNSQPASRLERAVFPYKTAPTRPVPGRANPIQTVPCPSLPRNAAMGTRPRGVVLAPWAVVLVLVLALRLAGASHVIHRSLEAEAAPSVPASIVSPLLRTGYHFQPPMNWINDPNAPLYYKGWYHLFYQYNPKGAVWGNIVWAHSVSRDLINWVALEPAIYPSIPSDKYGCWSGSATILEDGTPAILYTGIDRADINYQVQVLALPKDASDPLLREWEKPEEYNPVATPAAGGINATQFRDPTTAWRHAGHWRMLVGSVRGARGMALVYRSRDFRKWTKAKHPLHSAALTGMWECPDFFPVSGPGLQAGLDTSAPGRKYVLKSSLDLTRYDYYTIGSYDGGKDRYYPDDPAGDYHHRRRYDYGNYYASKTFYDPVERRRVLLGWANESDSVPDDKAKGWAGIHAIPRKIWLDPTGKQLLQWPIHEVEKLRGKAVSVDAKLVKPGDHFEVTGIATYQADVEVSFELELEAGTSLLEKAEAFDPAYDDDAQKLCGVKGADARGGVGPFGLWVLASADLQERTAVFFRVFRDGHGKPKVLMCTDPTKSSLSPDLYKPTFAGFVDADISSGKITLRSLIDRSVVESFGAGGKTCILSRVYPSIAVGKDAHLYVFNNGEVDVTVSGLTAWEMKKPLMNGA

SEQ ID NO: 1308 - protein, 591 aa, Zea mays
  misc_feature (60)..(380): Pfam Name: Glyco_hydro_32N Pfam Description: Glycosyl hydrolases family 32 N termi
  misc_feature (421)..(543): Pfam Name: Glyco_hydro_32C Pfam Description: Glycosyl hydrolases family 32 C termi
  misc_feature (1)..(591): Bit score of 1253.4 for HMM based on sequences of Figure 10
  misc_feature (1)..(591): Functional Homolog Of SEQ ID NO. 1215
MGTRPRGVVLAPWAVVLVLVLVLALRLAGASHVIHRSLEAEVPPSVPASIVSPLLRTGYHFQPPMNWINDPNAPLYYKGWYHLFYQYNPKGAVWGNIVWAHSVSRDLINWVALEAAIYPSIPSDKYGCWSGSATILEDGTPAILYTGIDRPDINYQVQVLALPKDASDPLLREWEKPEEYNPVATPAAGINATQFRDPTTAWRHAGAGHWRMLVGSVRGARGMALVYRSRDFRTWTKAKHPLHSAALTGMWECPDFFPVSGPGLQAGLDTSAPGTKYVLKSSLDLTRYDYYTIGSYDGGKDRYYPDDPAGDYRRRLRYDYGNYYASKTFYDPVERRRVLLGWANESDSVPDDKAKGWAGIHAIPRKIWLDPTGKQLLQWPIHEVEKLRGKAVSVDAKLVKPGDHFEVTGIATYQADVEVSFELEAGTSLLEKAEAFDPAYDDDAQKLCGVKGADARGGVGPFGLWVLASADLQERTAVFFRVFRDGHGKPKVLMCTDPTKSSLSPDLYKPTLAGLVDADISSGKITLRSLIDRSVVESFGAGGKTCILSRVYPSIAVGKDAHLYVFNNGEVDVTVSGLTAWEMKKPLMNGA

SEQ ID NO: 1309 - protein, 590 aa, Zea mays
  misc_feature (58)..(377): Pfam Name: Glyco_hydro_32N Pfam Description: Glycosyl hydrolases family 32 N termi
  misc_feature (418)..(542): Pfam Name: Glyco_hydro_32C Pfam Description: Glycosyl hydrolases family 32 C termi
  misc_feature (1)..(590): Bit score of 1258.0 for HMM based on sequences of Figure 10
  misc_feature (1)..(590): Functional Homolog Of SEQ ID NO. 1215
MGTRPRGVVLAPWAVVLVLVLALRLAGASHVIHRSLEAEAAPSVPASIVSPLLRTGYHFQPPMNWINDPNAPLYYKGWYHLFYQYNPKGAVWGNIVWAHSVSRDLINWVALEPAIYPSIPSDKYGCWSGSATILEDGTPAILYTGIDRADINYQVQVLALPKDASDPLLREWEKPEEYNPVATPAAGGINATQFRDPTTAWRHAGHWRMLVGSVRGARGMALVYRSRDFRKWTKAKHPLHSAALTGMWECPDFFPVSGPGLQAGLDTSAPGRKYVLKSSLDLTRYDYYTIGSYDGGKDRYYPDDPAGDYHHRLRYDYGNYYASKTFYDPVERRRVLLGWANESDSVTDDKAKGWAGIHAIPRKIWLDPTGKQLLQWPIHEVEKLRGKAVSVDAKLVKPGDHFEVTGIATYQADVEVSFELELEAGTSLLEKAEAFDPAYDDDAQKLCGVKGADARGGVGPFGLWVLASADLQERTAVFFRVFRDGHGKPKVLMCTDPTKSSLSPDLYKPTFAGFVDADISSGKITLRSLIDRSVVESFGAGGKTCILSRVYPSIAVGKDAHLYVFNNGEVDVTVSGLTAWEMKKPLMNGA

SEQ ID NO: 1310 - protein, 590 aa, Zea mays
  misc_feature (58)..(377): Pfam Name: Glyco_hydro_32N Pfam Description: Glycosyl hydrolases family 32 N termi
  misc_feature (418)..(542): Pfam Name: Glyco_hydro_32C Pfam Description: Glycosyl hydrolases family 32 C termi
  misc_feature (1)..(590): Bit score of 1251.6 for HMM based on sequences of Figure 10
  misc_feature (1)..(590): Functional Homolog Of SEQ ID NO. 1215
MGTRPRGVVLAPWAVVLVLVLALRLAGASHVIHRSLEAEAAPSVPASIVSPLLRTGYHFQPPMNWINDPNAPLYYKGWYHLFYQYNPKGAVWGNIVWAHSVSRDLINWVALEPAIYPSIPSDKYGCWSGSATILEDGTPAILYTGIDRADINYQVQVLALPKDASDPLLREWEKPEEYNPVATPAAGGINATQFRDPTTAWRHAGHWRMLVGSVRGARGMALVYRSRDFRKWTKAKHPLHSAALTGMWECPDFFPVSGPGLQAGLDTSAPGTKYVLKSSLDLTRYDYYTIGSYDGGKDRYYPDDPAGDYHHRRRYDYGNYYASKTFYDPVERRRVLLGWANESDSVTDDKAKGWAGIHAIPRKIWLDPTGKQLLQWPIHEVEKPRGKAVSVDAKLVKPGDHFEVTGIATYQADVEVSFELELEAGTSLLEKAEAFDPAYDDDAQKLCGVKGADARGGVGPFGLWVLASADLQERTAVFFRVFRDGHGKPKVLMCTDPTKSSLSPDLYKPTFAGFVDADISSGKITLRSLIDRSVVESFGAGGKTCILSRVYPSIAVGKDAHLYVFNNGEVDVTVSGLTAWEMKKPLMNGA

SEQ ID NO: 1311 - protein, 583 aa, Lolium perenne
  misc_feature (53)..(376): Pfam Name: Glyco_hydro_32N Pfam Description: Glycosyl hydrolases family 32 N termi
  misc_feature (417)..(535): Pfam Name: Glyco_hydro_32C Pfam Description: Glycosyl hydrolases family 32 C termi
  misc_feature (1)..(583): Bit score of 1272.5 for HMM based on sequences of Figure 10
  misc_feature (1)..(583): Functional Homolog Of SEQ ID NO. 1215
MGNPKWVLAPWAVLLLLQLASASHHARLSLETSAASPSVPASIVSPLLRTGYHFQPPMNWINDPNGPLYYKGWYHLFYQYNPKGAVWGNIIWAHSVSRDLINWIALEPAISPTIPTDQYGVWSGSTTILHDGTPAILYTGIDRPSVNYQIQNIALPKNASDPLLREWYKPGYNPIAVPVEGINATQFRDPTTAWFAGRHWRMLVGGLRPGTLRGEAILYRSRDFKHWVRAKHPLHSALTGMWECPDFFPVGKAGVEKGLDTSEYGAAAGVEKHVLKNSLDLTRYDYYTIGTYDNVKERYVPDNPTGDVYQRLQYDYGNFYASKTFFDPVKQRRILLGWANESDSVAHDKAKGWAGIQAIPRKIWLDPSGKQLVQWPVEELEKLRGKPVNVGDKVVKPGQHFEVTGLQSYQSDVEVSFEVSSLDKAEPFDPAYSNDAQKLCGIKGADVKGGVGPFGLWVLSSADLAEKTAVFFRVFKDGYGKPIVLMCSDPTKSSLTPDLYKPTFAGFVDTDISSGKISLRSLIDRSVVESFGAGGKTCILSRVYPSMALGKDAHLHVFNNGETDIKVSKLTAWEMKRPLMNGA

SEQ ID NO: 1312 - protein, 637 aa, Oryza sativa
  misc_feature (53)..(356): Pfam Name: Glyco_hydro_32N Pfam Description: Glycosyl hydrolases family 32 N termi
  misc_feature (470)..(589): Pfam Name: Glyco_hydro_32C Pfam Description: Glycosyl hydrolases family 32 C termi
  misc_feature (1)..(637): Bit score of 1147.3 for HMM based on sequences of Figure 10
  misc_feature (1)..(637): Functional Homolog Of SEQ ID NO. 1215
MGTRLLALAPWLLLLLLQLAGASHVVHRSLEAEQAPSSVPASIVSPLLRTGYHFQPPMNWINDPNGPLYYKGWYHLFYQYNPKGAVWGNIVWAHSVSQDLINWIALEPAIKPDIPSDQYGCWSGSATILPDGTPAILYTGIDRPNINYQVQNIAFPKNASDPLLREWVKPAYNPVATPEPGMNATQFRDPTTAWYADGHWRMLVGGLKGARLGLAYLYRSRDFKTWVRAKHPLHSALTGMWECPDFFPLQAPGLQAGLDTSVPSSKYVLKNSLDLTRYDYYTVGIYNKVTERYVPDNPAGDYHRLRYDYGNFYASKTFFDPVKHRRILLGWANESDSVTYDKAKGWAGIHVNYSYNFAILISCTTYLHKCLMLLVILIQELTKRKRKIGGTRGLIRIDLEIDGLACVVGRRSQERYGLDPSGKQLLQWPIEELETLRGKSVSVFDKVVKPGEHFQVTGLGTYQADVEVSLEVSGLEKAEALDPAFGDDAERLCGAKGADVRGGVVFGLWVLASAGLEEKTAVFFRVFKPAGHGAKPVVLMCTDPTKSSLSPDLYKPTFAGFVDTDISSGKISLRSLIDRSVVESFGAGGKTCILSRVYPSMAIGDKAHLYVFNNGEADIKISHLKAWEMKKPLMNGA

SEQ ID NO: 1313 - protein, 581 aa, Triticum aestivum
  misc_feature (53)..(374): Pfam Name: Glyco_hydro_32N Pfam Description: Glycosyl hydrolases family 32 N termi
  misc_feature (415)..(533): Pfam Name: Glyco_hydro_32C Pfam Description: Glycosyl hydrolases family 32 C termi
  misc_feature (1)..(581): Bit score of 1273.8 for HMM based on sequences of Figure 10
  misc_feature (1)..(581): Functional Homolog Of SEQ ID NO. 1215
  misc_feature (212)..(212): Xaa is any aa, unknown, or other
MGAPKWVVAPLALLLLLQLAGASHDVRRSLEAEAATPSVPASILSPLLRTGYHFQPPMNWINDPNGPLYYKGWYHLFYQYNPKGAVWGNIIWAHSVSRDLINWMALDPAIKPSIPTDQYGVWSGSATILPNGTVAMLYTGIDRPGTNYQIQNIAFPKDPSDPLLREWVKPGYNPIAVPEAGINATQFRDPTTAWHAGDGLWRMLVGGAQARXLRGMAILYRSRDFKHWVRAKHPLHSALTGMWECPDFFPVREPGKTDGLDTSEFGPRYKYVLKNSLDLTRYDYYTVGTYNNRTERYVPDNPTGDVYQRLQYDYGNFYASKTFYDPAKNRRVLLGWANESDSVAHDNAKGWAGIHAIPRKIWLDPSGKQLLQWPVEELDQLRGKAVSVGDKLVKPGQHFEVTGLQSYQSDVEVSFEVSSLDKAEPFDPAYANDAQKLCGMKNADVKGGVGPFGLWVLASDNLAEKTAVFFRVFKDGHGKPLVLMCSDPTKSSLTPGLYKPTFAGFVDTDISSGKISLRSLIDRSVVESFGAGGKTCILSRVYPSMAIGKDAHLYVFNNGVTDIKVSKLTAWEMKKPMMNGA

SEQ ID NO: 1314 - protein, 583 aa, Festuca arundinacea
  misc_feature (55)..(376): Pfam Name: Glyco_hydro_32N Pfam Description: Glycosyl hydrolases family 32 N termi
  misc_feature (417)..(535): Pfam Name: Glyco_hydro_32C Pfam Description: Glycosyl hydrolases family 32 C termi
  misc_feature (1)..(583): Bit score of 1261.0 for HMM based on sequences of Figure 10
  misc_feature (1)..(583): Functional Homolog Of SEQ ID NO. 1215
MGNPKWIFAPWAVLLLFLLQLACASHHTRRSLETEAASPSVPASIVSPLLRTGYHFQPPMNWINDPNGPLYYKGWYHLFYQYNPKGAVWGNIIWAHSVSRDLINWIALEPAITPSIPTDKYGVWSGSTTILHDGTPAILYTGIDRPSINYQIQNIALPKNASDPLLREWYKPGYNPIAVPVAGMNATQFRDPTTAWFAGRHWRMLVGGLRPGTLRGEAILYRSLDFKNWTRAHHPLHSALTGMWECPDFFPVGEAGVEKGLDTSEHGEGVEKHVLKNSLDLTRYDYYTVGTYDNVKERYVPDNPTGDVYRRLQYDYGNFYASKTFFDPVKQRRILLGWANESDSVAHDKAKGWAGIQAIPRKIWLDPSGKQLVQWPVEELEKLRGKPVTVGDKVVKPGQHFEVTGLQSYQSDVEVSFEVSSLDKAEPFDPAYSNDAQKLCGIKGADANGGVGPFGLVVLASADLAEKTAVFFRVFKDGYGKPIVLMCSDPTKSSLTPDLYKPTFAGFVDTDISSGKISLRSLIDRSVVESFGAGGKTCILSRVYPSMALGKNAHLHVFNNGETDIKVSKLTVWEMKRPLMNGA

SEQ ID NO: 1315 - protein, 581 aa, Triticum aestivum
  misc_feature (53)..(374): Pfam Name: Glyco_hydro_32N Pfam Description: Glycosyl hydrolases family 32 N termi
  misc_feature (415)..(533): Pfam Name: Glyco_hydro_32C Pfam Description: Glycosyl hydrolases family 32 C termi
  misc_feature (1)..(581): Bit score of 1258.5 for HMM based on sequences of Figure 10
  misc_feature (1)..(581): Functional Homolog Of SEQ ID NO. 1215
MGAPKWVVAPLALLLLLQLAGASHDVRRSLEAEAASPSVPASILSPLLRTGYHFQPPMNWINDPNGPLYYKGWYHLFYQYNPKGAVWGNIIWAHSVSRDLINWIALDPAIKPSIPTDQFGVWSGSATILPNGTVAMLYTGIDRPGTNYQIQNIAFPKDPSDPLLREWVKPGYNPIAIPEAGMNATQFRDPTTAWHAGDGLWRMLVGGLKPGTLRGMAILYRSRDFKHWVRAKHPLHSALTGMWECPDFFPVREPGHPDGLDTSEFGPHYKYVLKNSLDLTRYDYYTVGTYNNRTERYVPDNPTGDVYQRLQYDYGNFYASKTFYDPAKNRRVLLGWANESDSVAHDNAKGWAGIHAIPRKIWLDPSGKQLLQWPVEELDQLRGKAVSVGDKLVKPGQHFEVTGLQSYQSDVEVSFEVSSLDKAEPFDPAYANDAQKLCGMKNADVKGGVGPFGLWVLASDNLAEKTAVFFRVFKDGHGKPLVLMCSDPTKCLNTAGLYKPTFAGFVDTDISSGKISLRSLIDRSVVESFGAGGRTCILSRVYPSMAIGKDAHLHVFNNGVTDIKVSKLTAWEMKKPMMNGA

SEQ ID NO: 1316 - protein, 524 aa, Sorghum bicolor
  misc_feature (58)..(374): Pfam Name: Glyco_hydro_32N Pfam Description: Glycosyl hydrolases family 32 N termi
  misc_feature (415)..(521): Pfam Name: Glyco_hydro_32C Pfam Description: Glycosyl hydrolases family 32 C termi
  misc_feature (1)..(524): Bit score of 1042.4 for HMM based on sequences of Figure 10
  misc_feature (1)..(524): Functional Homolog Of SEQ ID NO. 1215
  misc_feature (261)..(261): Xaa is any aa, unknown, or other
  misc_feature (275)..(275): Xaa is any aa, unknown, or other
MGTRQRVLAPWAVLLLTALQLAGASHVVVHRSLEAEAAAAPPSVPASIVSPLLRTGYHFQPPMNWINDPNAPMYYKGWYHLFYQYNPKGAVWGNIVWAHSISRDLINWIALEPAIYPSIPSDQYGCWSGSATMLQDGTPAILYTGINRPDINYQVQVLAFPKNASDPLLREWEKPAAYNPVAAPVGGINATQFRDPTTAWYADGHWRMLVGSVRDTRGMAIVYRSRDFRRWTKAKHPLHSALTGMWECPDFFPVSGPALQXGVDTSDAGAKYVLXNSLDLTRYDYYTIGSYDKRKDRYYPDNPNGDYHRLRYDYGNFYASKTFYDPAKRRRVLLGWANESDSVPDDKAKGWAGIHAIPRKIWLDPSGKQLLQWPIEEVEKLRGKAVTVGGKVVKPGEHFEVTGIATYQADVEVSFEISSLDKAEPFDPAYDNDAQKLCGVKGADVKGGVGPFGLWVLASADLQEKTAVFFRVFKDGYGKPKVLMCTDPTKSSLSPDLYKPTFAGFVDTDISSGKIALRSLVRTD

SEQ ID NO: 1317 - protein, 528 aa, Zea mays
  misc_feature (1)..(315): Pfam Name: Glyco_hydro_32N Pfam Description: Glycosyl hydrolases family 32 N termi
  misc_feature (356)..(480): Pfam Name: Glyco_hydro_32C Pfam Description: Glycosyl hydrolases family 32 C termi
  misc_feature (1)..(528): Bit score of 1102.8 for HMM based on sequences of Figure 10
  misc_feature (1)..(528): Functional Homolog Of SEQ ID NO. 1215
MNWINDPNAPLYYKGWYHLFYQYNPKGAVWGNIVWAHSVSRDLINWVALEPAIYPSIPSDKYGCWSGSATILEDGTPAILYTGIDRADINYQVQVLALPKDASDPLLREWEKPEEYNPVATPAAGGINATQFRDPTTAWRHAGHWRMLVGSVRGARGMALVYRSRDFRKWTKAKHPLHSAALTGMWECPDFFPVSGPGLQAGLDTSAPGTKYVLKSSLDLTRYDYYTIGSYDGGKDRYYPDDPAGDYHHRRRYDYGNYYASKTFYDPVERRRVLLGWANESDSVPDDKAKGWAGIHAIPRKIWLDPTGKQLLQWPIHEVEKLRGKAVSVDAKLVKPGDHFEVTGIATYQADVEVSFELELEAGTSLLEKAEAFDPAYDDDAQKLCGVKGADARGGVGPFGLWVLASADLQERTAVFFRVFRDGHGKPKVLMCTDPTKSSLSPDLYKPTFAGFVDADISSGKITLRSLIDRSVVESFGAGGKTCILSRVYPSIAVGKDAHLYVFNNGEVDVTVSGLTAWEMKKPLMNGA

SEQ ID NO: 1318 - protein, 593 aa, Zea mays
  misc_feature (58)..(382): Pfam Name: Glyco_hydro_32N Pfam Description: Glycosyl hydrolases family 32 N termi
  misc_feature (423)..(545): Pfam Name: Glyco_hydro_32C Pfam Description: Glycosyl hydrolases family 32 C termi
  misc_feature (1)..(593): Bit score of 1175.2 for HMM based on sequences of Figure 10
  misc_feature (1)..(593): Functional Homolog Of SEQ ID NO. 1215
MRALVVVSFASACLLLLLQLAGASHVVYNYKDLEAEAAAATDQVPPSIVNPLLRTGYHFQPPKNWINDPNAPMYYKGWYHFFYQYNPKGAVWGNIVWAHSVSRDLINWVALEPALRPSIPGDRYGCWSGSATVLPDGGGPVIMYTGVDHPDINYQVQNVAYPKNVSDPLLREWVKPSHNPVIVPEGGINATQFRDPTTAWRGPGPEQWRLLVGSAAGSSPRGVAYVYRSRDFRRWRRVRRPLHSAPTGMWECPDFYPVSKGGAPRAGLETSVPPGPRVKHVLKNSLDLRRYDYYTVGTYHPRAERYVPDDPAGDEHRLRYDYGNFYASKTFYDPAKRRRILWGWANESDTAADDVAKGWAGIQAIPRTVWLDPSGKQLLQWPIEEVEALRAKSVTLKNRVIKAGHHVEVTGIQTAQADVEVSFEVSPAALAGAETLDPALAYDAEKLCGVKRADVRGGVGPFGLWVLASANRKERTAVFFRVFKPAAGSDKPVVLMCTDPTKSSLNPNLYRPTFAGFVDTDISNGKISLRSLIDRSVVESFGAGGKTCILSRVYPSLAIGKDARLYVFNNGRAHVKVSRLTAWEMKKPVMNGA

SEQ ID NO: 1319 - protein, 588 aa, Lolium perenne
  misc_feature (56)..(375): Pfam Name: Glyco_hydro_32N Pfam Description: Glycosyl hydrolases family 32 N termi
  misc_feature (417)..(539): Pfam Name: Glyco_hydro_32C Pfam Description: Glycosyl hydrolases family 32 C termi
  misc_feature (1)..(588): Bit score of 1196.1 for HMM based on sequences of Figure 10
  misc_feature (1)..(588): Functional Homolog Of SEQ ID NO. 1215
MGVRLGRVAWACPAVLVLLLQLAGASHVVYETSLLETEAAAATVPASIFELSTGYHFRPQKNWINDPNAPLYYKGWYHLFFQYNPKGAVWGNIVWAHSVSRDLINWVALETALAPSIDADKYGCWSGSATIMPDGTPVIMYTGVSRPDVNYEVQNVAFPKNSSDPLLREWVKPAHNPVIVPEGGINATQFRDPTTAWYADGHWRILVGALSGASRGVAYVYRSRDFRRWTRVRKPLHSAPTGMWECPDFYPVTVDGKESGVDTSVVSSSRVKHVLKNSLDLRRYDYYTVGTYDRLKERYVPDNPAGDKHHLRYDYGNFYASKTFYDPSKRRRILWGWANESDTAVDDVAKGWAGIQAIPRKVWLDPSGRQLMQWPVEEVEALRGKKPVSLKDRMVKRGEHVEVTGLQTAQADVEVSFEVPSLEGAEALDPALANDAQKLCGVKGADVEGGVGPFGLWVLASSKLEERTAVFFRVFKAAGNVNSTKPLVLMCSDPTKSSLNKNLYHPTFAGFVDIDMAKGKISLRSLIDQSVVESFGAGGRTCILSRVYPSLAIGRNAHLHVFNNGKADIKVSRLTAWEMKKPALMNGA

SEQ ID NO: 1320 - protein, 592 aa, Zea mays
  misc_feature (58)..(382): Pfam Name: Glyco_hydro_32N Pfam Description: Glycosyl hydrolases family 32 N termi
  misc_feature (423)..(544): Pfam Name: Glyco_hydro_32C Pfam Description: Glycosyl hydrolases family 32 C termi
  misc_feature (1)..(592): Bit score of 1169.6 for HMM based on sequences of Figure 10
  misc_feature (1)..(592): Functional Homolog Of SEQ ID NO. 1215
MRALVVVSFASACLLLLLQLAGASHVVYNYKDLEAEAAAATDQVPPSIVNPLLRTGYHFQPPKNWINDPNAPMYYKGWYHFFYQYNPKGAVWGNIVWAHSVSRDLINWVALEPALRPSIPGDRYGCWSGSATVLPDGGGPVIMYTGVDHPDINYQVQNVAYPKNVSDPLLREWVKPSHNPVIVPEGGINATQFRDPTTAWRGPGPEQWRLLVGSAAGSSPRGVAYVYRSRDFRRWRRVRRPLHSAPTGMWECPDFYPVSKGGAPRAGLETSVPPGPRVKHVLKNSLDLRRYDYYTVGTYHPRAERYVPDDPAGDEHRLRYDYGNFYASKTFYDPAKRRRILWGWANESDTAADDVAKGWAGIQAIPRTVWLDPSGKQLLQWPIEEVEALRAKSVTLKNRVIKAGHHVEVTGIQTAQADVEVSFEVSPSALAGAETLDPALAYDAERLCGVKRADVRGGVGPFGLWVLASANRKERTAVFFRVFKPAAGDKPVVLMCTDPTKSSQNPNLYRPTFAGFVDTDISNGKISLRSLIDRSVVESFGAGGKTCILSRVYPSLAIGKDARLYVFNNGRAHVKVSRLTAWEMKKPVMNGA

SEQ ID NO: 1321 - protein, 595 aa, Zea mays
  misc_feature (52)..(384): Pfam Name: Glyco_hydro_32N Pfam Description: Glycosyl hydrolases family 32 N termi
  misc_feature (425)..(547): Pfam Name: Glyco_hydro_32C Pfam Description: Glycosyl hydrolases family 32 C termi
  misc_feature (1)..(595): Bit score of 1152.2 for HMM based on sequences of Figure 10
  misc_feature (1)..(595): Functional Homolog Of SEQ ID NO. 1215
  misc_feature (354)..(354): Xaa is any aa, unknown, or other
  misc_feature (369)..(369): Xaa is any aa, unknown, or other
MRALGTVAWAWLLLLQQLAGASHVVYENLEVEATTAAVRPSIVDPLLRTGYHFQPRKNWINDPNAPLYYKGWYHLFYQYNPKGAVWGNIVWGHSVSRDLINWVALQPAIEPSIPSDRYGCWSGSATTLADGTPAIMYTGVNRPDVNYQVQNVAYPRNRSDPLLREWVKPSHNPIIVPGGGINATQFRDPTTAWRGAGDGRWRLLIGSVTEARHGVAYVYRSRDFRRWTRARRPLHSAATGMWECPDFYPVGAPGRRAGVETETSAASDGDGGSPRRREQSKYVLKNSLDLRRYDYYTVGTYDRAAERYVPDDPAGDERHLRYDYGNFYASKTFFDPVKRRRVLWGWANESDTAXDDVAKGWAGIQAIPXTVWLDPSGKQLLQWPIEEVEALRGRSVALKNRVIKPGQHVEVTGIQTAQADVEVSFEVSSLAGAEALLDPALASDAQRLCGARGAAVEGGVGPFGLWVLASGDREERTAVFFRVFRGGGGHDDKPVVLMCTDPTKSSLDANLYQPTFAGFVDTDISNGKISLRTLIDRSVVESFGGGGRTCILSRVYPSLAIGSKARLYVFNNGRADVRVSRLTAWEMKKPLMNGA

SEQ ID NO: 1322 - protein, 598 aa, Oryza sativa
  misc_feature (59)..(384): Pfam Name: Glyco_hydro_32N Pfam Description: Glycosyl hydrolases family 32 N termi
  misc_feature (426)..(549): Pfam Name: Glyco_hydro_32C Pfam Description: Glycosyl hydrolases family 32 C termi
  misc_feature (1)..(598): Bit score of 1179.8 for HMM based on sequences of Figure 10
  misc_feature (1)..(598): Functional Homolog Of SEQ ID NO. 1215
MGVLGSRVAWAWLVQLLLLQQLAGASHVVYDDLELQAAATTADGVPPSIVDSELRTGYHFQPPKNWINDPNAPMYYKGWYHLFYQYNPKGAVWGNIVWAHSVSRDLINWVALKPAIEPSIRADKYGCWSGSATMMADGTPVIMYTGVNRPDVNYQVQNVALPRNGSDPLLREWVKPGHNPVIVPEGGINATQFRDPTTAWRGADGHWRLLVGSLAGQSRGVAYVYRSRDFRRWTRAAQPLHSAPTGMWECPDFYPVTADGRREGVDTSSAVVDAAASARVKYVLKNSLDLRRYDYYTVGTYDRKAERYVPDDPAGDEHHIRYDYGNFYASKTFYDPAKRRRILWGWANESDTAADDVAKGWAGIQAIPRKVWLDPSGKQLLQWPIEEVERLRGKWPVILKDRVVKPGEHVEVTGLQTAQADVEVSFEVGSLEAAERLDPAVAYDAQRLCSARGADARGGVGPFGLWVLASAGLEEKTAVFFRVFRPAARGGGAGKPVVLMCTDPTKSSRNPNMYQPTFAGFVDTDITNGKISLRSLIDRSVVESFGAGGKACILSRVYPSLAIGKNARLYVFNNGKAEIKVSQLTAWEMKKPVMMNGA

SEQ ID NO: 1323 - protein, 588 aa, Lolium perenne
  misc_feature (56)..(375): Pfam Name: Glyco_hydro_32N Pfam Description: Glycosyl hydrolases family 32 N termi
  misc_feature (417)..(539): Pfam Name: Glyco_hydro_32C Pfam Description: Glycosyl hydrolases family 32 C termi
  misc_feature (1)..(588): Bit score of 1193.3 for HMM based on sequences of Figure 10
  misc_feature (1)..(588): Functional Homolog Of SEQ ID NO. 1215
MGVRLGRVAWACPAVLVLLLQLAGASHVVYETSLLETEAAAATVPASIFELSTGYHFRPQKNWINDPNAPLYYKGWYHLFFQYNPKGAVWGNIVWAHSVSRDLINWVALETALAPSIDADKYGCWSGSATIMPDGTPVIMYTGVSRPDVNYEVQNVAFPKNSSDPLLREWVKPAHNPVIVPEGGINATQFRDPTTAWYADGHWRILVGALSGASRGVAYVYRSRDFRRWTRVRKPLHSAPTGMWECPDFYPVTVDGKESGVDTSVVSSSRVKHVLKNSLDLRRYDYYTVGTYDRLKERYVPDNPAGDKHHLRYDYGNFYASKTFYDPSKRRRILWGWANESDTAVDDVAKGWAGIQAIPRKVWLDPSGRQLMQWPVEEVKALRGKKPVSLKDRMVKRGEHVEVTGLQTAQADVEVSFEVPSLEGAEALDPALANDAQKLCGVKGADVEGGVGPFGLWVLASSKLEERTAVFFRVFKAAGNVNSTKPLVLMCSDPTKSSLNKNLYHPTFAGFVDIDMAKGKISLRSLIDQSVVESFGAGGRTCILSRVYPSLAIGRNAHLHVFNNGKADIKVSRLTAWEMKKPALMNGA

SEQ ID NO: 1324 - protein, 592 aa, Zea mays
  misc_feature (58)..(382): Pfam Name: Glyco_hydro_32N Pfam Description: Glycosyl hydrolases family 32 N termi
  misc_feature (423)..(544): Pfam Name: Glyco_hydro_32C Pfam Description: Glycosyl hydrolases family 32 C termi
  misc_feature (1)..(592): Bit score of 1165.5 for HMM based on sequences of Figure 10
  misc_feature (1)..(592): Functional Homolog Of SEQ ID NO. 1215
MRALVVVSFASACLLLLLQLAGASHVVYNYKDLEAEAAAATDQVPPSIVNPLLRTGYHFQPPKNWINDPNAPMYYKGWYHFFYQYNPKGAVWGNIVWAHSVSRDLINWVALEPALRPSIPGDRYGCWSGSATVLPDGGGPVIMYTGVDHPDINYQVQNVAYPKNVSDPLLREWVKPSHNPVIVPEGGINATQFRDPTTAWRGPGPEQWRLLVGSAAGSSPRGVAYVYRSRDFRRWRRVRRPLHSAPTGMWECPDFYPVSKGGAPRAGLETSVPPGPRVKHVLKNSLDLRRYDYYTVGTYHPRAERYVPDDPAGDEHRLRYDYGNFYASKTFYDPAKRRRILWGWANESDTAADDVAKGWAGIQAIPRTVWLDPSGKQLLQWPIEEVEALRAKSVTLKNRVIKAGHHVEVTGIQTAQADVEVSFEVSPSALAGAETLDPALAYDAERLCGVKRADVRGGVGLFGLWVLASANRKERTAVFFRVFKPAAGDKPVVLMCTDPTKSSQNPNLYRPTFAGFVDTDISNGKISLRSLIDRSVVESFGAGGKTCILSRVYPSLAIGKDARLYVFNNGRAHVKVSRLTAWEMKKPVMNGA

SEQ ID NO: 1325 - protein, 593 aa, Zea mays
  misc_feature (58)..(383): Pfam Name: Glyco_hydro_32N Pfam Description: Glycosyl hydrolases family 32 N termi
  misc_feature (424)..(545): Pfam Name: Glyco_hydro_32C Pfam Description: Glycosyl hydrolases family 32 C termi
  misc_feature (1)..(593): Bit score of 1171.2 for HMM based on sequences of Figure 10
  misc_feature (1)..(593): Functional Homolog Of SEQ ID NO. 1215
MRALVVVSFASACLLLLLQLAGASHVVYNYKDLEAEAAAATDQVPPSIVNPLLRTGYHFQPPKNWINDPNAPMYYKGWYHFFYQYNPKGAVWGNIVWAHSVSRDLINWVALEPALRPSIPGDRYGCWSGSATVLPDGGGPVIMYTGVDHPDINYQVQNVAYPKNVSDPLLREWVKPSHNPVIVPEGGINATQFRDPTTAWRGPGPEQWRLLVGSAAGSMPPRGVAYVYRSRDFRRWRRVRRPLHSAPTGMWECPDFYPVSKGGAPRAGLETSVPPGPRVKHVLKNSLDLRRYDYYTVGTYHPRAERYVPDDPAGDEHRLRYDYGNFYASKTFYDPAKRRRILWGWANESDTAADDVAKGWAGIQAIPRTVWLDPSGKQLLQWPIEEVEALRAKSVTLRNRVIKAGHHVEVTGIQTAQADVEVSFEVSPAALAGAETLDPALAYDAERLCGVKRADVRGGVGPFGLWVLASANRKERTAVFFRVFKPAAGDKPVVLMCTDPTKSSLNPNLYRPTFAGFVDTDISNGKISLRSLIDRSVVESFGAGGKTCILSRVYPSLAIGKDARLYVFNNGRAHVKVSRLTAWEMKKPVMNGA

SEQ ID NO: 1326 - protein, 595 aa, Zea mays
  misc_feature (52)..(384): Pfam Name: Glyco_hydro_32N Pfam Description: Glycosyl hydrolases family 32 N termi
  misc_feature (425)..(547): Pfam Name: Glyco_hydro_32C Pfam Description: Glycosyl hydrolases family 32 C termi
  misc_feature (1)..(595): Bit score of 1151.7 for HMM based on sequences of Figure 10
  misc_feature (1)..(595): Functional Homolog Of SEQ ID NO. 1215
  misc_feature (408)..(408): Xaa is any aa, unknown, or other
  misc_feature (410)..(410): Xaa is any aa, unknown, or other
MRALGTVAWAWLLLLQQLAGASHVVYENLEVEATTAAVRPSIVDPLLRTGYHFQPRKNWINDPNAPLYYKGWYHLFYQYNPKGAVWGNIVWGHSVSRDLINWVALQPAIEPSIPSDRYGCWSGSATTLADGTPAIMYTGVNRPDVNYQVQNVAYPRNRSDPLLREWVKPSHNPIIVPGGGINATQFRDPTTAWRGAGDGRWRLLIGSVTEARHGVAYVYRSRDFRRWTRARRPLHSAATGMWECPDFYPVGAPGRRAGVETETSAASDGDGGSPRRREQSKYVLKNSLDLRRYDYYTVGTYDRAAERYVPDDPAGDERHLRYDYGNFYASKTFFDPVKRRRVLWGWANESDTAADDVAKGWAGIQAIPRTVWLDPSGKQLLQWPIEEVEALRGRSVALKNRVIKPGQXVXVTGIQTAQADVEVSFEVSSLAGAEALLDPALASDAQRLCGARGAAVEGGVGPFGLWVLASGDREERTAVFFRVFRGGGGHDDKPVVLMCTDPTKSSLDANLYQPTFAGFVDTDISNGKISLRTLIDRSVVESFGGGGRTCILSRVYPSLAIGSKARLYVFNNGRADVRVSRLTAWEMKKPLMNGA

SEQ ID NO: 1327 - protein, 595 aa, Oryza sativa
  misc_feature (59)..(381): Pfam Name: Glyco_hydro_32N Pfam Description: Glycosyl hydrolases family 32 N termi
  misc_feature (423)..(546): Pfam Name: Glyco_hydro_32C Pfam Description: Glycosyl hydrolases family 32 C termi
  misc_feature (1)..(595): Bit score of 1159.3 for HMM based on sequences of Figure 10
  misc_feature (1)..(595): Functional Homolog Of SEQ ID NO. 1215
MGVLGSRVAWAWLVQLLLLQQLAGASHVVYDDLELQAAAATADGVPPSIVDSELRTGYHFQPPKNWINAPMYYKGWYHLFYQYNPKGAVWGNIVWAHSVSRDLINWVALKPAIEPSIRADKYGCWSGSATMMADGTPVIMYTGVNRPDVNYQVQNVALPRNGSDPLLREWVKPGHNPVIVPEGGINATQFRDPTTAWRGADGHWRLLVGSLAGQSRGVAYVYRSRDFRRWTRAAQPLHSAPTGMWECPDFYPVTADGRREGVDTSSAVVDAAASARVKYVLKNSLDLRRYDYYTVGTYDRKAERYVPDDPAGDEHHIRYDYGNFYASKTFYDPAKRRRILWGWANESDTAADDVAKGWAGIQAIPRKVWLDPSGKQLLQWPIEEVERLRGKWPVILKDRVVKPGEHVEVTGLQTAQADVEVSFEVGSLEAAERLDPAMAYDAQRLCSARGADARGGVGPFGLWVLASAGLEEKTAVFFRVFRPAARGGGAGKPVVLMCTDPTKSSRNPNMYQPTFAGFVDTDITNGKISLRSLIDRSVVESFGAGGKACILSRVYPSLAIGKNARLYVFNNGKAEIKVSQLTAWEMKKPVMMNGA

SEQ ID NO: 1328 - protein, 524 aa, Triticum aestivum
  misc_feature (1)..(317): Pfam Name: Glyco_hydro_32N Pfam Description: Glycosyl hydrolases family 32 N termi
  misc_feature (358)..(476): Pfam Name: Glyco_hydro_32C Pfam Description: Glycosyl hydrolases family 32 C termi
  misc_feature (1)..(524): Bit score of 1133.9 for HMM based on sequences of Figure 10
  misc_feature (1)..(524): Functional Homolog Of SEQ ID NO. 1215
MNWINDPNGPLYYKGWYHLFYQYNPKGAVWGNIIWAHSVSRDLINWMALDPAIKPSIPTDQYGVWSGSATILPNGTVAMLYTGIDRPGTNYQIQNIAFPKDPSDPLLREWVKPGYNPIAVPEAGINATQFRDPTTAWHAGDGLWRMLVGGLKPGTLRGMAILYRSRDFKHWVRAKHPLHSALTGMWECPDFFPVREPGKTDGLDTSEFGPRYKYVLKNSLDLTRYDYYTVGTYNNRTERYVPDNPTGDVYQRLQYDYGNFYASKTFYDPAKNRRVLLGWANESDSVAHDNAKGWAGIHAIPRKIWLDPSGKQLLQWPVEELDQLRGKAVSVGDKLVKPGQHFEVTGLQSYQSDVEVSFEVSSLDKAEPFDPAYANDAQKLCGMKNADVKGGVGPFGLWVLASDNLAEKTAVFFRVFKDGHGKPLVLMCSDPTKSSLTPGLYKPTFAGFVDTDISSGKISLRSLIDRSVVESFGAGGKTCILSRVYPSMAIGKDAHLYVFNNGVTDIKVSKLTAWEMKKPMMNGA

SEQ ID NO: 1329 - protein, 564 aa, Triticum aestivum
  misc_feature (32)..(351): Pfam Name: Glyco_hydro_32N Pfam Description: Glycosyl hydrolases family 32 N termi
  misc_feature (393)..(515): Pfam Name: Glyco_hydro_32C Pfam Description: Glycosyl hydrolases family 32 C termi
  misc_feature (1)..(564): Bit score of 1185.4 for HMM based on sequences of Figure 10
  misc_feature (1)..(564): Functional Homolog Of SEQ ID NO. 1215
  misc_feature (26)..(26): Xaa is any aa, unknown, or other
MSSTRPTSSRRRRRRPTCRRQFLTPXLSTGYHFRPIKNWINDPNAPMYYKGWYHFFYQYNPKGAVWGNIVWAHSVSRDLINWVALETAIQPSIKSDKYGCWSGSATILRDGTPVIMYTGIDRADINYEVQNIAFPKNKSDPLLREWVKPRSNPIIVPEGGINATQFRDPTTAWYADGHWRLLIGALSGASRGVAYVYRSRDFMRWTRVRKPLHSAPTGMWECPDLYPVTVDGRQNGLDTSVTSSPKVKHVLKNSLDLRRYDYYTVGTYNRKTERYVPDNPTGDEHHLRYDYGNFYASKTFYDPVKRRRILWGWANESDTAVDDVAKGWAGIQAIPRKVWLDPSGRQLMQWPVEELEALRGKKPVSLRDGVVKRGEHVEVTGLRSSQADVEVSFEVPSLEGAEALDPALANDAQKLCSVKGADVEGGVGPFGLWVLASAKLEEKTAVFFRVFKAARNINSTKPVVLMCSDPTTSSLNPNLYKPTFAGFVDTDIAKGKISLRSLIDRSVVESFGAGGRTCILSRVYPTLALGKNAHLHVFNNGKVDIKVSQLTAWEMKKPALMNGA

SEQ ID NO: 1330 - protein, 542 aa, Sorghum bicolor
  misc_feature (2)..(329): Pfam Name: Glyco_hydro_32N Pfam Description: Glycosyl hydrolases family 32 N termi
  misc_feature (370)..(494): Pfam Name: Glyco_hydro_32C Pfam Description: Glycosyl hydrolases family 32 C termi
  misc_feature (1)..(542): Bit score of 1030.7 for HMM based on sequences of Figure 10
  misc_feature (1)..(542): Functional Homolog Of SEQ ID NO. 1215
MHAAPFYYKGWYHFFYQYNPKGAVWGNIVWAHSVSRDLINWMALEPAIKPSIPSDKYGCWSGSATTMPDGTPVIMYTGIDRPNTNYQVQNVAYPRNKSDPLLREWVKPSYNPVIVPEGGINATQFRDPTTAWRATAGGDGHWRLLIGSVRTTTTTGATAPPRGVAYVYRSRDFRRWTRVRRPLHSAATGMWECPDFYPVSSDEDGRRRRVGLETSVPSGARVKHVLKNSLDLRRYDYYTVGTYDRDAERYVPDDPAGDDDGERRLRYDYGNFYASKTFYDPAKRRRILWGWANESDTAADDVAKGWAGIQAIPRTVWLDPSGKQLLQWPVEEVEALRGKAVTLKNRVIKPGQHVEVTGIQTAQADVEVSFEVSPSALAGAERLDPALADDAERLCGVKRADVKGGVGPFGLWVLASANLKERTAVFFRVFKAAAGSSNNKPVVLMCTDPTKSSLNPNLYRPTFAGFVDTDISNGKISLRSLIDRSVVESFGAGGKTCILSRVYPSLAIGNNARLYVFNNGKADVRVSRLTAWEMKKPLMNGA

SEQ ID NO: 1331 - protein, 521 aa, Zea mays
  misc_feature (1)..(311): Pfam Name: Glyco_hydro_32N Pfam Description: Glycosyl hydrolases family 32 N termi
  misc_feature (352)..(473): Pfam Name: Glyco_hydro_32C Pfam Description: Glycosyl hydrolases family 32 C termi
  misc_feature (1)..(521): Bit score of 1005.5 for HMM based on sequences of Figure 10
  misc_feature (1)..(521): Functional Homolog Of SEQ ID NO. 1215
MYYKGWYHFFYQYNPKGAVWGNIVWAHSVSRDLINWVALEPALRPSIPGDRYGCWSGSATVLPDGGGPVIMYTGVDHPDINYQVQNVAYPKNVSDPLLREWVKPSHNPVIVPEGGINATQFRDPTTAWRGPGPEQWRLLVGSAAGSSPPRGVAYVYRSRDFRRWRRVRRPLHSAPTGMWECPDFYPVSKGGAPRAGLETSVPPGPRVKHVLKNSLDLRRYDYYTVGTYHPRAERYVPDDPAGDEHRLRYDYGNFYASKTFYDPAKRRRILWGWANESDTAADDVAKGWAGIQAIPRTVWLDPSGKQLLQWPIEEVEALRAKSVTLRNRVIKAGHHVEVTGIQTAQADVEVSFEVSPAALAGAETLDPALAYDAERLCGVKRADVRGGVGPFGLWVLASANRKERTAVFFRVFKPAAGDKPVVLMCTDPTKSSLNPNLYRPTFAGFVDTDISNGKISLRSLIDRSVVESFGAGGKTCILSRVYPSLAIGKDARLYVFNNGRAHVKVSRLTAWEMKKPVMNGA

SEQ ID NO: 1332 - DNA, 720 bp, Panicum virgatum
  misc_feature (1)..(720): Ceres Clone ID no. 1871521
  misc_feature (1)..(720): Encodes the peptide sequence at SEQ ID NO. 1333
acacacgcggacacgccactagcctcctctcggtttgagcagctcatcaacgccgccggcaagaagtcccctcgagctcgcccccggcagccagccagcccagccatcagccatgggctcgaccgccgccgacgtggccgcggccgcggccgcggacgaggaggcgtgcatgtacgcgctgcagctggcgtcgtcgtccatcctgccgatgacgctcaagaacgccatcgagctgggcctgctggaggtgctccagaaggaccccgcggcggcgctggcgccggaggaggtggtggcgcggctgcccgtggcgccggccaacccggacgcggcggccatggtcgaccgcatgctgcgcctgctcgcctcctacgacgtcgtcaggtgccggatggaggagggcaaggacggccggtactcgcgccggtacgccgccgcgccggtgtgcaagtggctcacccccaacgaggacggcgtctccatggccgcgctcgcgctcatgaaccaggacaaggtcctcatggagagctggtgagtgtgagtcctccatcgaaaattattcttgctgcatcagctttgagctgattaattagttttgtttttgttttgttttttttcttcactgaacttaatacggtggagtggttgtagattgcaagtagcagtagaagcttgcagagtagttaggttatccataatgtttctctaaatatgaaacgc

SEQ ID NO: 1333 - protein, 363 aa, Panicum virgatum
  misc_feature (94)..(340): Pfam Name: Methyltransf_2 Pfam Description: O-methyltransferase
  misc_feature (33)..(85): Pfam Name: Dimerisation Pfam Description: Dimerisation domain
  misc_feature (1)..(363): Ceres Clone ID no. 1871521
  misc_feature (1)..(363): Bit score of 947.1 for HMM based on sequences of Figure 1
  misc_feature (1)..(363): in Figure 1
MGSTAADVAAAAAADEEACMYALQLASSSILPMTLKNAIELGLLEVLQKDPAAALAPEEVVARLPVAPANPDAAAMVDRMLRLLASYDVVRCRMEEGKDGRYSRRYAAAPVCKWLTPNEDGVSMAALALMNQDKVLMESWYYLKDAVLEGGIPFNKAYGMTAFEYHGTDPRFNRVFNEGMKNHSVIITKKLLEFYAGFEGVGTLVDVGGGVGATLHAITSRYPGIRGVNFDLPHVISEAPPFPGVEHVGGDMFKAVPAGDAILMKWILHDWSDAHCAAILKNCYDALPAGGKVIAVECILPVNPEATPKAQGVFHVDMIMLAHNPGGKERYEREFEELAKGAGFTGFKATYIYANAWAIEFTK

SEQ ID NO: 1334 - protein, 362 aa, Sorghum bicolor
  misc_feature (92)..(339): Pfam Name: Methyltransf_2 Pfam Description: O-methyltransferase
  misc_feature (31)..(83): Pfam Name: Dimerisation Pfam Description: Dimerisation domain
  misc_feature (1)..(362): Public GI ID no. 28569609
  misc_feature (1)..(362): Bit score of 940.6 for HMM based on sequences of Figure 1
  misc_feature (1)..(362): Functional Homolog Of SEQ ID NO. 1333
  misc_feature (1)..(362): in Figure 1
MGSTAEDVAAVADEEACMYAMQLASSSILPMTLKNALELGLLEVLQKDAGKALAAEEVVARLPVAPTNPAAADMVDRMLRLLASYDVVRCQMEDKDGKYERRYSAAPVGKWLTPNEDGVSMAALALMNQDKVLMESWYYLKDAVLDGGIPFNKAYGMTAFEYHGTDPRFNRVFNEGMKNHSVIITKKLLEFYTGFDESVSTLVDVGGGIGATLHAITSHHSHIRGINFDLPHVISEAPPFPGVQHVGGDMFKSVPAGDAILMKWILHDWSDAHCATLLKNCYDALPEKGGKVIVVECVLPVTTDAVPKAQGVFHVDMIMLAHNPGGRERYEREFRDLAKAAGFSGFKATYIYANAWAIEFIK

SEQ ID NO: 1335 - protein, 364 aa, Zea mays
  misc_feature (96)..(341): Pfam Name: Methyltransf_2 Pfam Description: O-methyltransferase
  misc_feature (31)..(87): Pfam Name: Dimerisation Pfam Description: Dimerisation domain
  misc_feature (1)..(364): Public GI ID no. 729135
  misc_feature (1)..(364): Bit score of 945.9 for HMM based on sequences of Figure 1
  misc_feature (1)..(364): Functional Homolog Of SEQ ID NO. 1333
  misc_feature (1)..(364): in Figure 1
MGSTAGDVAAVVDEEACMYAMQLASSSILPMTLKNAIELGLLEVLQKEAGGGKAALAPEEVVARMPAAPSDPAAAAAMVDRMLRLLASYDVVRCQMEDRDGRYERRYSAAPVCKWLTPNEDGVSMAALALMNQDKVLMESWYYLKDAVLDGGIPFNKAYGMTAFEYHGTDARFNRVFNEGMKNHSVIITKKLLDFYTGFEGVSTLVDVGGGVGATLHAITSRHPHISGVNFDLPHVISEAPPFPGVRHVGGDMFASVPAGDAILMKWILHDWSDAHCATLLKNCYDALPENGKVIVVECVLPVNTEATPKAQGVFHVDMIMLAHNPGGKERYEREFRELAKGAGFSGFKATYIYANAWAIEFIK

SEQ ID NO: 1336 - protein, 362 aa, Saccharum officinarum
  misc_feature (94)..(339): Pfam Name: Methyltransf_2 Pfam Description: O-methyltransferase
  misc_feature (31)..(85): Pfam Name: Dimerisation Pfam Description: Dimerisation domain
  misc_feature (1)..(362): Public GI ID no. 29839259
  misc_feature (1)..(362): Bit score of 952.1 for HMM based on sequences of Figure 1
  misc_feature (1)..(362): Functional Homolog Of SEQ ID NO. 1333
  misc_feature (1)..(362): in Figure 1
MGSTAEDVAAVADEEACMYAMQLASASILPMTLKNALELGLLEVLQAEAPAGKALAPEEVVARLPVAPTNPDAADMVDRMLRLLASYDVVKCQMEDKDGKYERRYSAAPVGKWLTPNEDGVSMAALTLMNQDKVLMESWYYLKDAVLDGGIPFNKAYGMTAFEYHGTDPRFNRVFNEGMKNHSVIITKKLLEFYTGFEGVSTLVDVGGGIGATLHAITSHHPQIKGINFDLPHVISEAPPFPGVQHVGGDMFKSVPAGDAILMKWILHDWSDAHCATLLKNCYDALPENGKVIIVECVLPVNTEAVPKAQGVFHVDMIMLAHNPGGRERYEREFHDLAKGAGFSGFKATYIYANAWAIEFIK

SEQ ID NO: 1337 - protein, 368 aa, Oryza sativa subsp. japonica
  misc_feature (98)..(345): Pfam Name: Methyltransf_2 Pfam Description: O-methyltransferase
  misc_feature (31)..(89): Pfam Name: Dimerisation Pfam Description: Dimerisation domain
  misc_feature (1)..(368): Public GI ID no. 115474869
  misc_feature (1)..(368): Bit score of 929.6 for HMM based on sequences of Figure 1
  misc_feature (1)..(368): Functional Homolog Of SEQ ID NO. 1333
  misc_feature (1)..(368): in Figure 1
MGSTAADMAAAADEEACMYALQLASSSILPMTLKNAIELGLLETLQSAAVAGGGGKAALLTPAEVADKLPSKANPAAADMVDRMLRLLASYNVVRCEMEEGADGKLSRRYAAAPVCKWLTPNEDGVSMAALALMNQDKVLMESWYYLKDAVLDGGIPFNKAYGMTAFEYHGTDARFNRVFNEGMKNHSVIITKKLLDLYTGFDAASTVVDVGGGVGATVAAVVSRHPHIRGINYDLPHVISEAPPFPGVEHVGGDMFASVPRGGDAILMKWILHDWSDEHCARLLKNCYDALPEHGKVVVVECVLPESSDATAREQGVFHVDMIMLAHNPGGKERYEREFRELARAAGFTGFKATYIYANAWAIEFTK

SEQ ID NO: 1338 - DNA, 1391 bp, Gossypium hirsutum
  misc_feature (1)..(1391): Ceres Clone ID no. 1838010
  misc_feature (1)..(1391): Encodes the peptide sequence at SEQ ID NO. 1339
atgcccatatcttctttattctctgcaatctcttctttttagagtttcatcacaccagatattacaatgggttcaatcggtgaaactcaaatgacacccacccaagtctcagatgaggaagccaacttattcgctatgcaacttgccagtgcatcagttctccccatggtcctcaaatcagccattgaacttgacttgctggagatcatggccaaagctggtccaggtgctttcttgtccccaaaagaagtggcttccaagctccccaccaccaaccctgatgcacccgtcatgctggaccgtatcttgcgtctcctggctagctacaacgtcctcacttgctccttgcgtacccttcctgatggcaaagtggaaagactctatggccttggccctgtctgcaaattcttgaccaagaacgaagatggtgtcactctttccgcccttagtctcatgaatcaagacaaggtccttatggagagctggtactacttgaaagatgctgtgctggatggtggaattccattcaacaaggcctatggtatgactgcatttgagtaccatggcactgatactagattcaacaaggttttcaacaggggaatgtctgatcactctaccatcaccatgaagaagattctcgatacatatgatggtttccaaggactaaaaacattggtcgatgttggcggtggtaccggtgccacgcttagcatgatcgtctctaagtaccccaccataaaaggcattaacttcgatttgcctcatgtcattgaggatgctcctagctgtcctggtgtggagcatgttggtggagacatgtttgtaagtgtaccaaaaggagatgccattttcatgaagtggatatgtcatgattggagcgacgaacactgcgccaagtttttgaagaactgctatgaagctttgccagacaacgggaaagtgattgttgccgaatgcattcttcctgattaccccgatcctagccttgccacgaagttggttgtccatattgattgcatcatgttggctcacaaccctggtgggaaagagaggaccgcaaaggaattcaaggcactagcaacgggtgcgggatttcaaggcttccaaatcaaatgctccgcttttggcaccaacatcatggagtttctcaaaagtgtttgaatcttacatgcttttggattctgaagcttggtgattgttgtctcaaaggtggattttctggaattacatactttttgtttgacagaaaacaataaagaacgaaatttcatggtttttacgtagaagaaataccatactatatccactaccttactgtaactattaaacaaagttaaaaggcataaagcctctactttgagaatgattcatggagaagatgattgttt

SEQ ID NO: 1339 - protein, 365 aa, Gossypium hirsutum
  misc_feature (94)..(340): Pfam Name: Methyltransf_2 Pfam Description: O-methyltransferase
  misc_feature (34)..(85): Pfam Name: Dimerisation Pfam Description: Dimerisation domain
  misc_feature (1)..(365): Ceres Clone ID no. 1838010
  misc_feature (1)..(365): Bit score of 926.1 for HMM based on sequences of Figure 1
  misc_feature (1)..(365): Functional Homolog Of SEQ ID NO. 1333
  misc_feature (1)..(365): in Figure 1
MGSIGETQMTPTQVSDEEANLFAMQLASASVLPMVLKSAIELDLLEIMAKAGPGAFLSPKEVASKLPTTNPDAPVMLDRILRLLASYNVLTCSLRTLPDGKVERLYGLGPVCKFLTKNEDGVTLSALSLMNQDKVLMESWYYLKDAVLDGGIPFNKAYGMTAFEYHGTDTRFNKVFNRGMSDHSTITMKKILDTYDGFQGLKTLVDVGGGTGATLSMIVSKYPTIKGINFDLPHVIEDAPSCPGVEHVGGDMFVSVPKGDAIFMKWICHDWSDEHCAKFLKNCYEALPDNGKVIVAECILPDYPDPSLATKLVVHIDCIMLAHNPGGKERTAKEFKALATGAGFQGFQIKCSAFGTNIMEFLKSV

SEQ ID NO: 1340 - DNA, 1095 bp, Populus balsamifera subsp. trichocarpa
  misc_feature (1)..(1095): Ceres Annot ID no. 1521032
  misc_feature (1)..(1095): Encodes the peptide sequence at SEQ ID NO. 1341
atgggttcgacaggtgaaactcagatgactccaactcaggtatcagatgaagaggcacacctctttgccatgcaactagccagtgcttcagttctaccaatgatcctcaaaacagccattgaactcgaccttcttgaaatcatggctaaagctggccctggtgctttcttgtccacatctgagatagcttctcacctccctaccaaaaaccctgatgcgcctgtcatgttagaccgtatcttgcgcctcctggctagctactccattcttacttgctctctgaaagatcttcctgatgggaaagttgagagactgtatggccttgctcctgtttgcaaattcttgaccaagaacgaggatggtgtctctgtcagccctctctgtctcatgaaccaggacaaggtcctcatggaaagctggtattatttgaaagatgcaattcttgatggaggaattccatttaacaaggcctatgggatgactgcatttgaatatcatggcacggatccaagattcaacaaggtgttcaataagggaatgtctgaccactctaccattaccatgaagaagcttcttgagacctacaaaggctttgaaggcctcacatccttggtggatgttggtggtgggactggagctgtcgttaacaccatcgtctctaaatacccttcaattaagggcattaactttgatctgccccacgtcattgaggatgccccatcttatcccggtgtggagcatgttggtggggacatgtttgttagtgtgcccaaagcagatgccgttttcatgaagtggatatgccatgattggagcgacgcacactgcttaaaattcttgaagaattgctatgacgccttgccggaaaacggcaaggtgatacttgttgagtgcattcttcccgtggctcctgacacaagccttgccaccaagggagtcgtgcacattgatgttatcatgctggcgcacaaccccggtgggaaagagaggaccgaaaaggaatttgagggcttagcaaagggagctggctttcaaggttttgaagtaatgtgctgtgcattcaacacacatgtcattgaattccgcaagaactaa

SEQ ID NO: 1341 - protein, 364 aa, Populus balsamifera subsp. trichocarpa
  misc_feature (94)..(340): Pfam Name: Methyltransf_2 Pfam Description: O-methyltransferase
  misc_feature (34)..(85): Pfam Name: Dimerisation Pfam Description: Dimerisation domain
  misc_feature (1)..(364): Ceres Annot ID no. 1521032
  misc_feature (1)..(364): Bit score of 933.7 for HMM based on sequences of Figure 1
  misc_feature (1)..(364): Functional Homolog Of SEQ ID NO. 1333
  misc_feature (1)..(364): in Figure 1
MGSTGETQMTPTQVSDEEAHLFAMQLASASVLPMILKTAIELDLLEIMAKAGPGAFLSTSEIASHLPTKNPDAPVMLDRILRLLASYSILTCSLKDLPDGKVERLYGLAPVCKFLTKNEDGVSVSPLCLMNQDKVLMESWYYLKDAILDGGIPFNKAYGMTAFEYHGTDPRFNKVFNKGMSDHSTITMKKLLETYKGFEGLTSLVDVGGGTGAVVNTIVSKYPSIKGINFDLPHVIEDAPSYPGVEHVGGDMFVSVPKADAVFMKWICHDWSDAHCLKFLKNCYDALPENGKVILVECILPVAPDTSLATKGVVHIDVIMLAHNPGGKERTEKEFEGLAKGAGFQGFEVMCCAFNTHVIEFRKN

SEQ ID NO: 1342 - DNA, 1459 bp, Panicum virgatum
  misc_feature (1)..(1459): Ceres Clone ID no. 1769444
  misc_feature (1)..(1459): Encodes the peptide sequence at SEQ ID NO. 1343
attcccagcactgagcacacgcggacacgccactagctagcctcctcccggtctgagcagctcatcaacgccgccggcaagaagccccctcgagctcgccgccggcagccagccagccagccagccatgggctcgaccgccgccgacgtggccgcggccgcggacgaggaggcgtgcatgtacgcgctgcagctggcgtcgtcgtccatcctgccgatgacgctcaagaacgccatcgagctgggcctgctggaggtgctccagaaggaccccgcggcggcgctggcgccggaggaggtggtggcgcggctgcccgtggcgccggccaacccggacgcggcggccatggtcgaccgcatgctgcgcctgctcgcctcctacgacgtcgtcaggtgccggatggaggagggcaaggacggccggtactcgcgccggtactccgccgcgccggtgtgcaagtggctcacccccaacgaggacggcgtctccatggccgcgctcgcgctcatgaaccaggacaaggtcctcatggagagctggtactacctcaaggacgcggtgctggagggcggcatcccgttcaacaaggcgtacggcatgacggcgttcgagtaccacggcacggacccgcgcttcaaccgcgtgttcaacgagggcatgaagaaccactcggtgatcatcaccaagaagctgctcgagttctacgccggcttcgagggcgtcggcaccctggtcgacgtcggcggcggcgtcggcgccaccctgcacgccatcacctcccgctaccccggcatcaggggggtcaacttcgacctgccccacgtgatctccgaggcgccgccgttccccggcgtggagcacgtcggcggggacatgttcaaggccgtgcccgccggtgacgccatcctcatgaagtggatcctccacgactggagcgacgcccactgcgcggcgatcctcaagaactgctacgacgcgctccccgccggcggcaaggtgatcgccgtcgagtgcatcctgccggtgaacccggaggcgacgcccaaggcgcagggcgtgttccacgtcgacatgatcatgctcgcgcacaaccccggaggcaaggagcgctacgagagggagttcgaggagctcgccaagggcgccggcttcaccgggttcaaggccacctacatctacgccaacgcatgggccatcgagttcaccaagtagatctgttgtcgcgcatgtgcttgtgcttaatttgctttcttcatcatcatcttcatcctgctgctggcctgcctgccggcctccatggccggaccaccatcgatccttgttctggattccaaattctaatggttgtatgtgttgagatgtctctaccatgtaccattaataaataataacagccaatgtactcttatatatatacatattgtaacaccccagttgttaatcacttgtagttaaggtc

SEQ ID NO: 1343 - protein, 361 aa, Panicum virgatum
  misc_feature (92)..(338): Pfam Name: Methyltransf_2 Pfam Description: O-methyltransferase
  misc_feature (31)..(83): Pfam Name: Dimerisation Pfam Description: Dimerisation domain
  misc_feature (1)..(361): Ceres Clone ID no. 1769444
  misc_feature (1)..(361): Bit score of 944.8 for HMM based on sequences of Figure 1
  misc_feature (1)..(361): Functional Homolog Of SEQ ID NO. 1333
MGSTAADVAAAADEEACMYALQLASSSILPMTLKNAIELGLLEVLQKDPAAALAPEEVVARLPVAPANPDAAAMVDRMLRLLASYDVVRCRMEEGKDGRYSRRYSAAPVCKWLTPNEDGVSMAALALMNQDKVLMESWYYLKDAVLEGGIPFNKAYGMTAFEYHGTDPRFNRVFNEGMKNHSVIITKKLLEFYAGFEGVGTLVDVGGGVGATLHAITSRYPGIRGVNFDLPHVISEAPPFPGVEHVGGDMFKAVPAGDAILMKWILHDWSDAHCAAILKNCYDALPAGGKVIAVECILPVNPEATPKAQGVFHVDMIMLAHNPGGKERYEREFEELAKGAGFTGFKATYIYANAWAIEFTK

SEQ ID NO: 1344 - DNA, 1448 bp, Panicum virgatum
  misc_feature (1)..(1448): Ceres Clone ID no. 1869486
  misc_feature (1)..(1448): Encodes the peptide sequence at SEQ ID NO. 1345
cagcactggcgcacgccacttgactgttgcctctcgatcggtctcggcagctcaacgccggcaagaagccccccctagctcgccgccggcagctccaccactcgagcaggctgcagccagccatgggctccaccgccaccgacgtggccgcggccgcggacgaggaggcgtgcatgtacgcgctgcagctggcgtcgtcgtccatcctgccgatgacgctcaagaacgccatcgagctgggcctgctggaggtgctccagaaggaccccgcggcggcgctggcgccggaggaggtggtggcgcggctgcccgtgacgcccactaaccccgacgcggcgaccatggtcgaccgcatcctgcgcctgctcgcctcctacgacgtcgtccggtgccagatggaggagggcaaggacggcaagtactcgcgccgctacgccgccgcgcccgtctgcaagtggctcacccccaacgaggacggcgtctccatggccgccctcgcgctcatgaaccaggacaaggtcctcatggagagctggtactacctcaaggacgccgtgctggagggcggcatcccgttcaacaaggcgtacggcatgacggcgttcgagtaccacggcacggacccgcgcttcaaccgcgtgttcaacgagggcatgaagaaccactcggtgatcatcaccaagaagctgctcgagttctacaccggcttcgagggcgtcggcaccctggtcgacgtcggcggcggcatcggcgccaccctgcacgccatcacctcccactacccgcggataacgggggtcaacttcgacctgccccacgtgatctccgaggcgccgccgttccccggcgtgcagcacgtcggcggcgacatgttcaaggccgtgcccgccggcgacgccatcctcatgaagtggatcctccacgactggagcggcgcccactgcgcggtgatcctcaagaactgctacgacgcgctccccgccggcggcaaggtgatcatcgtcgagtgcatcctgccggtgaacccggaggcgacgcccaaggcgcagggcgtgttccacgccgacctcatcatgctcgcgcacaaccccggcggcaaggagcgctacgagagggagttcgaggagctcgccaagggcgccggcttcaccgggttcaaggccacctacatctacgccaacgcatgggccatcgagttcaccaagtagatctctgaagctgcttcctcgtgctgttgtcgcgcatgtgctttcgcttaatttgctttcttcttcttcatcatcatcatcctactggcctgcctgcctccatgtccatggccaccatcgatcttgttctggattccaaacgaactctaatggttgtatgtgttgagatgtctctaccatgtaccattaataacagccaaggtactcttatatatatacatacatacttaatatgatgac

SEQ ID NO: 1345 - protein, 361 aa, Panicum virgatum
  misc_feature (92)..(338): Pfam Name: Methyltransf_2 Pfam Description: O-methyltransferase
  misc_feature (31)..(83): Pfam Name: Dimerisation Pfam Description: Dimerisation domain
  misc_feature (1)..(361): Ceres Clone ID no. 1869486
  misc_feature (1)..(361): Bit score of 931.8 for HMM based on sequences of Figure 1
  misc_feature (1)..(361): Functional Homolog Of SEQ ID NO. 1333
MGSTATDVAAAADEEACMYALQLASSSILPMTLKNAIELGLLEVLQKDPAAALAPEEVVARLPVTPTNPDAATMVDRILRLLASYDVVRCQMEEGKDGKYSRRYAAAPVCKWLTPNEDGVSMAALALMNQDKVLMESWYYLKDAVLEGGIPFNKAYGMTAFEYHGTDPRFNRVFNEGMKNHSVIITKKLLEFYTGFEGVGTLVDVGGGIGATLHAITSHYPRITGVNFDLPHVISEAPPFPGVQHVGGDMFKAVPAGDAILMKWILHDWSGAHCAVILKNCYDALPAGGKVIIVECILPVNPEATPKAQGVFHADLIMLAHNPGGKERYEREFEELAKGAGFTGFKATYIYANAWAIEFTK

SEQ ID NO: 1346 - DNA, 1089 bp, Sorghum bicolor
  misc_feature (1)..(1089): Ceres Annot ID no. 8704591
  misc_feature (1)..(1089): Encodes the peptide sequence at SEQ ID NO. 1347
atggggtcgacggcggaggacgtggcggcggtggcggacgaggaggcgtgcatgtacgcgatgcagctggcgtcgtcgtcgatcctccccatgacgctgaagaacgcgctggagctgggcctgctggaggtgcttcagaaggacgccggcaaggcgctggcggcggaggaggtggtggcgcggctgcccgtggcgccgacgaaccccgccgcggcggacatggtggaccgcatgctccgcctcctcgcctcctacgacgtcgtgaagtgccagatggaggacaaggacggcaagtacgagcgtcggtactccgccgcccccgtcggcaagtggctcacccctaacgaggacggcgtctccatggccgccctcgcgctcatgaaccaggacaaggtcctcatggagagctggtactacctgaaggacgcggtgcttgacggcggcatcccgttcaacaaggcgtacgggatgacggcgttcgagtaccacggcacggacccgcgcttcaaccgcgtgttcaacgagggcatgaagaaccacagcgtgatcatcaccaagaagctcctcgagttctacacgggcttcgacgagtccgtctcgacgctcgtcgacgtgggcggcggcatcggcgccaccttacacgccatcacctcccaccactcccacatcaggggcgtcaacttcgacctcccccacgtgatctccgaggcgccgccgttccccggcgtgcagcacgtcggcggggacatgttcaagtcggtgccggccggcgacgccatcctcatgaagtggatcctccacgactggagcgacgcgcactgcgccacgctgctcaagaactgctacgacgcgctgccggagaagggcggcaaggtgatcgtcgtcgagtgcgtgctgccggtgaccaccgacgccgtccccaaggcgcagggcgtgttccatgtcgacatgatcatgctcgcgcataaccccggcggcagggagcggtacgagcgggagttccgtgacctcgccaaggccgctggcttctctgggttcaaggccacctacatctacgccaacgcctgggccatcgagttcatcaagtaa

SEQ ID NO: 1347 - protein, 362 aa, Sorghum bicolor
  misc_feature (92)..(339): Pfam Name: Methyltransf_2 Pfam Description: O-methyltransferase
  misc_feature (31)..(83): Pfam Name: Dimerisation Pfam Description: Dimerisation domain
  misc_feature (1)..(362): Ceres Annot ID no. 8704591
  misc_feature (1)..(362): Bit score of 938.6 for HMM based on sequences of Figure 1
  misc_feature (1)..(362): Functional Homolog Of SEQ ID NO. 1333
MGSTAEDVAAVADEEACMYAMQLASSSILPMTLKNALELGLLEVLQKDAGKALAAEEVVARLPVAPTNPAAADMVDRMLRLLASYDVVKCQMEDKDGKYERRYSAAPVGKWLTPNEDGVSMAALALMNQDKVLMESWYYLKDAVLDGGIPFNKAYGMTAFEYHGTDPRFNRVFNEGMKNHSVIITKKLLEFYTGFDESVSTLVDVGGGIGATLHAITSHHSHIRGVNFDLPHVISEAPPFPGVQHVGGDMFKSVPAGDAILMKWILHDWSDAHCATLLKNCYDALPEKGGKVIVVECVLPVTTDAVPKAQGVFHVDMIMLAHNPGGRERYEREFRDLAKAAGFSGFKATYIYANAWAIEFIK

SEQ ID NO: 1348 - protein, 362 aa, Sorghum bicolor
  misc_feature (92)..(339): Pfam Name: Methyltransf_2 Pfam Description: O-methyltransferase
  misc_feature (31)..(83): Pfam Name: Dimerisation Pfam Description: Dimerisation domain
  misc_feature (1)..(362): Public GI ID no. 18033964
  misc_feature (1)..(362): Bit score of 937.9 for HMM based on sequences of Figure 1
  misc_feature (1)..(362): Functional Homolog Of SEQ ID NO. 1333
MGSTAEDVAAVADEEACMYAMQLASSSILPMTLKNALELGLLEVLQKDAGKALAAEEVVARLPVAPTNPAAADMVDRILRLLASYDVVKCQMEDKDGKYERRYSAAPVGKWLTPNEDGVSMAALALMNQDKVLMESWYYLKDAVLDGGIPFNKAYGMTAFEYHGTDPRFNRVFNEGMKNHSVIITKKLLEFYTGFDESVSTLVDVGGGIGATLHAITSHHSHIRGVNFDLPHVISEAPPFPGVQHVGGDMFKSVPAGDAILMKWILHDWSDAHCATLLKNCYDALPEKGGKVIVVECVLPVTTDAVPKAQGVFHVDMIMLAHNPGGRERYEREFRDLAKAAGFSGFKATYIYANAWAIEFIK

SEQ ID NO: 1349 - protein, 361 aa, Oryza sativa subsp. japonica
  misc_feature (91)..(338): Pfam Name: Methyltransf_2 Pfam Description: O-methyltransferase
  misc_feature (24)..(82): Pfam Name: Dimerisation Pfam Description: Dimerisation domain
  misc_feature (1)..(361): Public GI ID no. 125602246
  misc_feature (1)..(361): Bit score of 903.3 for HMM based on sequences of Figure 1
  misc_feature (1)..(361): Functional Homolog Of SEQ ID NO. 1333
MAAAADEEACMYALQLASSSILPMTLKNAIELGLLETLQSAAVAGGRGKAALLTPAEVADKLPSKANPAAADMVDRMLRLLASYNVVRCEMEEGADGKLSRRYAAAPVCKWLTPNEDGVSMAALALMNQDKVLMESWYYLKDAVLDGGIPFNKAYGMTAFEYHGTDARFNRVFNEGMKNHSVIITKKLLDLYTGFDAASTVVDVGGGVGATVAAVVSRHPHIRGINYDLPHVISEAPPFPGVEHVGGDMFASVPRGGDAILMKWILHDWSDEHCARLLKNCYDALPEHGKVVVVECVLPESSDATAREQGVFHVDMIMLAHNPGGKERYEREFRELARAAGFTGFKATYIYANAWAIEFTK

SEQ ID NO: 1350 - protein, 361 aa, Oryza sativa subsp. indica
  misc_feature (91)..(338): Pfam Name: Methyltransf_2 Pfam Description: O-methyltransferase
  misc_feature (24)..(82): Pfam Name: Dimerisation Pfam Description: Dimerisation domain
  misc_feature (1)..(361): Public GI ID no. 125560205
  misc_feature (1)..(361): Bit score of 903.0 for HMM based on sequences of Figure 1
  misc_feature (1)..(361): Functional Homolog Of SEQ ID NO. 1333
MAAAADEEACMYALQLASSSILPMTLKNAIELGLLETLQSAAVAGGGGKAALLTPAEVAEKLPSKANPAAADMVDRMLRLLASYNVVRCEMEEGADGKLSRRYAAAPVCKWLTPNEDGVSMAALALMNQDKVLMESWYYLKDAVLDGGIPFNKAYGMTAFEYHGTDARFNRVFNEGMKNHSVIITKKLLDLYTGFDAASTVVDVGGGVGATVAAVVSRHPHIRGINYDLPHVISEAPPFPGVEHVGGDMFASVPRSGDAILMKWILHDWSDEHCARLLKNCYDALPEHGKVVVVECVLPESSDATAREQGVFHVDMIMLAHNPGGKERYEREFRELARAAGFTGFKATYIYANAWAIEFTK

SEQ ID NO: 1351 - DNA, 1212 bp, Populus balsamifera subsp. trichocarpa
  misc_feature (1)..(1212): Ceres Annot ID no. 1467665
  misc_feature (1)..(1212): Encodes the peptide sequence at SEQ ID NO. 1352
atgggttcgacaggtgaaactcagatgactccaactcaggtatcagatgaagaggcacacctctttgccatgcaactagccagtgcttcagttctaccaatgatcctcaaaacagccattgaactcgaccttcttgaaatcatggctaaagctggccctggtgctttcttgtccacatctgagatagcttctcacctccctaccaaaaaccctgatgcgcctgtcatgttagaccgtatcttgcgcctcctggctagctactccattcttacttgctctctgaaagatcttcctgatgggaaagttgagagactgtatggccttgctcctgtttgcaaattcttgaccaagaacgaggatggtgtctctgtcagccctctctgtctcatgaaccaggacaaggtcctcatggaaagctggtattatttgaaagatgcaattcttgatggaggaattccatttaacaaggcctatgggatgactgcatttgaatatcatggcacggatccaagattcaacaaggtgttcaataagggaatgtctgaccactctaccattaccatgaagaagcttcttgagacctacaaaggctttgaaggcctcacatccttggtggatgttggtggtgggactggagctgtcgttaacaccatcgtctctaaatacccttcaattaagggcattaactttgatctgccccacgtcattgaggatgccccatcttatcccggtgtggagcatgttggtggggacatgtttgttagtgtgcccaaagcagatgccgttttcatgaagtggatatgccatgattggagcgacgcacactgcttaaaattcttgaagaattgctatgacgccttgccggaaaacggcaaggtgatacttgttgagtgcattcttcccgtggctcctgacacaagccttgccaccaagggagtcgtgcacattgatgttatcatgctggcgcacaaccccggtgggaaagagaggaccgaaaaggaatttgagggcttagcaaagggagctggctttcaaggtaccttctcaaccttcccttctcaagatgcaattcttgaaggaggcattccattcaacaaggcccatggaatggctgtatttgaatactttggcatggatccaatactcatcaaggttttcaatgagggaatgtcagaccactctaccattacctgcatgcagaagattctttag

SEQ ID NO: 1352 - protein, 403 aa, Populus balsamifera subsp. trichocarpa
  misc_feature (94)..(340): Pfam Name: Methyltransf_2 Pfam Description: O-methyltransferase
  misc_feature (34)..(85): Pfam Name: Dimerisation Pfam Description: Dimerisation domain
  misc_feature (1)..(403): Ceres Annot ID no. 1467665
  misc_feature (1)..(403): Bit score of 892.7 for HMM based on sequences of Figure 1
  misc_feature (1)..(403): Functional Homolog Of SEQ ID NO. 1333
MGSTGETQMTPTQVSDEEAHLFAMQLASASVLPMILKTAIELDLLEIMAKAGPGAFLSTSEIASHLPTKNPDAPVMLDRILRLLASYSILTCSLKDLPDGKVERLYGLAPVCKFLTKNEDGVSVSPLCLMNQDKVLMESWYYLKDAILDGGIPFNKAYGMTAFEYHGTDPRFNKVFNKGMSDHSTITMKKLLETYKGFEGLTSLVDVGGGTGAVVNTIVSKYPSIKGINFDLPHVIEDAPSYPGVEHVGGDMFVSVPKADAVFMKWICHDWSDAHCLKFLKNCYDALPENGKVILVECILPVAPDTSLATKGVVHIDVIMLAHNPGGKERTEKEFEGLAKGAGFQGTFSTFPSQDAILEGGIPFNKAHGMAVFEYFGMDPILIKVFNEGMSDHSTITCMQKIL

SEQ ID NO: 1353 - DNA, 1095 bp, Populus balsamifera subsp. trichocarpa
  misc_feature (1)..(1095): Ceres Annot ID no. 1472909
  misc_feature (1)..(1095): Encodes the peptide sequence at SEQ ID NO. 1354
atgggttcaacaggtgaaactcagatgtctccagctcagatattagatgaagaagcgaattttgccatgcaactgatcagttcttcagtgctacctatggtcctcaaaacagccattgaacttgaccttcttgaaatcatggctaaagctggccctggtgctctcttgtccccatccgatatagcttctcatctccctaccaaaaaccctgatgcacctgtcatgttagatcgtatcttgcgccttctggctagttactccattcttatttgctctctaagagatcttcctgatgggaaagttgagagactctatggtcttgcttctgtttgtaagttcttgaccaagaatgaagatggtgtctctgttagccctctctgtctcatgaaccaggacaaggtcctcatggaaagttggtatcatttgaaagacgcgattcttgaaggaggaattccatttaacaaggcctatggaatgactgcatttgaatatcatggcacggatccaagattcaacaaggttttcaacaagggaatgtctgaccattctaaaattgccatgaagaagattcttgagacctacaaaggctttgaaggcctcgcatccttggtggatgttggtggcgggactggtgctgtgcttagcacaatcgtctccaagtacccttcaattaagggcatcaactttgatttgcctcatgtcattgcggatgccccagctttccctggtgtggagaatgttggtggtgacatgtttgttagtgtgcccaaagcagatgctgttttcatgaagtggatatgtcatgattggagcgatgaacactgcttaagattcttgaagaactgctatgatgcgctgccggaaaacgggaaagtgatccttgttgaatgcattctccctgtggctcctgacacaagtcttgccaccaagggagtcatgcacgttgatgccataatgctggcacataaccccggaggaaaagagaggaccgaaaaggaatttgagggcttggccaggggagctggcttcaagggtttcgaagtgatgtgctgtgcattcaatacgtacgtgattgaattccgcaagcaggcctaa

SEQ ID NO: 1354 - protein, 364 aa, Populus balsamifera subsp. trichocarpa
  misc_feature (93)..(339): Pfam Name: Methyltransf_2 Pfam Description: O-methyltransferase
  misc_feature (33)..(84): Pfam Name: Dimerisation Pfam Description: Dimerisation domain
  misc_feature (1)..(364): Ceres Annot ID no. 1472909
  misc_feature (1)..(364): Bit score of 877.4 for HMM based on sequences of Figure 1
  misc_feature (1)..(364): Functional Homolog Of SEQ ID NO. 1333
MGSTGETQMSPAQILDEEANFAMQLISSSVLPMVLKTAIELDLLEIMAKAGPGALLSPSDIASHLPTKNPDAPVMLDRILRLLASYSILICSLRDLPDGKVERLYGLASVCKFLTKNEDGVSVSPLCLMNQDKVLMESWYHLKDAILEGGIPFNKAYGMTAFEYHGTDPRFNKVFNKGMSDHSKIAMKKILETYKGFEGLASLVDVGGGTGAVLSTIVSKYPSIKGINFDLPHVIADAPAFPGVENVGGDMFVSVPKADAVFMKWICHDWSDEHCLRFLKNCYDALPENGKVILVECILPVAPDTSLATKGVMHVDAIMLAHNPGGKERTEKEFEGLARGAGFKGFEVMCCAFNTYVIEFRKQA

SEQ ID NO: 1355 - DNA, 1310 bp, Arabidopsis thaliana
  misc_feature (1)..(1310): Ceres Clone ID no. 253173
  misc_feature (1)..(1310): Encodes the peptide sequence at SEQ ID NO. 1356
atattttcatataaataaacctctcaacctccacactttctcacccatcacacaatcctcaaaacagagtaacccaaaaaacagagcaatctctaaaaaatctcaagaaacctcactaaaatgggttcaacggcggagacacaattaactccggtgcaagtcaccgacgacgaagctgccctcttcgccatgcaactagccagtgcttccgttcttccgatggctttaaaatccgccttagagcttgaccttcttgagattatggccaagaatggttctcccatgtctcctaccgagatcgcttctaaacttccgaccaaaaaccctgaagctccggtcatgctcgaccgtatcctccgtcttcttacgtcttactccgtcttaacctgctccaaccgtaaactttccggtgatggcgttgaacggatttacgggcttggtccggtttgcaagtatttgaccaagaacgaagatggtgtttccattgctgctctttgtcttatgaaccaagacaaggttctcatggaaagctggtaccatttgaaggatgcaattcttgatggtgggattccattcaacaaggcttatggaatgagcgcgttcgagtaccacgggactgaccctagattcaacaaggtctttaacaatggaatgtctaaccattccacaatcaccatgaagaagattcttgagacctataagggttttgaagggttgacttctttggttgatgttggtggtggcattggtgctacactcaaaatgattgtctccaagtaccctaatcttaaaggcatcaactttgatctcccacatgtcattgaagatgctccttctcatcctggtattgagcatgttggaggagatatgtttgtaagtgtccctaaaggtgatgccatattcatgaagtggatatgtcatgactggagtgacgaacattgcgtgaaattcttgaaaaactgctacgagtcacttccagaggatggaaaagtgatattagcagagtgtatacttccagagacaccagactcaagcctctcaaccaaacaagtagtccatgtcgattgcattatgttggctcacaatcccggaggcaaagaacgaaccgagaaagagtttgaggcattagccaaagcatcaggcttcaagggcatcaaagttgtctgcgacgcttttggtgttaaccttattgagttactcaagaagctctaaaaacaaacaatgttcctatgaagatgatttatatgtaaacattatctcatatctccttccacggttccaaaactatgctgtttaataatggtttttac

SEQ ID NO: 1356 - protein, 363 aa, Arabidopsis thaliana
  misc_feature (92)..(338): Pfam Name: Methyltransf_2 Pfam Description: O-methyltransferase
  misc_feature (34)..(83): Pfam Name: Dimerisation Pfam Description: Dimerisation domain
  misc_feature (1)..(363): Ceres Clone ID no. 253173
  misc_feature (1)..(363): Bit score of 831.3 for HMM based on sequences of Figure 1
  misc_feature (1)..(363): Functional Homolog Of SEQ ID NO. 1333
MGSTAETQLTPVQVTDDEAALFAMQLASASVLPMALKSALELDLLEIMAKNGSPMSPTEIASKLPTKNPEAPVMLDRILRLLTSYSVLTCSNRKLSGDGVERIYGLGPVCKYLTKNEDGVSIAALCLMNQDKVLMESWYHLKDAILDGGIPFNKAYGMSAFEYHGTDPRFNKVFNNGMSNHSTITMKKILETYKGFEGLTSLVDVGGGIGATLKMIVSKYPNLKGINFDLPHVIEDAPSHPGIEHVGGDMFVSVPKGDAIFMKWICHDWSDEHCVKFLKNCYESLPEDGKVILAECILPETPDSSLSTKQVVHVDCIMLAHNPGGKERTEKEFEALAKASGFKGIKVVCDAFGVNLIELLKKL

SEQ ID NO: 1357 - DNA, 1354 bp, Glycine max
  misc_feature (1)..(1354): Ceres Clone ID no. 464420
  misc_feature (1)..(1354): Encodes the peptide sequence at SEQ ID NO. 1358
ggtcacaactcacaagctcacagagcaagaacactgttccaatacggaatctaaggcaaagcaaaccaaacatcttgaatcatgggttcaacaggtgagactcagattaccccaacccacgtatctgatgaagaagcaaaccttttcgccatgcaactagccagtgcttctgtccttccaatgatcctcaaatcagcacttgagcttgatctgttggaaatcatagccaaggctggccctggtgttcatctttcccccactgacatttcttctcagctcccaacacagaaccctgatgcacccgttatgttggaccgtatattgcgcctattggcttgctacaatatcctctctttttctctccgcactctccctgatggcaaggttgagaggctctatggtctcgcccccgttgccaagtacttggttaagaacgaagatggtgtctccattgctgcgctcaacctcatgaaccaggacaaagtcctcatggaaagctggtactatttgaaagatgcagtccttgaaggaggcattccatttaacaaggcttatggaatgacagcctttgagtaccatggaacagatccaaggtttaacaaggttttcaacaagggaatggctgatcactctaccatcacaatgaagaaaattcttgagacctacacaggttttgagagtcttaaatctctggttgatgttggtggtgggactggagctgtaatcaacatgattgtctcaaagcatcccactattaagggcattaattttgatttgcctcatgtcattgaagatgccccatcttatcctggagtggagcatgtaggtggagatatgtttgcgagtgttccgaaagctgatgctatttttatgaagtggatttgccacgattggagtgatgagcactgcttgaagtttttgaagaactgctacgaggcactaccagacaatgggaaggtgattgtggcagaatgcattcttccagtggctccagactctagcttggccacaaaaggtgtggttcacatcgatgtgatcatgttggcacataatccaggtgggaaagagagaacagagaaagagtttgaggctctggccaaagggtctggattccaaggtttccgagttgtttgctgtgctttcaataccaacatcatggaatttctcaaaaagatttaagttctttggcatggattcatgtcaagctgcatttgggttttgagattgaggttgtggttgtggtgctactttccaaagctttcccggaaaaacgtaattttctcttaggaaaagaataatgaacaagttcaatgtagactgccaatatcaaataacaagtttcattttgtggatc

SEQ ID NO: 1358 - protein, 365 aa, Glycine max
  misc_feature (94)..(340): Pfam Name: Methyltransf_2 Pfam Description: O-methyltransferase
  misc_feature (34)..(85): Pfam Name: Dimerisation Pfam Description: Dimerisation domain
  misc_feature (1)..(365): Ceres Clone ID no. 464420
  misc_feature (1)..(365): Bit score of 880.7 for HMM based on sequences of Figure 1
  misc_feature (1)..(365): Functional Homolog Of SEQ ID NO. 1333
MGSTGETQITPTHVSDEEANLFAMQLASASVLPMILKSALELDLLEIIAKAGPGVHLSPTDISSQLPTQNPDAPVMLDRILRLLACYNILSFSLRTLPDGKVERLYGLAPVAKYLVKNEDGVSIAALNLMNQDKVLMESWYYLKDAVLEGGIPFNKAYGMTAFEYHGTDPRFNKVFNKGMADHSTITMKKILETYTGFESLKSLVDVGGGTGAVINMIVSKHPTIKGINFDLPHVIEDAPSYPGVEHVGGDMFASVPKADAIFMKWICHDWSDEHCLKFLKNCYEALPDNGKVIVAECILPVAPDSSLATKGVVHIDVIMLAHNPGGKERTEKEFEALAKGSGFQGFRVVCCAFNTNIMEFLKKI

SEQ ID NO: 1359 - DNA, 1310 bp, Brassica napus
  misc_feature (1)..(1310): Ceres Clone ID no. 1086143
  misc_feature (1)..(1310): Encodes the peptide sequence at SEQ ID NO. 1360
atcacacactcctctcaaaacagagaaacaaaagaaaaagaaacattccaagaatatcttagagatttcaagaaaaatgggatcaacggcggagacacagataactccggtacaagtcaccgacgacgaagccgctctctttgccatgcagctagccagcgcctccgtccttcccatggttttaaagtccgcgctagaccttgatcttctcgagatcatggccaagaactcttctccgatgtctccctctgagattgcttctaaacttcagaccaaaaaccccgaagctccggtcatgctcgaccgaatcctccgtcttctcacgtcttactccatcctcacctgctccaaccgaaccattcccggcggagacagcgtcgagaggatttacgggcttggtccggtttgcaagtacttgaccaagaacgaagatggtgtctctatagctgctctttgtcttatgaaccaagacaaggttctcatggaaagctggtaccatttgaaagatgcaattcttgatggtgggattccattcaacaaggcttatggaatgagcgcttttgagtaccacgggaaggatctaaggttcaacacggtattcaacaatggaatgtctaaccattcaaccattacaatgaagaagattctcgagacctataagggttttgagggtttgacttctttggttgacgttggtggtggcattggtgctactctcaaaatgattgtctctaagtaccctgaccttaaaggcatcaactttgatctcccacatgtcatcgaagaagctacttctcatcccggtattgatcatgttggaggagatatgtttgtaagtgtccctaaaggtgatgcaattttcatgaagtggatatgccacgactggagcgatgaacactgcgtgaaattcttgaagaactgctacgaggcgcttccagaggatggaaaagtgatactagcagagtgtatacttccagagacaccagactcaagcctctcgaccaaacaagtagtccatgttgattgcattatgttggctcacaaccctggaggcaaagaacggaccgagaaggagttcgaggcattagctaaaggatcaggcttcaaaggcatcaatgttgcctgcaatgcttttggtgtttacgttattgagctgctcaaaaagatgtaagacacacacacacacacacaatccatgtaataatgatattatatgtaaacattgctttcatgtacgtctacttcaccgtctttgttttaaaactatgatgtgtaataatggtttattaagagattgatctaaagttttc

SEQ ID NO: 1360 - protein, 364 aa, Brassica napus
  misc_feature (94)..(339): Pfam Name: Methyltransf_2 Pfam Description: O-methyltransferase
  misc_feature (34)..(83): Pfam Name: Dimerisation Pfam Description: Dimerisation domain
  misc_feature (1)..(364): Ceres Clone ID no. 1086143
  misc_feature (1)..(364): Bit score of 810.5 for HMM based on sequences of Figure 1
  misc_feature (1)..(364): Functional Homolog Of SEQ ID NO. 1333
MGSTAETQITPVQVTDDEAALFAMQLASASVLPMVLKSALDLDLLEIMAKNSSPMSPSEIASKLQTKNPEAPVMLDRILRLLTSYSILTCSNRTIPGGDSVERIYGLGPVCKYLTKNEDGVSIAALCLMNQDKVLMESWYHLKDAILDGGIPFNKAYGMSAFEYHGKDLRFNTVFNNGMSNHSTITMKKILETYKGFEGLTSLVDVGGGIGATLKMIVSKYPDLKGINFDLPHVIEEATSHPGIDHVGGDMFVSVPKGDAIFMKWICHDWSDEHCVKFLKNCYEALPEDGKVILAECILPETPDSSLSTKQVVHVDCIMLAHNPGGKERTEKEFEALAKGSGFKGINVACNAFGVYVIELLKKM

SEQ ID NO: 1361 - DNA, 1352 bp, Brassica napus
  misc_feature (1)..(1352): Ceres Clone ID no. 1118817
  misc_feature (1)..(1352): Encodes the peptide sequence at SEQ ID NO. 1362
atcacacaatcctctcaaacacaaagcattctaagaatatcttaaagatttcaagaaaaaaacatggggttaacggaggagacacagataactccggtgcaagtcaccgacgatgaagctgctctcttcgccatgcagctagcaagcgcctccgttcttccgatggttttaaaaacggctttagacctcgatcttctcgagatcatggccaagaactcttctcagatgtctccctctgagattgcttctcaacttcagaccaaaaaccctgaagctccaatcatgctcgaccgtatccttcgtcttcttacgtcttactccatcctcacctgctccagtcgtactattcccggcggcgacagcgtcgagaggatttacgggcttggtccggtttgcaagtatttgaccaagaacgaggatggtgtgtccattgctgctctctgtcttatgaaccaagacaaggttctcttggaaagctggtaccatttgaaagatgcaattcttgatggtgggattccattcaacaaggcctatggaatgagcgctttcgagtaccatgggaaggaccttaggttcaacacggtgttcaacaatggaatttctaaccattcaaccatcacaatgaagaagattcttgagacctataagggtttcgaaggactgacttctttggtggatgttggtggtggcattggtgcgactctcaaaatgattgtctctaagtaccctaaccttaaaggcatcaactttgatctccctcatgtcatcgaagaagctacttctcatcccggtattgagcatgttggaggagatatgtttgtaagtgtccctgaaggtgatgcaattttcatgaagtggatatgccacgattggagcgacaaacattgcgtgaaattcttgaagaactgctacgaggcgcttccagaggatggaaaagtgatattagcagagtgtatactaccagagacaccagactcgagcctgtcgacaaaacaagtagtccatgtggactgcatcatgttggctcacaaccctggtggcaaagaacggaccgagaaagagttcgagaggttagctaaagaatcaggcttcaaaggcatcaaagttgcttgcaacgcttttggtgtttacgttattgagttgctcaagaagatctaaacactgctcccatgtcttatgtctacgtcaacttcaccacctttgtcatgatgtttaataatggtttataaagagattgatctagagtttttcattgatctggttgtattgatataatcttatttgtgtttttgtttgtttggaaaacaatcatgtaattttatatttaaaaataaaataatgagattgaatcg

SEQ ID NO: 1362 - protein, 364 aa, Brassica napus
  misc_feature (94)..(339): Pfam Name: Methyltransf_2 Pfam Description: O-methyltransferase
  misc_feature (34)..(83): Pfam Name: Dimerisation Pfam Description: Dimerisation domain
  misc_feature (1)..(364): Ceres Clone ID no. 1118817
  misc_feature (1)..(364): Bit score of 791.8 for HMM based on sequences of Figure 1
  misc_feature (1)..(364): Functional Homolog Of SEQ ID NO. 1333
MGLTEETQITPVQVTDDEAALFAMQLASASVLPMVLKTALDLDLLEIMAKNSSQMSPSEIASQLQTKNPEAPIMLDRILRLLTSYSILTCSSRTIPGGDSVERIYGLGPVCKYLTKNEDGVSIAALCLMNQDKVLLESWYHLKDAILDGGIPFNKAYGMSAFEYHGKDLRFNTVFNNGISNHSTITMKKILETYKGFEGLTSLVDVGGGIGATLKMIVSKYPNLKGINFDLPHVIEEATSHPGIEHVGGDMFVSVPEGDAIFMKWICHDWSDKHCVKFLKNCYEALPEDGKVILAECILPETPDSSLSTKQVVHVDCIMLAHNPGGKERTEKEFERLAKESGFKGIKVACNAFGVYVIELLKKI

SEQ ID NO: 1363 - DNA, 1347 bp, Brassica napus
  misc_feature (1)..(1347): Ceres Clone ID no. 1128033
  misc_feature (1)..(1347): Encodes the peptide sequence at SEQ ID NO. 1364
atcgaaacccaaaaacaaagcattctaaaatctcagaaatttcacgaaaatgggctcaacggcagagacacattcaactccagtgcaagtcaccgacgacgaaactgctctctttgccatacagttagccagtgcctcagttctccctatggctttaaaatcagctatagagctcgatcttctagagatcatggccaggaactgttctcccatgtctgcatctgagatctcttctcatcttccgaccaaaaaccccgaagctccggtcatgcttgaccgtatcctccgtcttcttacggcttactccgtcctcacttgctccgtccgtacacttcccgacggcgtcgaccggctttacgggcttggtccagtttgcaaatatttcatcaagaacgaagatggcgtctcgatagctcctctctgtctcctgaatcatgacaaggtcttcatgggcagctggtactatttgaaggatgcagttcttgatggtgggattccattcaataaagcttatggcatgagcgcgtttgagtaccatgggactgacctgagattcaacaaggttttcaacaatggaatgtctaaccattccaccatcaccatgaagaagattcttgagacctataatggttttgagggtttggtctccttggttgatgtcgggggtggcattggtgctactctcaaaatgattgtctctaagtaccctaatcttaaaggcatcaactttgatctccctcatgtcatcgaagatgctccttctcatcccggtgttgagcatgttggaggagatatgtttgtaagtgttcccaaaggtgatgctattttcatgaagtggatatgccatgactggagtgacgaacactgtttaaaattcttaaagaattgttacgaggcgcttccagagaatggaaaagtgatcttggcagagtgtatacttccagagacactagactcgagcctgtcgaccaaacaagtagtcaatgtcgattgcattatgttggctctcaatcctggaggcaaagaacggaccgagaaagagtatgaggcattagccaaaggatcaggctttgaaggcatcaaagttgtttgcaacgtttttggtgttcacgtcattgagctgctcaagaagatctgagaaaaagctttcttagtggtgctttataaataagcatgcatgctctctcttgtacgtctacttcaccagcttaattgttgtacttatgtgatcttttccgatttaaagtcttagactatgatgcttaatcatggttgccgtgcgacctgtttatcaataaattgtacttgtgtttttatttctaagaataatataaaacaatcctctat

SEQ ID NO: 1364 - protein, 362 aa, Brassica napus
  misc_feature (94)..(337): Pfam Name: Methyltransf_2 Pfam Description: O-methyltransferase
  misc_feature (34)..(83): Pfam Name: Dimerisation Pfam Description: Dimerisation domain
  misc_feature (1)..(362): Ceres Clone ID no. 1128033
  misc_feature (1)..(362): Bit score of 789.3 for HMM based on sequences of Figure 1
  misc_feature (1)..(362): Functional Homolog Of SEQ ID NO. 1333
MGSTAETHSTPVQVTDDETALFAIQLASASVLPMALKSAIELDLLEIMARNCSPMSASEISSHLPTKNPEAPVMLDRILRLLTAYSVLTCSVRTLPDGVDRLYGLGPVCKYFIKNEDGVSIAPLCLLNHDKVFMGSWYYLKDAVLDGGIPFNKAYGMSAFEYHGTDLRFNKVFNNGMSNHSTITMKKILETYNGFEGLVSLVDVGGGIGATLKMIVSKYPNLKGINFDLPHVIEDAPSHPGVEHVGGDMFVSVPKGDAIFMKWICHDWSDEHCLKFLKNCYEALPENGKVILAECILPETLDSSLSTKQVVNVDCIMLALNPGGKERTEKEYEALAKGSGFEGIKVVCNVFGVHVIELLKKI

SEQ ID NO: 1365 - DNA, 1969 bp, Panicum virgatum
  misc_feature (1)..(1969): Ceres Clone ID no. 1786268
  misc_feature (1)..(1969): Encodes the peptide sequence at SEQ ID NO. 1366
aaaattgcgatgcttcgtcctcctcgtcgcgccgccgcatctaactccggcgactcaccgccggcgatccgatccgcgctgcgccgccacgccacagcctctctgtgacgctcacgtaatcctactccgcgttcctctacctcctccgctccggcgtccgcgcaatccgcccgaatgggcaccgggacggggggtgcgagagggggcgcgggcggcggaggcttggtgcccggcgagcggtggtggcgggtcctcttcctcgcgctggcgtccgtctccttcctcatctctctcatcctcctcttcctctccgccccgcgcctccgactcccgggcgtcgccccatccgcctccacctccgccgcttccgccgtccggcgcgggctagacgcgccgccctgcctcgcctacctccttatcggcgcgcggggcgacgggcgccgcctactaaggctcctcctcgcggtctaccacccgcgcaaccggtacgtgctccacctctccgccgacgcgcccgacgacgagcgacagagcctagctgccggggttgtcgccgccgctcccgcggtgggagcgttcgagaacgtcgctgtcgtcggcaaccccaccgccgggacgctcgtgggctcctccgggctcgccggcacgctccgcgccgcggccgttctgctccggctccacccagactgggactggttcctcactctcaacgccgcggactaccccctcgtcacccaggacgatctgattcatgtcctatcctcggttccaagggaccttaacttcattgaccacaccagtaacattggatcaaaagaacctgagaaagtggaacaaattatagtcgatgctggaatttacttgtcaggaaggaccaacttctttcgaggaacacagaaacgaccagctcctgtggcttttaagttcttcacaggttctccatgggtcatattaaaccgtcggttcatagagtactgcattcttgcttgggagaatctccctcgaattcttctcatgtacttcaacaacataatacaaccccaggaaggatatttccactcggtcatctgcaactctctggaattccgcaatttcactgtgaacaacgacttgaggtttattccgcgggaggatccagctcagaaagagcccccttttctgagtcgagaacattacagtcagatggtggatagtggggcgccttttgcaaggccgtttcgggagaatgatcctctgctggaccagattgatggcaacatactcaagcgttggagccatggaccagttcctggtgcttggtgctctgggaggaagaggtggttcagtgatccatgttcccagtggggcgacgtgaacattgtgagaccaggcccccaagctgtgaaattgcaccaatacgtaaatcggactttacaagaagcaaagtctagcagcaacacatgcaggcaatagcagcattgatgccagtggcctcatatcccatggctgaaagctttgagctattccatttatccacacaggctcttcactctgctgaataaatagctgctacctgcctgaacggaaacaagcattcctggcacctggatagtaacacacaaccgtggaggactgctttcctgatcctttcttttgtgtggcaactatcacagtcacggatcaggggttctaatctgttgaatccccatattctgcacctatgacactgaaggcagatagcttagagccgatgaaaagcagtggcctatattactactgtagtttatatgccgtggtcatttgttgaacggcttgtggtatatagtgcagatgaagttatgagacccttttgctctcaggttgccaggcctggagacaatgtagaacaaggaatcttgttagtcttactgattactgttgtgctttgggcttacatgcctagtcttgtacctagaacaagccttcaattgtcccattttttccccttttg

SEQ ID NO: 1366 - protein, 425 aa, Panicum virgatum
  misc_feature (77)..(303): Pfam Name: Branch Pfam Description: Core-2/I-Branching enzyme
  misc_feature (1)..(425): Ceres Clone ID no. 1786268
  misc_feature (1)..(425): Bit score of 1102.1 for HMM based on sequences of Figure 8
  misc_feature (1)..(425): in Figure 8
MGTGTGGARGGAGGGGLVPGERWWRVLFLALASVSFLISLILLFLSAPRLRLPGVAPSASTSAASAVRRGLDAPPCLAYLLIGARGDGRRLLRLLLAVYHPRNRYVLHLSADAPDDERQSLAAGVVAAAPAVGAFENVAVVGNPTAGTLVGSSGLAGTLRAAAVLLRLHPDWDWFLTLNAADYPLVTQDDLIHVLSSVPRDLNFIDHTSNIGSKEPEKVEQIIVDAGIYLSGRTNFFRGTQKRPAPVAFKFFTGSPWVILNRRFIEYCILAWENLPRILLMYFNNIIQPQEGYFHSVICNSLEFRNFTVNNDLRFIPREDPAQKEPPFLSREHYSQMVDSGAPFARPFRENDPLLDQIDGNILKRWSHGPVPGAWCSGRKRWFSDPCSQWGDVNIVRPGPQAVKLHQYVNRTLQEAKSSSNTCRQ

SEQ ID NO: 1367 - DNA, 1266 bp, Sorghum bicolor
  misc_feature (1)..(1266): Ceres Annot ID no. 8724997
  misc_feature (1)..(1266): Encodes the peptide sequence at SEQ ID NO. 1368
atgggaatggggaccgcgagaggggccgcagggggctggctccccggcgagcggtggcggcgggtcctcttcctggcgctggcgtccgtctccttcctcatctcgctcatcctcctcttcctctccgcgccgcgcctccgcctcccgagcgtcgtcctgccttacaccgccgctgccgcttccgccgtccgccgcgggcccgacgcgccgccctgcctcgcgtacctcctaatcggcgcgcgcggcgacgggcgccgcctcctcaggctcctcctcgcggtctaccacccgcgtaaccggtacgtgctccacctctccgccgacgcgcccgacgacgagcgcctgagcctcgccgccggggtcgtcgccgctgcacccgctgtcggagcattcgagaacgttgctgttgtcggcaaacccaccgccgggacgcccgtggggtcctccgggctcgccggcacgctccgcgctgcggccgtgctgctccgactccacgccgactgggattggttcctcaccctcaatgccgcagattaccccctcgtcacacaggatgacctgattcatgtcctttcttctgttccaagggatcttaacttcattgaccacatgggtgacattgaatcaaaagaacctgagaaagtgcaacaaattatagttgatgctggaatttacttgtcagggaggaccaacttctttcgaggaacacagaaacgaccagctcctgaggcttttaagttctttacaggttctccatgggtcatattaaaccggcgatttatagagtactgcattcttgcttgggagaatctccctcggattcttctcatgtacttccacaacgtaatacaaccccaggaaggatatttccagtcagtcatctgcaactcgctggacttccgcaatttcactgtgaacaacgacttgaggttcatggtgcgggatgattccgctgaggcaaagccccttttcctgagcagagaacattacggccacatggtggatagtggggcaccttttgcaaggccgtttcaggagaatgatcctctgctggaccagatcgacagcaacatactcaagcgttggagccatggaacagttcctggtgcctggtgcacaggtaggaagaggtggttcagtgatccatgttcccagtggggcgatgtgaatattgtgagaccaggccctcaagcagtgatgttgcaacagtatgtaaatcggaccttagaagaagcaaagtctggcagcaactcatgcaggcggtag

SEQ ID NO: 1368 - protein, 421 aa, Sorghum bicolor
  misc_feature (73)..(298): Pfam Name: Branch Pfam Description: Core-2/I-Branching enzyme
  misc_feature (1)..(421): Ceres Annot ID no. 8724997
  misc_feature (1)..(421): Bit score of 1103.9 for HMM based on sequences of Figure 8
  misc_feature (1)..(421): Functional Homolog Of SEQ ID NO. 1366
  misc_feature (1)..(421): in Figure 8
MGMGTARGAAGGWLPGERWRRVLFLALASVSFLISLILLFLSAPRLRLPSVVLPYTAAAASAVRRGPDAPPCLAYLLIGARGDGRRLLRLLLAVYHPRNRYVLHLSADAPDDERLSLAAGVVAAAPAVGAFENVAVVGKPTAGTPVGSSGLAGTLRAAAVLLRLHADWDWFLTLNAADYPLVTQDDLIHVLSSVPRDLNFIDHMGDIESKEPEKVQQIIVDAGIYLSGRTNFFRGTQKRPAPEAFKFFTGSPWVILNRRFIEYCILAWENLPRILLMYFHNVIQPQEGYFQSVICNSLDFRNFTVNNDLRFMVRDDSAEAKPLFLSREHYGHMVDSGAPFARPFQENDPLLDQIDSNILKRWSHGTVPGAWCTGRKRWFSDPCSQWGDVNIVRPGPQAVMLQQYVNRTLEEAKSGSNSCRR

SEQ ID NO: 1369 - DNA, 1687 bp, Zea mays
  misc_feature (1)..(1687): Ceres Clone ID no. 210401
  misc_feature (1)..(1687): Encodes the peptide sequence at SEQ ID NO. 1370
gctccacgtcacgacgccgcatctaaccctccggcgactcatcgccggcgagccggtccgccacgccatagcctcgtcctgaagcgcacttaatcctacgtctcgttcctctctcgcccccggtaccctccataggcatgggaatggggtctgcgagagggggcgcagggggatggctccccggcgagcggtggcggcgggtcatcttcctcgctctggcggccgtctcgttcctcatctcactcatactcctcttcctatccgcgccgcgtctccgcctcccaagtgtcgtcctgccttacaccaccgcttccgcttctgccgtccgccgcgggcccggcgagccgccctgcctggtgtacctgctgaccggcgcgcgcggcgacgggcgccgcctcctcaggctcctcctcgcggtttaccacccgcgcaaccggtacgtgctccacctctccgccgacgcgccagacgacgagcgcctgagcctcgccaccggggtcgtcgccgcggcgcccgccgtgggagcattcgagaacgtggttattattggcaatcccaccgccgggacgcccgtggggtcctccggactcgccggcacgctccgcgctgcggccgtgctgctccggctccacgctgactgggactggttcctcaccctcaatgccgccgactaccccctcgtcacacaggatgacctgattcatgtcctttcttctgtcccaagggatcttaacttcattgaccacaccggtgacgttggatcaaaagaacctgagaaagttcaacaaattatagtcgatgctggaatttacttgtcagggaggaccaacttctttcgaggaacacagaaacgagcagctcctgaggcttttaagttctttacaggttctccatgggtcatattaaaccggcaatttatagagtactgcattcttgcttgggagaatctccctaggattcttctcatgtacttcaacaatgtaatacaacctcaggaagggtatttccagacagtcatctgcaactcactggacttccgtaatttcactgtgaacaatgacttgaggttcatggtgcaagatgattccgctcagaaaaagtcccttttcacgagcagggaacattatggtcacatggtggatagtggggcacccttcgcaaggccgtttcaggagaatgatcctctgctggaccagatcgacggcaatatactcaagcgttggagccatggaccagttcctggtgcttggtgcacaggaaggaagaggtggttcagtgatccatgttcccagtggggcgatgtgaatgttttgagaccaggtcctcaagcagtgatgttgcaccaatatgtaaatcggaccttagaagaagcaaagtctagcagcaattcatgcaggcggtagcagcattggcgtctagaacctcatgtcccatggttgaaagctttgagctttttccgcttatccactaagggttctccactctgctgaataaatagctgccacatgtctaagctgaaacaagcactcgtcgcacctggaacaaagccatggagggatgttcttttctgatattttcatgatgactatcatagtcacggatcaggagtttcactttggtctgtgattaatctgtgcaatccccatatttggctcatataacacttccaggcgctgataataggctg

SEQ ID NO: 1370 - protein, 421 aa, Zea mays
  misc_feature (73)..(298): Pfam Name: Branch Pfam Description: Core-2/I-Branching enzyme
  misc_feature (1)..(421): Ceres Clone ID no. 210401
  misc_feature (1)..(421): Bit score of 1094.6 for HMM based on sequences of Figure 8
  misc_feature (1)..(421): Functional Homolog Of SEQ ID NO. 1366
  misc_feature (1)..(421): in Figure 8
MGMGSARGGAGGWLPGERWRRVIFLALAAVSFLISLILLFLSAPRLRLPSVVLPYTTASASAVRRGPGEPPCLVYLLTGARGDGRRLLRLLLAVYHPRNRYVLHLSADAPDDERLSLATGVVAAAPAVGAFENVVIIGNPTAGTPVGSSGLAGTLRAAAVLLRLHADWDWFLTLNAADYPLVTQDDLIHVLSSVPRDLNFIDHTGDVGSKEPEKVQQIIVDAGIYLSGRTNFFRGTQKRAAPEAFKFFTGSPWVILNRQFIEYCILAWENLPRILLMYFNNVIQPQEGYFQTVICNSLDFRNFTVNNDLRFMVQDDSAQKKSLFTSREHYGHMVDSGAPFARPFQENDPLLDQIDGNILKRWSHGPVPGAWCTGRKRWFSDPCSQWGDVNVLRPGPQAVMLHQYVNRTLEEAKSSSNSCRR

SEQ ID NO: 1371 - protein, 406 aa, Oryza sativa subsp. japonica
  misc_feature (48)..(284): Pfam Name: Branch Pfam Description: Core-2/I-Branching enzyme
  misc_feature (1)..(406): Public GI ID no. 52353585
  misc_feature (1)..(406): Bit score of 1026.1 for HMM based on sequences of Figure 8
  misc_feature (1)..(406): Functional Homolog Of SEQ ID NO. 1366
  misc_feature (1)..(406): in Figure 8
MVSVFFLLSLLLLLFSSSPPRLRLPGPAAAAPSLADDLRCGHGAPPCLAYLLVGARGDGARLLRLLLAVYHPRNRYVLHLSADASDSERRDLAAWVAAATPAVGAFRNVAVVGAPTAGTPVGSSGLAGTLRAAAVLLRLHPDWDWFITLNAADYPVVTQDDLIYVLSNVSRQFNFVDHTSDIGQKESEKVQSMIVDAGIYLAGRTNFFRASEKRPTPDAFKFFTGISCCLCFCFGSPWVILNRQFIEYCILGWENLPRILLMYFNNIMLPQEGYFHSVICNSLEFRNFTVNNDLRYKAWDNPPQTEPVFLDMTHYDKMVDSGAPFARRFRENESLLDKIDGNVLGRWGHGPVPGAWCSGRKSWFSDPCSQWSDVNIVRPGPQGIKLRQYINRALEGGEFGSKSCRR

SEQ ID NO: 1372 - protein, 409 aa, Vitis vinifera
  misc_feature (55)..(288): Pfam Name: Branch Pfam Description: Core-2/I-Branching enzyme
  misc_feature (1)..(409): Public GI ID no. 157338893
  misc_feature (1)..(409): Bit score of 1100.3 for HMM based on sequences of Figure 8
  misc_feature (1)..(409): Functional Homolog Of SEQ ID NO. 1366
  misc_feature (1)..(409): in Figure 8
MLAEKKWLFTLFSAAFVSLLLFLSSISGFNASYALSFHKPFSSTVHHGLHYPPAFAYYISGGRGHKDRILRLLLAVYHPRNRYLLHLGADASDEERRLLASAVKSVPAIRAFGNVDVVGKPDRLTYMGSSNIAATLRAASILLRVDSGWNWFITLSSMDYPLITQDDLSHVFSSVRRDLNFIDHTSDLGWKESQRVHPIVVDPGIYLARRSQIFHATEKRPTPDGFKFFTGKVLLYVLCSPWVILNRSFLEFCILGWDNLPRTLLMYFTNVILSDEGYFHSVICNSPEFRNTTVNNDLRYVIWDSPPKMEPHFLNVSDYDQTVQSGAAFARQFQKDDPVLNMIDEKILKRGRNRVVPGAWCTGRKSWWMDPCSNWGDANVLRPGLQAKKLEESVTNLLEGSNSQSNQCK

SEQ ID NO: 1373 - DNA, 1197 bp, Populus balsamifera subsp. trichocarpa
  misc_feature (1)..(1197): Ceres Annot ID no. 1517155
  misc_feature (1)..(1197): Encodes the peptide sequence at SEQ ID NO. 1374
atgggagcagagaaaagatggcttttcactctcttctcctcagcatttctttcactactctttctcttagtctattcaatctctgctttcagttcctctaaacagttcccttctataattcaccatggaatccactaccctcctgcttttgcctattatatctcaggtggaaggggtgataaggatcggatccttaggttattgctggcagtttatcacccaagaaaccgttatttattgcatttgggtgccgaggcatctgacgaggagagaatgaagcttgttggggctgtaaatgcggtgcctgcgattaggagttttgggaacgtggacgttgttgggaaacctggaaggcttacctacatgggttcttctaacctggccgcgattttgcgtgctgctgccattttgttgaggatggatgctgggtggacgtggtttgtgtctttgagtgcaatggattatccgttggtaactcaggatgacttgtcccatgttttctcctctgttagcagagacctcaatttcatagatcacaccagtgaccttgggtggaaagaagatcaaagaattcagcctattgtagttgacccagggatttacctagccaggaggagccagatatttcatgctacagagaagcggccaactcctgatggtttcaaaatatctcctactgcaggttccccgtgggtgatcttgagcaggtcatttcttgaattttgcattcttggttgggataatcttcctcgaacccttcttatgtacttcaacaatgtggtcttatctgaagaaagctatttccactctgtcatttgcaatgcaccagagtttaagaacacaactttaaacagtgatctaaggtatatggtctgggacaatcctccaaagatggaaccacattttcttaatacatctgattatgatctcatggttcaaagtggagtggcttttgcaaggcagtttcagaaggatgaccctgtgctagacaaggtggacgagaagatccttaagcgtgggcatgatcgagctgccccaggtgcatggtgcactggccggaggacctggtggattgatccttgctctcaatggggtgatgtcaatgttgtgaagccaggtcctcaggctaagaagttcaaggagaccattaaaaaccttcttgatgaatggaactcacagatgaatcagtgcaaatga

SEQ ID NO: 1374 - protein, 398 aa, Populus balsamifera subsp. trichocarpa
  misc_feature (50)..(277): Pfam Name: Branch Pfam Description: Core-2/I-Branching enzyme
  misc_feature (1)..(398): Ceres Annot ID no. 1517155
  misc_feature (1)..(398): Bit score of 1061.6 for HMM based on sequences of Figure 8
  misc_feature (1)..(398): Functional Homolog Of SEQ ID NO. 1366
  misc_feature (1)..(398): in Figure 8
MGAEKRWLFTLFSSAFLSLLFLLVYSISAFSSSKQFPSIIHHGIHYPPAFAYYISGGRGDKDRILRLLLAVYHPRNRYLLHLGAEASDEERMKLVGAVNAVPAIRSFGNVDVVGKPGRLTYMGSSNLAAILRAAAILLRMDAGWTWFVSLSAMDYPLVTQDDLSHVFSSVSRDLNFIDHTSDLGWKEDQRIQPIVVDPGIYLARRSQIFHATEKRPTPDGFKISPTAGSPWVILSRSFLEFCILGWDNLPRTLLMYFNNVVLSEESYFHSVICNAPEFKNTTLNSDLRYMVWDNPPKMEPHFLNTSDYDLMVQSGVAFARQFQKDDPVLDKVDEKILKRGHDRAAPGAWCTGRRTWWIDPCSQWGDVNVVKPGPQAKKFKETIKNLLDEWNSQMNQCK

SEQ ID NO: 1375 - protein, 395 aa, Arabidopsis thaliana
  misc_feature (49)..(274): Pfam Name: Branch Pfam Description: Core-2/I-Branching enzyme
  misc_feature (1)..(395): Public GI ID no. 18409754
  misc_feature (1)..(395): Bit score of 1028.7 for HMM based on sequences of Figure 8
  misc_feature (1)..(395): Functional Homolog Of SEQ ID NO. 1366
  misc_feature (1)..(395): in Figure 8
MGAEKKWLFTLFSVVFLSVFLLLLYSISAFTSKPFPSSIRHGAHYPPAFAYYITGGRGDNDRISRLLLAVYHPRNRYLIHLGAEATDAERLALLSDLKSVPAVNAFGNVDVLGKVDRLSENGASKIASTLHAVSILLKLDPTWNWFIELSALDYPLITQDDLSHVFASVNRSLNFIDHTSDLAWKESQRIKPIVVDPALYLARRTQLFTATEKRPTPDAFKVFTGSPWIVLSRPFLEYCIFGWDNLPRILLMYFNNVILSEECYFHTVICNAPEFSNTTVNGDLRYMIWDSPPKMEPHFLTISDFDQMAQSGAAFARQFKKDDPVLDMVDREILKRGRYRVTPGAWCSSHSSWWTDPCSEWDEVNIVKAGPQAKKLDETITNFLDDLNSQSNQCK

SEQ ID NO: 1376 - DNA, 1991 bp, Glycine max
  misc_feature (1)..(1991): Ceres Clone ID no. 479516
  misc_feature (1)..(1991): Encodes the peptide sequence at SEQ ID NO. 1377
aaaaaaaattgcaatttaagaacgagctcttgtgttgtactcttgcatctgtattcttccatctttcctcgttttacactctttaaagaagtaaacacccctctctgagtctctcacctcaccaccacccacctgaacaatttccctgcacccaacacggtttcaaatatcactcccctataaaacatccttaaaaacggttaaacacccaaaaggggttttcaatttcacgcaattccttccattcccacaccaacaaaaaaaaaaaaaaaaccatcacacatattactacattataattgctatagattatgaagaaattgaagaattactacatgcacctccggcaccaccacacggcggagcgcaagtgggtgttcccactcgccatcggctccctcctctccctcttcctcctcttcctcgctaccctaacctccccggagggcacccccattctcccattctaccgctccatcaccgccgcctcctactccgtcttcgtcgaatccaagctccgccccctccccgtctccgccctccctcccccgccgcgcctcgcctacctcgtctccggctccaagggcgacggcgccgccgtcacccgcgtcctcctcgctctctaccaccccaacaatcgctacgtggtccacctcgacctcgagtcctcggcggaggagcgctccgatttggtgaggttcgtggagggccacgcgctgttcaagcggttcgggaatgtgagggttatcaagaaggcgaacctcgtcacgtacaggggacccaccatggtcgccaacacgctccacgccgccgcgatcctgcttagggagctcggggattgggactggttcatcaatctcagcgcctccgattacccacttgtcacacaggatgatctgctgcacacgttttcctacttgccgcgggatctgaatttcattgatcatacgagtgacattggatggaaagatcatcatcgtgccaggccgatcatcgttgatccggggttgtatatgaataagaagcaagatgtgttttgggttacgcagaggaggagtaggccaacggctttcaagcttttcacaggctcagcttggatggcactgtcaaaatctttcattgattactgcatatggggatgggacaacctacctcggactgtactcatgtactattcaaatttcatatcttcccctgaaggatacttccacacagttatttgcaatgctcaagagttcaggaacacaactgtgaacagtgatctacatttcatttcttgggacaatcctcccaagcagcatcctcactaccttacagttgatgacatgaaaggcatggttggcagcaatgctccctttgcaaggaaattccacagagaagatccagtgttggacaaaattgatgctgaactattatccagaggtcctggaatggctgttcccggaggttggtgcataggaaaaagggagaatggcaccgatccctgctctgaagtcggtgatcctaacgtcctgaggcctggccaaggttccaagaggcttgaaacattaatcagctcattgttgtcgaatgaaaagttccggccaaggcagtgcgtatgaggtgaagaagaagaagaatcaaatgggctaaggcagtyttytagaaaagattatttttcactggctttagtttacacgtgctcatttagttaggatgatcagtaaattagtgtttctttcaagtaggagaagaaatagtgaaagcatacagtctttgatattgagaagaaaaaaaaaagtgagacaaattctggtgaaatgtgatgactagagagttggatcacacactgtaatagtatggtatatatgacagttgactctgttgtccctggtcacctcttcccccctagcttttctgtggaacacgaaagggataaagaggatgacatgggcggggggacggacaaaagaacagaaactgtgccaaatgaaatggaaatactttttatg

SEQ ID NO: 1377 - protein, 421 aa, Glycine max
  misc_feature (75)..(300): Pfam Name: Branch Pfam Description: Core-2/I-Branching enzyme
  misc_feature (1)..(421): Ceres Clone ID no. 479516
  misc_feature (1)..(421): Bit score of 1022.7 for HMM based on sequences of Figure 8
  misc_feature (1)..(421): Functional Homolog Of SEQ ID NO. 1366
  misc_feature (1)..(421): in Figure 8
MHLRHHHTAERKWVFPLAIGSLLSLFLLFLATLTSPEGTPILPFYRSITAASYSVFVESKLRPLPVSALPPPPRLAYLVSGSKGDGAAVTRVLLALYHPNNRYVVHLDLESSAEERSDLVRFVEGHALFKRFGNVRVIKKANLVTYRGPTMVANTLHAAAILLRELGDWDWFINLSASDYPLVTQDDLLHTFSYLPRDLNFIDHTSDIGWKDHHRARPIIVDPGLYMNKKQDVFWVTQRRSRPTAFKLFTGSAWMALSKSFIDYCIWGWDNLPRTVLMYYSNFISSPEGYFHTVICNAQEFRNTTVNSDLHFISWDNPPKQHPHYLTVDDMKGMVGSNAPFARKFHREDPVLDKIDAELLSRGPGMAVPGGWCIGKRENGTDPCSEVGDPNVLRPGQGSKRLETLISSLLSNEKFRPRQCV

SEQ ID NO: 1378 - protein, 425 aa, Aegilops tauschii
  misc_feature (72)..(302): Pfam Name: Branch Pfam Description: Core-2/I-Branching enzyme
  misc_feature (1)..(425): Public GI ID no. 61656778
  misc_feature (1)..(425): Bit score of 1022.1 for HMM based on sequences of Figure 8
  misc_feature (1)..(425): Functional Homolog Of SEQ ID NO. 1366
  misc_feature (1)..(425): in Figure 8
MKPIVVHAASVDRRWLLPLAVGSALSLFLLVLLTTVPLPFFPSSSPSPALFVEHKLAPTPPASRAAGSLPRIAYVISGSARDASALRRVLLALYHPRNLYVLHLDAEAPESDRRDLAAGLAAHPVIAAAGNVRVVERANLVTYRGPTMVASTLHAAAALLWGHSGAGGSDWDWFINLSASDYPLVTQDDLIHVFSKLPRDLNFIDHTSNIGWKEFQRAKPVIIDPGLYMKKKADVFWIPQRRSVPTAFKLFTGSAWMALSRSLVEYSIWGWDNLPRTVLMYYSNFISSPEGYFHTVVCNAEEFKNTTVNHDLHYISWDNPPKQHPHYLTMDDLDRMIASDAPFARKFHADEPVLDRIDAELLSRRAGPDAPTPGGWCAGTRDNGSDPCSVVGNTSFLQPGRGAVRLQRLVTSLLSEEKFHPRQCK

SEQ ID NO: 1379 - protein, 402 aa, Oryza sativa subsp. japonica
  misc_feature (55)..(281): Pfam Name: Branch Pfam Description: Core-2/I-Branching enzyme
  misc_feature (1)..(402): Public GI ID no. 13486801
  misc_feature (1)..(402): Bit score of 963.0 for HMM based on sequences of Figure 8
  misc_feature (1)..(402): Functional Homolog Of SEQ ID NO. 1366
MGAADKWLLPLVSVSFVSLLLFLSALSGFSASSSLFARLPPPSYVRRGAAAPPSFAYVLSGGRGEGRKLLRLLLAVYHPRNRYLLHLSADAPESERVELAAAVSRAAPAVRAFGNVDVVGRPTAGTPMGSSGLAATLRAAAALLRLDSEWDWFVTLNAADYPLVTQDDLIHVFSSVPRHLNFIDHTSDIGWKETQRVQPIIVDAGIYLAGRNQFFQATEKRDTPDGFKFFTGSPWVILNRRFIEYCIFGWENLPRTLLMYFTNVMLPQEGYFHSVVCNSDFRNSTVNSDMRYMEWDDPPQMEPHFLNTTHYDEIVESGVPFARKFRENEPLLDKIDERVLHRWRHRPVPGAWCTGRKRWFNDPCSQWSNVNIVRPGPQAEKFRKHMNQIIEESASGNNSCKQ

SEQ ID NO: 1380 - DNA, 1856 bp, Zea mays
  misc_feature (1)..(1856): Ceres Clone ID no. 494392
  misc_feature (1)..(1856): Encodes the peptide sequence at SEQ ID NO. 1381
aagcaagagagaaacgcacgcgagccgcgagcagaacagagcagcgcggcgccatcccgatctcgctatttcccttctcccccgatgcgatctcgccgaaccctaatccccacgcccgacgcccggccgtcgccggagccctagccccgaatgcggcggtgacgcgcggcgtgccaccaccaccacctcagcgcccgcgcccgcgcccgcgcccgccaccgaccgtcctgcccggccgacaccagctgccatgggcgccgccgacaagtggctgctcccgctcgtctccgtctccttcgtctcgctcctgctcttcctctccgcgctctcgggcttctccgcctcctccgcactcttcgcgcgcctctcgccaccctcctacgtgcgccgaggcgccgccgcaccgccctccttcgcctacctgctcgcgggcggccggggggacggcaggaagctcctgcggctgctcctcgccgtctaccaccccaggaaccgctacctgctccacctctccgccgacgcgccggcctccgagcgcgccgagctcgccgcggccgtcgcgcgcgccgctcccgccgtgcgcgccttctcgaacgtcgatgtcgtgggcaggcccaccgcgggcaccccaatgggatcctccggcctcgccgccacgctccgtgcggccgccgcgatgctccggctggatgcggagtgggactggttcatcacgctcaacgccgccgactacccccttctcacccaggacgacttgatccatgttttctcctctgttccaaggcacctcaactttattgatcacaccagtgacattggatggaaagagtctcagagagtgcagccgattatagtagatgctggagtgtatttggcagggaggaatcagttcttccaagccacagagaaacgggacactcctgatagtttcaaatttttcacaggttctccatgggtcattttaaacagacgctttgttgagtattgtatttttggctgggagaatctccctagaacactcctcatgtacttcacaaacgtgatgctacctctcgaggggtatttccattcggttgcatgcaactcggacttccgcaatttcacagtgaacaactacttgcggtatatgatttgggacaatccacctcagatggagccccatttcctaaatgttacacattacgatgagctagtagggactggggttccttttgcccggaagtttaaggagaatgaacccttgttggacaagattgatgatcaagtgcttcgacgatggcatcagagacctgttcctggtgcgtggtgcacaggcaggaggaggtggttcagtgatccttgctcccagtggagcaacgtcaacattgtaagacctggtcctcaagctgagaagttccgaacatatataaaccagattatggaagaatcaaagtcaggcaacaactcttgcaagcaatagcggttgaagcattgagattgtctcattttgcacagaggagaggagcgaactccccatgtctcgagaacttcctggcatctggttcgggagcaagcatttttgcacctgttatatgaacacacggccaagtgacgcagtgccccttaactgcaggagtttagtgagctaatgagctgtggatgtgaacaatggcaaattggcagtacagcatccctacacttcgtaggatctgtttgcatgaattgtgtggccttcaatggtatccctgctccagtgtagtccagtgtggaaggctactgtatccatgtcgaaacatgctaggttacaatggattaaaatgtgcagtaccagtagcgtttgatgcagcaatctatatatgaattgcaatggattctgc

SEQ ID NO: 1381 - protein, 402 aa, Zea mays
  misc_feature (55)..(281): Pfam Name: Branch Pfam Description: Core-2/I-Branching enzyme
  misc_feature (1)..(402): Ceres Clone ID no. 494392
  misc_feature (1)..(402): Bit score of 953.4 for HMM based on sequences of Figure 8
  misc_feature (1)..(402): Functional Homolog Of SEQ ID NO. 1366
MGAADKWLLPLVSVSFVSLLLFLSALSGFSASSALFARLSPPSYVRRGAAAPPSFAYLLAGGRGDGRKLLRLLLAVYHPRNRYLLHLSADAPASERAELAAAVARAAPAVRAFSNVDVVGRPTAGTPMGSSGLAATLRAAAAMLRLDAEWDWFITLNAADYPLLTQDDLIHVFSSVPRHLNFIDHTSDIGWKESQRVQPIIVDAGVYLAGRNQFFQATEKRDTPDSFKFFTGSPWVILNRRFVEYCIFGWENLPRTLLMYFTNVMLPLEGYFHSVACNSDFRNFTVNNYLRYMIWDNPPQMEPHFLNVTHYDELVGTGVPFARKFKENEPLLDKIDDQVLRRWHQRPVPGAWCTGRRRWFSDPCSQWSNVNIVRPGPQAEKFRTYINQIMEESKSGNNSCKQ

SEQ ID NO: 1382 - DNA, 1191 bp, Sorghum bicolor
  misc_feature (1)..(1191): Ceres Annot ID no. 8659030
  misc_feature (1)..(1191): Encodes the peptide sequence at SEQ ID NO. 1383
atgggcgccgccgacaagtggctgctcccgctcgtctccgtctccttcgtctcgctcctgctcttcctctccgcgctctcgggcttctccgcctcgtccgcgctcttcgcgcgcctcccgccgccctcctacgtgcgccggggcgccgccgcgccgccttccttcgcgtacctgctcgcgggggggcgaggcgacggcaggaagctcctgcggctgctcctcgccgtctaccaccccaggaaccgctacctgctccacctctccgccgacgcgccggcctccgagcgcgccgagctcgccgcggccgtcgcgcgcgccgcacccgccgtgcgcgccttcggaaatgtcgatgtcgtgggcaggcccaccgcgggcaccccaatgggctcctccggcctcgccgccacgctgcgtgcggccgccgcgatgctccggctcgatgcggagtgggactggttcgtcacgctcaacgccgccgactacccccttctcacccaggacgacttgattcatgttttctcctctgttccaaggcacctcaactttattgatcacacgagtgacattggatggaaagagtctcagagagtgcaaccgattatagtagatgctggagtatacttggcagggaggaatcagttcttccaagccacagagaaacgggacactcctgatggttctccatgggtcattttaaacagacgctttgtggagtattgtgtttttggttgggagaatctccctagaacactcctcatgtacttcacaaatgtgatgctacctctagaggggtatttccattcggttgcatgcaactcagacttccgcaatttcacggtgaacaatgacttgcggtatgtggtgtgggacgatccacctcagatggaaccccattccctaaatgttacacattatgatgagctagtagggagtggggttccttttgcccggaagtttaaggagaatgaaccactattggacaagattgatgataaagtgctacgacgttggcgccacagacctgttcctggtgcatggtgcacaggtaggaggaggtggttcagtgatccttgctcccagtggagcaatgtcaacattgtaagacctggtcctcaagctgagaagttccgaacatatatgaaccggattctggaagaatcaaagtcaagcaacaactcttgcaagcaatag

SEQ ID NO: 1383 - protein, 396 aa, Sorghum bicolor
  misc_feature (55)..(275): Pfam Name: Branch Pfam Description: Core-2/I-Branching enzyme
  misc_feature (1)..(396): Ceres Annot ID no. 8659030
  misc_feature (1)..(396): Bit score of 924.2 for HMM based on sequences of Figure 8
  misc_feature (1)..(396): Functional Homolog Of SEQ ID NO. 1366
MGAADKWLLPLVSVSFVSLLLFLSALSGFSASSALFARLPPPSYVRRGAAAPPSFAYLLAGGRGDGRKLLRLLLAVYHPRNRYLLHLSADAPASERAELAAAVARAAPAVRAFGNVDVVGRPTAGTPMGSSGLAATLRAAAAMLRLDAEWDWFVTLNAADYPLLTQDDLIHVFSSVPRHLNFIDHTSDIGWKESQRVQPIIVDAGVYLAGRNQFFQATEKRDTPDGSPWVILNRRFVEYCVFGWENLPRTLLMYFTNVMLPLEGYFHSVACNSDFRNFTVNNDLRYVVWDDPPQMEPHSLNVTHYDELVGSGVPFARKFKENEPLLDKIDDKVLRRWRHRPVPGAWCTGRRRWFSDPCSQWSNVNIVRPGPQAEKFRTYMNRILEESKSSNNSCKQ

SEQ ID NO: 1384 - protein, 412 aa, Physcomitrella patens subsp. patens
  misc_feature (67)..(292): Pfam Name: Branch Pfam Description: Core-2/I-Branching enzyme
  misc_feature (1)..(412): Public GI ID no. 168060848
  misc_feature (1)..(412): Bit score of 771.6 for HMM based on sequences of Figure 8
  misc_feature (1)..(412): Functional Homolog Of SEQ ID NO. 1366
MERKWLSPLLASTMISILLLLLATLNLGYRGHHPSIGTNRMDPSRAQNVQEITEEEQMAGLPPPPKLAYLISGTKGDGFRMQRTLQALYHPHNYYLLHLDLEAPEKERMDLAVYVKHEPVFQEAGNVFVVGKANLVTYKGSTMIATTLHGAAILLRKAKDWDWFINLSASDYPLITQDDLLHVFSYLPKDLNFIEHTSDIGWKEEQRVKPIIIDPGLYQKTKTDIYWMTQRRAVPSAFRLFTGSAWVVLSRSFIEYTIMGWENLPRTVLMYYANFVSSPEGYFHTVLCNSQEFRNTTVNHDLHFIAWDTPPKQHPLSLTVKFFKDMSNSGAPFARKFNKDDPVLDKIDAELLHRKKHGFSPGGWCVGPDDNPCSVRGDYSLLKPGPGARRFEDLVVRLLLPENFRSRQCVGV

SEQ ID NO: 1385 - DNA, 1644 bp, Triticum aestivum
  misc_feature (1)..(1644): Ceres Clone ID no. 794127
  misc_feature (1)..(1644): Encodes the peptide sequence at SEQ ID NO. 1386
atccaattccaaaaccacgcactagtcgacgacggccacctcgccgccgccgtaacgcgcacggtctcaccttaccactcattaccgcgcttccagttccgtacgcctcatgccgccggccgcgcgggtcaaacctcccaaaacatgaaactcggtgcaatggggtcgtgccgcttgcccccggccatcgcggccgccgcgctggccgcggctgcgctgctggtgctcttccgcgcctccccgtacgggctcgcctacccccgcgcgggcgtccagccagggccgccgctcgtggcgaggggtcccgggagcccgccctccttcgcgtactggatatccggcacgggcggagagggccgcagggtcctcaggctgctcagggcggtgtatcacccgaggaaccggtacctgctgcacctggacgcgggggcgtcgcgggacgagcggacggagctggccgccgctgcgcgggacgaggcggcgtggagggagttctcaaacgtcgacgtggtaggggagagctacgcggtagacaggacgggctcctcggtgctcgccgcggcgctgcacggcgccgccgtgctgctcaggattggggctgactgggactggttcgtcacgctcagctcctgggactatcctctcgtcacgcaggacgatctcttttatgcattttcttctgtaccaaggcacctcaactttattgatcacacaagtaacctcggatggaaagagcatgaaaggtttgaaaaacttattgtcgacgcaagtctatatatggacaagaatacccagccctttcctgcgacagaaacaagacaaatgcctgaggcattcaagatattcacaggctctccatgggtaattctgagtaggaacttcactgaacattgcgtgcatggctgggacaacctcccccgcaggctactgatgtactttgccaacgctgcttactccatggaatcatatttccagactgtcatatgcagttcatctgactttagaaacaccactgtcaacggcgatctacgtttctttgtttgggacgatcctcctgggctggagccgcgtattcttgatgaaacgcatctcgataacatggtgaacagcagcgctgccttcgcaaggcggtttgtggaggaagcaccagtgctgaagaaggttgatgatgagctactgaaccgttcttcggcccagttggttcctggtgtgtggtgccggaatttgggtgaaaagcaaggaggcggggatgtggaggcgtgctcggaatggggcgacattaacgttgtcaggcctgggcgtgctggagagcggttgaggcgcttcatatctgagatcattcatataagaggatgcacggtcgcagcagctagctgaaagccgaacccaccacaagtctggaattctttgtcaagagagcagttaaacaaagaatttaaggaacacattcttcgctgcaggtaaagcacgcgttgctgcagtcgacagttctaccaggctgcataataccactgacgctccttctacacaaactaggtacaagtattttcgaacgaagggaactgtataaagctgtaactgatttgccctttttttaaccatatggataggacatagaataggttacactgcagtagttacagt

SEQ ID NO: 1386 - protein, 410 aa, Triticum aestivum
  misc_feature (60)..(285): Pfam Name: Branch Pfam Description: Core-2/I-Branching enzyme
  misc_feature (1)..(410): Ceres Clone ID no. 794127
  misc_feature (1)..(410): Bit score of 614.8 for HMM based on sequences of Figure 8
  misc_feature (1)..(410): Functional Homolog Of SEQ ID NO. 1366
MKLGAMGSCRLPPAIAAAALAAAALLVLFRASPYGLAYPRAGVQPGPPLVARGPGSPPSFAYWISGTGGEGRRVLRLLRAVYHPRNRYLLHLDAGASRDERTELAAAARDEAAWREFSNVDVVGESYAVDRTGSSVLAAALHGAAVLLRIGADWDWFVTLSSWDYPLVTQDDLFYAFSSVPRHLNFIDHTSNLGWKEHERFEKLIVDASLYMDKNTQPFPATETRQMPEAFKIFTGSPWVILSRNFTEHCVHGWDNLPRRLLMYFANAAYSMESYFQTVICSSSDFRNTTVNGDLRFFVWDDPPGLEPRILDETHLDNMVNSSAAFARRFVEEAPVLKKVDDELLNRSSAQLVPGVWCRNLGEKQGGGDVEACSEWGDINVVRPGRAGERLRRFISEIIHIRGCTVAAAS

SEQ ID NO: 1387 - DNA, 1278 bp, Sorghum bicolor
  misc_feature (1)..(1278): Ceres Annot ID no. 8724191
  misc_feature (1)..(1278): Encodes the peptide sequence at SEQ ID NO. 1388
atgaagcccctcgcgcactccctccacgcggccgtcgaccgccgttggctactccctctggccatcggctccgcgctctcgctcctcctcctcgtcgcgctcaccaccttcccctcgcccttcccctccacctccacgccctcctcctcctcgtcgctcttcgtggagcacaagctcgcccccaccccgccgtcccccgccgccggctcaccgccccgcatcgccttcctcatctccggatccgcgggggacgcctccgcgctccgccgcgtcctcctcgcgctctaccaccccaggaaccgctacatcttgcacctcgatgccgaggcgcccgactccgaccgcaccagcctcgccgccgacctcgcctcccaccccgccatcgccgccgccgccaacgtccgcgtcgtcgaccgtgctaacctcgtcacgtaccgtggacccaccatggtcgccaacacgctccacgccgccgccgccttcttgtggggtcacgccggcgacggcggctcacaatgggattggttcatcaacctctccgcctccgattacccgctcgtcacgcaggatgatctgatacatgtattctccaagctgccgcgtgatctcaacttcatcgaccacaccagcgacattggatggaaggagttccagagggcgaagccggtcatcattgatccagggctctacatgaagaagaaggccgacgtgttctggataccgcagaggcggagcgtccctacagcattcaagctattcactggttctgcttggatggcactgtcgaggccctttgtcgaatactgcatatggggctgggataacctacctcgcacagtgctcatgtactattccaatttcatctcctcgcctgaaggatacttccacactgtggtctgcaacgccgatgaattcaagaacacgaccgtgaaccatgacctgcattacatctcatgggacaaccctccaaaacagcacccgcactacctgacggttgaagacttggaccgcatggttgccagtgacgcgccatttgctcggaagttccacgaggatgatctggtgctggacaagatagatgaggagatcctgggtcgtggcgtggacatgccgactcctggaggctggtgtgctggaacgcgggagaacgggagcgacccttgcacgatgattggaaacaccagcctcctccagcctggccgtggagctgtgcgactgcagcggctgatcacgttgttgctgtcggaggagaagttccacccaaggcagtgcaagtag

SEQ ID NO: 1388 - protein, 425 aa, Sorghum bicolor
  misc_feature (74)..(304): Pfam Name: Branch Pfam Description: Core-2/I-Branching enzyme
  misc_feature (1)..(425): Ceres Annot ID no. 8724191
  misc_feature (1)..(425): Bit score of 958.4 for HMM based on sequences of Figure 8
  misc_feature (1)..(425): Functional Homolog Of SEQ ID NO. 1366
MKPLAHSLHAAVDRRWLLPLAIGSALSLLLLVALTTFPSPFPSTSTPSSSSSLFVEHKLAPTPPSPAAGSPPRIAFLISGSAGDASALRRVLLALYHPRNRYILHLDAEAPDSDRTSLAADLASHPAIAAAANVRVVDRANLVTYRGPTMVANTLHAAAAFLWGHAGDGGSQWDWFINLSASDYPLVTQDDLIHVFSKLPRDLNFIDHTSDIGWKEFQRAKPVIIDPGLYMKKKADVFWIPQRRSVPTAFKLFTGSAWMALSRPFVEYCIWGWDNLPRTVLMYYSNFISSPEGYFHTVVCNADEFKNTTVNHDLHYISWDNPPKQHPHYLTVEDLDRMVASDAPFARKFHEDDLVLDKIDEEILGRGVDMPTPGGWCAGTRENGSDPCTMIGNTSLLQPGRGAVRLQRLITLLLSEEKFHPRQCK

SEQ ID NO: 1389 - protein, 447 aa, Arabidopsis thaliana
  misc_feature (101)..(326): Pfam Name: Branch Pfam Description: Core-2/I-Branching enzyme
  misc_feature (1)..(447): Public GI ID no. 15242532
  misc_feature (1)..(447): Bit score of 878.5 for HMM based on sequences of Figure 8
  misc_feature (1)..(447): Functional Homolog Of SEQ ID NO. 1366
MKKLRSYYSNVRHHQNHHHHHHHHSNIVSSERKWIFFPLLIGSIFALFLLFLTTTLTSPTGGVRFLPFTRPVLLTGSGSSAFVESKIKPQQISSLPSPPRFAYLISGSAGDGKSLRRTLLALYHPNNRYVVHLDRESSREEREELHGYIKNSSLFRRFMNVHMIEKANLVTYRGPTMVANTLHAAAILLREGADWDWFINLSSSDYPLVTQDDLLHIFSHLPRDLNFIDHTSNIGWKASQRAKPVIIDPGLYLNKKSDVFWVTQRRSIPTAFKLFTGSAWMALSRPFVDYCIWGWDNLPRTVLMYYSNFLSSPEGYFHTVLCNAEEFRNTTVNSDLHFISWDNPPKQHPHHLTLTDMTKMVNSNAPFARKFRREDPVLDKIDDELLNRGPGMITPGGWCIGSHENGSDPCAVIGDTDVIRPGPGARRLENLVTSLLSTENFRSKQCK

SEQ ID NO: 1390 - protein, 428 aa, Vitis vinifera
  misc_feature (82)..(307): Pfam Name: Branch Pfam Description: Core-2/I-Branching enzyme
  misc_feature (1)..(428): Public GI ID no. 225452656
  misc_feature (1)..(428): Bit score of 903.4 for HMM based on sequences of Figure 8
  misc_feature (1)..(428): Functional Homolog Of SEQ ID NO. 1366
MKRLKSYYLHLRQPQTMKRKWIFPLAIGTVVSLFLLFLTTLTSPEGVPLFPFYRSATARASVFVESKLHPISTSSIPPPPRFAYLISGSTGDGDMLKRTLQALYHPRNSYVVHLDLESSPEERLDLQNYVKSQPLFAKFGNVRMITKANLVTYRGPTMVANTLHAAAILLREGGDWDWFINLSASDYPLVTQDDLLHAFSYLPRDLNFLDHTSNIGWKEYQRAKPIIIDPGLYMTKKADVFWVTQRRSVPTAFKLFTGSAWMALSRPFVDYCIWGWDNLPRTVLMYYANFLSSPEGYFHTVMCNAQEFRNTTVNHDLHFISWDNPPKQHPHILTIADMPRMIESNAPFARKFRHDDPVLDKIDANLLGRGQDMFVPGGWCIGSRKNGSDPCSVVGNSTILRPGPGAKRLENLISSLLSQENFRPRQCK

SEQ ID NO: 1391 - DNA, 1608 bp, Arabidopsis thaliana
  misc_feature (1)..(1608): Ceres Clone ID no. 25053
  misc_feature (1)..(1608): Encodes the peptide sequence at SEQ ID NO. 1392
aacaaacaaacaaaaacacaccaattccttcattcatcttctccatttcgtaattcgtacacttcactctcaagtctctctaagccacaaaccactgaagaagaatccatctaagagctgttaaaaattgatgaagcttcgaatatgaagaaattgaaaagctattacatgcaagttcgtaaccagcaacaatctcttgaccgaaaatggattcttccattagcaatcggatccatttgttctctgtttctcttgttgctaacgaacttagcttcttcttctggtcaaactcgtttgattccattttcagtttacggatttagatcctccgtcttcgtcgaatccaagataaatccagtatccgtctcactcaccgtctccgtctctcctcctccgccgccacgtctcgcttatctaatctccggctcctctggtgacggtcagatgctgaaacgaactctaatggcgctttatcatcccaacaaccagtacgttgttcatctcgatcgggaatcttcaccggaggaacgattggatctcagtggttttgtggcgaatcatactctgtttcagagatttcaaaatgttcggatgattgttaaggctaatttcgttacgtatcgtggtccaactatggtggctaatacacttcacgctgcagcgattttgcttcgtgaaggtggtgattgggattggttcatcaatctcagtgcctctgattatcctctcgtaacacaagatgatctgttgcatacgttttcgtatcttcctcgagatctcaatttcatcgatcatacaagcaacattggctggaaagagtctcatagagcaaagcctataattattgatcctggtttgtatatgtcaaagaaagctgatgttttctgggtttcacagaagagaagtatgcctacagctttcaaactcttcacaggatctgcgtggatgatgttatctagaccttttgtggattatttcatatggggatgggataatcttcctcgaattgtgttaatgtattacgcaaacttcctttcatcgccagaaggttacttccacactgtgatttgcaatgctcgagagtttaccaacacaacggttaacagtgacttacatttcatctcatgggacaatcctccaaagcaacatcctcaccatcttacattagatgatttccagagaatggtggacagtaacgctccttttgctaggaaattccgtagagatgagcctgttctcgataagattgattcggaactattgtttcggagtcacgggatggtcactccgggtggttggtgtattggtacgagggaaaacgggagcgatccgtgtgcggtgattggtgatacgtcggttattaaacctggtcttggagctaaacggatcgagaaactcataacttatttgttatctactgagaatttcagaccacggcaatgccggtaatggcaaattagagttttgtcatagagatggttacgtggtttttcacacaaatgaactgtattgattatccgatactttgatatggttgtatagagatctttttggactttcttcatttgagaaagtgcagaaatttcgggaaagatcattgattattgc

SEQ ID NO: 1392 - protein, 434 aa, Arabidopsis thaliana
  misc_feature (88)..(313): Pfam Name: Branch Pfam Description: Core-2/I-Branching enzyme
  misc_feature (1)..(434): Ceres Clone ID no. 25053
  misc_feature (1)..(434): Bit score of 862.6 for HMM based on sequences of Figure 8
  misc_feature (1)..(434): Functional Homolog Of SEQ ID NO. 1366
MKKLKSYYMQVRNQQQSLDRKWILPLAIGSICSLFLLLLTNLASSSGQTRLIPFSVYGFRSSVFVESKINPVSVSLTVSVSPPPPPRLAYLISGSSGDGQMLKRTLMALYHPNNQYVVHLDRESSPEERLDLSGFVANHTLFQRFQNVRMIVKANFVTYRGPTMVANTLHAAAILLREGGDWDWFINLSASDYPLVTQDDLLHTFSYLPRDLNFIDHTSNIGWKESHRAKPIIIDPGLYMSKKADVFWVSQKRSMPTAFKLFTGSAWMMLSRPFVDYFIWGWDNLPRIVLMYYANFLSSPEGYFHTVICNAREFTNTTVNSDLHFISWDNPPKQHPHHLTLDDFQRMVDSNAPFARKFRRDEPVLDKIDSELLFRSHGMVTPGGWCIGTRENGSDPCAVIGDTSVIKPGLGAKRIEKLITYLLSTENFRPRQCR

SEQ ID NO: 1393 - protein, 426 aa, Oryza sativa subsp. japonica
  misc_feature (76)..(305): Pfam Name: Branch Pfam Description: Core-2/I-Branching enzyme
  misc_feature (1)..(426): Public GI ID no. 115489808
  misc_feature (1)..(426): Bit score of 924.3 for HMM based on sequences of Figure 8
  misc_feature (1)..(426): Functional Homolog Of SEQ ID NO. 1366
MKPTTGTAAAAAVDRRWLLPLAIGSALSLLLLVLLTTFPLPFPFPSSAASRPPNPTLFVEHKLAPSPPSTASPPRFAYLISGSAGDAAALRRVLLALYHPRNLYILHLDAEAPDSDRANLAADLADHPVIAAAANVHVIQRANLVTYRGPTMVANTLHAAAAFLYTNQHPHLEWDWFINLSASDYPLLTQDDLIHVFSKLPRGLNFIDHTSNIGWKEYQRAKPVIIDPGLYMKKKADVFWIPQRRSVPTAFKLFTGSAWMALSKPFVEYCIWGWDNLPRTVLMYYANFISSPEGYFHTVVCNAEEFKNTTVNHDLHYISWDNPPKQHPHYLTIEDLDRMVASDAPFARKFHADDPVLDKIDAEILLRGPDMLTPGGWCGGTRENGSDPCSVIGNTTHLQPGRGAVRLQRLMTSLLSEEKFHPRQCK

SEQ ID NO: 1394 - protein, 425 aa, Triticum monococcum
  misc_feature (72)..(302): Pfam Name: Branch Pfam Description: Core-2/I-Branching enzyme
  misc_feature (1)..(425): Public GI ID no. 46358506
  misc_feature (1)..(425): Bit score of 1008.5 for HMM based on sequences of Figure 8
  misc_feature (1)..(425): Functional Homolog Of SEQ ID NO. 1366
MKPIVVHAAAVDRRWLLPLAVGSALSLFLLVLLTTVPFPFFPSSSPSPALFVEHKLAPTPPASRAAGSLPRIAYVISGSAKDASALRRVLLALYHPRNLYVLHLDAEAPESDRRDLAAGLAAHPVIAAAGNVRVVERANLVTYRGPTMVASTLHAAAALLWGHSGAGGSDWDWFINLSASDYPLVTQDDLIHVFSKLPRDLNFIDHTSNIGWKEFQRAKPVIIDPGLYMKKKADVFWIPQRRSVPTAFKLFTGSAWMALSRSLVEYSIWGWDNLPRTVLMYYSNFISSPEGYFHTVVCNAEEFKNTTVNHDLHYISWDNPPKQHPHYLTMDDLDRMIASDAPFARKFHADEPVLDRIDAELLSRHAGPDAPTPGGWCAGTGDNGSDPCSVVGNTSFLQPGRGAVRLQRLVTSLLSDEKFHPRQCK

SEQ ID NO: 1395 - protein, 425 aa, Hordeum vulgare subsp. vulgare
  misc_feature (72)..(302): Pfam Name: Branch Pfam Description: Core-2/I-Branching enzyme
  misc_feature (1)..(425): Public GI ID no. 55276719
  misc_feature (1)..(425): Bit score of 1002.3 for HMM based on sequences of Figure 8
  misc_feature (1)..(425): Functional Homolog Of SEQ ID NO. 1366
MKPIVVHAAAVDRRWLLPLAVGSALSLFILVLLTTVPFPFVPSSTPSPALFVEHKLAPTPPASRVAGSLPRIAYVISGSARDAAALRRVLLALYHPRNLYVLHLDAEAPEADRRELAAGLAAHPVIAAAGNVRVVERANLVTYRGPTMVASTLHAAAALLWGHSGAGGSDWDWFINLSASDYPLVTQDDLIHVFSKLPRDLNFIDHTSNIGWKEFQRAKPVIIDPGLYMKKKADVFWIPQRRSVPTAFKLFTGSAWMALSRSLVEYSIWGWDNLPRTVLMYYSNFISSPEGYFHTVVCNAEEFKNTTVNHDLHYIAWDNPPKQHPHYLTMDDLDRMIASDAPFARKFHADEPVLDRIDEELLSRRAGPDAPTPGGWCAGTGDNGSDPCSVIGNTSFLQPGRGAVRLQRLVTSLLSEEKFHPRQCK

SEQ ID NO: 1396 - protein, 425 aa, Triticum aestivum
  misc_feature (72)..(302): Pfam Name: Branch Pfam Description: Core-2/I-Branching enzyme
  misc_feature (1)..(425): Public GI ID no. 61656789
  misc_feature (1)..(425): Bit score of 1007.4 for HMM based on sequences of Figure 8
  misc_feature (1)..(425): Functional Homolog Of SEQ ID NO. 1366
MKPIVVHAAAVDRRWLLPLAVGSALSLFLLVLLTTVPLPFFPSSSPSPALFVEHKLAPTPPASRAAGSLPRIAYVISGSARDAAALRRVLLALYHPRHLYVLHLDAEAPESDRRGLAAGLAAHPVIAAAGNVRVVERANLVTYRGPTMVASTLHAAAALLWGHSGAGGSDWDWFINLSASDYPLVTQDDLIHVFSKLPRDLNFIDHTSNIGWKEFQRAKPVIIDPGLYMKKKADVFWIPQRRSVPTAFKLFTGSAWMALSRSLVEYSIWGWDNLPRTVLMYYSNFISSPEGYFHTVVCNAEEFKNTTVNHDLHYISWDNPPKQHPHYLTMDDLDRMIASDAPFARKFHADEPVLDRIDAELLSRRAGPDAPTPGGWCAGTGDNGSDPCSVVGNTSFLQPGRGAVRLQRLVTSLLSEEKFHPRQCK

SEQ ID NO: 1397 - protein, 425 aa, Triticum turgidum
  misc_feature (72)..(302): Pfam Name: Branch Pfam Description: Core-2/I-Branching enzyme
  misc_feature (1)..(425): Public GI ID no. 61656799
  misc_feature (1)..(425): Bit score of 1003.9 for HMM based on sequences of Figure 8
  misc_feature (1)..(425): Functional Homolog Of SEQ ID NO. 1366
MKPIVVHAAAVDRRWLLPLAVGSALSLFLLVLLTTVPFPFFPSSSPSPALFVEHKLAPTPPASRAAGSLPRIAYVISGSAKDASALRRVLLALYHPRNLYVLHLDAEAPESDRRDLAAGLAAHPVIAAAGNVRVVERANLVTYRGPTMVASTLHAAAALLWGHSGAGGSDWDWFINLSASDYPLVTQDDLIHVFSKLPRDLNFIDHTSNIGWKEFQRAKPVIIDPGLYMKKKADVFWIPQRRSVPTAFKLFTGSAWMALSRSLVEYSIWGWDNLPRTVLMYYSNFISSPEGYFHTVVCNAEEFKNTTVNHDLHYISWDNPPKQHPHYLTMDDLDRMIASDAPFARKFYADEPVLDRIDAELLSRHAGPDAPTPGGWCAGTGDNGSDPCSVVGNTSFLQPGRGAVRLQRLVTSLLSDEKFHPRQCK

SEQ ID NO: 1398 - DNA, 1918 bp, Panicum virgatum
  misc_feature (1)..(1918): Ceres Clone ID no. 1857630
  misc_feature (1)..(1918): Encodes the peptide sequence at SEQ ID NO. 1399
aaaccaccggcttctcgtcgcggtcgtcgccttcgcggcgcttccacgcacgcgccacgacgactcgtccacggtctacccggccggcgttcggcgccgcacgcagcgctccccttccgccgcgtgccgccacagccgatcgagcaagctagctgggcacctggcccagccacagcccgttccggccggcgttccccgccccggcaaagccacagctgcacagatagcaacccagcagcgccggtatgcggccgcgccggctgcccccgtgcctggcagtgacggcggtttcagcggcgctgctgttcgtgctcctgctgctctgcgcctcctcctccccgcccctcttcgcctggcggtcctccgccgcgtcccgccccgcgccgccgccgccgccgccgcgggcggagtgggggcccggccgcccgccctccttcgcgtactggatctccggcacgggcggggacgcgcgccgcgtgctgcgccttctccgggcggtctaccacccgcgcaaccgctacctgctgcacctcgacgccggggcggccgccggggagcgggaggcgctggcgcaagcggtcaggtgggacgagcccgcgtggagggagttccggaacgtcgacgtcgtgggggaaggctacgcggtcgaccggaccgggtcgtcggcgctcgccgccgtgctgcacggggcggcggtcctgctcaggatcggggcccactgggactggctcgtcacgctcagcgcagaggactacccgctcgtcacgcaggacgatctcctttatgccttttcttctgtgccaagggacctcaactttattgatcacacaagtgagcttggatggaaaaggcatgaaagatttgaaaagattattgttgacccaagtctatatatggacagaaacactgaacctttcccttcaaaagaaataagacaaatacctgatgcattccagatattcacaggttctccttgggtaattctgagcaggaactttgctgaacactgtgtgcatggttgggacaacctaccccgcaaactactgatgtactttgccaacacagcttattccatggagtcgtacttccagactctcatctgcaactcttccgacttccggaacacaactgtcaatggcgatctaaggtactttgtctgggatgaccctccaggcctcgatccacttgttctcaatgaatcacactttgagaacatgttgaacagcagctctgcctttgcaaggcggtttgaggaggacacaccaatgctgaagaagatggatgatgaactactaaaccggtctcctgtccagttggttccaggggtatggtgtctgaacttgggcaaagaacagaacgggactgatgcggattcgtgctcaaaatggggtgatatcaatactgtcagacctggacgtgggggggagcggctcaggcagttcatttctgagatcagtcaggcaagagggtgccgctagctgaatcagtattggtgtctattgttcaggaggtaaagtttcaggtagagttttgtggagcaaatatcggctggagtgaggtacgtgatggaattacaatgatacggatttctcctacgcgttgaagaaaacagaaggcacatggagtcatatggaaatggccaaaaagtttcagattcaggtgatgggcaccggatactgcattgtccaaatattcaaggctgcatagtaagagcagtagtagtgtttatacagattaggtatactgtatactatccgtagctgctttgccctgtttttgatcgtgtaggtaggacacagaaataggatctgctcatataccttgtagcagcacctttgtatagatgatacattgagataactatacacgtctgtattatattgatactgataatacagctcttgggtgtgctcgtctc

SEQ ID NO: 1399 - protein, 410 aa, Panicum virgatum
  misc_feature (64)..(290): Pfam Name: Branch Pfam Description: Core-2/I-Branching enzyme
  misc_feature (1)..(410): Ceres Clone ID no. 1857630
  misc_feature (1)..(410): Bit score of 609.5 for HMM based on sequences of Figure 8
  misc_feature (1)..(410): Functional Homolog Of SEQ ID NO. 1366
MRPRRLPPCLAVTAVSAALLFVLLLLCASSSPPLFAWRSSAASRPAPPPPPPRAEWGPGRPPSFAYWISGTGGDARRVLRLLRAVYHPRNRYLLHLDAGAAAGEREALAQAVRWDEPAWREFRNVDVVGEGYAVDRTGSSALAAVLHGAAVLLRIGAHWDWLVTLSAEDYPLVTQDDLLYAFSSVPRDLNFIDHTSELGWKRHERFEKIIVDPSLYMDRNTEPFPSKEIRQIPDAFQIFTGSPWVILSRNFAEHCVHGWDNLPRKLLMYFANTAYSMESYFQTLICNSSDFRNTTVNGDLRYFVWDDPPGLDPLVLNESHFENMLNSSSAFARRFEEDTPMLKKMDDELLNRSPVQLVPGVWCLNLGKEQNGTDADSCSKWGDINTVRPGRGGERLRQFISEISQARGCR

SEQ ID NO: 1400 - protein, 389 aa, Physcomitrella patens subsp. patens
  misc_feature (43)..(268): Pfam Name: Branch Pfam Description: Core-2/I-Branching enzyme
  misc_feature (1)..(389): Public GI ID no. 168052705
  misc_feature (1)..(389): Bit score of 743.2 for HMM based on sequences of Figure 8
  misc_feature (1)..(389): Functional Homolog Of SEQ ID NO. 1366
MERKWRIPLFASIFISFVLLLVAGTKDSLVGQSVVTLPAPPRLAYLISGNKGDGMRIRRTLQALYHPRNYYVLHLDLEAPPKERVELARYVRSDPVFQQTKNVIMIVKANLVTYRGPTMVSTTLHGAAILLKNFQDWDWFINLSASDYPLATQDDILHVFSFLPRDLNFIEHTSNIGWKEFQRAKPIIIDPGLHMNRKSDIFWATQRRALPTAYRLFTGSAWAVLSRSFMEFTIMGWDNLPRILLMYYTNFVSSPEGYFHTVICNSQEFRNTTVNHDLHYIAWDNPPKQHPLALSMRDFQNMTSSGAPFARKFNREDPVLTFIDKQLLGRSPGKFTPGGWCIGGVGDDPCTMIGDTSVLRPGPGARRLQGLIERLLAKPRFRSEQCILT

SEQ ID NO: 1401 - DNA, 1783 bp, Arabidopsis thaliana
  misc_feature (1)..(1783): Ceres Clone ID no. 105097
  misc_feature (1)..(1783): Encodes the peptide sequence at SEQ ID NO. 1402
cttcaatctctcgtctcttactaacgttatttcttcaatctcattgatcaaaaaaaccaaaaccctaatctcaatttcctccaaaagtttcagtttttaaaaatgggttttcttcttttgtaacgaaaaatgtgtcaaactttgaattgaccatttttttttataaggattcgatgaagaaattgagaagctattactcaaatgtgagacatcatcagaatcaccatcatcatcaccatcatcatagcaacattgtttcttcagagaggaaatggatatttttccctctattgattggttcaatcttcgctttgttcttactcttcctcacaacaaccctaacttcaccaaccggaggagtccggtttctcccttttacccgacccgytttgttaaccggatctggtycatcagctttcgytgamtccaaaaycaamcctcaacaaatctcatcactcccgtcgccacygcgttttgcttacttgatttctggatccgccggtgacgggaaatctctccggcgaactcttttggctctttaccatccgaataatcggtatgttgttcatttagatagagaatcttccatggaagagagagaggagcttcatggatatatcaaaaactcgtctttgtttcgaaggtttatgaatgttcatatgattgagaaagctaatcttgtcacgtatcgtggacctactatggttgccaatacacttcacgctgcggcgattttgcttagagaaggagctgattgggattggtttattaatcttagctcttctgattatcctctagtgactcatgatgatttgttgcatatcttttcgcatttgccgcgggatttgaacttcattgatcatactagtaacattggatggaaagcatcacaaagagcaaaaccggtgattatagatcctggactgtatttgaacaagaaatctgatgttttttgggttacgcaaagacggagcatcccaacagcattcaagcttttcacaggctctgcttggatggcgttatctcggccattcgtcgactattgtatatggggttgggataatctacctcgtacggtcttaatgtattactcgaattttctctcttctccagaaggatattttcacactgttctctgcaacgctgaggaattcagaaacacaacggtaaatagcaacctgcacttcatatcgtgggacaatccgcctaagcagcatccacaccatctcactcttasagacakgaccaaaatggtaaatagcaatgccccgtttgctagaaagttcagaagagaagatcctgtccttgacaagatcgatgatgagctccttaacagaggtcctgggatgataacacctggcggttggtgcattggaagccatgagaatgggagtgacccttgtgctgttattggtgatactgatgttatcaggcctggtccaggcgctagacggctcgagaatctggtamttcgttattatccactgagaatttccgatcaaaacagtgtaagtgatctgatatatctagagaacgacatcacacagagatggaatgtagcagccttgattattggggttagatgtgatttaggatctgatagaaatccctcttttagtcaagaatataagtgaagaaatacagaacaattaggctatatgatgtgggaagtatttgtcttgttgctccacacaacatgccttaaggtcttgttgtagttctcagattggaattttgagattttgtactctgctgttttaaaattagtttcttcctttcaacc

SEQ ID NO: 1402 - protein, 486 aa, Arabidopsis thaliana
  misc_feature (101)..(326): Pfam Name: Branch Pfam Description: Core-2/I-Branching enzyme
  misc_feature (1)..(486): Ceres Clone ID no. 105097
  misc_feature (1)..(486): Bit score of 811.7 for HMM based on sequences of Figure 8
  misc_feature (1)..(486): Functional Homolog Of SEQ ID NO. 1366
  misc_feature (72)..(72): Xaa is any aa, unknown, or other
  misc_feature (79)..(79): Xaa is any aa, unknown, or other
  misc_feature (83)..(83): Xaa is any aa, unknown, or other
  misc_feature (84)..(84): Xaa is any aa, unknown, or other
  misc_feature (87)..(87): Xaa is any aa, unknown, or other
  misc_feature (88)..(88): Xaa is any aa, unknown, or other
  misc_feature (99)..(99): Xaa is any aa, unknown, or other
  misc_feature (355)..(355): Xaa is any aa, unknown, or other
  misc_feature (357)..(357): Xaa is any aa, unknown, or other
  misc_feature (433)..(433): Xaa is any aa, unknown, or other
MKKLRSYYSNVRHHQNHHHHHHHHSNIVSSERKWIFFPLLIGSIFALFLLFLTTTLTSPTGGVRFLPFTRPXLLTGSGXSAFXXSKXXPQQISSLPSPXRFAYLISGSAGDGKSLRRTLLALYHPNNRYVVHLDRESSMEEREELHGYIKNSSLFRRFMNVHMIEKANLVTYRGPTMVANTLHAAAILLREGADWDWFINLSSSDYPLVTHDDLLHIFSHLPRDLNFIDHTSNIGWKASQRAKPVIIDPGLYLNKKSDVFWVTQRRSIPTAFKLFTGSAWMALSRPFVDYCIWGWDNLPRTVLMYYSNFLSSPEGYFHTVLCNAEEFRNTTVNSNLHFISWDNPPKQHPHHLTLXDXTKMVNSNAPFARKFRREDPVLDKIDDELLNRGPGMITPGGWCIGSHENGSDPCAVIGDTDVIRPGPGARRLENLVXRYYPLRISDQNSVSDLIYLENDITQRWNVAALIIGVRCDLGSDRNPSFSQEYK

SEQ ID NO: 1403 - protein, 442 aa, Picea sitchensis
  misc_feature (96)..(321): Pfam Name: Branch Pfam Description: Core-2/I-Branching enzyme
  misc_feature (1)..(442): Public GI ID no. 116786996
  misc_feature (1)..(442): Bit score of 826.5 for HMM based on sequences of Figure 8
  misc_feature (1)..(442): Functional Homolog Of SEQ ID NO. 1366
MNPMLKRIKNLVQMHFRLANMERKWIFPLATASLVSLFLVLVATLFSASNNGVYPVLSFFRFNGGGNAVAKAVFVESKISSAATTSMAALPPPPRLAYLISGSRGDGERLVRTLQALYHPLNQYVVHLDLESSPRERVDLAVYVKTDPIFAKVGNVHMITKANLVTYRGPTMVANTLHAAAILLKKSQEWDWFINLSASDYPLVSQDDLLHTFSYLPRDLNFIEHTSNIGWKEHQRARPIIIDPGLYMSKKSDVFWVTQKRGVPTSFKLFTGSAWMALSRAFIEFCIWGWDNLPRTVLMYYANFISSPEGYFHTVICNAREFQNTTVNHDMHYISWDTPPKQHPHSLGLKDFEKMNESSAPFARKFDRMDPVLDKIDKELLGRKNGSFVPGGWCIGNRDDGSDPCSVMGDKTVLKPGPGAKRLEKLIVALLSKENFRNKQCK

SEQ ID NO: 1404 - DNA, 1368 bp, Glycine max
  misc_feature (1)..(1368): Ceres Clone ID no. 532355
  misc_feature (1)..(1368): Encodes the peptide sequence at SEQ ID NO. 1405
gacatccaaaaaacatgaaacgaaaccataatttccccttccaccaccggccacgcaagtgggcgatggtgatccccaccgtcacaatatgcttcctcctcctcttcctcccgctccttcccctcaccaaaccctcatcttcatcttcttctttttctgcgacatggtcttcttcttcgctgaatttaacggaagaactagaagtgggtgttccgagattggcgtacatgttgacggcgacgaaaggggagggggcgcagctgaagagggtccttcaggcagtgtaccatcccaggaactactacctgctccatctcgatctagaggcttctgatgcggagaggctggagctggccaaatacgtcaagtccgagactgtgcttgcggcgtttgggaacgtcttggtggtgggtaagcctgatttggtcacctacaagggccccaccatgattgcttctactcttcacggtattgcccttttgctcaagagggccccacactgggactggttaatcaatctcagcgcctctgattatcctctcctctcccaggacgatatcttgcacatcttttcattcttgcccagggatctaaatttcattgagcatacaagtaatattggttggaaagagcatcaaagagctaggcctatcattatagatccaggcttatatcattcaaagaaatctggtgtttactgggctaaagagaagagatctgttccatcttcgttcaagttattcacagggtctgcatgggttgtcctgacaaaatcatttcttgagttttgtgtttggggttgggataatcttcctcgaactctccttatgtattacacaaattttctttcatcccctgagggttacttccatacggtcatttgcaatcataaggactatcaaaacacaaccattaatcatgatttacgttacataaggtgggacaacccgccaaagcagcatccagttttcttgaaattggagcattttgatgacatggtccatagtggtgcaccttttgctcgaaagtttaccaaggatgatccagttctcaacaaaattgataaggaacttttgagaagatcagatggtcactttacaccgggaggttggtgtattggcaatcctcttttgggaaaagatccttgtgctgtttatggaaatccaattgtagttaaacctaccttacaatcaaagaagctagaaaaactaatagtgaaactattagattctgaaaattttaggccgaaacaatgtaaatagtagtcactctgcaacgtgaaatttttatacacaattctattggcatttttaatgcgtcgtctgttcaaatttaacattatgaattgttatgaaacatctttctagc

SEQ ID NO: 1405 - protein, 415 aa, Glycine max
  misc_feature (69)..(294): Pfam Name: Branch Pfam Description: Core-2/I-Branching enzyme
  misc_feature (1)..(415): Ceres Clone ID no. 532355
  misc_feature (1)..(415): Bit score of 738.8 for HMM based on sequences of Figure 8
  misc_feature (1)..(415): Functional Homolog Of SEQ ID NO. 1366
MKRNHNFPFHHRPRKWAMVIPTVTICFLLLFLPLLPLTKPSSSSSSFSATWSSSSLNLTEELEVGVPRLAYMLTATKGEGAQLKRVLQAVYHPRNYYLLHLDLEASDAERLELAKYVKSETVLAAFGNVLVVGKPDLVTYKGPTMIASTLHGIALLLKRAPHWDWLINLSASDYPLLSQDDILHIFSFLPRDLNFIEHTSNIGWKEHQRARPIIIDPGLYHSKKSGVYWAKEKRSVPSSFKLFTGSAWVVLTKSFLEFCVWGWDNLPRTLLMYYTNFLSSPEGYFHTVICNHKDYQNTTINHDLRYIRWDNPPKQHPVFLKLEHFDDMVHSGAPFARKFTKDDPVLNKIDKELLRRSDGHFTPGGWCIGNPLLGKDPCAVYGNPIVVKPTLQSKKLEKLIVKLLDSENFRPKQCK

SEQ ID NO: 1406 - DNA, 1287 bp, Populus balsamifera subsp. trichocarpa
  misc_feature (1)..(1287): Ceres Annot ID no. 1530144
  misc_feature (1)..(1287): Encodes the peptide sequence at SEQ ID NO. 1407
atgaagagattgaaaagctactacatgcacctacgccaccaccaaaacatggaaaggaaatggatctttccgttagctattggctctatagtctctcttttcctcctcttccttacagcaatcaccacctcagacggcatgtctctgtttcctttctaccgttccttctcttctttcagctctaaatttgttgaaactaaaatccacccgatacccacttcaaatctccctccaccccctcgatttgcctacttaatctctggctctgccggtgatggcagcatgttgaagcggaccttacaagctctctaccatcccaacaaccaatacgttgttcatttggacagggaatcctcggacgaggagagattagatctaagcaattttgttaaagaccaccctgtttttctcaggtttggtaacgtaagaatgattactaaagctaatcttgttacctatagaggacccactatggtggctaatacattacatgctgctgctatcttgttgagagaaggtggggattgggattggtttattaatcttagtgcatctgattatccacttgtcacacaggatgatctgttgcacacattttcatatctgccaagggatcttaattttattgatcatacaagtaacattggatggaaagagtttcaaagggcaaagccggtaattatagatccggggttgtatatgacaaagaaagctgatgttttttggattacgcagaggaggagtgtcccaacagcatttaaattgtttacaggttctgcctggatggcgctgtctcggccttttattgattataccatatggggatgggacaatttacctcgaacagtgctaatgtactatgcgaactttatatcttccccagaaggttacttccacactgtcatttgcaatgctcaagaatttctaaacaccactgtgaacagtgacctgcatttcatatcttgggacaacccaccgaagcagcatccacatcacctcaaccttgctgacatgcaaaggatgatcgacagcaatgctccatttgctagaaagttcccccaagacgatcctgtgcttgacaagattgattctgagctcctgtctcgtagtccaggcatgtttactcctggtggttggtgcgtaggaagcagggagaatgggaccgatccatgctctgctatcggtaatacaactgtcctgagacctggccctggagctaaaaggttggagacaatgatcagcactctgctatcaaatgaaaattttcgaccaaggcagtgcaaatag

SEQ ID NO: 1407 - protein, 412 aa, Populus balsamifera subsp. trichocarpa
  misc_feature (66)..(291): Pfam Name: Branch Pfam Description: Core-2/I-Branching enzyme
  misc_feature (1)..(412): Ceres Annot ID no. 1530144
  misc_feature (1)..(412): Bit score of 895.5 for HMM based on sequences of Figure 8
  misc_feature (1)..(412): Functional Homolog Of SEQ ID NO. 1366
MERKWIFPLAIGSIVSLFLLFLTAITTSDGMSLFPFYRSFSSFSSKFVETKIHPIPTSNLPPPPRFAYLISGSAGDGSMLKRTLQALYHPNNQYVVHLDRESSDEERLDLSNFVKDHPVFLRFGNVRMITKANLVTYRGPTMVANTLHAAAILLREGGDWDWFINLSASDYPLVTQDDLLHTFSYLPRDLNFIDHTSNIGWKEFQRAKPVIIDPGLYMTKKADVFWITQRRSVPTAFKLFTGSAWMALSRPFIDYTIWGWDNLPRTVLMYYANFISSPEGYFHTVICNAQEFLNTTVNSDLHFISWDNPPKQHPHHLNLADMQRMIDSNAPFARKFPQDDPVLDKIDSELLSRSPGMFTPGGWCVGSRENGTDPCSAIGNTTVLRPGPGAKRLETMISTLLSNENFRPRQCK

SEQ ID NO: 1408 - protein, 420 aa, Vitis vinifera
  misc_feature (74)..(299): Pfam Name: Branch Pfam Description: Core-2/I-Branching enzyme
  misc_feature (1)..(420): Public GI ID no. 225424849
  misc_feature (1)..(420): Bit score of 837.3 for HMM based on sequences of Figure 8
  misc_feature (1)..(420): Functional Homolog Of SEQ ID NO. 1366
MKRVKNHPTHVNPKWIMLISTCSILSLIVLFFTTLVSPDSIPFLTLHRSGSASLFVEYKLRPISPTPVSLPPRLAYLISGTVGDCGALKRTLQALYHPHNLYIIHLDLESPQIERSHLRDYIRNHPAFSSVKNVWMMEKANLVTYRGPTMVANTLHAAAILLKEGGEWDWFINLSASDYPLVTQDDLLHTFSYLPRDLNFVDHTSNIGWKEFQRAKPIIVDPGLYMTKKNNVFWVKQRRSVPTAFKLFTGSAWVALSRPFIDYCIWGWDNLPRTVLMYYTNFVSSPEGYFHTVICNAEEFRNTTVNSDLHFISWDNPPKQHPHLLTITDMSKMISSNAPFARKFRRDDPVLDKIDAELLSRRPDMLVPGAWCIGSSSNGTDPCSVVGNPSVLKPGPGAKRLENLLVSLLSKQNFRPRQCK

SEQ ID NO: 1409 - protein, 404 aa, Vitis vinifera
  misc_feature (58)..(283): Pfam Name: Branch Pfam Description: Core-2/I-Branching enzyme
  misc_feature (1)..(404): Public GI ID no. 147787134
  misc_feature (1)..(404): Bit score of 805.1 for HMM based on sequences of Figure 8
  misc_feature (1)..(404): Functional Homolog Of SEQ ID NO. 1366
  misc_feature (29)..(29): Xaa is any aa, unknown, or other
  misc_feature (147)..(147): Xaa is any aa, unknown, or other
  misc_feature (243)..(243): Xaa is any aa, unknown, or other
  misc_feature (329)..(329): Xaa is any aa, unknown, or other
  misc_feature (368)..(368): Xaa is any aa, unknown, or other
  misc_feature (386)..(386): Xaa is any aa, unknown, or other
MLISTCSILSLIVLFFTTLVSPESIPFLXLHRSGSASLFVEYKLRPISPTPVSLPPRLAYLISGTVGDCGALKRTLQALYHPHNLYIIHLDLESPQIERSHLRDYIRNHPAFSSVKNVWMMEKANLVTYRGPTMVANTLHAAAILLXEGGDWDWFINLSASDYPLVTQDDLLHTFSYLPRDLNFVDHTSNIGWKEFQRAKPIIVDPGLYMTKKNNVFWVKQRRSVPTAFKLFTGSAWVALSRXFIDYCIWGWDNLPRTVLMYYTNFVSSPEGYFHTVICNAEEFRNTTVNSDLHFISWDNPPKQHPHLLTITDMSKMISSNAPFARKFXRDDPVLDKIDAELLSRRPDMLVPGAWCIGSSSNGTDPCXVVGNPSVLKPGPGAKRLXNLLVSLLSKQNFRPRQCK

SEQ ID NO: 1410 - protein, 424 aa, Picea sitchensis
  misc_feature (78)..(303): Pfam Name: Branch Pfam Description: Core-2/I-Branching enzyme
  misc_feature (1)..(424): Public GI ID no. 116794047
  misc_feature (1)..(424): Bit score of 773.9 for HMM based on sequences of Figure 8
  misc_feature (1)..(424): Functional Homolog Of SEQ ID NO. 1366
MRKNLHFQKAVRDRKWLAPMVASFLVSMILIYIATIRLGSSTQGVNSSLKQIDDSGGYFVEANLGEDAHSGEAKLPRLAYLISGTKGDSHRMKRTLQALYHPLNHYLLHLDLEAPPRERLEVAMYVKSDPTFSKINNVHVVGKANLVTYKGPTMVACTLQAVAILLRQSKDWDWFINLSASDYPLVTQDDLLRVFSALPRGLNFIEHTSDIGWKEYQRAKPIIIDPGLYLPKKSDIFWVTQHRAVPTSFKLFTGSAWVMLTRTFLEFCIWGWDNLPRTVLMYYTNFVSSPEGYFHTVICNSQVFRNTTVNHDLHYIAWDTPPKQHPTSLTVKNFDDMVKSGAPFARKFAKDDPVLDKIDKELLGRSDGQFTPGGWCVGSRENGRDPCAVRGDPAVFKPGPGDKRLEGLLFKLLAPENFRAKQCI

SEQ ID NO: 1411 - DNA, 1678 bp, Zea mays
  misc_feature (1)..(1678): Ceres Clone ID no. 1562166
  misc_feature (1)..(1678): Encodes the peptide sequence at SEQ ID NO. 1412
ctctccagtgccctgccaatcccccgctctcccgcctaccgccaggcccaggcgccagcctccaaagtccaaacccagctagagcttagagctagcatggagtccgccgccccgtgcccgcgcgcgcacgcgcaccccgtggacctccgctggctgctctccgtcgccgccggcggcctcttcgcgctgctgctggtgctgctggccacctccccgtcgttccggctcgcctccacctcgccctcaccccgcctcttcctcggccccgcgtccggctcctcccgggcgcgcccaccactcttcgtcgagcccgccctgtcccgcccggcggcgccgtccccgcccgcgtccgcctcgctcccgcgcttcgcgtacctcatctccggctcggccggggacgccggcatgatgcgccgctgcctgctggcgctctaccaccccaggaaccgctacgtgctccacctagacgcggaggcgcccgacgccgaccgggcggggctggccgccttcgtcgccgcgcacccggtgctcgcggcggcgcggaacgtgagggtggtcgagaaggccaacctcgtcacctacaggggccccaccatggtgaccaccacgctgcacgccgccgccgcgctcctgtggggcgagggcaggggccgcggcgccgactgggactggttcatcaacctctccgcctccgactacccgctcgtcacgcaggatgatttgatgcatgtgttctccaagctgccgcgcgatctcaacttcatcgaccacacgagtaacatctcctggaaagcgtttgcgagggcgatgccggtgatcatagacccggcgctgtacatgaagaaaaagggcgatctgttctgggtgccggagaggcggagcttgccgacggcattcaagctgttcactggttccgcgtggatggtgctgtcccgggcgttcgtggagtacctgatctgggggtgggacaacctcccgcgcacggtgctcatgtactacgccaacttcatctcgtccccggagggctacttccacacggtggcgtgcaacgccgacgggttccggaacaccacggtgaacagcgacctgcacttcatctcctgggacaacccgcccatgcagcacccgcaccagctcaccgtcggcgactgggaccggatgctcggcagcggcgcgcccttcgcgcgcaagttccgcagggacgacccggtgctggacaggatcgacgccgacatcctcgcgcggggccccggcacggtggcgcccgggggctggtgcggccgcggagcagccggcggcggcgggcaggggcagagcaacgggaccgacccgtgcgcggccgtcggggacgcggcggtcctgcggcccggcccgggcgccgagcggctgcagcggctcgtcacgtcgctgctgtcggaggagaacttccggcccaggcagtgcgtagtagaaaacgagaactgagccgggctggcagggcagggcaacgagcctgctactagcggtactacgggagtatgcatgatacagtgataccgtgcctaaaaatgtatggtacatgatgctatgtgccgggtcttctctgcggtacacgcgaaggcatgtacgagtacttggacgaaaattacacctagacattcatgtatctgctaatatatactacacctttcttttctct

SEQ ID NO: 1412 - protein, 455 aa, Zea mays
  misc_feature (91)..(321): Pfam Name: Branch Pfam Description: Core-2/I-Branching enzyme
  misc_feature (1)..(455): Ceres Clone ID no. 1562166
  misc_feature (1)..(455): Bit score of 815.8 for HMM based on sequences of Figure 8
  misc_feature (1)..(455): Functional Homolog Of SEQ ID NO. 1366
MESAAPCPRAHAHPVDLRWLLSVAAGGLFALLLVLLATSPSFRLASTSPSPRLFLGPASGSSRARPPLFVEPALSRPAAPSPPASASLPRFAYLISGSAGDAGMMRRCLLALYHPRNRYVLHLDAEAPDADRAGLAAFVAAHPVLAAARNVRVVEKANLVTYRGPTMVTTTLHAAAALLWGEGRGRGADWDWFINLSASDYPLVTQDDLMHVFSKLPRDLNFIDHTSNISWKAFARAMPVIIDPALYMKKKGDLFWVPERRSLPTAFKLFTGSAWMVLSRAFVEYLIWGWDNLPRTVLMYYANFISSPEGYFHTVACNADGFRNTTVNSDLHFISWDNPPMQHPHQLTVGDWDRMLGSGAPFARKFRRDDPVLDRIDADILARGPGTVAPGGWCGRGAAGGGGQGQSNGTDPCAAVGDAAVLRPGPGAERLQRLVTSLLSEENFRPRQCVVENEN

SEQ ID NO: 1413 - protein, 432 aa, Physcomitrella patens subsp. patens
  misc_feature (85)..(310): Pfam Name: Branch Pfam Description: Core-2/I-Branching enzyme
  misc_feature (1)..(432): Public GI ID no. 168043094
  misc_feature (1)..(432): Bit score of 759.1 for HMM based on sequences of Figure 8
  misc_feature (1)..(432): Functional Homolog Of SEQ ID NO. 1366
MKKVTQLSCRLATIERKWLVPLVASIITSIMLLFLVAFKVGSGEHHSSGDSIVPIIPARDGTQSQNVVESIAQDPTAELPPPPRLAYLISGTKGDGLRMQRTLQALYHPWNYYLLHLDLDAPPRERLDLARYVKNEVVFKEGGNVYVVGKTNLVTYRGPTMIAATLHGAAILLRKAKDWDWFINLSAADYPLVTQDDLLHVFSYLPRDLNFIQHTSDIGWKEFQRAKPIIIDPGLYQNKKTDIFWATQRRALPTAFRLFTGSAWFALTRSFMEYCNLGWENLPRTLLMYYTNFVSSPEGYFHTVLCNAQEFRNTTVNHDLHYIKWDHPPKQHPLSLTLKDMENMTISGAAFARKFDKDDPVLDRIDETLLNRKKGQFTPGGWCIGRRHATDPCALRGNHSLLRPGPGSRRFENLVVRMLSAESFRTQQCASV

SEQ ID NO: 1414 - protein, 401 aa, Oryza sativa subsp. indica
  misc_feature (63)..(288): Pfam Name: Branch Pfam Description: Core-2/I-Branching enzyme
  misc_feature (1)..(401): Public GI ID no. 116308950
  misc_feature (1)..(401): Bit score of 595.4 for HMM based on sequences of Figure 8
  misc_feature (1)..(401): Functional Homolog Of SEQ ID NO. 1366
MRPPARSPPRLAAAAAALATSAALLLICGTWPGFGFGFGAYTASSSARRASSTGGADAPPPSFAYLISGTGGEAARVVRLLRAVYHPRNRYLLHLDAAAGAEERAELAAAVRGVRAWRERANVDVVGEGYAVDRAGPSALAAALHGAAVLLRVAADWDWFVTLSSSDYPLVTQDDLLYAFSSVPRDLNFIDHTSDLGWKEHERFEKLIVDPSLYMDRNSEILPATEPRQMPDAFKIFTGSPWVILSRNFTEHCVHGWDNLPRKLLMYFANTAYSMESYFQTVICNSSKFRNTTVNGDLRYFVWDDPPGLEPLVLDESHFDDMVNSSAAFARRFVDDSPVLKKIDKEILNRSSAVCASFSRRRGMDVDSCSKWGDVNVLQPARAGEQLRRFISEISQTRGCS

SEQ ID NO: 1415 - protein, 433 aa, Picea sitchensis
  misc_feature (87)..(312): Pfam Name: Branch Pfam Description: Core-2/I-Branching enzyme
  misc_feature (1)..(433): Public GI ID no. 116789207
  misc_feature (1)..(433): Bit score of 778.6 for HMM based on sequences of Figure 8
  misc_feature (1)..(433): Functional Homolog Of SEQ ID NO. 1366
MKQLVQMHSSLASMEKKWIIPLAFCSLGSLFLLVIDFNVGNSYTQNTLSSILATFHFGDALGSSPPVFAESKVVLPSPVTRPGPPRFAYLISGSKGDGGKLKRTLASLYHPLNQYVVHLDRECLPKERVDLANHVRSNPIFAEVGNVHVITKANMITYKGPTMVSNTLHAAAILLRKSKEWDWFINLSASDYPLVTQDDLLHTFQSLPRNLNFLEHTSSLGWKENQRAKPIIIDPGLYMSRKSDIVWVAEKRDIPTAFKLFTGSAWMVLSRAFVEYCIWGWDNLPRTVLMYYANFVSSPEGYFHTVICNTQEFQNTTVNHDLHYISWDNPPKQHPHSLGLSDSPKMIDSKAPFARKFHGDDPVLDKIDKELLGRQNGRFTPGGWCKGNRDNGSDPCSAIGDKNFLKPGLGAKRLGELIKDLLSPAKFAQNQCK

SEQ ID NO: 1416 - protein, 401 aa, Oryza sativa subsp. japonica
  misc_feature (63)..(288): Pfam Name: Branch Pfam Description: Core-2/I-Branching enzyme
  misc_feature (1)..(401): Public GI ID no. 115457614
  misc_feature (1)..(401): Bit score of 596.6 for HMM based on sequences of Figure 8
  misc_feature (1)..(401): Functional Homolog Of SEQ ID NO. 1366
MRPPARSPPRLAAAAAALATSAALLLICGTWPASASGFGAYTASSSARRASSTGGADAPPPSFAYLISGTGGEAARVVRLLRAVYHPRNRYLLHLDAAAGAEERAELAAAVRGVRAWRERANVDVVGEGYAVDRAGPSALAAALHGAAVLLRVAADWDWFVTLSSSDYPLVTQDDLLYAFSSVPRDLNFIDHTSDLGWKEHERFEKLIVDPSLYMDRNSEILPATEPRQMPDAFKIFTGSPWVILSRNFTEHCVHGWDNLPRKLLMYFANTAYSMESYFQTVICNSSKFRNTTVNGDLRYFVWDDPPGLEPLVLDESHFDDMVNSSAAFARRFVDDSPVLKKIDKEILNRSSAVCASFSRRRGMDVDSCSKWGDVNVLQPARAGEQLRRFISEISQTRGCS

SEQ ID NO: 1417 - protein, 422 aa, Populus tremula x Populus tremuloides
  misc_feature (65)..(290): Pfam Name: Branch Pfam Description: Core-2/I-Branching enzyme
  misc_feature (1)..(422): Public GI ID no. 60657606
  misc_feature (1)..(422): Bit score of 540.0 for HMM based on sequences of Figure 8
  misc_feature (1)..(422): Functional Homolog Of SEQ ID NO. 1366
MRTSKISSGNSGYHVWILAFAMSLLILIALSKSWFYDHASAAASEDLQYFSVIVPSKGRDYPPVLAYWICGTSGDGKRMLRLLKAIYHPRNQYLLQLDAESSDYERAELVVSVQSESLFQAFGNVNVVGKGFAINEMGSSALAAILNAAALLLKLSTDWDWFINLSVSDYPLVSQDDLLHAFTSLPRDLNFINYSNDTAKNEIHKINQIVVDPSLHLQKRSHLYYAVETRTTPDAFKIFGGSPWLILTRAFMEYCVQGWDNLPRKLLMYFSNTASPLESYFHSVLCNSPEFQNTTVSDDLRYNILETTTDGESPYDKMLNGGAAFARPFKEDAAALNMIDENVLNREPNGLVPGKWCLDQGMNKSSEASKPPGEDLCSTWGNINDVKPGSYGIKLAFLLSKIASEEKLTTSQCLQATKMGSS

SEQ ID NO: 1418 - protein, 444 aa, Oryza sativa subsp. indica
  misc_feature (98)..(323): Pfam Name: Branch Pfam Description: Core-2/I-Branching enzyme
  misc_feature (1)..(444): Public GI ID no. 125555973
  misc_feature (1)..(444): Bit score of 741.8 for HMM based on sequences of Figure 8
  misc_feature (1)..(444): Functional Homolog Of SEQ ID NO. 1366
MLETKPPSPGTAGAAGVAGGGYHRRWAAPLLASVLLSSLLIAASLFFSSSRALLLSFSPLPSAASAEPLFVEAKLRQQQQMRGAAASGGRGRGAVPRIAYLVSGSAGDGAALRRTLRALYHPSNMYVVHLDLEAPATERAELAAAVRADPVYSRFRNVKVVTRANLVTYRGPTMVANTLHAAAILLREGGEWDWFINLSASDYPLVTQDDLLYVLSDLPRQLNFIEHTSDIGWKEYQRAKPVIIDPGLYSLQKSDVFWITEKRSVPTAFKLFTGSAWMMLTHQFIEYCIWGWDNLPRTVLMYYANFLSSPEGYFHTVICNVPEFRNTTVNHDLHFISWDNPPKQHPHYLTLNDFDGMVNSNAPFARKFGREDPVLDKIDQELLGRQPDGFVSGGWMDLLNTTTVKGSFTVERVQDLRPGPGADRLKKLVTGLLTQEGFDDKHCL

SEQ ID NO: 1419 - DNA, 2034 bp, Zea mays
  misc_feature (1)..(2034): Ceres Clone ID no. 508189
  misc_feature (1)..(2034): Encodes the peptide sequence at SEQ ID NO. 1420
actcacgagaccgtccaccgcgacgcgctctcttgcccgtgcccccgtcctccccttccccctccacctccgcggcgcccgcggtaacctcgccacgccacatcgcgtgcgagcaccaaccgtcgccggccctctaattaagctgcctgcgcggcgcgatccggtgtccaccgctgccccgccggaggaggaggaggaggaggaagggggcggggggtggagcacagggggatgctagaggcgaagccgccgtcgccgggctcctccggcgcggccggggcggcggcacacatccacgctcaccggcggtgggcggcgccgctgctggcctcggtcctgctctcgtcgctcctcatctccgcgtcgctcttcttctcctcctcccgcgcgctgctcctctccttctcgccgctcccctccgcggcctccgccgagcccctcttcgtcgaggccaagctccgccagcagatgcgggccgaggagcgccccgcgcggggcgccgtgcccaggatctcctacctcgtctccggctccgcgggggacggagccgcgctgcgccggacgctcagggcgctctaccacccggcaaacacgtacgtcgtgcacctcgacctcgaggctcccgccgccgagcgcgccgagctcgccgctgccgtccgcgccgaccccgtctacgccaggttccgcaacgtcaaggtcgtcacacgggcgaacctggtcacctaccgtggcccgaccatggtggccaatacgctgcacgcggctgccatcctgctgcgcgagggcggtgattgggactggttcatcaacctctccgcctccgactatccactcgtcacccaggacgacctgttgcatgtgctctccgagttgcccaggcagcttaacttcattgagcataccagtgacatcggatggaaggagtaccagagggcgaagccagtgatcatcgaccctgggctatacagcctgcagaagtctgacgttttctggataacagagaaacggagtgtcccaactgcgttcaagctcttcactggctcggcatggatggtgctcacccaccagtttatcgaatactgcatatggggatgggacaatctcccaaggacagtcctgatgtactacgccaatttcctttcctcgccagagggctacttccacacggtcatctgcaacgtgccggagttccgcaacaccacagtcaaccacgacctgcatttcatttcctgggacaacccaccgaagcagcaccctcactacctcacgctcgctgacttcgacggcatggttaacagcaacgcgccctttgcaaggaagttcgggagagaagaccccgtgctggacaagatcgaccaggagctactgggccgccggcctgatgggtttgtgcccggtggatggacgtatctactgaatgcgacgagtgaggaagggagacccttcgccgttgagcgcgtgcaggatctccgcccagggcctggtgtggatagattgaagaaactcgtcacgggcttgctcacacaagaaggctttgatgacaagcactgcctgtgagactgccccccagtaagatgattctggctgggggcggtagattacacggtcaaatctgagggcattggagccattttctgggaatatgcctactggctgaagaagcagcacatagtatcatgtgatgtacgcgtggatgcaagcaacggtaagataggtgctcttacagacacagccgcctgagttgagctactaccgtacagcaggaggccacggacgtagccggcggagattatacaggaatagtagctcattaggttatgttagatgactatatcagccccttcccaaccgtcaataatgttgggaattttgacatctccgcggcgctgcgggttgtgcaaggcaggcaggcaggcagtccattcttcgcttggatgccatggcgcctggtgtaaccaactggtagcgtgtgaggaggcttcgttgtattgactagtgcatatttctgggcaaaacagatgcgtttggttgcat

SEQ ID NO: 1420 - protein, 441 aa, Zea mays
  misc_feature (94)..(319): Pfam Name: Branch Pfam Description: Core-2/I-Branching enzyme
  misc_feature (1)..(441): Ceres Clone ID no. 508189
  misc_feature (1)..(441): Bit score of 745.2 for HMM based on sequences of Figure 8
  misc_feature (1)..(441): Functional Homolog Of SEQ ID NO. 1366
MLEAKPPSPGSSGAAGAAAHIHAHRRWAAPLLASVLLSSLLISASLFFSSSRALLLSFSPLPSAASAEPLFVEAKLRQQMRAEERPARGAVPRISYLVSGSAGDGAALRRTLRALYHPANTYVVHLDLEAPAAERAELAAAVRADPVYARFRNVKVVTRANLVTYRGPTMVANTLHAAAILLREGGDWDWFINLSASDYPLVTQDDLLHVLSELPRQLNFIEHTSDIGWKEYQRAKPVIIDPGLYSLQKSDVFWITEKRSVPTAFKLFTGSAWMVLTHQFIEYCIWGWDNLPRTVLMYYANFLSSPEGYFHTVICNVPEFRNTTVNHDLHFISWDNPPKQHPHYLTLADFDGMVNSNAPFARKFGREDPVLDKIDQELLGRRPDGFVPGGWTYLLNATSEEGRPFAVERVQDLRPGPGVDRLKKLVTGLLTQEGFDDKHCL

SEQ ID NO: 1421 - DNA, 1287 bp, Populus balsamifera subsp. trichocarpa
  misc_feature (1)..(1287): Ceres Annot ID no. 1502889
  misc_feature (1)..(1287): Encodes the peptide sequence at SEQ ID NO. 1422
atgaagagattgaagagttactacatgcacttacgccaccaccaaaacatggaaagaaaatggatctttccattagcaattggctctctagtttctctcttccttctcttccttacaacaattactacctctgacggcatctctgtgttccctttctaccgttctttctcttctctcagctctaaatttgttgaaacaaagatccacccactacccatttcgaatcttcctccaccccctcgatttgcctacgtaatatccggttctgctggtgatgccaatatgttgaagaggactttacaagctctttaccatcccaacaaccaatatgttgttcatttggacagggaatcctcgactcaggagagattagatctaagcaattttgttaaacaccatcctgtttttctcaggttcggtaatgtaagaatgatcagtaaagctaatcttgttacttatagaggacccactatggttgctaatacattacatgctgctgctatcttgttgagagaaggtggagattgggattggtttattaatcttagtgcatctgattatccacttgttacacaggatgatctgttgcatacattttcatatctgccacgggatcttaattttattgatcatacaagtgacattggatggaaagagtttcaaagggcgaagccaataattatagatcccgggttgtatatgacaaagaaagctgatgttttttggattacacagaggaggagtgtcccaacagcatttaaattatttacaggttctgcctggatggcactatctcgaccttttattgattacaccatatggggatgggataatatacctcgaactgtactcatgtactatgccaactttatatcttccccagaaggttacttccacactgtcatttgcaattctccacaatttctcaataccactgtgaatagcgatctgcatttcatatcttgggacaacccacctaagcagcatccacaccacctcaaccttgctgacatgcaaaggatgattgagagcaatgctccatttgctagaaagttcccccatgaagatccagtgcttgacaaaattgattctgagctcttgtctcgtggtccaggcatgtttactcctggtggttggtgcataggaagtagggagaatggaactgatccatgctctgctattggtaacacaactgtcctgagacctggccctggagctaaaaggttgcagtcattgatcagctctctgctatcaaatgaaaatttccaaccaaggcagtgcaagtaa

SEQ ID NO: 1422 - protein, 412 aa, Populus balsamifera subsp. trichocarpa
  misc_feature (66)..(291): Pfam Name: Branch Pfam Description: Core-2/I-Branching enzyme
  misc_feature (1)..(412): Ceres Annot ID no. 1502889
  misc_feature (1)..(412): Bit score of 888.5 for HMM based on sequences of Figure 8
  misc_feature (1)..(412): Functional Homolog Of SEQ ID NO. 1366
MERKWIFPLAIGSLVSLFLLFLTTITTSDGISVFPFYRSFSSLSSKFVETKIHPLPISNLPPPPRFAYVISGSAGDANMLKRTLQALYHPNNQYVVHLDRESSTQERLDLSNFVKHHPVFLRFGNVRMISKANLVTYRGPTMVANTLHAAAILLREGGDWDWFINLSASDYPLVTQDDLLHTFSYLPRDLNFIDHTSDIGWKEFQRAKPIIIDPGLYMTKKADVFWITQRRSVPTAFKLFTGSAWMALSRPFIDYTIWGWDNIPRTVLMYYANFISSPEGYFHTVICNSPQFLNTTVNSDLHFISWDNPPKQHPHHLNLADMQRMIESNAPFARKFPHEDPVLDKIDSELLSRGPGMFTPGGWCIGSRENGTDPCSAIGNTTVLRPGPGAKRLQSLISSLLSNENFQPRQCK

SEQ ID NO: 1423 - DNA, 1549 bp, Gossypium hirsutum
  misc_feature (1)..(1549): Ceres Clone ID no. 1808311
  misc_feature (1)..(1549): Encodes the peptide sequence at SEQ ID NO. 1424
acagtacaaacttgaccggacaccaaatccaataattttatgttcttttaccttagatctagttccaaaaccatcctaaattttagctctcttgtccgaaagtctcctgttttctttttcaattaatgaaaagaactcactttccttattcagatcgatcatggcttttactgccaatcctcataatctcaatcatttcactcactttccttctctcattaaccttcacccaaaataaatccacttcattcgaacccgaattttcctttcaagaacccagattttctttctccgaacgggattacggccggttaccgaggttgcccagatttgcttattccatatcggggacgaaaggtgatgggccgcgcgttaaaaggttgttgcaggcgatttatcacccgaggaattactatttggtccatttggatcttgatgcttcggattcggagcggtttgagttggctaagtatgtgaaagcggagggtgtgattaaggagttcgggaacgtgatggtcatcggaaaagctgatttggtgacttataaggggcctactatggttgccgctacgcttcatgccgtggcgattttgttgaaggaagctaaagattgggattggtttgtgaaccttagtgcagatgattatccccttatgacccaagatgatatcgtgcacatcttctcgtacttgcctagggatctcaatttcctcgagcacacgagtagcattggctggaaagaataccaaagagcaaggccaatcattatagacccgggtttataccattcgaagaaatctggcgtattttgggctaaggagaaaagatcgttgcctgcttctttcaagttattcatgggatcagaatgggtggtgctgacaaaatcgtttctcgaattctgtgtatggggatgggataatcttccacgtaccctccttatgtactacacgaacttcatatcgtccccggaaggttacttccacaccgtagtttgcaatcacaaagattaccagaacacgaccgtgaaccatgacttgcattatatacgatgggataatcctccgaagcagcatccgatgactttgacattggaacatttcgacgacatggttcgaagtggagcaccttttgctcggaagtttgccaaggatgatgattcagccctcaataagattgacaaggaattgttgaggagatcgtacggtcgttttaccccagggggttggtgcgtgggaggttcaaacccgggtaaagatccgtgtgtagtttacgggaacccaaatgctgtcaaacctactgtaagttcaaagaggcttgagaaactattggtacaacttcttgattctggaaatttcagatcaaaacaatgtaaatagttattttttgtaatgtgatgcttaatgtcccgattctcgaggtcattggttgtcattcgatattcgattcttgttcgatactaagctgccgcctagattttgaattggttcttgaatgtagccgttttaatagaatcttcaaaatatcggtattgtatcaattgtatattatc

SEQ ID NO: 1424 - protein, 416 aa, Gossypium hirsutum
  misc_feature (69)..(294): Pfam Name: Branch Pfam Description: Core-2/I-Branching enzyme
  misc_feature (1)..(416): Ceres Clone ID no. 1808311
  misc_feature (1)..(416): Bit score of 729.3 for HMM based on sequences of Figure 8
  misc_feature (1)..(416): Functional Homolog Of SEQ ID NO. 1366
MKRTHFPYSDRSWLLLPILIISIISLTFLLSLTFTQNKSTSFEPEFSFQEPRFSFSERDYGRLPRLPRFAYSISGTKGDGPRVKRLLQAIYHPRNYYLVHLDLDASDSERFELAKYVKAEGVIKEFGNVMVIGKADLVTYKGPTMVAATLHAVAILLKEAKDWDWFVNLSADDYPLMTQDDIVHIFSYLPRDLNFLEHTSSIGWKEYQRARPIIIDPGLYHSKKSGVFWAKEKRSLPASFKLFMGSEWVVLTKSFLEFCVWGWDNLPRTLLMYYTNFISSPEGYFHTVVCNHKDYQNTTVNHDLHYIRWDNPPKQHPMTLTLEHFDDMVRSGAPFARKFAKDDDSALNKIDKELLRRSYGRFTPGGWCVGGSNPGKDPCVVYGNPNAVKPTVSSKRLEKLLVQLLDSGNFRSKQCK

SEQ ID NO: 1425 - DNA, 1955 bp, Zea mays
  misc_feature (1)..(1955): Ceres Clone ID no. 349234
  misc_feature (1)..(1955): Encodes the peptide sequence at SEQ ID NO. 1426
gctctcctgcccgtgcccacctccacgactccacctccgcagcgcccgcagtaacctccccacgccacgccacatcgcgtgcgagccccaaccgtcgccggcctcccaattaagccgcccccgcggcgcgatccggtgtccaccgctgctccgccggaggagggggaaggggaagaaaagggagggggggagcacagggggatgctagaggcgaagccgccgtcgccgggctccggcgcggccggggcggcggcgcacatccacggtcaccggcggtgggcggcgccgctgctggcctcggttctgctctcgtcgctcctcatcaccgcgtcgctcttcttttcctcctcccgcgcgctgctactctccttctcgccgctcccctccgcggcctccgccgagcctctcttcgtcgaggccaagctccgccagcagatgcgggccgaggagcgccccacgcggggcgccgtgcccaggatcgcctacctcatctccggctccgcgggggacggagccgcgctgcgccggacgctcagggcgctctaccacccggtaaacacatacgtcgtgcacctcgacctcgaggcccccgccgccgagcgcgccgaactcgcctctgccatccacgcggaccccgtctacgctaggttccgcaacgtcaaggtcgtcacacgggccaacttggtcacctaccgtggcccgaccatggtggccaacacgctgcacgcggctgccatcctgctgcgcgagggcggtaattgggactggttcatcaacctctccgcctccgactatccgctcgtcacccaggacgatctattgcatgtgctttctgagttgcccaggcagcttaacttcattgagcataccagtgacatcggatggaaggagtaccagagggcgaagccagtgatcatcgaccctgggctatacagcctgcagaagtctgacgttttctggataacagagaaaaggagtgtcccaactgcattcaagctcttcaccggctcagcatggatgatgcttactcatcagttcattgaatattgtatatggggatgggacaatctcccaaggacagtcctgatgtattacgcaaattttctttcttcaccagagggttacttccacactgtcatctgcaatgtccccgagttccgcaacaccacagtcaaccatgatctacatttcatttcttgggacaacccaccaaagcaacaccctcattatctcacactcgctgacttcgatggtatggttaacagcaacgcaccctttgcaaggaagtttggaagagaggatcctgtgctggacaagattgaccaggaactgttggcccgccgacctgatggatttgtgcctggtggatggacagacctactgaacacaactgagaaagggaaacccttcacggttgagcgcgtgcaagatctccgcccaggtcctggtgtggacagattaaagaaactcgtcacaggattgctcacccaagaaggttttgatgacaagcattgcctgtgaaactcccagtaagatgattctggggcagtaggttacacgctcaaatttgaaggcatcgggccatttgctaggaatgcccctactagctgaggcagcagcacattagcgtcatgtacgcgaggatgcaacgataaggaaggtgctcttacagacaactgcttgagttgagttaccttacagcaggagaccacggatgtagcagtcggagatgattatacagaactagtagctcattagtttattagatgattataatcagccccccaaccatgaataatgttggaatttttgacatttctgcgcccgagggttgtgcaaggtagcccattctttgtttcgaagccatggcacctggtgcaccagctggtagcgtgagacttcgttgtattgactagtggatgtttctgagtaaactgatacatttgattgcacac

SEQ ID NO: 1426 - protein, 439 aa, Zea mays
  misc_feature (93)..(318): Pfam Name: Branch Pfam Description: Core-2/I-Branching enzyme
  misc_feature (1)..(439): Ceres Clone ID no. 349234
  misc_feature (1)..(439): Bit score of 738.3 for HMM based on sequences of Figure 8
  misc_feature (1)..(439): Functional Homolog Of SEQ ID NO. 1366
MLEAKPPSPGSGAAGAAAHIHGHRRWAAPLLASVLLSSLLITASLFFSSSRALLLSFSPLPSAASAEPLFVEAKLRQQMRAEERPTRGAVPRIAYLISGSAGDGAALRRTLRALYHPVNTYVVHLDLEAPAAERAELASAIHADPVYARFRNVKVVTRANLVTYRGPTMVANTLHAAAILLREGGNWDWFINLSASDYPLVTQDDLLHVLSELPRQLNFIEHTSDIGWKEYQRAKPVIIDPGLYSLQKSDVFWITEKRSVPTAFKLFTGSAWMMLTHQFIEYCIWGWDNLPRTVLMYYANFLSSPEGYFHTVICNVPEFRNTTVNHDLHFISWDNPPKQHPHYLTLADFDGMVNSNAPFARKFGREDPVLDKIDQELLARRPDGFVPGGWTDLLNTTEKGKPFTVERVQDLRPGPGVDRLKKLVTGLLTQEGFDDKHCL

SEQ ID NO: 1427 - DNA, 1269 bp, Populus balsamifera subsp. trichocarpa
  misc_feature (1)..(1269): Ceres Annot ID no. 1457604
  misc_feature (1)..(1269): Encodes the peptide sequence at SEQ ID NO. 1428
atgaggacatcaaaaatttcttcagggaattcaggctatcatgcatggattcttgcttttgcaatgagtctactgatactgattgccttgtcgaagtcatggttttatgatcacgcttctgctactgcaagtgaggatttgcaatacttttcagtgattgtcccttcaaaagggcgggcctatcctcctgttcttgcttattggatatgtggtactagtggagatgggaagagaatgttaaggctattaaaagcaatttatcatccaaggaaccaatatctattgcagcttgatgctgaatcctcagattatgaaagggcagagttagttgtttcagttcaatctgaaagtttgtttcaagcatacggtaatgttaatgttgttggaaaaggttatgctatcaacgaaatgggatcgtctgctcttgctgccatactcaacgctgctgcattgcttcttaagctgagtgcagactgggattggttcatcaatttaagtgtctcagactatcctctagtgagtcaagatgatctcctccatgccttcacttccttgccaagagatctcaacttcatcaactatactaatgacactgcgaaaaacgagatacacaagattaaccaaattgttgtagaccccagcttacatcttcagaagagtagccacctttattacgctgttgagactcgaacaacacctgatgctttcaagatatttggaggttcaccctggctgattcttacaagagctttcatggagtactgtgtccaaggatgggacaaccttccaagaaaactactaatgtacttcagcaacacggcatccccacttgaatcgtatttccactctgtcctctgcaactctcctgagtttcaaaacacaacagtaagcaatgatttaaggtacaatattctggaaactactacagatggggaatcaccttatgacaaaatgctaaatggtggagcagcatttgcaaggccatttaaagaagatgctgctgcactaaacatgatagatgagaatgtcttgaaccgtgaacccaatggattggtgcctggaaaatggtgcttagaccaaggtctgaacaagagctcagaggcatcaaagcctccaggggaggatttgtgttcaacttggggtaacattaatgatgtcaagccaggatcttatggtatcaagcttgcatttttattgtctaagattgccggtgaagagaaattgacaactagtcaatgccttcaagctacacaaatggggtcatcatag

SEQ ID NO: 1428 - protein, 422 aa, Populus balsamifera subsp. trichocarpa
  misc_feature (65)..(290): Pfam Name: Branch Pfam Description: Core-2/I-Branching enzyme
  misc_feature (1)..(422): Ceres Annot ID no. 1457604
  misc_feature (1)..(422): Bit score of 534.3 for HMM based on sequences of Figure 8
  misc_feature (1)..(422): Functional Homolog Of SEQ ID NO. 1366
MRTSKISSGNSGYHAWILAFAMSLLILIALSKSWFYDHASATASEDLQYFSVIVPSKGRAYPPVLAYWICGTSGDGKRMLRLLKAIYHPRNQYLLQLDAESSDYERAELVVSVQSESLFQAYGNVNVVGKGYAINEMGSSALAAILNAAALLLKLSADWDWFINLSVSDYPLVSQDDLLHAFTSLPRDLNFINYTNDTAKNEIHKINQIVVDPSLHLQKSSHLYYAVETRTTPDAFKIFGGSPWLILTRAFMEYCVQGWDNLPRKLLMYFSNTASPLESYFHSVLCNSPEFQNTTVSNDLRYNILETTTDGESPYDKMLNGGAAFARPFKEDAAALNMIDENVLNREPNGLVPGKWCLDQGLNKSSEASKPPGEDLCSTWGNINDVKPGSYGIKLAFLLSKIAGEEKLTTSQCLQATQMGSS

SEQ ID NO: 1429 - DNA, 1323 bp, Sorghum bicolor
  misc_feature (1)..(1323): Ceres Annot ID no. 8743317
  misc_feature (1)..(1323): Encodes the peptide sequence at SEQ ID NO. 1430
atgctagaggcgaagccgccgtcgccgggctccggcgcggccggggcggcggcggcgcacatccacagtcaccggcggtgggcggcgccgctgctggcctcggtcctgctctcgtcgctcctcatctccgcgtcgctcttcttctcctcctcccgcgcgctgctcctctccttctcgccgctcccttccgcggcctccgccgagcctctcttcgtcgaggccaagctccgccagcagatgcgcgccgaggagcgccccgcgaggggcgccgtgcccaggatcgcctacctcatctccggctccgcgggggacggagccgcgctgcgccggacgctcagggcgctctaccacccggccaacacgtacgtcgtgcacctcgacctcgaggcccccgccgccgagcgcgccgagctcgccgcggccgtccgcgcggacaccgtctacgcaaggttccgcaacgtcaaggtcgtcacacgggccaacctcgtcacctaccgtggcccgaccatggtggccaacacgctgcacgcggctgccatcctgctgcgcgagggcggtgattgggactggttcatcaacctctccgcctccgactatccgctcgtcacccaggacgatctgttgcatgtgctctccgagttgcccaggcagcttaacttcattgagcataccagtgacatcggatggaaggagtaccagagggcgaagccagtgatcatcgaccctgggctatacagcctgcagaagtctgacgttttctggataacagagaaaaggagtgtaccaactgcgttcaagctattcactggctcagcatggatgatgcttacccatcagtttattgaatactgcatatggggatgggacaatctcccaaggacagtcttgatgtattacgccaattttctttcttcaccagaaggttacttccacacagtcatctgcaatgtccccgagttccggaacaccacagtcaaccatgatctacatttcatttcttgggacaacccaccaaagcaacaccctcattatctcacacttgctgactatgatggtatggttaacagtaacgcaccctttgcaaggaagtttggaagagaagatcctgtgctggacaagattgaccaggaactattgggccgccaacctgatggatttgtgcctggtggatggacagatgtactgaatacaactgagaaagggaaacccttcactgttgagcgtgtgcaagatctccgcccagggcctggtgtggacagattaaagaaacttgtcacaggcttgctcacacaagaaggttttgatgacaagcattgcttgtga

SEQ ID NO: 1430 - protein, 440 aa, Sorghum bicolor
  misc_feature (94)..(319): Pfam Name: Branch Pfam Description: Core-2/I-Branching enzyme
  misc_feature (1)..(440): Ceres Annot ID no. 8743317
  misc_feature (1)..(440): Bit score of 750.4 for HMM based on sequences of Figure 8
  misc_feature (1)..(440): Functional Homolog Of SEQ ID NO. 1366
MLEAKPPSPGSGAAGAAAAHIHSHRRWAAPLLASVLLSSLLISASLFFSSSRALLLSFSPLPSAASAEPLFVEAKLRQQMRAEERPARGAVPRIAYLISGSAGDGAALRRTLRALYHPANTYVVHLDLEAPAAERAELAAAVRADTVYARFRNVKVVTRANLVTYRGPTMVANTLHAAAILLREGGDWDWFINLSASDYPLVTQDDLLHVLSELPRQLNFIEHTSDIGWKEYQRAKPVIIDPGLYSLQKSDVFWITEKRSVPTAFKLFTGSAWMMLTHQFIEYCIWGWDNLPRTVLMYYANFLSSPEGYFHTVICNVPEFRNTTVNHDLHFISWDNPPKQHPHYLTLADYDGMVNSNAPFARKFGREDPVLDKIDQELLGRQPDGFVPGGWTDVLNTTEKGKPFTVERVQDLRPGPGVDRLKKLVTGLLTQEGFDDKHCL

SEQ ID NO: 1431 - DNA, 1329 bp, Populus balsamifera subsp. trichocarpa
  misc_feature (1)..(1329): Ceres Annot ID no. 1523979
  misc_feature (1)..(1329): Encodes the peptide sequence at SEQ ID NO. 1432
atgtctatcaaaaaggcattggtgagtatgaggaagaatggaagttcccactcgggaaggttgttcagtgatagaaaatggcttatcccattctttgcaagcttgctagtgttcttaactctgttttcatcggctacttttggggtgtttacatcttcttttggaggagagcaggtgccatttgacattgtttcgtattcaagaccggaggactcaagtgggtatttcgtagaatcggatttaaagaaatggtttgatagaagtaggtattcagaattggaaccgcctagattagcttatctcatttcaggtacgaagggtgatagtcaaagaatgatgaggactttgcaggctgtgtatcatcctagaaatcagtatattctacatttggatcttgaggcacccccacgagaaaggttgatgttgggagggtatgtgaagaatgatccaacgtttcaagaagttgggaatgtgcgtgtaatggcacagtccaacttggtgacttataaagggcctacaatgtttgcctgtacccttcaagcaattgcaatcatgttgagggagagtttagagtgggactggtttatcaatctcagcgcttcagattatcctcttgtgacacaagatgatttgctccatgtgttctcaaatttgtctagaaaccttaatttcattgaacatacacagctaactggatggaaattgaactccagggcaaaaccgattattgttgatccaggcctttactcatcaaagaaatctgacctttattttaccactcaacgcagatcacttccctcatctttcaagttgtttactggttcagcatgggtaatgctgacacgatcgtttctcgaatactgtataatgggatgggagaaccttccacgaactatcctaatgtactacacaaatttcatctcctctcctgaaggatatttccacactgttatttgcaatactgaagaattccaaaacacagccataggtcatgatctccactacatagcctgggacagtcctcctaagcaacaccctatctctttgacaatgaaagactttgataaaatggttaaaagcaatgccccatttgcccggaaatttgcaagggatgatccagttctagacaagattgataaagagattctaaaccgcacgggcaggtttgctcctggagcatggtgtattggcggcgcagacaatggatctgatccatgctccatacccggtaattattcagtatttagaccaggtcctggtgctcagaggttacaagaactgctccagacattattgtccgaagattttcgaaaaaaacagtgttcatga

SEQ ID NO: 1432 - protein, 433 aa, Populus balsamifera subsp. trichocarpa
  misc_feature (89)..(314): Pfam Name: Branch Pfam Description: Core-2/I-Branching enzyme
  misc_feature (1)..(433): Ceres Annot ID no. 1523979
  misc_feature (1)..(433): Bit score of 712.0 for HMM based on sequences of Figure 8
  misc_feature (1)..(433): Functional Homolog Of SEQ ID NO. 1366
MRKNGSSHSGRLFSDRKWLIPFFASLLVFLTLFSSATFGVFTSSFGGEQVPFDIVSYSRPEDSSGYFVESDLKKWFDRSRYSELEPPRLAYLISGTKGDSQRMMRTLQAVYHPRNQYILHLDLEAPPRERLMLGGYVKNDPTFQEVGNVRVMAQSNLVTYKGPTMFACTLQAIAIMLRESLEWDWFINLSASDYPLVTQDDLLHVFSNLSRNLNFIEHTQLTGWKLNSRAKPIIVDPGLYSSKKSDLYFTTQRRSLPSSFKLFTGSAWVMLTRSFLEYCIMGWENLPRTILMYYTNFISSPEGYFHTVICNTEEFQNTAIGHDLHYIAWDSPPKQHPISLTMKDFDKMVKSNAPFARKFARDDPVLDKIDKEILNRTGRFAPGAWCIGGADNGSDPCSIPGNYSVFRPGPGAQRLQELLQTLLSEDFRKKQCS

SEQ ID NO: 1433 - protein, 432 aa, Vitis vinifera
  misc_feature (86)..(311): Pfam Name: Branch Pfam Description: Core-2/I-Branching enzyme
  misc_feature (1)..(432): Public GI ID no. 225433389
  misc_feature (1)..(432): Bit score of 606.9 for HMM based on sequences of Figure 8
  misc_feature (1)..(432): Functional Homolog Of SEQ ID NO. 1366
MQNSHQPPFPISGTTAAALTKDNRSFYLIIATSFVSLLFILSLSATSPPAPSAPATDPYLFPTSHHRHPIFLNPNPSDSTPTPPSLAYFISGSAGDSHKILRLLFAAYHPRNHYLLHLDLTAPQSDRDRLALAVQSVPVFRAARNVNVMGKADFAYGKGSSSISSTLHGASILLRLSSSWDWFINLSASDYPLVTQDDLLHILSFVPRDLNFVNHTSYIGWRESRKLKPIIVDPGLYLTQKTEIFYATQKRGLPNSFQLFTGSSSAILNRAFIEFCIVGTDNLPRTLLMYLANTPSSLPNYFPTILCNSRQFNKTIVNHNLQYASFDKPAKEEPRRLGSKDFDDMIQSGAAFATQFRLNDVALDRIDQEILGRSPGKILPGGWCLGEAGNDTCSVWGDADVLRPGPGAKRLEKRIAELLSDGTFQAHQCIVE

SEQ ID NO: 1434 - protein, 449 aa, Oryza sativa subsp. japonica
  misc_feature (81)..(311): Pfam Name: Branch Pfam Description: Core-2/I-Branching enzyme
  misc_feature (1)..(449): Public GI ID no. 115454715
  misc_feature (1)..(449): Bit score of 767.2 for HMM based on sequences of Figure 8
  misc_feature (1)..(449): Functional Homolog Of SEQ ID NO. 1366
MDTHAVPRAAATVDLRWLLSVAAGAVFALLLLLAASPPFPLRPASLFTTTSPRRALPPLFVESSSTLSAPPPTPPPSPPRFAYLISGSAGDAPMMRRCLLALYHPRNSYILHLDAEAPDDDRAGLAAFVAAHPALSAAANVRVIRKANLVTYRGPTMVTTTLHAAAAFLWGRGGGRGADWDWFINLSASDYPLVTQDDLMHVFSKLPRDLNFIDHTSDIGWKAFARAMPMIVDPALYMKTKGELFWIPERRSLPTAFKLFTGSAWMVLSRPFVEYLIWGWDNLPRTVLMYYANFISSPEGYFHTVACNAGEFRNTTVNSDLHFISWDNPPMQHPHYLADADWGPMLASGAPFARKFRRDDSVLDRIDADLLSRRPGMVAPGAWCGAAAAADGDSNSTTTGGAVDPCGVAGGGGEAVRPGPGAERLQRLVASLLSEENFRPRQCKVVEAN

SEQ ID NO: 1435 - protein, 502 aa, Vitis vinifera
  misc_feature (155)..(380): Pfam Name: Branch Pfam Description: Core-2/I-Branching enzyme
  misc_feature (1)..(502): Public GI ID no. 157344331
  misc_feature (1)..(502): Bit score of 549.2 for HMM based on sequences of Figure 8
  misc_feature (1)..(502): Functional Homolog Of SEQ ID NO. 1366
MATKATPKMSLKLLINKKDDKVVFAEAEYDFIDFLFNLLTLPIGTIVSLLPKENCLRNLHKSINKLEEAYLLPNQSVDSLLKMNTPVDAILHFFDLPLSSSDRHVKDGLVTYMVADDLSVTPMSMTSTMALFKKYNIQEVDVLEEKVVSIEFVGLAYFISGTHGDSPRLLRLLRALYHPNNQYLLHLDRRATPQERVELSASVGSVAVFAAAENVNVVGSADAVNLDGSTPIASLLRGAAIFLRYCSDWDWFVNLEASDYPLISQDDLLHILSFVPRDFNFIEHTSNIGWNEYQRIIQIVVDPGLYLASKRGIFLGTKRRVLPRQFRFFTGSPQVILSRKLVEFSILGWDNFPRTLLLFFANIKSSHRGYFQTLACNAREFSNTVMNSNLRYMAWDNPPGKEPRNPRVSDVKKMLGSGAAFAGNFAPNDHEVLDLIDSVVLHRRKGMISPGGWCVGRRDRGRDPCQHWGDTNILRPGHAAERFEKLLLRVMANSTLRSNQCR

SEQ ID NO: 1436 - protein, 418 aa, Vitis vinifera
  misc_feature (71)..(296): Pfam Name: Branch Pfam Description: Core-2/I-Branching enzyme
  misc_feature (1)..(418): Public GI ID no. 157342943
  misc_feature (1)..(418): Bit score of 739.3 for HMM based on sequences of Figure 8
  misc_feature (1)..(418): Functional Homolog Of SEQ ID NO. 1366
MENKPQHKKKKWFLPLVFSLLVFSFLVVLAIFTSTSTSPFHRQPIKVQNPVFVESKLGLASASSANSVPRIAYLISGSKGDGLSLRRTLKALYHPWNQYAVHLDLKASPEERLELLNFVKNESVFSRWGNVRVIVRANLVTYRGPTMVSNTLHAAAILMKEGGDWDWFINLSASDYPLVTQDDLLHTLSTIPRDLNFIEHTSDIGWKEYQRAKPLIIDPGLYSLKKTDVFWATETRSVPTAYRLFTGSAWMMLSRSFVEYTLWGWDNLPRIVLMYYANFLSSPEGYFHTVICNAEEFRNTTVNHDLHFISWDNPPKQHPHFLTVDNYQSMIGSNAPFARKFGRNEPVLDKIDKELLGRSADGFVPGGWFNNEGNTNITAPHDIIANVSILRPGPGAERLNRLITGLLSAEDFQRNQCA

SEQ ID NO: 1437 - DNA, 1412 bp, Triticum aestivum
  misc_feature (1)..(1412): Ceres Clone ID no. 1018703
  misc_feature (1)..(1412): Encodes the peptide sequence at SEQ ID NO. 1438
acacccatgtcgatgtcgtcctccatggaccacgccggcccctccgtgtccgtcctgcgctggctgctctccgtcgccgccgggggcctcttcgcgctcttcctcctcgtcgcctcgccggtccccttcccctccgcctcgctcttcctcgccccgacctccccggcctcctcctccacgcgcgcctccaagaacctcttcgtcgaccaggcgctctcggtgcaggcccgcgcgccgcccgcctcgccgccgcgcttcgcgtacctgatctccggctcggcgggggacgccgggatgctgcgccgctgcctgctggcgctgtaccacccgaggaaccactacatcctgcacctggacgcggaggcgcccgactcggaccgcgcggcgctggcggcgttcgtggcgtcccacccggtcctcgccgcggcgcgcaacgtgcgcgtcgtggagaaggcgaacctggtcacctaccgcggccccaccatggtgaccaccacgctgcacgccgccgccgcgttcctctggggcgagggccgcggcaaaggcgccgactgggactggttcatcaacctctccgcctccgactacccgctcgtcacgcaggacgatatgatggaggtgttctcggagctgccgcgcgacctcaacttcctcgaccacaccagcgacatcggctggaaagcgttcgcgagggcgatgccggtgatcatcgacccggcgctctacatgaagaagaagggcgatctcttctggatccctcagaagcgggagctgcccaccgccttcaagctcttcaccggttccgcgtggatggtgctgtcgaggccgttcgtggagtacctgatctgggggtgggacaacctgccgcgcacggtgctcatgtactacgccaacttcatctcgtccccggagggctacttccacaccgtggcctgcaacgccgacgagttccgcaacaccaccgtcaaccacgacctgcactacatcgcgtgggacaaccccccgatgcagcacccgcacctgctcaccctcgccgactgggacggcatgctcgccagcgccgcccccttcgcgcgcaagttccgccgggacgaccccgtcctcgacaggatcgacgccgacctcctctcgcgggcgcccggaatgctcgccccgggcggctggtgcgtcggggaggtgccggctgccggtgccaaccgcactggcggcgacgacccgtgcgccgttgtcgggaacgcggcgtatgttcggcctggcccgggggctgcgcggctgaagcggctcgttacgtcgctcctgtcggaggagaacttccggccgaaacagtgcaaagtagcagtagtagaacaacatattcccgccaaaaaagtagaagaacatattccctcggaaaaggtagaagaccatcactg

SEQ ID NO: 1438 - protein, 468 aa, Triticum aestivum
  misc_feature (84)..(314): Pfam Name: Branch Pfam Description: Core-2/I-Branching enzyme
  misc_feature (1)..(468): Ceres Clone ID no. 1018703
  misc_feature (1)..(468): Bit score of 792.9 for HMM based on sequences of Figure 8
  misc_feature (1)..(468): Functional Homolog Of SEQ ID NO. 1366
MSMSSSMDHAGPSVSVLRWLLSVAAGGLFALFLLVASPVPFPSASLFLAPTSPASSSTRASKNLFVDQALSVQARAPPASPPRFAYLISGSAGDAGMLRRCLLALYHPRNHYILHLDAEAPDSDRAALAAFVASHPVLAAARNVRVVEKANLVTYRGPTMVTTTLHAAAAFLWGEGRGKGADWDWFINLSASDYPLVTQDDMMEVFSELPRDLNFLDHTSDIGWKAFARAMPVIIDPALYMKKKGDLFWIPQKRELPTAFKLFTGSAWMVLSRPFVEYLIWGWDNLPRTVLMYYANFISSPEGYFHTVACNADEFRNTTVNHDLHYIAWDNPPMQHPHLLTLADWDGMLASAAPFARKFRRDDPVLDRIDADLLSRAPGMLAPGGWCVGEVPAAGANRTGGDDPCAVVGNAAYVRPGPGAARLKRLVTSLLSEENFRPKQCKVAVVEQHIPAKKVEEHIPSEKVEDHH

SEQ ID NO: 1439 - DNA, 1485 bp, Sorghum bicolor
  misc_feature (1)..(1485): Ceres Annot ID no. 8643189
  misc_feature (1)..(1485): Encodes the peptide sequence at SEQ ID NO. 1440
atggcgctgcattgcaactttgcttgcaagcagctgctggctggtcttctccaacaacaagacctaaaagacaacactatctggaaatgggtctcgagaagagaggatatccaaatttgggttatgcctctcctgatacctaaaatgggtcttctgtatggtactctgttggaggctataggccgcagagcagagcgccgcagctcagaatttcccctctccccccatgcaatgcaatccgccgcggcggccgcgccctccgccctgccgcacagcgtcttccccaaggactcccgcccgctcccgtgcctcctcctcacttccctgctgctgctgctgaccctccacctcctctcctcctcctcccccgccccctcgccgcctccaccacaacagccccgcctcgcgccgctcccgtccgcagcctccgcggggccggccccgccctcgctcgcgttcctcctcacgggatccgcgggcgacgccgaccgcctccagcggctgctcctcgctacctaccacccccgcaacgtctacctcctcctgctcgaccgcgccgcctccgcggacgaccgcgcacggctcgctcgcagtgcgcggtctgctcccggacgcgacaacgtccatgtcgtcggggaccccgggttcgccaacccgcgcggggcctccgccctcgccgccactttgcacggcgccgcgctgctgctgagggtcgaccagggctgggactggttcctgcacctcgacgccgatgagtacccgctcgtgacacccgatgacctcctgcatgttttttcatacctaccgaaggatctcaacttcattcagcatactagctatattggttggaaggaggaaagacaaataaggccaatcatcgttgatcctggtctatatctatcatccaggaatgacattttttatgctacccaaaagcgtgatctaccaaatgcttataaactgtttacaggctcttcgtctgttatcctttctcggaaattcattgaatattgtattgttggtatggataatctgccaagaactctcctgatgtactacactaacatgcccttgccacacaggaagtattttcagacagttctttgcaactcccctgaattcaacgagactgcagttaaccatgacctgcactattcaacatgggatgctcgttccaaaaacgagccacgcctactgactatagatgacctagaaaatatgaccgatagtggtgcagcctttgggactagatttccgaaagatgatcatgtgcttgatcacattgatgccgaaattttacaccgccttcctggagatccagttacaggaggatggtgcataggtgttgggcatgacagtccatgcgacatttcaggtaacccagatgttcttagacctgggcctaaagctgtaaaacttgctaagttccttgctgaaaggctgtcatatcagaacttttatggccatcaatgtatatgggattga

SEQ ID NO: 1440 - protein, 494 aa, Sorghum bicolor
  misc_feature (151)..(373): Pfam Name: Branch Pfam Description: Core-2/I-Branching enzyme
  misc_feature (1)..(494): Ceres Annot ID no. 8643189
  misc_feature (1)..(494): Bit score of 567.2 for HMM based on sequences of Figure 8
  misc_feature (1)..(494): Functional Homolog Of SEQ ID NO. 1366
MALHCNFACKQLLAGLLQQQDLKDNTIWKWVSRREDIQIWVMPLLIPKMGLLYGTLLEAIGRRAERRSSEFPLSPHAMQSAAAAAPSALPHSVFPKDSRPLPCLLLTSLLLLLTLHLLSSSSPAPSPPPPQQPRLAPLPSAASAGPAPPSLAFLLTGSAGDADRLQRLLLATYHPRNVYLLLLDRAASADDRARLARSARSAPGRDNVHVVGDPGFANPRGASALAATLHGAALLLRVDQGWDWFLHLDADEYPLVTPDDLLHVFSYLPKDLNFIQHTSYIGWKEERQIRPIIVDPGLYLSSRNDIFYATQKRDLPNAYKLFTGSSSVILSRKFIEYCIVGMDNLPRTLLMYYTNMPLPHRKYFQTVLCNSPEFNETAVNHDLHYSTWDARSKNEPRLLTIDDLENMTDSGAAFGTRFPKDDHVLDHIDAEILHRLPGDPVTGGWCIGVGHDSPCDISGNPDVLRPGPKAVKLAKFLAERLSYQNFYGHQCIWD

SEQ ID NO: 1441 - DNA, 1856 bp, Panicum virgatum
  misc_feature (1)..(1856): Ceres Clone ID no. 1888533
  misc_feature (1)..(1856): Encodes the peptide sequence at SEQ ID NO. 1442
gctgattgctggctcagcgaactcttcttccgaatccttcctccctacagcgcggcgcaaccgcgctccggcacttcgtggcttcgtgctccccctctctcacgcgcgcggacgcgccatgacgtcagggctccgagctcacgcgggcacgatccataaagccgcgacccagcattccgggcctctccccgccccggcccccgacgaccgccagcctccggcacgaccggccatggagtccgccgcctgccccgcgcgcgccgccgcgtccgtcgacctccgctggctgctctcggtggccgcgggggggctcttcgcgctgctcctcctgctcgccgcctccccgttccagctcccctcctcctcccgcctcttcctctccccagcctcctcctccacccagcagcgcccgccgccgccgctctacgtcgagtccacgctctcccgcgcggcgccccccgccgcctccctcccgccgcgcttcgcgtacctcatctccggctcggcgggggacgccggcatgatgcgccgctgcctgctcgcgctctaccacccccggaaccgctacatcctccacctcgacgcggaggcgcccgacgccgaccgcgcggggctcgccgccttcgtcgcggcgcacccggtcctgtccgccgccgggaacgtcagggtgatcgagaaggccaacctcgtcacctacaggggccccaccatggtgaccaccacgctgcacgccgccgcggcgttcctgtggggcgagggccacggccgcggcgccgactgggactggttcatcaacctctccgcctccgactaccctctcgtcacgcaggacgatttgatgcacgtcttctcgaagctgccgcgcgacctcaacttcatcgatcacacgagcaacatcagctggaaagcgttcgcgagggcgatgccggtgatcatagacccggcgctgtacatgaagacgaagggcgacctgttctgggtgccggagaagcggagcttgccgacggccttcaagctcttcactggttctgcgtggatggtgctgtcgcgtgcgttcgtggagtacctgatctgggggtgggacaacctgccgcgcacggtgctcatgtactacgccaacttcatctcctcgccggagggctacttccacacggtggcctgcaacgcggcggcgttccgcaacaccaccgtcaacagcgacctacacttcatctcctgggacaacccgccgatgcagcacccgcaccacctcaccctcgccgactgggaccggatgctcgccagcggcgcgcccttcgcgcgcaagttcccccgggacgaccccgtgctcgaccggatcgacgccgacgtcctcggccggcggccgggcgccgccggcacggtcgcgccgggcgggtggtgcgctgctggtggcggggagggcgacgggagcggcgccggcggcgacccgtgcgcggcggtcggcgacgcggcggccctgaggcccgggcccggggccgagcggctgcagcggctcgtgacgtcgctgctgtcgtcggagaacttccggccgaggcagtgcgtcgtggaagaggagaactgatgatgagctggtggtatggacgtatggtgctccgccgatccgttctggcaggcgttccagcatggcgcctggcaatgctggggttgtgccagtgtcacggcaaacgcacggcatgtagatgatacctgaagatgcatgcatggtacatgatgctaggtgccggctatcgatccatccttctcttggatacatatatatacatgtcagtatgcataaaaaggggacgaaatgtgtgccctcatatatgatattgataatacctattcgttcttct

SEQ ID NO: 1442 - protein, 487 aa, Panicum virgatum
  misc_feature (122)..(352): Pfam Name: Branch Pfam Description: Core-2/I-Branching enzyme
  misc_feature (1)..(487): Ceres Clone ID no. 1888533
  misc_feature (1)..(487): Bit score of 790.3 for HMM based on sequences of Figure 8
  misc_feature (1)..(487): Functional Homolog Of SEQ ID NO. 1366
MTSGLRAHAGTIHKAATQHSGPLPAPAPDDRQPPARPAMESAACPARAAASVDLRWLLSVAAGGLFALLLLLAASPFQLPSSSRLFLSPASSSTQQRPPPPLYVESTLSRAAPPAASLPPRFAYLISGSAGDAGMMRRCLLALYHPRNRYILHLDAEAPDADRAGLAAFVAAHPVLSAAGNVRVIEKANLVTYRGPTMVTTTLHAAAAFLWGEGHGRGADWDWFINLSASDYPLVTQDDLMHVFSKLPRDLNFIDHTSNISWKAFARAMPVIIDPALYMKTKGDLFWVPEKRSLPTAFKLFTGSAWMVLSRAFVEYLIWGWDNLPRTVLMYYANFISSPEGYFHTVACNAAAFRNTTVNSDLHFISWDNPPMQHPHHLTLADWDRMLASGAPFARKFPRDDPVLDRIDADVLGRRPGAAGTVAPGGWCAAGGGEGDGSGAGGDPCAAVGDAAALRPGPGAERLQRLVTSLLSSENFRPRQCVVEEEN

SEQ ID NO: 1443 - protein, 442 aa, Populus balsamifera subsp. trichocarpa
  misc_feature (98)..(323): Pfam Name: Branch Pfam Description: Core-2/I-Branching enzyme
  misc_feature (1)..(442): Public GI ID no. 118485429
  misc_feature (1)..(442): Bit score of 701.2 for HMM based on sequences of Figure 8
  misc_feature (1)..(442): Functional Homolog Of SEQ ID NO. 1366
MSIKKAFVSMRKNGNSHPGRLFGDRRWLIPFFTSLLVFLILFSSATFGVFTSSYGVEKVPFDTVSYKRPENSNGYFVESDLKKWFNRSRYSELEPPRLAYLISGTKGDSQRMMRTLQAVYHPRNQYILHLDLEAPPRERLMLGVYVKSDLTFQEVGNVRVMAQSNLVTYKGPTMIACTLQAIAIMLRESLEWDWFINLSASDYPLVTQDDLLHVFSNLSRNLNFIEHTRLTGWKMNSRAKPIAIDPGLYLSKKSDLSLTTQRRSLPTSFKLFTGSAWIMLTRSFLEYCIMGWENLPRTILMYYTNFVSSPEGYFHTVICNTEEFQDTAIGHDLHYIAWDNPPRQHPLSLTMKDFDKMVKSNAPFARKFARDDPVLDKIDKEILNRTSRFAPGAWCIGSSGNGSDPCSVRGNYSQFRPGPGAERLQELLQSLLSEDFRKKQCS

SEQ ID NO: 1444 - protein, 408 aa, Musa balbisiana
  misc_feature (67)..(292): Pfam Name: Branch Pfam Description: Core-2/I-Branching enzyme
  misc_feature (1)..(408): Public GI ID no. 102139993
  misc_feature (1)..(408): Bit score of 684.6 for HMM based on sequences of Figure 8
  misc_feature (1)..(408): Functional Homolog Of SEQ ID NO. 1366
MWPLLLCSIVVIVLAVTSSNMSIISSFQTMFLIFPTVPSANRTGPAFVESQLASAAPPPVGSRIPRLAYLISGSKGDLDRLWRTLRALYHPRNIYVVHLDLESPASERLELALRVANDTVLSTVGNVHVVEKANMVTYRGPTMVASTLHACAILLKESKEWDWFINLSASDYPLVTQDDILHVFSSLPRNISFVEHTSRLGWKEGQRAKPLMVDPGLYMTRKTDVFWVSQKREVPTAFKLFTGSAWVALTREFAEFCVWGWDNLPRILLMYYTNFVSSPEGYFQTVICNAPEFSVTVANHDLHYISWDVPPKQHPHTLSMDDLPKMIGSNAPFARKFKRDDPVLDQIDAELLGRAKGSFVPGGWCAGAPLCTEIGDPTRLQPGPGAERLAALMDVIVRSKKFTQNQCR

SEQ ID NO: 1445 - DNA, 1698 bp, Arabidopsis thaliana
  misc_feature (1)..(1698): Ceres Annot ID no. 863010
  misc_feature (1)..(1698): Encodes the peptide sequence at SEQ ID NO. 1446
gctttcgcctttggattgttgattccctagtggatgttctttatctctttaaaaaggtcctctcttttaaatcaatttttgctgaacttgcccaattcggaaactttgttgcaagtctcctcttggtctctggtaatcgttttcgcatcaatccttatattgatttgaatctgtaatcagattcgatctttgatgctaatttggtattctatagaagacaacatatctgaattgggtttcttcgttggataggataagtggttagggaatgagaaaattgtataggaagctggtttcattcagagacccatttgctagggtcaagagacatgttagttcacattcagggtttagagctttcagcgacagaaaatggttgttcccttttctagctagcttgatcatgtccattactcttctgattttgttaatttctggccaattcgacaacttctttggggaagaagatcaattaccagttgatgttgtttcagagtctaatgactactttgtagaatcagatttcaagcaatctatgaattcgacggctgatgttaatccagagcctcctagattagcttatttaatatcgggaacaaaaggcgatagtcataggatgatgaggactttacaagctgtgtaccatcctagaaaccagtatgttctgcatttggatcttgaggctccacctcgagaacggatggagctggccatgtccgtgaagactgatccgactttccgtgaaatggagaatgttcgtgtgatggctcagtctaatcttgttacttataaaggccctacaatgattgcttgtactcttcaagccgtttcaatcttgctaagagaaagcttacattgggattggtttcttaaccttagtgcctcggattatcctctagtaacacaagatgatttgttgtatgtcttctcaaatctgtctcggaatgtcaatttcatcgagaatatgcagctcaccggatggaaactgaatcagagggctaaatcaatcattgttgatcctgccctatacctatcgaagaaatccgatatcgcttggactactcaacggcgatcacttccaaattctttcaggctattcactggctcagcttggataatgttgactcggtctttcctcgagtactgcatttggggatgggataatttcccaagaacaatactaatgtactacacaaatttcgtatcttctcctgaaggatacttccacacagtaatctgcaacagcaaagagtttatcaacactgcaatcggtcacgaccttcactacattgcttgggacagtcctccaaagcaacaccctagatctctctcgttgaaggattttgacaatatggtcaagagcaaagctccatttgcacgcaagttccacaaaaacgatcctgcgttagacaagatcgataaagagctattgggacggacacaccggtttgcaccaggaggatggtgtgtcgggagttcagctaatggcaatgatcagtgctctgtgcaaggtgacgactcggtgttgaaaccaggacctggttctgagaggttgcaggagcttgttcaaacactttcctctgaagaatttaggcgaaaacagtgttcttgaagttatctactgatgacgcaaaatataacgttgtacagtatattgttttgtttgattataaatttttggttatagaaatttcttcg

SEQ ID NO: 1446 - protein, 447 aa, Arabidopsis thaliana
  misc_feature (103)..(328): Pfam Name: Branch Pfam Description: Core-2/I-Branching enzyme
  misc_feature (1)..(447): Ceres Annot ID no. 863010
  misc_feature (1)..(447): Bit score of 694.6 for HMM based on sequences of Figure 8
  misc_feature (1)..(447): Functional Homolog Of SEQ ID NO. 1366
MRKLYRKLVSFRDPFARVKRHVSSHSGFRAFSDRKWLFPFLASLIMSITLLILLISGQFDNFFGEEDQLPVDVVSESNDYFVESDFKQSMNSTADVNPEPPRLAYLISGTKGDSHRMMRTLQAVYHPRNQYVLHLDLEAPPRERMELAMSVKTDPTFREMENVRVMAQSNLVTYKGPTMIACTLQAVSILLRESLHWDWFLNLSASDYPLVTQDDLLYVFSNLSRNVNFIENMQLTGWKLNQRAKSIIVDPALYLSKKSDIAWTTQRRSLPNSFRLFTGSAWIMLTRSFLEYCIWGWDNFPRTILMYYTNFVSSPEGYFHTVICNSKEFINTAIGHDLHYIAWDSPPKQHPRSLSLKDFDNMVKSKAPFARKFHKNDPALDKIDKELLGRTHRFAPGGWCVGSSANGNDQCSVQGDDSVLKPGPGSERLQELVQTLSSEEFRRKQCS

SEQ ID NO: 1447 - protein, 466 aa, Oryza sativa subsp. japonica
  misc_feature (103)..(328): Pfam Name: Branch Pfam Description: Core-2/I-Branching enzyme
  misc_feature (1)..(466): Public GI ID no. 115474761
  misc_feature (1)..(466): Bit score of 669.6 for HMM based on sequences of Figure 8
  misc_feature (1)..(466): Functional Homolog Of SEQ ID NO. 1366
MRKSWGLGRPSGDRRWLLPFAASLLVSATLFLAAACGLFSPPSLADGDDDSILIDVATWDTASAAESEIKNRLLDSNSDSDDGDNPDDAAVNSDASSADPPRIAYLLEGTKGDGARMRRALQAIYHPRNQYILHLDLEAPPRERIDLAMYVKGDAMFSEVGNVRVIAKGNLVTYKGPTMVACTLHAVSILLKEGLEWDWFINLSASDYPLVTQDDILHVFSSLPRNLNFIEHMQLSGWKVISRAKPIVVDPGLYLSKKFDLTMTTERRELPTSFKLYTGSAWIMLTKTFLEYCIWGWDNLPRTLLMYYVNFISSPEGYFHTVICNSDEFRGTAVGHDLHYIAWDYPPKQHPNMLSMKDFNKMVKSGAPFARKFPKDDKVLDKIDRELLHRSEGQFTPGAWCDGSSEGGADPCSSRGEDSVFEPSPGAERLRGLMKKVLSWDYRNGSCSSLGYDQTKRDWYVPKGRG

SEQ ID NO: 1448 - DNA, 1287 bp, Populus balsamifera subsp. trichocarpa
  misc_feature (1)..(1287): Ceres Annot ID no. 1438095
  misc_feature (1)..(1287): Encodes the peptide sequence at SEQ ID NO. 1449
atgcaaatcccacaacaaccaccaccaccgccctcctcctcctccacaaatgacaacaccaaaaccacactcttcatcatcctaaccacctcctttttctccctccttttcatcttcaccctctcctcttactccttcaacacctcctccttatccacccatggccggcccgacccgtatctcttcccaaaccgccaacccactttcacaaaaatcccttctgatccaaccccaccctctatcgcctacttgatatccgggtccaagggtgatttggatcgggtccttaggcttttatatgccacttaccacccgaaaaaccaatacttgctccacctggacctctctgctccacaaaccgatcgtgatcaattagctcttagtgtccaatcagtgcctatttttaaagctgcacagaatgtgaatgtgatcgggaaggctgattttgcttacccaaaagggtcttctaccatttcagccacacttcatggcgctgctatattgttgaggttgccaaagaaatgggattggtttgttaatcttggtgctgctgattatccacttgttactccagatgatcttcttcacattttatcatatttgcctaaagatctcaactttgtcaatcactcgagttacattggctggagagagtctagacaattgaagccaataattgttgatccggggctttacttgtcggagaaatctgagatgttttatgctactcaaaagcgagatttgcctaattctttcaggctatttacaggaacttctttttcctttgctagtcgtaatttgatagagcactgcatcttgggtgtggacaaccttccgaggatcctaatgatgtatttatcaaatacaccttcatccctaatcaattatttcccaacagtcatatgcaattctcgtcagttcaataggactgtcataaaccataacttacaatatgtagcctttgagaagccttctaagaaggtgccccgcgcacttaattctagtgaatttgatgcaatgattcagagtggagcagcctttgccactcaattcaagttagatgatcctgtacttgatcgcattgaccaagatgttttgggacgaaatcctggtgaagtggtgcctggtggttggtgcttgggtggtgagcctggaaatataacatgctcagcttggggtgatgctgatattctgaggcctggcactggagcagcaagacttgaaaaactaattgttagattgctgtcgaatggtgaatttcactctcgtcaatgtatagttgaatga

SEQ ID NO: 1449 - protein, 428 aa, Populus balsamifera subsp. trichocarpa
  misc_feature (81)..(306): Pfam Name: Branch Pfam Description: Core-2/I-Branching enzyme
  misc_feature (1)..(428): Ceres Annot ID no. 1438095
  misc_feature (1)..(428): Bit score of 561.4 for HMM based on sequences of Figure 8
  misc_feature (1)..(428): Functional Homolog Of SEQ ID NO. 1366
MQIPQQPPPPPSSSSTNDNTKTTLFIILTTSFFSLLFIFTLSSYSFNTSSLSTHGRPDPYLFPNRQPTFTKIPSDPTPPSIAYLISGSKGDLDRVLRLLYATYHPKNQYLLHLDLSAPQTDRDQLALSVQSVPIFKAAQNVNVIGKADFAYPKGSSTISATLHGAAILLRLPKKWDWFVNLGAADYPLVTPDDLLHILSYLPKDLNFVNHSSYIGWRESRQLKPIIVDPGLYLSEKSEMFYATQKRDLPNSFRLFTGTSFSFASRNLIEHCILGVDNLPRILMMYLSNTPSSLINYFPTVICNSRQFNRTVINHNLQYVAFEKPSKKVPRALNSSEFDAMIQSGAAFATQFKLDDPVLDRIDQDVLGRNPGEVVPGGWCLGGEPGNITCSAWGDADILRPGTGAARLEKLIVRLLSNGEFHSRQCIVE

SEQ ID NO: 1450 - protein, 424 aa, Oryza sativa subsp. japonica
  misc_feature (63)..(311): Pfam Name: Branch Pfam Description: Core-2/I-Branching enzyme
  misc_feature (1)..(424): Public GI ID no. 70663986
  misc_feature (1)..(424): Bit score of 572.1 for HMM based on sequences of Figure 8
  misc_feature (1)..(424): Functional Homolog Of SEQ ID NO. 1366
MRPPARSPPRLAAAAAALATSAALLLICGTWPASASGFGAYTASSSARRASSTGGADAPPPSFAYLISGTGGEAARVVRLLRAVYHPRNRYLLHLDAAAGAEERAELAAAVRGVRAWRERANVDVVGEGYAVDRAGPSALAAALHGAAVLLRVAADWDWFVTLSSSDYPLVTQDDLLYAFSSVPRDLNFIDHTSDLGWKEHERFEKLIVDPSLYMDRNSEILPATEPRQMPDAFKIFTVNYKFLLRTQSVLKHERRTNNDDGSPWVILSRNFTEHCVHGWDNLPRKLLMYFANTAYSMESYFQTVICNSSKFRNTTVNGDLRYFVWDDPPGLEPLVLDESHFDDMVNSSAAFARRFVDDSPVLKKIDKEILNRSSAVCASFSRRRGMDVDSCSKWGDVNVLQPARAGEQLRRFISEISQTRGCS

SEQ ID NO: 1451 - DNA, 1374 bp, Sorghum bicolor
  misc_feature (1)..(1374): Ceres Annot ID no. 8633314
  misc_feature (1)..(1374): Encodes the peptide sequence at SEQ ID NO. 1452
atggaggccgccgccccgtgcccgcgcgcccaccccgtggacctccgctggctgctctccgtggccgccggcggcctcttcgcgctgctgctcctgctggccacctccccgtcgttccagctcccctcctcctccgccgccacctcccgcctcttcctcacccccgcgtcccgctcctcctcggcgcgccccgcgctgcccccgctcttcgtcgagcccgcgctctcccgcccgccgcccccgcccgccgcgtccctcccgcgcttcgcctacgtcatctccgggtccgccggggacgccgggatgatgcggcgctgcctgctggcgctgtaccacccgaggaaccgctacgtgctccacctggacgcgcaggcgcccgacgccgaccgcgccgacctcgccgctttcgtcgccgcgcacccggtgctcgccgcggcggggaacgtgaaggtggtcgagaaggccaacctcgtcacctacaggggacccaccatggtgaccaccacgctgcacgccgccgcgctgctcctgtggggcgacggcaggggacgcggcggcgccgactgggactggttcatcaacctctccgcctccgactacccgctcgtcacgcaggatgatttgatgcatgtgttctccaagctgccgcgcgatctcaacttcatcgatcacacgagtaacatctcctggaaagcgtttgcgagggcgatgccggtgatcgtagacccggcgttgtacatgaagacaaagggcgacctggtctggatgccggagaggcggagcttgccgacggcattcaagctattcactggttcggcgtggatggtgctgtcccgtccgttcgtggagtacctgatctgggggtgggacaacctcccgcgcacgctgctcatgtactacgccaacttcatctcctccccggagggctacttccacacggtggcgtgcaacgccgacaagttccgcaacacgacggtgaacagcgacctgcacttcatctcctgggacaacccgccgatgcagcacccgcactacctcaccgtcgccgactgggaccgcatggtcgccagcgacgcgcccttcgcgcgcaagttcctcagggacgaccccgtgctggaccgcatcgacgccgagatcctcgggggccgggggcccggcatggtcgcgccgggaggctggtgtcaggcagcagcagctgccggcgccggcggggagaacagtaacgggaccgacgacgacccgtgcgcggcggtggggaacgccgcgttcctaaggcccggaccgggtgctgagcggctgcagaggctcgtcacgtcgctgctgtcggaggagaacttccggcccaggcagtgcgtagtagaagacgagaagtga

SEQ ID NO: 1452 - protein, 457 aa, Sorghum bicolor
  misc_feature (89)..(320): Pfam Name: Branch Pfam Description: Core-2/I-Branching enzyme
  misc_feature (1)..(457): Ceres Annot ID no. 8633314
  misc_feature (1)..(457): Bit score of 800.4 for HMM based on sequences of Figure 8
  misc_feature (1)..(457): Functional Homolog Of SEQ ID NO. 1366
MEAAAPCPRAHPVDLRWLLSVAAGGLFALLLLLATSPSFQLPSSSAATSRLFLTPASRSSSARPALPPLFVEPALSRPPPPPAASLPRFAYVISGSAGDAGMMRRCLLALYHPRNRYVLHLDAQAPDADRADLAAFVAAHPVLAAAGNVKVVEKANLVTYRGPTMVTTTLHAAALLLWGDGRGRGGADWDWFINLSASDYPLVTQDDLMHVFSKLPRDLNFIDHTSNISWKAFARAMPVIVDPALYMKTKGDLVWMPERRSLPTAFKLFTGSAWMVLSRPFVEYLIWGWDNLPRTLLMYYANFISSPEGYFHTVACNADKFRNTTVNSDLHFISWDNPPMQHPHYLTVADWDRMVASDAPFARKFLRDDPVLDRIDAEILGGRGPGMVAPGGWCQAAAAAGAGGENSNGTDDDPCAAVGNAAFLRPGPGAERLQRLVTSLLSEENFRPRQCVVEDEK

SEQ ID NO: 1453 - protein, 448 aa, Arabidopsis thaliana
  misc_feature (104)..(329): Pfam Name: Branch Pfam Description: Core-2/I-Branching enzyme
  misc_feature (1)..(448): Public GI ID no. 15236287
  misc_feature (1)..(448): Bit score of 695.4 for HMM based on sequences of Figure 8
  misc_feature (1)..(448): Functional Homolog Of SEQ ID NO. 1366
MKKVYRKLIWIRDPLARLKRHVSSHSGFRFFRDRKWMFPFLASLVLSVTLLMSVLYVQLETSYVEEPLPFDNLSEETNDYFVESQLRMSLNSTLDSTSSEVPRLAYLISGTKGDSLRMMRTLQAVYHPRNQYVLHLDLEAPPKERLELAMSVKSDQTFREVENVRVMSQSNLVTYKGPTMIACTLQAVAILLKESLDWDWFINLSASDYPLVTQDDMLYVFANLSRNVNFIEHMKLTGWKLNQRAKSIIVDPGLYLSKKTEIAWTTQHRSLPTSFTLFTGSAWVVLTRSFLEYSILGWDNFPRTILMYYTNFVSSPEGYFHTLICNTEEFKSTAIGHDLHYIAWDYPPKQHPNSLSMKDFDKMVKSKAPFARKFHKNDPVLDKIDRELLGRTHRFSSGAWCIGSSENGADPCSVRGDDSALKPGPGAERLKELLQTLLSDEFRIKQCS

SEQ ID NO: 1454 - protein, 402 aa, Oryza sativa subsp. japonica
  misc_feature (57)..(281): Pfam Name: Branch Pfam Description: Core-2/I-Branching enzyme
  misc_feature (1)..(402): Public GI ID no. 108707468
  misc_feature (1)..(402): Bit score of 602.4 for HMM based on sequences of Figure 8
  misc_feature (1)..(402): Functional Homolog Of SEQ ID NO. 1366
MRKQPQPQGNRRLRWLRALLLALPLLSVPVLYAALGAARPAAPPRRGAAPHQLPPRLAYLVSGGAGDGPRIRRMLRALYHPWNFYLVGVAGEEERADLEAFVRGEEAPRRYGNVRVAAAGEWGPVSRRGPTELAATLHAAAVMLREFDGWSWFINLSASDYPLMPQDDILHIFSYLPRDLNFIEHTSNIGWREYQRARPIIVDPALQISNKTEVVTTKEKRSLPSAFKIFVGSSWVILSRSFLEFCLLGWDNLPRTLLMYFANFLASSEGYFHTVICNSKYYQNTTVNNDLRFMAWDNPPRTLPVNLTTEHFDAIASSGAPFAHSFANDNPVLDMIDTKLLRRAPERFTPGGWCLGSSVNDKDPCSFFGRSFVLRPTKSSAKLEKLLLKLLEPDNFRSKQCI

SEQ ID NO: 1455 - DNA, 1467 bp, Zea mays
  misc_feature (1)..(1467): Ceres Clone ID no. 468692
  misc_feature (1)..(1467): Encodes the peptide sequence at SEQ ID NO. 1456
cacctcgcgccggtgagcaagcgaatgccgcgggagctctagccctcggctcctcgcccgggccggcgtgtcgttccgatccatgaggaagctgccgccagcgcaccgcctccggtggatgcgcgcgctgctcctcgcgctcccgctcgtctcgctccccatcctctacgcggcgctcggcgcggcgcgctcgtcggcctcggcggcgcggccgccgccgccgcccccgcagcagcagaagcggaggccgccgccgaggctggcgtacctcataacgggcgcaggccccggggacggcccgcggatccggaggctgatgcgggcgctctaccacccctggaactactacctcgtcggagtggcgggggaggacgagcgggcggatctcgaggccttcgtgcgcgcccaggaggcgccgcgccggtacggcaatgtccgggtgtcggccgcgggggagtggggctccgtctcgcggaggggccccaccgaattggcctccacgctccacgccgccgcggtgctgctccgggagttcgacggctggagctggttcatcaatcttagcgcctccgattacccgctcatgccccaagatgacatcctgcatatcttctcatacatgccaagagacctcaatttcattgagcacacaagcaatattggttggaaagagtatcaaagagcccgaccaatcattgtagacccagcattgcaggtcccaaataaaactgaggttgtaacaacaaaggagaaaaggagtatgccctcagctttcaaaatatttgtaggttcgtcttgggtgatgcttagtagatcattcctggagttttgcttactgggatgggataaccttcctcgcacactactcatgtatttcaccaacttcctctcgtcctcagaaggctacttccacacagtgatctgcaactcagagtactaccagaacaccactgtgaacagtgatctgcgcttcatggcatgggataacccacctcggacgcaccctgctaacctcacaacagagcattttgatgcaatggcagacagcggggcgccgtttgcacactcatttgccaatgataactcagtcctggatatgatcgacgccaagttgttggggcgagcacctgaccgcttcacgccgggtggatggtgcctgggtagctcagtaggcgggaaagatccgtgtaccttcttgggaaggtcctttattctcaggccgaccaaaggctcggccaagctagagaagttgctgttgaaacttttggaacctgataacttcaggcctaaacagtgtaaataacactcattttacatggtagccagttttttttttttggtagtgttcagaggccgaagtttgatgacatgtttcttgttgttgcggcagtaagcattacatacagatgttttatacttgcaaccgaaaagctcaactcacaagtgatttgagatcatacacgatac

SEQ ID NO: 1456 - protein, 406 aa, Zea mays
  misc_feature (60)..(285): Pfam Name: Branch Pfam Description: Core-2/I-Branching enzyme
  misc_feature (1)..(406): Ceres Clone ID no. 468692
  misc_feature (1)..(406): Bit score of 620.2 for HMM based on sequences of Figure 8
  misc_feature (1)..(406): Functional Homolog Of SEQ ID NO. 1366
MRKLPPAHRLRWMRALLLALPLVSLPILYAALGAARSSASAARPPPPPPQQQKRRPPPRLAYLITGAGPGDGPRIRRLMRALYHPWNYYLVGVAGEDERADLEAFVRAQEAPRRYGNVRVSAAGEWGSVSRRGPTELASTLHAAAVLLREFDGWSWFINLSASDYPLMPQDDILHIFSYMPRDLNFIEHTSNIGWKEYQRARPIIVDPALQVPNKTEVVTTKEKRSMPSAFKIFVGSSWVMLSRSFLEFCLLGWDNLPRTLLMYFTNFLSSSEGYFHTVICNSEYYQNTTVNSDLRFMAWDNPPRTHPANLTTEHFDAMADSGAPFAHSFANDNSVLDMIDAKLLGRAPDRFTPGGWCLGSSVGGKDPCTFLGRSFILRPTKGSAKLEKLLLKLLEPDNFRPKQCK

SEQ ID NO: 1457 - protein, 421 aa, Vitis vinifera
  misc_feature (80)..(305): Pfam Name: Branch Pfam Description: Core-2/I-Branching enzyme
  misc_feature (1)..(421): Public GI ID no. 225461471
  misc_feature (1)..(421): Bit score of 714.5 for HMM based on sequences of Figure 8
  misc_feature (1)..(421): Functional Homolog Of SEQ ID NO. 1366
MGSFNMEKKWAFPLAISSLICMFLLATSFNMGLLSSLHPINSIFSIFSPGLSTNQTNPVFAEQKVGQPPPPPTTPNIPRFAYLISGSRGDLEKLWRTLQVLYHPLNQYVVHLDLESPAEERLDLAARVEKDPIFSKVGNVHMITKANMVTYRGPTMVANTLHACAILLKRSKNWDWFINLSASDYPLVTQDDLLYTFLGLDRNLNFIEHTSRLGWKENQRAMPLIVDPGLHMTTKSEIFWVSPRRTLPTAFKLFTGSAWMVLSRSFVEYCIWGWDNLPRTLLMYYANFVSSPEGYFQTVICNAPEYAKTTVNHDLHFISWDNPPKQHPHTLTINDTSRMIGSNAAFARKFRQDDPSLDKIDKDLLGRKKGGFTPGGWCSGNPPCSKVGDPTKLKPGPGAQRLRLLVSRLLLSARYGQNQCK

SEQ ID NO: 1458 - DNA, 1317 bp, Populus balsamifera subsp. trichocarpa
  misc_feature (1)..(1317): Ceres Annot ID no. 1462238
  misc_feature (1)..(1317): Encodes the peptide sequence at SEQ ID NO. 1459
atggaaaacaacaagtacttgaagttgcttctgcaacaaaagaaacagaaatggttgttactgttaatattatcttcaaccatcttgcttcttactaccatagcatcattctcatcttcccctcaattgctatacaaatcacacggcaacaaataccatttccagcaggttccacgctttgtggaacctaaattgaaaaactcaccttcttctcccgtacataaagtaccccgccttgcctacttaatttcaggttctgctggagatggagtgagcttgaaacgggctttaaaagcactctaccatccgaggaatcagtatgctgtgcatttggacttggaggccaccgcggaggagaggttggagctggcgagatgggtgagtgaggagaaggttttcgaggaggtgggaaatgtgagggtggttgtgagatccaatttggtaacttatagaggtctaactatggttagcaatacgcttcatgctgctgcaattttgctcaaggatattgatgatggggaatcttgggattggtttatcaatttgagcgcttctgattatcctttgatgactcaagatgatattcttcatacactctttgatattccaagagaccttaacttcatcgagcataccagtgacattggatggaaaaaagatcaaagagccaagcctgtcataatagacccagggctatatagccagccaaaatcagaggttttttggatctcggagaaaaggaggttgccaacagcatataatttgtttactggttctgcttggatgatgctctctcgaccttttgtggagtattgcctgtggggctgggacaacctcccaaggatagtcctcatgtactatgcaaactttctctcttcacctgagggatatttccacactgtaatctgcaatgctgatgagttccgaaacactactgttaaccatgaccttcatttcatatcttgggacaaccctcctaagcaacaccctcattttctcacagtagatgattatgagagcatggttgagagcaatgttccctttgcaaggaaatttggcaaggacgacccggttcttgacaagattgattctaaccttctgggacgcagagtcgatgggtttgtgcctggtggatggttcactgatgaaggaaatgcaagtacagttctccctcgtattaatttaaagaacgcgactgagcttaagcctggccctggtgctcagaggctcaagcgtctgatgagcagtctattgttagcagatgattttgactcgacacactgcaaaatgatgcctgctgtttcgaagatgaaatag

SEQ ID NO: 1459 - protein, 438 aa, Populus balsamifera subsp. trichocarpa
  misc_feature (79)..(307): Pfam Name: Branch Pfam Description: Core-2/I-Branching enzyme
  misc_feature (1)..(438): Ceres Annot ID no. 1462238
  misc_feature (1)..(438): Bit score of 675.5 for HMM based on sequences of Figure 8
  misc_feature (1)..(438): Functional Homolog Of SEQ ID NO. 1366
MENNKYLKLLLQQKKQKWLLLLILSSTILLLTTIASFSSSPQLLYKSHGNKYHFQQVPRFVEPKLKNSPSSPVHKVPRLAYLISGSAGDGVSLKRALKALYHPRNQYAVHLDLEATAEERLELARWVSEEKVFEEVGNVRVVVRSNLVTYRGLTMVSNTLHAAAILLKDIDDGESWDWFINLSASDYPLMTQDDILHTLFDIPRDLNFIEHTSDIGWKKDQRAKPVIIDPGLYSQPKSEVFWISEKRRLPTAYNLFTGSAWMMLSRPFVEYCLWGWDNLPRIVLMYYANFLSSPEGYFHTVICNADEFRNTTVNHDLHFISWDNPPKQHPHFLTVDDYESMVESNVPFARKFGKDDPVLDKIDSNLLGRRVDGFVPGGWFTDEGNASTVLPRINLKNATELKPGPGAQRLKRLMSSLLLADDFDSTHCKMMPAVSKMK

SEQ ID NO: 1460 - protein, 417 aa, Arabidopsis thaliana
  misc_feature (69)..(294): Pfam Name: Branch Pfam Description: Core-2/I-Branching enzyme
  misc_feature (1)..(417): Public GI ID no. 15229570
  misc_feature (1)..(417): Bit score of 553.4 for HMM based on sequences of Figure 8
  misc_feature (1)..(417): Functional Homolog Of SEQ ID NO. 1366
MQHTPEQPRVTLYIILTTAFLSLCFLLSLSSSSQYSSSSYTGRPDDLRPDPRLFPSSSKIAADTAPPSIAYLISGSSGDTRRILRLLYATYHPRNRYLLHLDSLATQSERDRLAVDVQDVPIFRAARNVDVIGKPDFAYQRGSSPMASTLHGASILLRLSGTWDWFVSISVDDYPLVTQDELLHIMSHLPKDLNFVNHTSYIGWKESRKLKPVIVDPGLYLVEKTDMFFASQKRELPKAFKLFSGPSFSILSRNFMEHCVLGTDNFPRTLLMYLSNTPDSLSNYFPTILCNTDTFKKTIMNNNLLYLASNDTSKERYHQLDHKEFTEMVDSGAAFARGFRYDDTVLDRIDHELLGRKPGEVVPGGWCLGDSSKNRSSCSVWGDSGILRPGSGSDRLERRIVELLSNDWFRLHQCVPE

SEQ ID NO: 1461 - DNA, 1245 bp, Sorghum bicolor
  misc_feature (1)..(1245): Ceres Annot ID no. 8641860
  misc_feature (1)..(1245): Encodes the peptide sequence at SEQ ID NO. 1462
atgaggaagctgacgccggcgcaccgcctccggtggatgcgcgcgctgctcctcgcgctcccgctcctctcgctccccatcctctacgcggcgctcggcgcggcgcgctcgtcgtcctccacggcctcggcctcggcgccgcggctaccccagcagcagcagcagcaggagcagcggaggccgcccgcgccgccgccgaggctggcgtacctcatcacgggcgcgggccccggggacggcccgcggatccggaggctgctgcgggcgctctaccacccgtggaactactacctcgtcggcgtggcgggggaggacgagcgcgcggatctcgaggccttcgtgcgcggccaggaggcgccgcgccggtacggcaacgtccgtgtggcggccgcgggggagtggggcgccgtatcgcggaggggacccaccgaattggccgccacgctccacgccgccgctgtgctgctccgggagttcgatggctggagctggttcatcaacctcagcgcatccgattacccgctcatgccccaagatgatatccttcatatcttctcatacatgccaagagacctcaatttcattgagcacacaagcaatattggctggaaagagcatcaaagagcccgaccaatcattgtagatccagcattgcaggtcccaaataaaactgaggttgtaacaacaaaggagaaaaggagcatgccctcagctttcaaaatatttgtaggttcgtcttgggtgatgcttagtcgatcattcctggagttttgcttattgggatgggacaaccttcctcgcacactactgatgtatttcaccaacttcctctcatcctcagaaggctacttccacacagtgatctgcaactctgagtactaccagaacaccactgtgaacagtgacctgcgtttcatggcttgggataacccccctcggatgcaccctgttaacctcacagcagagcattttgatgcaatggcaaacagtggggccccatttgcacactcctttgccaatgataattctgtcctggatatgattgacaccaagttgttgggccgagcacatgaccgcttcaccccgggtggctggtgcttgggtagctcagtaggcgggaaagatccgtgtacctttttgggaaggtcctttgttctcaggccgaccaaagcctcggccaagctagagaagttgttgttaaaacttttggaacctgataacttcaggcctaaacagtgtaaataa

SEQ ID NO: 1462 - protein, 414 aa, Sorghum bicolor
  misc_feature (68)..(293): Pfam Name: Branch Pfam Description: Core-2/I-Branching enzyme
  misc_feature (1)..(414): Ceres Annot ID no. 8641860
  misc_feature (1)..(414): Bit score of 625.0 for HMM based on sequences of Figure 8
  misc_feature (1)..(414): Functional Homolog Of SEQ ID NO. 1366
MRKLTPAHRLRWMRALLLALPLLSLPILYAALGAARSSSSTASASAPRLPQQQQQQEQRRPPAPPPRLAYLITGAGPGDGPRIRRLLRALYHPWNYYLVGVAGEDERADLEAFVRGQEAPRRYGNVRVAAAGEWGAVSRRGPTELAATLHAAAVLLREFDGWSWFINLSASDYPLMPQDDILHIFSYMPRDLNFIEHTSNIGWKEHQRARPIIVDPALQVPNKTEVVTTKEKRSMPSAFKIFVGSSWVMLSRSFLEFCLLGWDNLPRTLLMYFTNFLSSSEGYFHTVICNSEYYQNTTVNSDLRFMAWDNPPRMHPVNLTAEHFDAMANSGAPFAHSFANDNSVLDMIDTKLLGRAHDRFTPGGWCLGSSVGGKDPCTFLGRSFVLRPTKASAKLEKLLLKLLEPDNFRPKQCK

SEQ ID NO: 1463 - protein, 406 aa, Arabidopsis thaliana
  misc_feature (64)..(289): Pfam Name: Branch Pfam Description: Core-2/I-Branching enzyme
  misc_feature (1)..(406): Public GI ID no. 9454535
  misc_feature (1)..(406): Bit score of 646.7 for HMM based on sequences of Figure 8
  misc_feature (1)..(406): Functional Homolog Of SEQ ID NO. 1366
MEKKYVFSFVITSLVCVVLLATSFNIGLMSSLRPPINGTLSSFPKNDSNVVGKQPREDDKLPRFAYLVSGSKGDLESLWRTLRALYHPRNQYIVHLDLESPVDERSELASRISNDPMYSKAGNVYMITKANLVTYTGPTMVANTLHACAILLKRTPDWDWFINLSASDYPLVTQDDLIHTFSTLDRNLNFIEHTSSLGWKYKKRAMPLIIDPGLYMLNKSNVLLVRPNRSLPSAFKLFTGSAWMALSHAFVEYIIYGWDNLPRTLLMYYTNFVSSPEGYFHTVICNVPEFSKTAVNHDLHYIAWDKPPRQHPRMLSQRDMGKMISSGSAFGRKFRRNDTVLDKIDKELLIRINEDGFTPGGWCGGKPECSVVEDVARIRPSSGAVRLKELVDRLVTEAKLGKNQCV

SEQ ID NO: 1464 - DNA, 2088 bp, Zea mays
  misc_feature (1)..(2088): Ceres Clone ID no. 1553206
  misc_feature (1)..(2088): Encodes the peptide sequence at SEQ ID NO. 1465
gctcacactgtgagagcttcagttcacctgccaccgcctaccgagaagagatcagcgccgccgcgcgcgaagtgcttcactggggaggagcggagccgtgctgaagttggccggccgtgcccggcggcctcacgagctctccctcgttgctctacgccggggctgggccttgtcctcgtcgcgcgtacgtgctcgccgccgacgcggcgcctgctcgctgcccgtgcggaacaacggtggcctgcgcgcctcgccgggccactcgctcgtcgcgaacgagagctcggattgtttaggaggcctcatccgctgtcctcactcccctggcgagcaaaatccctcttgaaattccgaggcttcgcttgaggatcttgctctccagagctcatctgagttccagatccgtttcgtccccgccaccaatttggtgcgctcgcgagattctatatcaccggagaaaagccggtgtgctccgtaaggtcggacatcctgagattcagttgcgctaaagaagaaggaagacgcgcgcgcgcatgacgggcaaatgaggaagaatctggggctcggctcgggccccgcgcgtccgttcggtgaccgccgctggctgctccctttcctcgccaccatgctcgtcacggccacgctcctactcgccgccgcgtgcggcctcttctcgccgccgtacccgggcggcggcagcgacgcggtcttgttcgacgtggtctccctcgccgactgggacgacggcggctcgtcgacaggcggcgacggcgccccctccgtcgaggcgggaatcaagaaccggctgctggaaggtaacgccgccagcgacagcgatgacgagaaccccgacgacgccgccgtcaactctgacgactccgatgccgagccgccgcggatcgcgtacctcctcgagggcaccaagggggacggcctgcggatgcggcggactctgcaggccatctaccacccgcgcaaccagtacatcctgcacctcgacctggaggcgccgccgcgggaacggatcgacctggcaatgtatgtcaagggtgatcccatgttcagccaggtcgggaatgtgcgtgtcatcgccaagggcaaccttgtcacctacaaggggccgaccatggtcgcctgcacgctccacgccgtcgccattctcctcaaggaggggctccagtgggactggttcatcaatctcagtgcgtcagattatccgctcatgacacaagatgacatacttcatgtcttctcttctttgccaagaaatcttaattttatagagcactttcggttatctggatggaaagttaatataagggcaaaaccaattgttctggacccagggctctatctgtccaagaaatttgatcttactatgactactgagcggagagaattgccaacatctttcaaattatatactggttctgcttggataatgcttacgaagtccttccttgagtactgtatatggggctgggataatctcccacggaaccttctgatgtactatgtcaacttcatctcctcaccagaaggctacttccaaactgtcatatgcaattctgatgattttcggggcacggcagttggccacgaccttcattacatcgcctgggactaccctccaaagcagcatccgttgatcctctccatgaaggacttcaacaggatggtcaagagcggcgcgccatttgcgcgtaagtttcccaaggacgacaaggtcctggacaagatagaccgcgagctcttgcaccgctcggagggctggttcacccctggagcatggtgtgacgggagctctgaaggaggagctgatccatgcctgtctaggggtgaagactctgttttcgagcctggacctggtgccgaaaggctgcgaggcctgatgaagaaggtgctctcgtgggattaccgcaatggcagctgttcctcgcttgcttatgatcagacgaagagggactggtatgttcctaagagtagaggataattctggtgtcttgctatgctttcttgtaaatgcagctcttgacttgacccctttccattgaaatgaacaacactgaggaacacaacccgttgacc

SEQ ID NO: 1465 - protein, 482 aa, Zea mays
  misc_feature (119)..(344): Pfam Name: Branch Pfam Description: Core-2/I-Branching enzyme
  misc_feature (1)..(482): Ceres Clone ID no. 1553206
  misc_feature (1)..(482): Bit score of 638.8 for HMM based on sequences of Figure 8
  misc_feature (1)..(482): Functional Homolog Of SEQ ID NO. 1366
MRKNLGLGSGPARPFGDRRWLLPFLATMLVTATLLLAAACGLFSPPYPGGGSDAVLFDVVSLADWDDGGSSTGGDGAPSVEAGIKNRLLEGNAASDSDDENPDDAAVNSDDSDAEPPRIAYLLEGTKGDGLRMRRTLQAIYHPRNQYILHLDLEAPPRERIDLAMYVKGDPMFSQVGNVRVIAKGNLVTYKGPTMVACTLHAVAILLKEGLQWDWFINLSASDYPLMTQDDILHVFSSLPRNLNFIEHFRLSGWKVNIRAKPIVLDPGLYLSKKFDLTMTTERRELPTSFKLYTGSAWIMLTKSFLEYCIWGWDNLPRNLLMYYVNFISSPEGYFQTVICNSDDFRGTAVGHDLHYIAWDYPPKQHPLILSMKDFNRMVKSGAPFARKFPKDDKVLDKIDRELLHRSEGWFTPGAWCDGSSEGGADPCLSRGEDSVFEPGPGAERLRGLMKKVLSWDYRNGSCSSLAYDQTKRDWYVPKSRG

SEQ ID NO: 1466 - protein, 421 aa, Arabidopsis thaliana
  misc_feature (80)..(305): Pfam Name: Branch Pfam Description: Core-2/I-Branching enzyme
  misc_feature (1)..(421): Public GI ID no. 42567183
  misc_feature (1)..(421): Bit score of 697.2 for HMM based on sequences of Figure 8
  misc_feature (1)..(421): Functional Homolog Of SEQ ID NO. 1366
MASSNSEKRWIFPLAMASLMFIFLIAASFNMGLLSSVRSINSLIFSYNLSTTNETRVEFAESKINQSSHPPPVQPSLPRFGYLVSGSRGDLESLWRVLRTLYHPRNQYVVHLDLESPAEERLELAKRVSQDPVFSDVGNVHMITKANLVTYRGPTMVANTLHACAILLKQSKEWDWFINLSASDYPLVTQDDLIDTFSGLDRNLNFIDHSSKLGWKEEKRAKPLIIDPGLYSTKKSDVFWVTPRRTMPTAFKLFTGSAWMVLSRSFVEYCIWGWDNLPRTLLMYYTNFLSTPEGYFHTVICNAPEYSSTVLNHDLHFISWDRPPKQHPRALTINDTERMIASGSAFSRKFRHNDPALDKIDKELLGRGNGNFTPGGWCAGEPKCSRVGDPSKIKPGPGANRLRVLVSRLVLTSKLTQRQCR

SEQ ID NO: 1467 - protein, 397 aa, Populus tremula x Populus tremuloides
  misc_feature (52)..(275): Pfam Name: Branch Pfam Description: Core-2/I-Branching enzyme
  misc_feature (1)..(397): Public GI ID no. 60657604
  misc_feature (1)..(397): Bit score of 612.6 for HMM based on sequences of Figure 8
  misc_feature (1)..(397): Functional Homolog Of SEQ ID NO. 1366
MGIKLFMISFMVTSILFSLLYIPTKLTTPIAKYNPVINLNMLKDLKPYPVTFAYLISASRGDAKRLMRVLKALYHPGNYYLIHVDSDAPEKEHREIAEFVSSDPVFGLVGNVWIVGKPNLVTYRGPTMLATTLHAMAILLRTCKWDWFINLSASDYPLVTQDDLIDAFSTLPRNLNFIQHSSRLGWKLNKRAKPIMIDPGLYSLNKSEIWWVIKQRSLPTAFKLYTGSAWTILSRSFAEYSIVGWDNLPRTLLLYYTNFVSSPEGYFQTVICNSEDYKNTTVNHDLHYITWDTPPKQHPRSLGVKDYRRMILSSRPFARKFKRNDPVLDKIDRELLKRYKGQFAHGGWCARSGKRHGTCSGLQNGNYGVLRPGPGSRRLQNLLTKLLPEKNFKRQCR

SEQ ID NO: 1468 - protein, 393 aa, Vitis vinifera
  misc_feature (48)..(272): Pfam Name: Branch Pfam Description: Core-2/I-Branching enzyme
  misc_feature (1)..(393): Public GI ID no. 157359338
  misc_feature (1)..(393): Bit score of 613.0 for HMM based on sequences of Figure 8
  misc_feature (1)..(393): Functional Homolog Of SEQ ID NO. 1366
MTMKTLIIIVTLASTLLLLLSLLYLSTQSTAFPPTIKTFNSPKYPVTFAYLISASAGDARKLKRTLRALYHPANYYLLHLDAGAPQAEREEVSRYVAEDPVYGEVGNVWVVQKSNLVTYRGPTMLATTLHAMAMLLRSCKWDWFINLSASDYPLVTQDDLIHVFSDLPRDLNFVQHSSRLGWKLNKRGRPIIIDPGLYSQNKSDIWWVIKQRSLPTAFKLYTGSAWTILSRSFAEYCILGWDNLPRTLLLYYTNFVSSPEGYFQTVICNSDDYKNTTLNNDLHYIAWDTPPKQHPRSLGLKDFKRMYSSNRPFARKFKQDDRVLDKIDRQLLKRHPGQFSYGGWCSGDGRMHGSCSGLQSQSYGVLRPGPGSRRLKTLITKTLPERKYKRQCR

SEQ ID NO: 1469 - DNA, 1260 bp, Populus balsamifera subsp. trichocarpa
  misc_feature (1)..(1260): Ceres Annot ID no. 1520081
  misc_feature (1)..(1260): Encodes the peptide sequence at SEQ ID NO. 1470
atggggtccctaaacgtggagaagaaatggggtttccctcttgtcataagctctctcatatgtctattccttttagcaacttgtttcaacatgggtcttgtttcttcactgcatacaatcaatcaaatcttcaacattttcccatttcgaaccaaccagacaactcaaggttacgctgaaaaaaaagtctccctatctccttcccctcctctcccttccaagatccctcgatttgcttatctggtttctgggtctaaaggtgatttggaaaagctctggagaactcttcattcgctttaccatccccggaacgaatatgttgttcatctggaccttgagtcctctgcagaggaaagattggagcttgcatcgcgagtggaaaagcatccgattttctcaaaggttggaaatgtttatatgatcagcaaagccaatatggttacctatagaggaccctccatggtttctaatacacttcatgcttgtgcaattcttctcaaaaggagcaaagattgggattggtttatcaatctcagtgcttctgattatcctcttgttactcaagacgatcttattcacacattttcaactgtaaaccgaaatctaaactttattgagcacacaagtcagctgggctggaaagcggagaaacgagcaatgcctttgattgtggaccctggtctttactcgacagctaaagcagatatttacggggccacgccacagagatctttgccaacagcatttaaattattcaccggttcagcatggatggttctcacacggtcatttgttgaatacttaatttggggttgggataatctaccacgaaccttgttgatgtactacacaaactttgtttcctcacctgaaggatactttcacacagtaatatgcaatgtaccagagtttgctcaaactgcagtcagccatgacttgcactacattgcttgggacaatcctcccaagcagcatcctcacaccctcaccatcaatgacacaaacgagatgattgcgagtggtgctgcctttgccagaaaattcaaaggagacgatcctgtcttggataagattgacaaggatttacttcaccggaagaatgggagcttcactccgggtggatggtgctctggtagtcccaaatgttctgaggtcgggaacctggacaatattaaaccaggccctggagctagcagactgaaacgcctcatatctagggtagctttgtttacaacgcttaaacaaaaccaatgtaaatag

SEQ ID NO: 1470 - protein, 389 aa, Populus balsamifera subsp. trichocarpa
  misc_feature (48)..(273): Pfam Name: Branch Pfam Description: Core-2/I-Branching enzyme
  misc_feature (1)..(389): Ceres Annot ID no. 1520081
  misc_feature (1)..(389): Bit score of 641.4 for HMM based on sequences of Figure 8
  misc_feature (1)..(389): Functional Homolog Of SEQ ID NO. 1366
MGLVSSLHTINQIFNIFPFRTNQTTQGYAEKKVSLSPSPPLPSKIPRFAYLVSGSKGDLEKLWRTLHSLYHPRNEYVVHLDLESSAEERLELASRVEKHPIFSKVGNVYMISKANMVTYRGPSMVSNTLHACAILLKRSKDWDWFINLSASDYPLVTQDDLIHTFSTVNRNLNFIEHTSQLGWKAEKRAMPLIVDPGLYSTAKADIYGATPQRSLPTAFKLFTGSAWMVLTRSFVEYLIWGWDNLPRTLLMYYTNFVSSPEGYFHTVICNVPEFAQTAVSHDLHYIAWDNPPKQHPHTLTINDTNEMIASGAAFARKFKGDDPVLDKIDKDLLHRKNGSFTPGGWCSGSPKCSEVGNLDNIKPGPGASRLKRLISRVALFTTLKQNQCK

SEQ ID NO: 1471 - protein, 424 aa, Arabidopsis thaliana
  misc_feature (81)..(306): Pfam Name: Branch Pfam Description: Core-2/I-Branching enzyme
  misc_feature (1)..(424): Public GI ID no. 18400725
  misc_feature (1)..(424): Bit score of 700.2 for HMM based on sequences of Figure 8
  misc_feature (1)..(424): Functional Homolog Of SEQ ID NO. 1366
MGYVNVEKRWVFPLVITSLVCVFLLATSFNMGLVSSLRTINGIFSIIPSRLVKNQTRLDFAESKVARQTRVLPHEDKLPRFAYLVSGSKGDVEKLWRTLRAVYHPRNQYVVHLDLESPVNERLELASRINNDPMYSKTGNVYMITKANLVTYKGPTMVANTLHACAVLLKRNANWDWFINLSASDYPLVTQDDLLHTFSTLDRNLNFIEHTSQLGWKEEKRAQPLMIDPGLYLLNKSDIYWVTPRRSLPTAFKLFTGSAWMALSRPFVEYCIWGWDNLPRTLLMYYTNFVSSPEGYFQTVICNVPEFAKTAVNHDLHYISWDNPPQQHPHVLSLNDTMPMIWSGAAFARKFRRDDEVLNKIDKELLKRRNDKDSFTPGGWCSGKPKCSRVGNVAKIVPSFGAQRLQGLVTRLVNEANTGVSQCK

SEQ ID NO: 1472 - DNA, 1194 bp, Populus balsamifera subsp. trichocarpa
  misc_feature (1)..(1194): Ceres Annot ID no. 1523194
  misc_feature (1)..(1194): Encodes the peptide sequence at SEQ ID NO. 1473
atgggcatcaaactgttcatgatctcattcatggtaacctcgatactcttctctctactatacataccaacaaaactaaccacacccaatgccaaatacaaccctgtgatcaacttgaacatgttgaaagacctcaagccatatccagtaacgttcacgtacttgatatcagcatctagaggtgacgcgaagaggctaacgcgtgtgctgaaggcattgtaccatccagggaactactatctgattcatgtggatgctgatgcaccggaaaaggagcatagagaaatagctgaatttgtgtctagtgatccagtttttggcctggtgggaaatgtttggattgtcggtaaaccaaatctggttacttacagaggtcctactatgcttgctactacactccatgcaatggctatactgctgaggacctgcaaatgggactggttcattaatctcagcgcctctgattatcccttggtcacccaagatgatctgatcgatgccttctctaccttaccaagaaatctcaactttatacagcacagcagccgcctgggatggaaactgaataagagagccaagccaatcatgatagaccctggtctctccagcctgaacaaatcagagatctggtgggtaaataaacaaaggagtctcccaactgccttcaagctctatacaggttctgcttggaccatactgtcaagatcttttgctgagtacagcattgtgggctgggacaacttgccaaggactcttcttctctactacaccaactttgtgtcctcccctgaaggctacttccaaactgtaatatgcaactctgaagactataaaaacaccacagttaaccatgaccttcattacattacttgggatacacctcctaagcagcaccctcggtccctaggagttaaagattacagaagaatgatcttgagcagccggccatttgcaagaaagttcaagagaaatgatccagttctcgataagattgatcgcgagcttcttaagagatacaagggacagtttgctcacgggggctggtgtgccaggagtggcaagaggcatggaacatgttcaggtttgcaaaacgagaattatggtgttttgaggcctggaccaggatcaagaaggctgcaaaatttgctgaccaaacttctttcagaaaagaacttcaagcggcaatgcagatga

SEQ ID NO: 1473 - protein, 397 aa, Populus balsamifera subsp. trichocarpa
  misc_feature (52)..(275): Pfam Name: Branch Pfam Description: Core-2/I-Branching enzyme
  misc_feature (1)..(397): Ceres Annot ID no. 1523194
  misc_feature (1)..(397): Bit score of 606.6 for HMM based on sequences of Figure 8
  misc_feature (1)..(397): Functional Homolog Of SEQ ID NO. 1366
MGIKLFMISFMVTSILFSLLYIPTKLTTPNAKYNPVINLNMLKDLKPYPVTFTYLISASRGDAKRLTRVLKALYHPGNYYLIHVDADAPEKEHREIAEFVSSDPVFGLVGNVWIVGKPNLVTYRGPTMLATTLHAMAILLRTCKWDWFINLSASDYPLVTQDDLIDAFSTLPRNLNFIQHSSRLGWKLNKRAKPIMIDPGLSSLNKSEIWWVNKQRSLPTAFKLYTGSAWTILSRSFAEYSIVGWDNLPRTLLLYYTNFVSSPEGYFQTVICNSEDYKNTTVNHDLHYITWDTPPKQHPRSLGVKDYRRMILSSRPFARKFKRNDPVLDKIDRELLKRYKGQFAHGGWCARSGKRHGTCSGLQNENYGVLRPGPGSRRLQNLLTKLLSEKNFKRQCR

SEQ ID NO: 1474 - DNA, 1697 bp, Gossypium hirsutum
  misc_feature (1)..(1697): Ceres Clone ID no. 1927095
  misc_feature (1)..(1697): Encodes the peptide sequence at SEQ ID NO. 1475
aaatcgatctcattattattgtctctttttttatcctgaaaagatggggagagtttctctcatcacaattaagtttgggttatttgtttaagaattataagggtggttgcccacccaagcaaaatacaaagtgacagtacttccaaatccagacatttgccgccagaatgtaccaccacccaaaatcgccgccatttacaccttccaccaccgcggcaaccaccctatctaaagataactccaaatgcactccgtacataatcttagcaagcttcttcttttccctcctctttatcctctctcttctttccacttccgcctcccaatccttactcacaatccgacgcgacccgtctctcttcccaaaccgccccgtctccctaaccaatatcccttatggccccacccctccctccattgcttacctcatttcaggatccgccggcgactccgctcggattctccgcctcctcctcgctacatatcacccgagaaaccattaccttcttcaccttgacctctctgccccgcagactgaacgtgatcgattggccgtcacaatccactctgtccccatttttagagctgcccaaaatgtggacgttataggtaaagcaaattatgcttatcaaagagggtcttccaccgtgacttctgcgcttcacggtgcctccattttgctacgcttgtcttccaaatgggattggtttatctctctcagtgctggtgattacccgcttgttactcaagatgatcttcttcacattctgtcataccttccgaaaaatctcaattttgtgaatcacagcagttacattggctggaaagagtccaagagattgaaaccaataatcgttgatacggggcattaccttttggaaaaggatgagatattttatgttactcagaagcgggtattgcctaattctttcaggttgttttcaggttcagcatttgcaatgttaactcgtagtttcattgagttctgcatccttggtacagacaattttccaaggactttgctaatgtatttggcaaacatgccttattccttcaccaattatttccctaccatcctttgtaactctaagttcaagagcactgttataaaccataacctccagtatgtagccttcaacatgtcctcttcgaagaagaagctttcctcacgtgatcttgcagaatttaatgctatgattcagactggagatgcctttgcaacacaattcaagtttgatgatccagtgcttgatcatattgaccgaaaaattttgaaacgcaagcctggcagagttgtgcaaggtggatggtgcttaggcattcctgcaaatgacacatgttcagtatggggggatgctgatatcttgaggcctggtaaaggagcaaaaaggcttgaaagacgtattgttaagttactttcgggtgataggtttcggtcccagcaatgtcttgacagatgatctgaatcaaccagatttgagatatatgaaattgcaaaagtaaaaggtatgactaaaaccaagatgaattgtgtttcccctggggagttaaccctcggaccctcacattctttttaggagcattccatttcatcaagcacctagttgtgctattatttttgtatagtaatttacgattcacttgttattgtactaattgatattgaaagtaaattcaaccagtacggtattaggtac

SEQ ID NO: 1475 - protein, 430 aa, Gossypium hirsutum
  misc_feature (84)..(309): Pfam Name: Branch Pfam Description: Core-2/I-Branching enzyme
  misc_feature (1)..(430): Ceres Clone ID no. 1927095
  misc_feature (1)..(430): Bit score of 538.7 for HMM based on sequences of Figure 8
  misc_feature (1)..(430): Functional Homolog Of SEQ ID NO. 1366
MYHHPKSPPFTPSTTAATTLSKDNSKCTPYIILASFFFSLLFILSLLSTSASQSLLTIRRDPSLFPNRPVSLTNIPYGPTPPSIAYLISGSAGDSARILRLLLATYHPRNHYLLHLDLSAPQTERDRLAVTIHSVPIFRAAQNVDVIGKANYAYQRGSSTVTSALHGASILLRLSSKWDWFISLSAGDYPLVTQDDLLHILSYLPKNLNFVNHSSYIGWKESKRLKPIIVDTGHYLLEKDEIFYVTQKRVLPNSFRLFSGSAFAMLTRSFIEFCILGTDNFPRTLLMYLANMPYSFTNYFPTILCNSKFKSTVINHNLQYVAFNMSSSKKKLSSRDLAEFNAMIQTGDAFATQFKFDDPVLDHIDRKILKRKPGRVVQGGWCLGIPANDTCSVWGDADILRPGKGAKRLERRIVKLLSGDRFRSQQCLDR

SEQ ID NO: 1476 - DNA, 1587 bp, Panicum virgatum
  misc_feature (1)..(1587): Ceres Clone ID no. 1810164
  misc_feature (1)..(1587): Encodes the peptide sequence at SEQ ID NO. 1477
gtatctcctcccaactctctcaaacctaccccagaccctcaccggcctgtgtgcgccgccgccgccgcctcctcgatgactcccgcgcccgtccgattggcgtcccccctccccccctggttcccgagattcggcggcgagagcgggattgatgcgcgcatggcgctgcgggcgcggctgatggggccgggcggcgggccgcgggtgctgctgctgctctccgctgccttcacggcgctcctcgtcgcctccatcctcctcctcccgtcgctcctcctccggacgggcggcgcgcgggggcccagcttcctcctctcgtcccccgccgccgccgccgccgccgacctccagcaggagcagcaggaccagcggtacccggtctcgttcgcgtacctgatctcggcggcgtcgggggacgcggcccgcgcggcgcggctgctggcggcgctctaccacccggccaacacctacctgctgcacctggaccgggaggcgcccgcgggggagcaccgccgcctggcggagctcgtgtcggcgcgggccgtgtacgcgcgcgcgggcaacgtctgggtcgtcggccgccccaacctcgtcacctaccggggccccaccatgctcaccaccacgctgcacgccgtcgcgatgctgctccgcctgcgctgccgctgggactggttcgtcaacctcagcgcgtccgactacccgctcgtcacccaggacgacatgatggaggccttcgccgggctgcccagggacctcaacttcatccagcacaccagccacctcggctggaagataaagaagcgggcgcggccggtgatcctggacacggcgctgtacgaggacgggcgggcggagctcatccggccagagaacatcaccaccaacctccggaggttgcccacggccttcaagctctacacagggtccgcgtggacgatgctgtcgcgtcccttcgccgagtacgtgacgatggggtgggacaacctcccccggaccctcctgctgtaccacgccaacatcgtctcctcgccggagttctacttccagacggtggcctgcaactcgctgcggttccgcaacgccaccgtcaaccacgacctgcacttcatccgctgggacaacccgcccaagcagcacccgctgcacctcaccgccagggactaccgccggatgctgctcagcggcgcccccttcgcgcgcaagttccgggagggcgacccggtgctggaccggatcgaccgcgacatcctgcgccggcgcgggcccggccagttcgcctacggcgggtggtgcgccggggacggggacgggggcggagacggcggcgcggcggcgctgtgcggcagcaacccgcaggagccccggaggaagggggccgtcagggccggcgccggggcgcgccggctcaaggtgctgctgggcaaggcgctggccccggggaatctcaggagaaggcagtgtagatgaaataaatttgttttgggctttttattcacagggtggactgattctgatcaaacatgacatgtatagcgaaagggacaacgacatgaattacaggcaattttggttcggaaggaccct

SEQ ID NO: 1477 - protein, 464 aa, Panicum virgatum
  misc_feature (104)..(332): Pfam Name: Branch Pfam Description: Core-2/I-Branching enzyme
  misc_feature (1)..(464): Ceres Clone ID no. 1810164
  misc_feature (1)..(464): Bit score of 542.3 for HMM based on sequences of Figure 8
  misc_feature (1)..(464): Functional Homolog Of SEQ ID NO. 1366
MTPAPVRLASPLPPWFPRFGGESGIDARMALRARLMGPGGGPRVLLLLSAAFTALLVASILLLPSLLLRTGGARGPSFLLSSPAAAAAADLQQEQQDQRYPVSFAYLISAASGDAARAARLLAALYHPANTYLLHLDREAPAGEHRRLAELVSARAVYARAGNVWVVGRPNLVTYRGPTMLTTTLHAVAMLLRLRCRWDWFVNLSASDYPLVTQDDMMEAFAGLPRDLNFIQHTSHLGWKIKKRARPVILDTALYEDGRAELIRPENITTNLRRLPTAFKLYTGSAWTMLSRPFAEYVTMGWDNLPRTLLLYHANIVSSPEFYFQTVACNSLRFRNATVNHDLHFIRWDNPPKQHPLHLTARDYRRMLLSGAPFARKFREGDPVLDRIDRDILRRRGPGQFAYGGWCAGDGDGGGDGGAAALCGSNPQEPRRKGAVRAGAGARRLKVLLGKALAPGNLRRRQCR

SEQ ID NO: 1478 - protein, 420 aa, Oryza sativa subsp. japonica
  misc_feature (65)..(295): Pfam Name: Branch Pfam Description: Core-2/I-Branching enzyme
  misc_feature (1)..(420): Public GI ID no. 115482162
  misc_feature (1)..(420): Bit score of 545.8 for HMM based on sequences of Figure 8
  misc_feature (1)..(420): Functional Homolog Of SEQ ID NO. 1366
MRSPVGRREVVVSGVFTALLVLSILSLPSLLLTGPAYKSWPFLAAARDDSTTGSGGGAGYYPVSFAYLISASTGDAARAARLLAALYHPANCYLLHLDREAPAEEHRRLAELVSGQPVYARAGNVWIVGRPNLVTYRGPTMLSTTLHAVAMLLRLGRRWDWFVNLSASDYPLVTQDDLMDVFSRLPRDLNFIQHTSHLGWKIKKRARPVILDTALYEADRSELIRPANLTTNRRNLPTAFKLFTGSAWTMMSRQFAEYFTVGYDDNLPRTLLLYYTNFVSSPEFYFQTLACNSRRFRNTTVNHDLHFIRWDSPPKQHPLYLGPRDYRRMLLSAAPFARKFREDDPVLDRIDRDILRRDGAAPGRAFAYGGWCSEGGVRLCSNPQEAGRKGMIKAGAGSRRLRAMLNKMMNARNFRRQQCR

SEQ ID NO: 1479 - protein, 421 aa, Zea mays
  misc_feature (73)..(298): Pfam Name: Branch Pfam Description: Core-2/I-Branching enzyme
  misc_feature (1)..(421): Bit score of 1066.6 for HMM based on sequences of Figure 8
  misc_feature (1)..(421): Functional Homolog Of SEQ ID NO. 1366
  misc_feature (44)..(44): Xaa is any aa, unknown, or other
  misc_feature (60)..(60): Xaa is any aa, unknown, or other
MGMGSARGGAGGWLPGERWRRVIFLALAAVSFLISLILLFLSAXVSASQVSSCLTPPLPXSAVRRGPGEPPCLVYLLTGARGDGRRLLRLLLAVYHPRNRYVLHLSADAPDDERLSLATGVVAAAPAVGAFENVVIIGNPTAGTPVGSSGLAGTLRAAAVLLRLHADWDWFLTLNAADYPLVTQDDLIHVLSSVPRDLNFIDHTGDVGSKEPEKVQQIIVDAGIYLSGRTNFFRGTQKRAAPEAFKFFTGSPWVILNRQFIEYCILAWENLPRILLMYFNNVIQPQEGYFQTVICNSLDFRNFTVNNDLRFMVQDDSAQKKSLFTSREHYGHMVDSGAPFARPFQENDPLLDQIDGNILKRWSHGPVPGAWCTGRKRWFSDPCSQWGDVNVLRPGPQAVMLHQYVNRTLEEAKSSSNSCRR

SEQ ID NO: 1480 - protein, 430 aa, Oryza sativa
  misc_feature (78)..(308): Pfam Name: Branch Pfam Description: Core-2/I-Branching enzyme
  misc_feature (1)..(430): Bit score of 1064.5 for HMM based on sequences of Figure 8
  misc_feature (1)..(430): Functional Homolog Of SEQ ID NO. 1366
MGMGVRGGGGGASGSGGGGGERWRWILFFAMVSVFFLLSLLLLLFSSSPPRLRLPGPAAAAPSLADDLRCGHGAPPCLAYLLVGARGDGARLLRLLLAVYHPRNRYVLHLSADASDSERRDLAAWVAAATPAVGAFRNVAVVGAPTAGTPVGSSGLAGTLRAAAVLLRLHPDWDWFITLNAADYPVVTQDDLIYVLSNVSRQFNFVDHTSDIGQKESEKVQSMIVDAGIYLAGRTNFFRASEKRPTPDAFKFFTGISCCSPWVILNRQFIEYCILGWENLPRILLMYFNNIMLPQEGYFHSVICNSLEFRNFTVNNDLRYKAWDNPPQTEPVFLDMTHYDKMVDSGAPFARRFRENESLLDKIDGNVLGRWGHGPVPGAWCSGRKSWFSDPCSQWSDVNIVRPGPQGIKLRQYINRALEEGEFGSKSCRR

SEQ ID NO: 1481 - protein, 425 aa, Triticum aestivum
  misc_feature (76)..(302): Pfam Name: Branch Pfam Description: Core-2/I-Branching enzyme
  misc_feature (1)..(425): Bit score of 964.1 for HMM based on sequences of Figure 8
  misc_feature (1)..(425): Functional Homolog Of SEQ ID NO. 1366
  misc_feature (79)..(79): Xaa is any aa, unknown, or other
MGLGGMRGGIGGGGAGSGERWRWILFLSLVSVSFLLSFLFLFLSAYSSPTRLRLPGLTTARAAAGVRRGPDALPCLAYXLLLGGRGDGHRLLRLLRAVYHPRNRYILHLSADASHEERRDLAAGVAAAAPAAVSFDNVALVGTPTAGTPVGSSGLAGTLRAAAVLLRLHPDWDWFLTLNAADYPLVTQDDLIHALSYVPREFNFIDHTSDIGRKESEKVQSMIVDAGIYLSGRTNFFRATQKRPSPDAFKFFTGSPWVILNRRFIEYCVLGWENLPRLLLMYFNNVMLPQEGYFHSVICNSLDFRNSTVNNDLRYKVWDDPPQTEPLFLSMAHYDKMVDSGQPFARRFQANGPLLDKIDEKLLKRPGHGPVPGAWCAGRKSWFIDPCSQWSDVNVVKPGPQALKLQKYINRTLEEADSGAKSCRL

SEQ ID NO: 1482 - protein, 422 aa, Oryza sativa
  misc_feature (48)..(278): Pfam Name: Branch Pfam Description: Core-2/I-Branching enzyme
  misc_feature (1)..(422): Bit score of 1011.0 for HMM based on sequences of Figure 8
  misc_feature (1)..(422): Functional Homolog Of SEQ ID NO. 1366
MVSVFFLLSLLLLLFSSSPPRLRLPGPAAAAPSLADDLRCGHGAPPCLAYLLVGARGDGARLLRLLLAVYHPRNRYVLHLSADASDSERRDLAAWVAAATPAVGAFRNVAVVGAPTAGTPVGSSGLAGTLRAAAVLLRLHPDWDWFITLNAADYPVVTQDDLIYVLSNVSRQFNFVDHTSDIGQKESEKVQSMIVDAGIYLAGRTNFFRASEKRPTPDAFKFFTGISCCSPWVILNRQFIEYCILGWENLPRILLMYFNNIMLPQEGYFHSVICNSLEFRNFTVNNDLRYKAWDNPPQTEPVFLDMTHYDKMVDSGAPFARRFRENESLLDKIDGNVLGRWGHGPVPGAWCSGRKSWFSDPCSQWSDVNIVRPGPQGIKLRQYINRALEGGEFGSKSCRSKFISDSSMTLKAELRASSNRSL

SEQ ID NO: 1483 - protein, 406 aa, Oryza sativa
  misc_feature (48)..(284): Pfam Name: Branch Pfam Description: Core-2/I-Branching enzyme
  misc_feature (1)..(406): Bit score of 1027.5 for HMM based on sequences of Figure 8
  misc_feature (1)..(406): Functional Homolog Of SEQ ID NO. 1366
MVSVFFLLSLLLLLFSSSPPRLRLPGPAAAAPSLADDLRCGHGAPPCLAYLLVGARGDGARLLRLLLAVYHPRNRYVLHLSADASDSERRDLAAWVAAATPAVGAFRNVAVVGAPTAGTPVGSSGLAGTLRAAAVLLRLHPDWDWFITLNAADYPVVTQDDLIYVLSNVSRQFNFVDHTSDIGQKESEKVQSMIVDAGIYLAGRTNFFRASEKRPTPDAFKFFTGISCCLCFCFGSPWVILNRQFIEYCILGWENLPRILLMYFNNIMLPQEGYFHSVICNSLEFRNFTVNNDLRYKAWDNPPQTEPVFLDMTHYDKMVDSGAPFARRFRENESLLDKIDGNVLGRWGHGPVPGAWCSGRKSWFSDPCSQWSDVNIVRPGPQGIKLRQYINRALEEGEFGSKSCRR

SEQ ID NO: 1484 - DNA, 1464 bp, Sorghum bicolor
  misc_feature (1)..(1464): Ceres Annot ID no. 8704386
  misc_feature (1)..(1464): Encodes the peptide sequence at SEQ ID NO. 1485
atgaggaagaattgggggctcagctccgggcacgcgcggccgttcggtgaccgccggtggctgctccccttcctcgccagtctgctcgtgacggccacgctcctactcgccgccgcgtgcggcctcttctcgccgccctacccgagcggcgccggcgacgcggccctgttcgacgtcgtctccctcgccgactgggacgacggcggcggctcgtcgtcgggccgcgacggcgcgccctccgtcgaggcgggaatcaagaaccggctgctggaaggtaacgccgccagcgacagcgacgacgacgacgacgacgagaaccccgatgatgctgcagtcaactctgacgactccgacgccgagccgccgcggatcgcgtacctcctcgagggcaccaagggcgacggcctgcggatgcggcggacgttgcaggccatctaccacccgcgcaaccagtacatcctgcacctcgacctggaggcgccgccgcgggagcggatcgatctggctatgtatgtcaagggcgaccccatgttcagccaggtcggaaatgtgcgggtcatcgccaagggaaaccttgtcacctacaaggggccgaccatggtcgcctgcacgcttcacgctgtagccattcttctcaaggaggggctccagtgggactggttcatcaatctcagcgcgtcggattatccgctcatgacacaagatgatatacttcatgtcttctcttctttgccaagaaatcttaattttatagagcactttcggttatctgggtggaaagttaatataagggcgaaaccaattgttctggacccagggctttatctgtcaaagaaatttgatcttactatgactactgagcggagagaattgccaacatctttcaaattatatactgtatctgtctttgataatgcgcacgaatcctacgctcagcactgtatatggggatgggacaatctcccacgaaacctgctgatgtacgaagtcaacttcatctcctcaccacaacgctatttccaaactgctatctgcaactctaatgattttccgggcacggcagttggccctgaccttcactacatcgcttgggactaccctccaaagcagcatccattgatcctctccatgaaggacttcaacaagatggtcaagagcggcgcgccatttgcacggaagtttcccaaggatgacaaggtcctggacaagatagaccgcgagcttttgcaccgctcagagggccggttcaccccgggagcatggtgtgatgggagctctgaaggaggggctgatccatgtttgtctaggggtgaagactctgttttcgagcctggtcctggtgctgaaaggctgcgaggcctgatgaagaaggtgctctcatgggattaccgcaatggtagctgttcctcacttgcttatgatcagacaaagagggattggtatgttcctaaaagtaaaggatag

SEQ ID NO: 1485 - protein, 487 aa, Sorghum bicolor
  misc_feature (124)..(349): Pfam Name: Branch Pfam Description: Core-2/I-Branching enzyme
  misc_feature (1)..(487): Ceres Annot ID no. 8704386
  misc_feature (1)..(487): Bit score of 559.8 for HMM based on sequences of Figure 8
  misc_feature (1)..(487): Functional Homolog Of SEQ ID NO. 1366
MRKNWGLSSGHARPFGDRRWLLPFLASLLVTATLLLAAACGLFSPPYPSGAGDAALFDVVSLADWDDGGGSSSGRDGAPSVEAGIKNRLLEGNAASDSDDDDDDENPDDAAVNSDDSDAEPPRIAYLLEGTKGDGLRMRRTLQAIYHPRNQYILHLDLEAPPRERIDLAMYVKGDPMFSQVGNVRVIAKGNLVTYKGPTMVACTLHAVAILLKEGLQWDWFINLSASDYPLMTQDDILHVFSSLPRNLNFIEHFRLSGWKVNIRAKPIVLDPGLYLSKKFDLTMTTERRELPTSFKLYTVSVFDNAHESYAQHCIWGWDNLPRNLLMYEVNFISSPQRYFQTAICNSNDFPGTAVGPDLHYIAWDYPPKQHPLILSMKDFNKMVKSGAPFARKFPKDDKVLDKIDRELLHRSEGRFTPGAWCDGSSEGGADPCLSRGEDSVFEPGPGAERLRGLMKKVLSWDYRNGSCSSLAYDQTKRDWYVPKSKG

SEQ ID NO: 1486 - DNA, 1491 bp, Sorghum bicolor
  misc_feature (1)..(1491): Ceres Annot ID no. 8657984
  misc_feature (1)..(1491): Encodes the peptide sequence at SEQ ID NO. 1487
atgcacggcaacggcggccgcggcgaccagcactcgccgaggtcggtcaagtcggctcccccccgcggcggtggcggtgcgggcgggggtgaccatgaccatcattactccccgtcagccaagaccccgcgcggcggcggcggagcaggagcagcggcgtccccgatgaaactgctgccgagcagcgcggcgtggctggtggacagccggtgggcgctgtcggccgcgctgagcctgctgctgttcctggccgtcgcgctcgccgtgacgtcctcctcgtcgtcctacatctcctcgtcgtcgtccttcttctccttcctgcccgccacccgcgccgccgacttcgtggagggggagcgtgcccggccgcaggcaacagccgcggccaacgacacggctcccccgcccggctccggcgtgccccggctggcgtacctcatctccggctccaagggcgacctggaccgtctctggcgcgcgctgcacgcgctgtaccacccgcgcaaccagtacgtggtgcacctggaccgcgaggcccccgtggcggagcgcctggagctggccgcccgcgtcgccaactccaccgtcttccgccgcaccggcaacgtccacgtcgtccgccgcgccaacatggtcacctaccgtggccccaccatggtggccaacacgctgcacgcctgcgccatcctcctccgccgcggcggcgcctgggactggttcatcaacctctccgcctccgattacccgctcatgacgcaggacgacatcctgcacacattctcgacggtgcccaggaatatcaacttcatcgggcacacgggcaacttaggctggaagatgtggcagcggggtcagcctatgatcgtggatccagggctatacggctccaagaagcaggacctcttctgggtggcaccgaagcgggcactgccgacggcattcaagctcttcacaggctccgcttgggtggcactgacgcgggacttggtggagtacacggtgtgggggtgggacaacctgccgcgcaccctgctcatgtactacgccaacttcatctcctccccggagggctacttccagacgctagtctgcaacgcaccgcgtttcgtgcccaccgtcgccaaccacgacctccaccacatccagtgggacgtgccgccgaaacagcacccgcgcgcgctcgcgctcgccgacatgcccggcatgcttgctagcggtgcgccattcgcgaggaagttcccgcgtgatgaccctgtgctcgacgccatcgatgacgggctcctcgcacgcccacgcctgaccaacaacattggcaacggcaccgccggcgaggtagcattcgtgcctggcggttggtgtggtgccgatgccacgtgccaggctgtggacaatgactgggtgctcagacctgggcctggagctgagcgcttcgggaggctcattgataggatcgttaggtccaaaactttcctcaataggcaatgcaagtag

SEQ ID NO: 1487 - protein, 496 aa, Sorghum bicolor
  misc_feature (143)..(368): Pfam Name: Branch Pfam Description: Core-2/I-Branching enzyme
  misc_feature (1)..(496): Ceres Annot ID no. 8657984
  misc_feature (1)..(496): Bit score of 623.0 for HMM based on sequences of Figure 8
  misc_feature (1)..(496): Functional Homolog Of SEQ ID NO. 1366
MHGNGGRGDQHSPRSVKSAPPRGGGGAGGGDHDHHYSPSAKTPRGGGGAGAAASPMKLLPSSAAWLVDSRWALSAALSLLLFLAVALAVTSSSSSYISSSSSFFSFLPATRAADFVEGERARPQATAAANDTAPPPGSGVPRLAYLISGSKGDLDRLWRALHALYHPRNQYVVHLDREAPVAERLELAARVANSTVFRRTGNVHVVRRANMVTYRGPTMVANTLHACAILLRRGGAWDWFINLSASDYPLMTQDDILHTFSTVPRNINFIGHTGNLGWKMWQRGQPMIVDPGLYGSKKQDLFWVAPKRALPTAFKLFTGSAWVALTRDLVEYTVWGWDNLPRTLLMYYANFISSPEGYFQTLVCNAPRFVPTVANHDLHHIQWDVPPKQHPRALALADMPGMLASGAPFARKFPRDDPVLDAIDDGLLARPRLTNNIGNGTAGEVAFVPGGWCGADATCQAVDNDWVLRPGPGAERFGRLIDRIVRSKTFLNRQCK

SEQ ID NO: 1488 - DNA, 2138 bp, Panicum virgatum
  misc_feature (1)..(2138): Ceres Clone ID no. 1909354
  misc_feature (1)..(2138): Encodes the peptide sequence at SEQ ID NO. 1489
agccatcatcgccaccaccgagcgcactgcgcacccacggcccgacggcgacgacacgcccggatcggagcagacgccggtgagcgagcggccgccggacagatatacagtgcggcgcggcatgggggtgaccacggccggggaggcggtcaagtccccggtgcgggcgtctggcgtcgtcaagctcaacgcggcgttcctcgccctgttcctcctcgcgtacatggcgctcctcctccaccccaggtactcgtacctcctcgaccgcggcgccacctccctcgtccgctgcaccttcagcgacgacgcctgcccgccatcgatgacccagctctcacggaagctgggaggaggcgtgcgcggcgaacaaggtggcggcggagcggatcgtgaacgcggggcgcgcgccggccatgttcgacgagctccggggccggctgcggatgggcctggtgaacatccgccgcgaggacgtgctggcgctgggcgtggagggcgaggcgatgcgcgtggacctggagcgcgtctccgacgtgttccggtggtcggacctgttcccggagtggatcgacgaggaggaggacgacgaggggccgtcctgcccggagctccccatgcctgacctgtcccggatcgacggcgaggtggacgtggtggtggcgtccctgccgtgcaaccgcaccgcgcccggcgggtggaaccgcgacgtgttcaggctgcaggtgcacctggcggcggcgcgggtggcggcgcgcaagggccggcgcgacggcggcggggccgtgcgcgtcgtgctgcggagcgagtgcgagccgatgatggacctgttccggtgcgacgaggcggtgggccgggagggggactggtggatgtacagggtcaacgtggagcgcctcgaggagaagctccggctgcccgtcgggtcctgcaacctcgcgctgccgctctggggatcaggaggcatccacgaggtgttcaacgtgtcgtcggagccgccgacgacgacggggcgccgcccccgtcgcgaggcgtacgcgacggtgctgcactcgtcggacacgtacctgtgcggcgcgatcgtgctggcgcagagcatccggcggtcgggctccacccgcgacctggtcctcctccacgaccacacggtgtccaagccggcgctccgggcgctgtcggcggcggggtggaccccgcgcaggatcaagcgcatccgcaacccgcgcgcggcgcggggctcctacaacgagtacaactacagcaagttccggctgtggcagctgaccgagtacgaccgcgtggtgttcgtggacgccgacatcctggtgctccgcaacctggacgcgctgttcgggttcccgcagctctccgcggtgggcaacgacgggcccctcttcaactcgggcgtgatggtgatcgagccgtcggcgtgcacgttcgaggcgctggtccggaagcggcgcacggtgcggtcgtacaacggcggcgaccaggggttcctgaacgaggtgttcgtgtggtggcaccggctgccgcggcgcgtcaactacctcaagaacttctgggccaacaccaccggggagcgcgcgctcaaggggcgcctgttccgggcggaacccgccgaggtgtgggccatccactacctggggatgaagccgtggacgtgctaccgggactacgactgcaactggaacgtggcggaccagcgggtgtacgccagcgacgaggcgcacgcgcggtggtggcaggtgtacgaccggatgggggagcccatgcgcgggccctgcaggctctcggagcggaggaaggtggagatcgcgtgggacaggcacgtcgcccaggagatgggattcgcggaccagcactggaagatcaacatcaccgacccgcggaaatgggaataatatatatgactgctcaagatcatcggccttgcatcgccttgagcgagaggaagaagctaggccggcgacgcatctgatcgagctcgatcggtagtaggtcgccacattttgattgtattaattcgtgagtttctttttttatttttcctttgttgatgtgcatacatacataagggagaagtacgcatgcaggtcgaactcggatcgattgaataaagaataactcgagttccaggc

SEQ ID NO: 1489 - protein, 601 aa, Panicum virgatum
  misc_feature (314)..(525): Pfam Name: Glyco_transf_8 Pfam Description: Glycosyl transferase family 8
  misc_feature (1)..(601): Ceres Clone ID no. 1909354
  misc_feature (1)..(601): Bit score of 1556.1 for HMM based on sequences of Figure 2
  misc_feature (1)..(601): in Figure 2
MGVTTAGEAVKSPVRASGVVKLNAAFLALFLLAYMALLLHPRYSYLLDRGATSLVRCTFSDDACPPSMTQLSRKLGGGVRGEQGGGGADRERGARAGHVRRAPGPAMFDELRGRLRMGLVNIRREDVLALGVEGEAMRVDLERVSDVFRWSDLFPEWIDEEEDDEGPSCPELPMPDLSRIDGEVDVVVASLPCNRTAPGGWNRDVFRLQVHLAAARVAARKGRRDGGGAVRVVLRSECEPMMDLFRCDEAVGREGDWWMYRVNVERLEEKLRLPVGSCNLALPLWGSGGIHEVFNVSSEPPTTTGRRPRREAYATVLHSSDTYLCGAIVLAQSIRRSGSTRDLVLLHDHTVSKPALRALSAAGWTPRRIKRIRNPRAARGSYNEYNYSKFRLWQLTEYDRVVFVDADILVLRNLDALFGFPQLSAVGNDGPLFNSGVMVIEPSACTFEALVRKRRTVRSYNGGDQGFLNEVFVWWHRLPRRVNYLKNFWANTTGERALKGRLFRAEPAEVWAIHYLGMKPWTCYRDYDCNWNVADQRVYASDEAHARWWQVYDRMGEPMRGPCRLSERRKVEIAWDRHVAQEMGFADQHWKINITDPRKWE

SEQ ID NO: 1490 - DNA, 1818 bp, Sorghum bicolor
  misc_feature (1)..(1818): Ceres Annot ID no. 8642776
  misc_feature (1)..(1818): Encodes the peptide sequence at SEQ ID NO. 1491
atgggggtgaccaccgccggtgaagcggcctgcaagtccccggcggtgcgggcctcggtcatcgtcaggctcaacgccgcgttcctcgccttcttcctcttcgcctacctggcgctcctcctccaccccaagtactcggacatcctcgaccgcggcgccacctccctcgtccgctgcaccttccgcgactcctgcccaccgccggcgccgtcgtcgtcgtcgtcgacccagctctcacggaagctgggaggcgtggcggcgaacaaggtggcggcggcggcggagcgcatcgtgatcgtgaacgcggggcgcgcgccggccatgttcgacgacctccgtggccgtcttcggatgggcctggtgaacatcgggcgcgacgaggtggtggcgctgggcgtggagggcgacgcggtgcgcgtggacttcgaccgcgtctccgagacgttccggtggtcggacctgttcccggagtggatcgacgaggaggaggacgacgagggcccgtcctgcccggagctccccatgccggactggtcccggtacggcgacgtggacgtggtggtggcgtcgctgccgtgcaaccgcagcgcgaccgggtggaaccgcgacgtgttcaggctgcaggtgcacctggtggcggcgcaggtggcggcacggaagggccggcgcaacggggccggcgccggggccgtgcgcgtggtgctgcggagccagtgcgagcccatgatggacctgttccgctgcgacgaggcggtgggacgggagggggactggtacatgtacagagtcgacgtgcagcgcctggaggagaagctccgcctgcccgtgggctcctgcaacctcgccatgccgctctggggagcaggagggatccaggaggtgttcaacgcgtcgtcggagctggcgacgtcgccgtcgtggtcgggcgggcgtccccggcgtgaggcgtacgcgacggtgctgcactcgtcggacacgtacctgtgcggcgcgatcgtgctggcgcagagcatccggcgctcggggtccacccgggacctgatcctcctccacgaccacacggtgtcgaagccggcgctccgggcgctgacggcggccgggtggacgcctcgccggatcaagcggatccgcaacccgcgcgcggcgcggggcacctacaacgagtacaactacagcaagttccggctgtggcagctgaccgactacgaccgcgtggtgttcgtggacgccgacatcctggtgctccgcagcctggacgcgctgttcgcgttcccgcagctcacggcggtgggcaacgacgggtccctcttcaactccggtgtgatggtgatcgagccgtcggcgtgcacgttcgacgcgctgatccgggaccgccggaccatccggtcgtacaacggcggcgaccaggggttcctgaacgaggtgttcgtgtggtggcaccggctgccgcggcgggtgaactacctcaagaacttctgggcaaacaccaccggggagcgcgcgctcaaggagcggatgttccgggcggacccggccgaggtgtggtccatccactacctggggatgaagccatggacgtgctacagggactacgactgcaactggaacgtggcggaccagcgggtgtacgccagcgacgaggcgcacaggcgctggtggcaggtgtacgaccagatgggggagaccatgcgcgggccatgccgcctctccgagcggaggaaggtggagatcgcatgggacaggcacgtcgccgaggaggtcgggtacgccgaccagcactggaagatcaacatcacggacccaaggaaatgggactga

SEQ ID NO: 1491 - protein, 605 aa, Sorghum bicolor
  misc_feature (318)..(529): Pfam Name: Glyco_transf_8 Pfam Description: Glycosyl transferase family 8
  misc_feature (1)..(605): Ceres Annot ID no. 8642776
  misc_feature (1)..(605): Bit score of 1574.7 for HMM based on sequences of Figure 2
  misc_feature (1)..(605): Functional Homolog Of SEQ ID NO. 1489
  misc_feature (1)..(605): in Figure 2
MGVTTAGEAACKSPAVRASVIVRLNAAFLAFFLFAYLALLLHPKYSDILDRGATSLVRCTFRDSCPPPAPSSSSSTQLSRKLGGVAANKVAAAAERIVIVNAGRAPAMFDDLRGRLRMGLVNIGRDEVVALGVEGDAVRVDFDRVSETFRWSDLFPEWIDEEEDDEGPSCPELPMPDWSRYGDVDVVVASLPCNRSATGWNRDVFRLQVHLVAAQVAARKGRRNGAGAGAVRVVLRSQCEPMMDLFRCDEAVGREGDWYMYRVDVQRLEEKLRLPVGSCNLAMPLWGAGGIQEVFNASSELATSPSWSGGRPRREAYATVLHSSDTYLCGAIVLAQSIRRSGSTRDLILLHDHTVSKPALRALTAAGWTPRRIKRIRNPRAARGTYNEYNYSKFRLWQLTDYDRVVFVDADILVLRSLDALFAFPQLTAVGNDGSLFNSGVMVIEPSACTFDALIRDRRTIRSYNGGDQGFLNEVFVWWHRLPRRVNYLKNFWANTTGERALKERMFRADPAEVWSIHYLGMKPWTCYRDYDCNWNVADQRVYASDEAHRRWWQVYDQMGETMRGPCRLSERRKVEIAWDRHVAEEVGYADQHWKINITDPRKWD

SEQ ID NO: 1492 - protein, 593 aa, Zea mays
  misc_feature (306)..(517): Pfam Name: Glyco_transf_8 Pfam Description: Glycosyl transferase family 8
  misc_feature (1)..(593): Public GI ID no. 212276047
  misc_feature (1)..(593): Bit score of 1576.4 for HMM based on sequences of Figure 2
  misc_feature (1)..(593): Functional Homolog Of SEQ ID NO. 1489
  misc_feature (1)..(593): in Figure 2
MGVTTAGEAVCKSPARASVIVRLNAAFLAFFLFAYVALLLHPKYSGLLDRGATSLVRCTFRDSCPPPSPSNQQLSRKLGGVAANKVAEEERIVNAGRAAAMFDELRGRLRMGLVNIGRDELLALGVEGDAVRVDFERVSDAFRWSDLFPEWIDEEEDDEGPSCPELPMPDWARYGGDVDVVVASLPCNRSAPGWNRDVFRLQVHLVAAQVAARKGRRDGAGAVRVVLRSQCEPMMDLFRCDEEVGREGDWYMYKVDVPRLEEKLRLPVGSCNLAMPLWGSGGRGIHEVLNATSWSGGRRPRREAYATVLHSSDTYLCGAIVLAQSIRRAGSTRDLVLLHDHTVSRPALRALSAAGWTPRRIKRIRNPRAARGTYNEYNYSKFRLWQLADYDRVVFVDADILVLRDLDALFAFPQLAAVGNDGSLFNSGVMVIEPSACTFDALMRGRRTVRSYNGGDQGFLNEVFVWWHRLPRRVNYLKNFWANTTGERALKERLFRADPPEVWSVHYLGMKPWTCYRDYDCNWNVADQRVYASDEAHARWWQVYDQMGDHMRGPCRLSERRKVEIAWDRHVAEELGYTDQHWKINITDPRKWD

SEQ ID NO: 1493 - protein, 614 aa, Oryza sativa subsp. japonica
  misc_feature (327)..(538): Pfam Name: Glyco_transf_8 Pfam Description: Glycosyl transferase family 8
  misc_feature (1)..(614): Public GI ID no. 15217280
  misc_feature (1)..(614): Bit score of 1601.4 for HMM based on sequences of Figure 2
  misc_feature (1)..(614): Functional Homolog Of SEQ ID NO. 1489
  misc_feature (1)..(614): in Figure 2
MGVTGGAGEAVKPSSSSSLSPVAGLRAAAIVKLNAAFLAFFFLAYMALLLHPKYSYLLDRGAASSLVRCTAFRDACTPATTTTAQLSRKLGGVAANKAVAAAAERIVNAGRAPAMFDELRGRLRMGLVNIGRDELLALGVEGDAVGVDFERVSDMFRWSDLFPEWIDEEEDDEGPSCPELPMPDFSRYGDVDVVVASLPCNRSDAAWNRDVFRLQVHLVTAHMAARKGLRHDAGGGGGGGRVRVVVRSECEPMMDLFRCDEAVGRDGEWWMYMVDVERLEEKLRLPVGSCNLALPLWGPGGIQEVFNVSELTAAAATAGRPRREAYATVLHSSDTYLCGAIVLAQSIRRAGSTRDLVLLHDHTVSKPALAALVAAGWTPRKIKRIRNPRAERGTYNEYNYSKFRLWQLTDYDRVVFVDADILVLRDLDALFGFPQLTAVGNDGSLFNSGVMVIEPSQCTFQSLIRQRRTIRSYNGGDQGFLNEVFVWWHRLPRRVNYLKNFWANTTAERALKERLFRADPAEVWSIHYLGLKPWTCYRDYDCNWNIGDQRVYASDAAHARWWQVYDDMGEAMRSPCRLSERRKIEIAWDRHLAEEAGFSDHHWKINITDPRKWE

SEQ ID NO: 1494 - DNA, 1764 bp, Populus balsamifera subsp. trichocarpa
  misc_feature (1)..(1764): Ceres Annot ID no. 1539881
  misc_feature (1)..(1764): Encodes the peptide sequence at SEQ ID NO. 1495
atggctgagggacttaaccttcaaaagctaatgaagactacaccttcaaaagctttggttatcagaatcaatttggttttccttgctttctttcttgttttctatgcatcccttcttctctcgccatcttcttcagtctattttgagaatgcagcatctctcgttaagtgctcattgagagagtgccatcacaaggcagaaaatgggagtggggtgaaggcaatcgtggaagagacgaaagccaatgctcgaagaaatatgaccaaggttgaggtaccgagcttcatgaatgggatgggaaagggaaagaagatcggcatggtaaatatggatgaagatgatgttaccggctggaaagctcatggagagactatacctatcggttttgaaagggtgtctgagtttttcaagtggccggacttgtttcctgaatggattgacgaggaggaagaaacagatgttccatcctgtccagaaataccaatgccagatttcgaagtctatgacagcctggacttgatagtggcaaaactaccatgcaagtatcctgaagaaggatggaatagagaggtgtttaggctccaagttcacctcttagcagcgaatttggctgtgaaaaagggtaggagggattggaattggaggaccaaggtggtgttttggagcaaatgcagaccaatgttggagttgtttaggtgcgatgatttggtaaaacaggaaggtgattggtggttctatgagccggagatgacaaagttggaacagaaggtctcgttgcctattgggtcttgcaaactggctttgcctctgtggacacaagctggtattaacgaagtctacgatctctccaagattcaaaggacaacaagaactaccaaacgagaggcctatgccacggtactccattcctcagaagcctacgtctgtggtgtcatagcccttgcccaaagccttctccaaacggggaccaagcgtgaccttgttcttctcctagataattccatctctgaacccaaacgtcatgctcttgcagcagccgggtggaagatccgactcatcaaaagaatccgaaaccctagagctgaaaaatactcgtacaatgagtacaactatagcaagtttaggctgtggcagctcactgattatgacaagatcgtcttcatagatgcggacatcatagttttgcgtaaccttgatatcctttttcacttccctcaaatgtcagctacggggaacgatgtatggatttttaattctggtatcatggtcattgagccatcaaattgcacattcaaaatattaatggaccgacgcaaggagattatttcctacaatggaggtgatcaagggttccttaatgaagtttttgtatggtggcatagattaccaagaagagtgaacttcttgaaaaacttctgggctaacactaccaatgaggctagtgtcaagaacgagctctttggggcagacccaccaaaagtttattccatacattatctggggttaaagccttggctttgttacagagactatgattgtaactggaatataggagatcaacgtgtttatgcaagtgatgtagcacatcagaggtggtggaaatttcacgatgccatggatgagaagttgcaaaagttttgtgggttaacaaagcagagaaaaattgagttggactgggatagaaaaatggctagaaagagtcagttcagtgatgagcattggaaaataaatgttactgatcctagaagggttcatttgatataa

SEQ ID NO: 1495 - protein, 501 aa, Populus balsamifera subsp. trichocarpa
  misc_feature (212)..(423): Pfam Name: Glyco_transf_8 Pfam Description: Glycosyl transferase family 8
  misc_feature (1)..(501): Ceres Annot ID no. 1539881
  misc_feature (1)..(501): Bit score of 1378.5 for HMM based on sequences of Figure 2
  misc_feature (1)..(501): Functional Homolog Of SEQ ID NO. 1489
  misc_feature (1)..(501): in Figure 2
MTKVEVPSFMNGMGKGKKIGMVNMDEDDVTGWKAHGETIPIGFERVSEFFKWPDLFPEWIDEEEETDVPSCPEIPMPDFEVYDSLDLIVAKLPCKYPEEGWNREVFRLQVHLLAANLAVKKGRRDWNWRTKVVFWSKCRPMLELFRCDDLVKQEGDWWFYEPEMTKLEQKVSLPIGSCKLALPLWTQAGINEVYDLSKIQRTTRTTKREAYATVLHSSEAYVCGVIALAQSLLQTGTKRDLVLLLDNSISEPKRHALAAAGWKIRLIKRIRNPRAEKYSYNEYNYSKFRLWQLTDYDKIVFIDADIIVLRNLDILFHFPQMSATGNDVWIFNSGIMVIEPSNCTFKILMDRRKEIISYNGGDQGFLNEVFVWWHRLPRRVNFLKNFWANTTNEASVKNELFGADPPKVYSIHYLGLKPWLCYRDYDCNWNIGDQRVYASDVAHQRWWKFHDAMDEKLQKFCGLTKQRKIELDWDRKMARKSQFSDEHWKINVTDPRRVHLI

SEQ ID NO: 1496 - protein, 590 aa, Vitis vinifera
  misc_feature (303)..(514): Pfam Name: Glyco_transf_8 Pfam Description: Glycosyl transferase family 8
  misc_feature (1)..(590): Public GI ID no. 225458601
  misc_feature (1)..(590): Bit score of 1566.7 for HMM based on sequences of Figure 2
  misc_feature (1)..(590): Functional Homolog Of SEQ ID NO. 1489
  misc_feature (1)..(590): in Figure 2
MVLEGVSVPKMLIKVTPSKALVLKINLVFLAFFVVVYAALLLRPSLSVYHENAAALVRCTLRECNHKAEKGVKMKAALEENQADQAMAAKRKMVKSEKPSFLNEMRKGMRIGMVNMDDEDVGEWKVHGEIVHVHFQQVSELFNWTDLFPEWIDEEEEKEGTMCPEIPMPDFRRYWDMDLIVAKLPCKYPEEGWRRDVFRLQVHLIAANLAVKKGRRDWNWRTKLVFLSRCRPMMELFRCDDLVRQEGDWWFYQPSVARLEQKVSLPVGSCKLALPLWAKGVDKVFDLSKIKADTRSVKREAYATVLHSSDTYVCGAITLAQSLLRTGTKRDLLLLLDSSIPVSKRDALAAAGWQIRLIKRIRNPKAEKDSYNEYNYSKFRLWQLTEYDKIIFIDADIIVLRNLDLLFHFPQMSATGNDGSIFNSGIMTIEPSNCTFRILMNHIKDIVSYNGGDQGFLNEVFVWWHRFPKRVNFLKNFWSNSTVEAGVKNQLFGSDPPKLYSIHYLGLKPWLCYRDYDCNWDIENQLVYASDVAHHRWWKLHDAMDESLQTFCGLSERRKIELAWDRKVAGERGLRNQHWSINVTDPRRFL

SEQ ID NO: 1497 - DNA, 1919 bp, Arabidopsis thaliana
  misc_feature (1)..(1919): Ceres Annot ID no. 879992
  misc_feature (1)..(1919): Encodes the peptide sequence at SEQ ID NO. 1498
agaaacgagatgacgataatgacgatgataatgaagatggctccttccaaatctgcactgatacgctttaatctagtcttgttgggtttctcttttcttctctacactgccattttcttccacccttcttcatcagtctatttcagcagcggagcttcctttgttggatgctcttttcgtgattgcactcccaaggtggtgagaggagtgaagatgcaagaactcgttgaagagaacgaaataaacaagaaagatttgctaaccgctagtaaccagacaaagctggaggcgccaagcttcatggaagagattttaacaagagggttaggaaaaacaaagatagggatggtgaacatggaagaatgtgatcttactaattggaaacgttatggcgaaacggttcacatacattttgagcgtgtctcgaagctcttcaaatggcaagacttgttccccgagtggatagatgaagaggaagaaaccgaggttcccacatgtcctgagatacctatgcccgatttcgaaagcttagagaagttggatttggtagtagtgaagttgccttgtaattaccctgaagaagggtggagaagagaggttttgaggttgcaagtgaacctagttgcggctaacttggcagccaagaaagggaagacggattggagatggaaaagcaaagtgttgttttggagcaaatgtcaaccgatgattgagattttccggtgtgatgatttggagaagagagaggcagattggtggctgtatcgccctgaggtggttaggttacaacagagactcagtttgccagtcggatcttgcaatcttgctcttcctttgtgggcaccacaaggtgtagacaaagtgtatgacctaacgaagatagaagcagagacaaaacgaccaaaacgtgaagcctacgtaactgttcttcactcttccgagtcttatgtctgtggtgccataactttggctcaaagcctccttcagacaaacaccaaacgcgatcttatccttctccacgatgactccatctccattaccaaacttcgagctctcgccgccgcaggatggaagcttcgtcggatcattcgaatcagaaacccacttgcggagaaggactcgtacaatgaatacaactacagcaagtttcgactctggcaattgacagattacgacaaagtgatcttcattgatgccgacatcatcgtcttacgtaaccttgatcttctcttccattttcctcagatgtcggccaccggaaatgatgtatggatatataattcaggcatcatggtcatcgagccttctaattgtacgtttactacaatcatgagccagcgaagcgagatcgtttcatacaacggtggagatcaagggtacctaaacgagatatttgtgtggtggcaccgattgcctcgacgagtaaactttctgaagaacttctggtcgaacacaaccaaagaaagaaacatcaagaacaacctcttcgccgcggagccgcctcaggtctacgcggtccactacttaggttggaaaccatggctttgctatagggactacgattgcaactacgacgtggacgagcagttggtgtacgctagtgatgcggctcacgttaggtggtggaaagtgcacgactccatggacgatgcattgcaaaagttttgcaggctgacgaaaaagaggagaacggagatcaactgggagaggaggaaagcaaggcttagaggttccactgattatcattggaagatcaatgtcactgatccaagacgacgtcgttcttatttgattggttaatttgttttttccttgtatttagacatcatatcgagactgatacccattactccaccttttctttattcttgttctttgtagatcatgtctatgagtatcttacaatattattcatgagt

SEQ ID NO: 1498 - protein, 596 aa, Arabidopsis thaliana
  misc_feature (304)..(515): Pfam Name: Glyco_transf_8 Pfam Description: Glycosyl transferase family 8
  misc_feature (1)..(596): Ceres Annot ID no. 879992
  misc_feature (1)..(596): Bit score of 1540.2 for HMM based on sequences of Figure 2
  misc_feature (1)..(596): Functional Homolog Of SEQ ID NO. 1489
  misc_feature (1)..(596): in Figure 2
MTIMTMIMKMAPSKSALIRFNLVLLGFSFLLYTAIFFHPSSSVYFSSGASFVGCSFRDCTPKVVRGVKMQELVEENEINKKDLLTASNQTKLEAPSFMEEILTRGLGKTKIGMVNMEECDLTNWKRYGETVHIHFERVSKLFKWQDLFPEWIDEEEETEVPTCPEIPMPDFESLEKLDLVVVKLPCNYPEEGWRREVLRLQVNLVAANLAAKKGKTDWRWKSKVLFWSKCQPMIEIFRCDDLEKREADWWLYRPEVVRLQQRLSLPVGSCNLALPLWAPQGVDKVYDLTKIEAETKRPKREAYVTVLHSSESYVCGAITLAQSLLQTNTKRDLILLHDDSISITKLRALAAAGWKLRRIIRIRNPLAEKDSYNEYNYSKFRLWQLTDYDKVIFIDADIIVLRNLDLLFHFPQMSATGNDVWIYNSGIMVIEPSNCTFTTIMSQRSEIVSYNGGDQGYLNEIFVWWHRLPRRVNFLKNFWSNTTKERNIKNNLFAAEPPQVYAVHYLGWKPWLCYRDYDCNYDVDEQLVYASDAAHVRWWKVHDSMDDALQKFCRLTKKRRTEINWERRKARLRGSTDYHWKINVTDPRRRRSYLIG

SEQ ID NO: 1499 - protein, 611 aa, Picea sitchensis
  misc_feature (324)..(535): Pfam Name: Glyco_transf_8 Pfam Description: Glycosyl transferase family 8
  misc_feature (1)..(611): Public GI ID no. 116789722
  misc_feature (1)..(611): Bit score of 1555.4 for HMM based on sequences of Figure 2
  misc_feature (1)..(611): Functional Homolog Of SEQ ID NO. 1489
  misc_feature (1)..(611): in Figure 2
MKYRGQVSVNFFMQAYKGQVDRLNDKYFKYSPEMLRQVGTTRGCRPFGTRIRLLVLLLFMAACTSWMFFTPGSLDLEKELRNSTQAERYGKVRWRDPEKVGVIMERGLAEKRNEQNRVINWRRLNSMIGSVMGIKEGMKIALVNFEEEEVQQWEPLGETTVIKFERVDEDVAWTDLFPEWIDEEEQYTTPVCPTVPMPEISNETKFDLVVARLPCRKPEQGWSRDVLRLQIHLVSANVAARASRNGEKMAMLFFSSCRPMPDLFRCEDLVKNQGMDAVWLYVSDVKKLAKKISLPVGSCELALSWKDHPETPRVLNPNRREAYATILHSSEFYVCGAIALAQSIRMSGSMKDLIILVDKKVGEEKREGLRAAGWQVREIRRIRNPRAEKYSYNEWNYSKFRLWQLTDYDKIIFIDSDLLILRNLDFLFDLPEISATGNSRFIFNSGMMVIEPSNCTFSFLLRHRRDIVSYNGGDQGYLNEVFTWWHRIPKRMNYLKHFWSNDTEEFEMKTSLFGADPPELYVLHYLGIKPWLCYRDYDCNWNVENQRAYASNVAHARWWKIHDNMPRQLHKFCLVPTVQKEILEWDRMQAQISGFPDQHWKLNITDPRLHL

SEQ ID NO: 1500 - DNA, 2094 bp, Glycine max
  misc_feature (1)..(2094): Ceres Clone ID no. 517025
  misc_feature (1)..(2094): Encodes the peptide sequence at SEQ ID NO. 1501
gcttgatctttctttcttttgaattgtgagacttactttttctcctactttgacctttttgtccctgcattctgctatcgtttggcgaaatctgatgctcccttgagctgaatcggacaatgaggggaccctccccgagctccgtggaaccgcgccaccgctcctcctcttccttcagtgaggatactggcaagagaaggtctcaaagaattaaagattttaaagatgttgagaaggcgttgcatattccattccaagacaggattataacttgcaggccgaattggaagttagttttggttattattgtattgggaaccttagttacaattttccatcctccagctgtttataatactgatcatctatcaaactctttatcacggccaacttttataaacaactggaaaggagggttcaatggcattgattcacgttatgcatcattattaaatattgagtgggaccaagtatctaatgttcttgaaaatttgaaggataaggatacataccagggtgttggcttattaaacttcaatgacagtgagaatgaccagtggaaggagctgataccagaagctgagcatgtagtccttcacctgaactacacttcaagtaatattacttgggatgtcctgtatccagaatggatagacgaagaagaagaatacgagttccctacatgtccaacactacctaggattcaggtaccaggaaagcctcggcttgatcttattgctgtcaagcttccctgcaacaagtcagggtgctggtcaagagatgtagctcgtttgcacctgcagattgaagctgcgagacttgctgcctcatccaaaggatatcatcctgtgcgtttgcttttggtcactgattgcttcccaaccccaaatctctttacttgcaaggaacttatacagcgtgaagggaatacctggctttatgaacccaacctgaatacacttagagagaagctgcagctgcccattggttcatgtgaactgacagttcctttgaaagctaaagaaaatttttattcagaaaggccacaccgagaagcttatgcaaccatcctgcactctgcacagatgtatgtttgtggagccattactgcagctcagagtattcgcatgtcgggttcaacacgagatcttgtgattcttgttgatgaaacaattagtgagtatcatagagggggcttgaaggctgctggatggaagatccatacaatccaaagaatcaggaatccaaaagcagaaccagaggcatataacgagtggaactacagcaaattccgtctctggcagctaacagattatgataaaatcattttcattgatgctgaccttcttatacttagaaacatcgatttcctttttgagatgccagaaatatctgccataggaaacaatgctacgctgttcaactcaggtgtaatggtggttgaaccatcaaattgtacatttcaacttcttatggatcacatcaacgagattgtctcctacaatggtggggaccaggggtatctgaatgaactcttcacatggtggcaccggattccaaaacacatgaacttcttgaagcacttctgggaaggtgatgaggaagagaaaaaagcaatgaaaactcgtctcttcagagctgatccaccaatcctttatgtcatccattatctgggtaataagccatggctttgcttccgagactatgactgcaactggaacgtggacatcctgcaggagtttgcaagcaatgtagctcatgcaagatggtggaaggtgcatgatgcaatgccagaaaacttgcagaagttctgtttgcttaggtccaagcagaaggctgcattagagtgggatcgtcgacaagctgaaaagggaaactacagtgatggtcactggaaaattaagataaaagacccaagattgaacacttgctttgaggatttctgtttctgggagagcatgttatggcattggggtgaaaagaattggacagataattctactgttaacaattcaccacttattgtccaaacccaatctctctcttccttatgaatttacttctctttatggttatacttccatatattactgt

SEQ ID NO: 1501 - protein, 644 aa, Glycine max
  misc_feature (315)..(527): Pfam Name: Glyco_transf_8 Pfam Description: Glycosyl transferase family 8
  misc_feature (1)..(644): Ceres Clone ID no. 517025
  misc_feature (1)..(644): Bit score of 1635.8 for HMM based on sequences of Figure 2
  misc_feature (1)..(644): Functional Homolog Of SEQ ID NO. 1489
  misc_feature (1)..(644): in Figure 2
MRGPSPSSVEPRHRSSSSFSEDTGKRRSQRIKDFKDVEKALHIPFQDRIITCRPNWKLVLVIIVLGTLVTIFHPPAVYNTDHLSNSLSRPTFINNWKGGFNGIDSRYASLLNIEWDQVSNVLENLKDKDTYQGVGLLNFNDSENDQWKELIPEAEHVVLHLNYTSSNITWDVLYPEWIDEEEEYEFPTCPTLPRIQVPGKPRLDLIAVKLPCNKSGCWSRDVARLHLQIEAARLAASSKGYHPVRLLLVTDCFPTPNLFTCKELIQREGNTWLYEPNLNTLREKLQLPIGSCELTVPLKAKENFYSERPHREAYATILHSAQMYVCGAITAAQSIRMSGSTRDLVILVDETISEYHRGGLKAAGWKIHTIQRIRNPKAEPEAYNEWNYSKFRLWQLTDYDKIIFIDADLLILRNIDFLFEMPEISAIGNNATLFNSGVMVVEPSNCTFQLLMDHINEIVSYNGGDQGYLNELFTWWHRIPKHMNFLKHFWEGDEEEKKAMKTRLFRADPPILYVIHYLGNKPWLCFRDYDCNWNVDILQEFASNVAHARWWKVHDAMPENLQKFCLLRSKQKAALEWDRRQAEKGNYSDGHWKIKIKDPRLNTCFEDFCFWESMLWHWGEKNWTDNSTVNNSPLIVQTQSLSSL

SEQ ID NO: 1502 - DNA, 2189 bp, Gossypium hirsutum
  misc_feature (1)..(2189): Ceres Clone ID no. 1948550
  misc_feature (1)..(2189): Encodes the peptide sequence at SEQ ID NO. 1503
aaagcgttggatcacacaacagaaccagctctgtcctttcttttttatcccctaaaattttgaaaaaaaaatcagttaaggctttaaatatctcaaagtataaacaaatgattattaatttttgagtttcaggtgatctgaaagaaattattctgaagatgagaggcccctctctgagtcccaaagagccccgccaccgcgttgctgcttccgccgctgaagaaacaagcagaagagggttccaaaggaacaaggttttcagagatgttgagaaggctctccatgttcctattcggtacaggaactggaattgcaagatttctactttgaaagttcttctggttataattttggtgggatctctcatcactctccttcgctctcctgcagtttacatttcagatcgtccatccaatcttgtatctcggcctggttttgtagacagatggataagagacagtggtgccgcagatccacgttatttatcaatgttggatgtaaattgggatcaaatcttgaatgtcattgagaaactgactgacagggacggatatcagggaattggcttattgaacttcaataatactgaaactaatcaatggaagcagctgttaccagatgctgagcatgttgttttgcaattggactatgtggcagacaatgttacttgggaatccctgttccctgaatggattgacgaagaagaagtatttgaggttcctaattgtccttcactacctagtcttcagtttcctggaaaaccacggattgatcttattgctgttaagcttccttgcaacaaggcagggaagtggtcaagagatgtcacacgtctacactttcagctagcagcagcaaggcttgctgcatctgctaaagggcttcacccagtgcatgtgctttttgtcactgactgcttcccgcttccaaatctttttgcatgcaaggaccttgttgcacgtgaaggaagtgcttggctgtatacacccaacctacataggttaagagaaaagattcgactgccagtcggttcatgtgaactttcagttcctctccaggctaaagggtctttctattcagagagagcacaccgtgaagcatatgcaacaatcctacactcagctcatgtatatgtttgtggggccattactgctgctcaaagtatccgcatgtcaggttcaaccagggaccttgtgatacttgttgatgactcaatcagtgactatcatagaggtggcttggaagctgctgggtggaaaatttatacaatccaaagaatcaggaatccaaaagctgaaccagaagcttataacgaatggaattacagcaagttccgtctttggcagttgacagattatgacaagattattttcatcgatgctgaccttcttatacttaggaatattgatttcttattcgagatgccagaaatttctgctataggaaacaatgcgacgctattcaactcgggtgtgatggttgttgagccatcgaattgtacattccagctactaatggatcacatcaatgagattgaatcatacaatggtggtgatcagggttatctgaacgaaatatttacttggtggcatcggattccaaaacacatgaacttcttgaagcacttctgggaaggtgatgaggtggagaagaaacagatgaagactcgcctctttggagccgatccaccaattctttatgtcatccattatctgggaaacaagccatggctatgcttccgggactacgattgcaactggaatgtggacattttgcaggagtttgctagtgatgttgctcacaaaacatggtggaaggtacacgatgcgatgccagaaaatttacagaagtactgtctacttaggtcgaaacagaaggcacagttagagtgggatcggaggcaagctgagaaaggtaattacacagatggccattggaaaattaagataaaagacaagcgtttaaagacatgttttgaagaattctgcttctgggaaagtatgctgtggcattggggtgaaaagaattggacggataattcaactgctagcccatcaccacctgctataaagaaggtatctctctcttcattctgattttatttttcctttcattttctcctacatattttctgtgcagatcttataatcaacggtgttttttaaagaaaaaattatagattgagttcc

SEQ ID NO: 1503 - protein, 535 aa, Gossypium hirsutum
  misc_feature (206)..(418): Pfam Name: Glyco_transf_8 Pfam Description: Glycosyl transferase family 8
  misc_feature (1)..(535): Ceres Clone ID no. 1948550
  misc_feature (1)..(535): Bit score of 1408.2 for HMM based on sequences of Figure 2
  misc_feature (1)..(535): Functional Homolog Of SEQ ID NO. 1489
  misc_feature (1)..(535): in Figure 2
MLDVNWDQILNVIEKLTDRDGYQGIGLLNFNNTETNQWKQLLPDAEHVVLQLDYVADNVTWESLFPEWIDEEEVFEVPNCPSLPSLQFPGKPRIDLIAVKLPCNKAGKWSRDVTRLHFQLAAARLAASAKGLHPVHVLFVTDCFPLPNLFACKDLVAREGSAWLYTPNLHRLREKIRLPVGSCELSVPLQAKGSFYSERAHREAYATILHSAHVYVCGAITAAQSIRMSGSTRDLVILVDDSISDYHRGGLEAAGWKIYTIQRIRNPKAEPEAYNEWNYSKFRLWQLTDYDKIIFIDADLLILRNIDFLFEMPEISAIGNNATLFNSGVMVVEPSNCTFQLLMDHINEIESYNGGDQGYLNEIFTWWHRIPKHMNFLKHFWEGDEVEKKQMKTRLFGADPPILYVIHYLGNKPWLCFRDYDCNWNVDILQEFASDVAHKTWWKVHDAMPENLQKYCLLRSKQKAQLEWDRRQAEKGNYTDGHWKIKIKDKRLKTCFEEFCFWESMLWHWGEKNWTDNSTASPSPPAIKKVSLSSF

SEQ ID NO: 1504 - protein, 613 aa, Oryza sativa subsp. indica
  misc_feature (326)..(537): Pfam Name: Glyco_transf_8 Pfam Description: Glycosyl transferase family 8
  misc_feature (1)..(613): Public GI ID no. 125542675
  misc_feature (1)..(613): Bit score of 1600.0 for HMM based on sequences of Figure 2
  misc_feature (1)..(613): Functional Homolog Of SEQ ID NO. 1489
MGVTGGAGEAVKPSSSSSLSPVAGLRAAAIVKLNAAFLAFFFLAYMALLLHPKYSYLLDRGAASSLVRCTAFRDACTPATTTTAQLSRKLGGVAANKAVAAAAERIVNAGRAPAMFDELRGRLRMGLVNIGRDELLALGVEGDAVGVDFERVSDMFRWSDLFPEWIDEEEDDEGPSCPELPMPDFSRYGDVDVVVASLPCNRSDAAWNRDVFRLQVHLVTAHMAARKGLRHDAGGGGGGRVRVVVRSECEPMMDLFRCDEAVRRDGEWWMYMVDVERLEEKLRLPVGSCNLALPLWGPGGIQEVFNVSELTAAAATAGRPRREAYATVLHSSDTYLCGAIVLAQSIRRAGSTRDLVLLHDHTVSKPALAALVAAGWTPRKIKRIRNPRAERGTYNEYNYSKFRLWQLTDYDRVVFVDADILVLRDLDALFGFPQLTAVGNDGSLFNSGVMVIEPSQCTFQSLIRQRRTIRSYNGGDQGFLNEVFVWWHRLPRRVNYLKNFWANTTAERALKERLFRADPAEVWSIHYLGLKPWTCYRDYDCNWNIGDQRVYASDAAHARWWQVYDDMGEAMRSPCRLSERRKIEIAWDRHLAEEAGFSDHHWKINITDPRKWE

SEQ ID NO: 1505 - DNA, 1965 bp, Populus balsamifera subsp. trichocarpa
  misc_feature (1)..(1965): Ceres Annot ID no. 1486466
  misc_feature (1)..(1965): Encodes the peptide sequence at SEQ ID NO. 1506
atggctgagggacttaaccttcaaaagctaatgaagactacaccttcaaaagctttggttatcagaatcaatttggttttccttgctttctttcttgttttctatgcatcccttcttctctcgccatcttcttcagtctattttgagaatgcagcatctctcgttaagtgctcattgagagagtgccatcacaaggcagaaaatgggagtggggtgaaggcaatcgtggaagagacgaaagccaatgctcgaagaaatatgaccaaggttgaggtaccgagcttcatgaatgggatgggaaagggaaagaagatcggcatggtaaatatggatgaagatgatgttaccggctggaaagctcatggagagactatacctatcggttttgaaagggtgtctgagtttttcaagtggccggacttgtttcctgaatggattgacgaggaggaagaaacagatgttccatcctgtccagaaataccaatgccagatttcgaagtctatgacagcctggacttgatagtggcaaaactaccatgcaagtatcctgaagaaggatggaatagagaggtgtttaggctccaagttcacctcttagcagcgaatttggctgtgaaaaagggtaggagggattggaattggaggaccaaggtggtgttttggagcaaatgcagaccaatgttggagttgtttaggtgcgatgatttggtaaaacaggaaggtgattggtggttctatgagccggagatgacaaagttggaacagaaggtctcgttgcctattgggtcttgcaaactggctttgcctctgtggacacaaggtaggggtcgaacctacgactttctgcttaggaaacagacgctctatccactgagctacagacgcttcgatgctcttcggtgctttttatataaagatccaatgagtaaagctaagtctgtcgtcagccgaagaaatgaagttacaaaggctagatatatagtgcaacgacgtgcaaatatttctttagttatattggcagctggtattaacgaagtctacgatctctccaagattcaaaggacaacaagaactaccaaacgagaggcctatgccacggtactccattcctcagaagcctacgtctgtggtgtcatagcccttgcccaaagccttctccaaacggggaccaagcgtgaccttgttcttctcctagataattccatctctgaacccaaacgtcatgctcttgcagcagccgggtggaagatccgactcatcaaaagaatccgaaaccctagagctgaaaaatactcgtacaatgagtacaactatagcaagtttaggctgtggcagctcactgattatgacaagatcgtcttcatagatgcggacatcatagttttgcgtaaccttgatatcctttttcacttccctcaaatgtcagctacggggaacgatgtatggatttttaattctggtatcatggtcattgagccatcaaattgcacattcaaaatattaatggaccgacgcaaggagattatttcctacaatggaggtgatcaagggttccttaatgaagtttttgtatggtggcatagattaccaagaagagtgaacttcttgaaaaacttctgggctaacactaccaatgaggctagtgtcaagaacgagctctttggggcagacccaccaaaagtttattccatacattatctggggttaaagccttggctttgttacagagactatgattgtaactggaatataggagatcaacgtgtttatgcaagtgatgtagcacatcagaggtggtggaaatttcacgatgccatggatgagaagttgcaaaagttttgtgggttaacaaagcagagaaaaattgagttggactgggatagaaaaatggctagaaagagtcagttcagtgatgagcattggaaaataaatgttactgatcctagaagggttcatttgatataa

SEQ ID NO: 1506 - protein, 654 aa, Populus balsamifera subsp. trichocarpa
  misc_feature (365)..(576): Pfam Name: Glyco_transf_8 Pfam Description: Glycosyl transferase family 8
  misc_feature (1)..(654): Ceres Annot ID no. 1486466
  misc_feature (1)..(654): Bit score of 1461.6 for HMM based on sequences of Figure 2
  misc_feature (1)..(654): Functional Homolog Of SEQ ID NO. 1489
MAEGLNLQKLMKTTPSKALVIRINLVFLAFFLVFYASLLLSPSSSVYFENAASLVKCSLRECHHKAENGSGVKAIVEETKANARRNMTKVEVPSFMNGMGKGKKIGMVNMDEDDVTGWKAHGETIPIGFERVSEFFKWPDLFPEWIDEEEETDVPSCPEIPMPDFEVYDSLDLIVAKLPCKYPEEGWNREVFRLQVHLLAANLAVKKGRRDWNWRTKVVFWSKCRPMLELFRCDDLVKQEGDWWFYEPEMTKLEQKVSLPIGSCKLALPLWTQGRGRTYDFLLRKQTLYPLSYRRFDALRCFLYKDPMSKAKSVVSRRNEVTKARYIVQRRANISLVILAAGINEVYDLSKIQRTTRTTKREAYATVLHSSEAYVCGVIALAQSLLQTGTKRDLVLLLDNSISEPKRHALAAAGWKIRLIKRIRNPRAEKYSYNEYNYSKFRLWQLTDYDKIVFIDADIIVLRNLDILFHFPQMSATGNDVWIFNSGIMVIEPSNCTFKILMDRRKEIISYNGGDQGFLNEVFVWWHRLPRRVNFLKNFWANTTNEASVKNELFGADPPKVYSIHYLGLKPWLCYRDYDCNWNIGDQRVYASDVAHQRWWKFHDAMDEKLQKFCGLTKQRKIELDWDRKMARKSQFSDEHWKINVTDPRRVHLI

SEQ ID NO: 1507 - DNA, 2590 bp, Panicum virgatum
  misc_feature (1)..(2590): Ceres Clone ID no. 1794546
  misc_feature (1)..(2590): Encodes the peptide sequence at SEQ ID NO. 1508
acccagagctctgtagaagaagcggcgagggggcgaaccggagccactcagccgccacctcaccgcgccaccgactgcgtgaatcccctccccacgccgctcctgctcgccgccgcccgctgctctcgccatttcagctgcagcgctcgccgccgccgcagggccgcagcgcctctcctcctccgcccgcctgccggctgccttccggatgagaagcggcgcaaccggggcggcggaagcgtggtcggcgtgaggcttcgtcggagtccgtgaacgcgccgacaaggatcctggagatcaagcgcatgggttccttggaggcccggtaccggccggccggggcagctgaggacacggctaagagaaggactcagaaaagcaaaagtttcaaagaggttgaaaaatttgatgtttttgttctggagaaaagctcgggatgcaaattcagatccttgcaacttttgctctttgctatcatgtctgcggcatttctaacactcctatacacgccgtctgtgtatgaacatcagctacagtcaagctctagacttgtcaatgggtggatatgggataagagaagttctgatcctcgatatgtgtctactgccaacattcaatgggaagatgtatataaaagtattcaaaatctgaatggtggtgaacaaaagctcaaagttgcactcctgaattttaacagaactgagtttggcacttggacagatatgctcccagaaagtgatttttcagtcgtaagactagagcatgccaatgaaaccattacctggcagactctctatcctgaatggatagatgaggaggaagaaacagagataccatcttgcccttcgcttccagatccaaattttccaagatcgacacactttgatgttgttgctgttaagcttccctgtactcgtgtggcgggttggtcaagagatgttgcacggctgcatttgcagttatcagcagcaaaaatagcagcgaccacggcaagaggcaatggtggagtccatgtgctctttgtgactgattgcttcccggttccaaatctcttctcttgcaagaacctggtgaaacgtgaaggcaatgcttggctgtacaaacctgatgtgaaggctctacaggagaaactcaggctacctgttggttcctgtgagcttgctgttccactgaacgcaaaagcacgactttacacagtggacagacgcagagaagcatatgctacaatactgcattcagcaagtgaatatgtttgtggtgcaatcacagcagctcaaagcattcgccaagcaggatctacaagagaccttgttattcttgttgatgagaccataagtgatcaccaccgcaaggggctggaatctgcggggtggaaggtcagaataatagagaggatccggaaccctaaggctgaacgagatgcctacaatgaatggaactacagcaaattccggctatggcagcttacagattatgacaaggttatattcattgatgctgatctccttatcctgaggaatatagatttcttgtttgcaatgccggaaatcactgcaactggcaacaatgcaacactcttcaactctggagtgatggtcattgagccctcgaactgcacgttccagttactgatggagcacatcaatgagataacatcgtacaatggtggtgaccagggctatctgaatgagatattcacatggtggcatcgcattccaaaacacatgaacttcttgaagcatttctgggagggcgatgaagaggcagtgaaggcgaagaagactaggttgtttggggctaacccgccaatcctctatgtccttcactacttgggccggaagccatggctgtgcttccgggactacgactgcaactggaatgtagaaattctgcgggagtttgcgagtgatgttgcacatgctcgctggtggaaggtgcacaacaagatgccgaagaagcttcagagctattgccttctgaggtcaaggctgaaggccgggttggagtgggagcggcggcaggctgagaaagcaaacttcactgacgggcactggaaaaggaacataactgatccaaggctgaaaacctgctttgagaagttctgcttctgggagagcatgctgtggcattggggtgagaacaagaccaactcgacaaagaacaacccggcgcctgctccgcctactgcgagcctgtcgagctcatgagatctgtagatagctttgttgagagagtagtatacccagatacaaaacttctgaagctccatacatacatagcaacaactttgtgaaggtagctatgtaggcctcttcggctcttcccgaatgactctatacctctgttggccaatcactccagcgtcctcccgctgctttttgatggctggcaaatttttttggtttcttctgctaataattcgtcagtataggctgttttcctttctggcttagagtcctgtccggggtcttgttgcttcatgttccatcggctattgctgtgctgcagtacgcctggtttgttgatgtatggtggttgaacagtttcagtgatcaatctggagtgatgcaacatgagattgctgaccagc

SEQ ID NO: 1508 - protein, 633 aa, Panicum virgatum
  misc_feature (306)..(518): Pfam Name: Glyco_transf_8 Pfam Description: Glycosyl transferase family 8
  misc_feature (1)..(633): Ceres Clone ID no. 1794546
  misc_feature (1)..(633): Bit score of 1233.8 for HMM based on sequences of Figure 2
  misc_feature (1)..(633): Functional Homolog Of SEQ ID NO. 1489
MGSLEARYRPAGAAEDTAKRRTQKSKSFKEVEKFDVFVLEKSSGCKFRSLQLLLFAIMSAAFLTLLYTPSVYEHQLQSSSRLVNGWIWDKRSSDPRYVSTANIQWEDVYKSIQNLNGGEQKLKVALLNFNRTEFGTWTDMLPESDFSVVRLEHANETITWQTLYPEWIDEEEETEIPSCPSLPDPNFPRSTHFDVVAVKLPCTRVAGWSRDVARLHLQLSAAKIAATTARGNGGVHVLFVTDCFPVPNLFSCKNLVKREGNAWLYKPDVKALQEKLRLPVGSCELAVPLNAKARLYTVDRRREAYATILHSASEYVCGAITAAQSIRQAGSTRDLVILVDETISDHHRKGLESAGWKVRIIERIRNPKAERDAYNEWNYSKFRLWQLTDYDKVIFIDADLLILRNIDFLFAMPEITATGNNATLFNSGVMVIEPSNCTFQLLMEHINEITSYNGGDQGYLNEIFTWWHRIPKHMNFLKHFWEGDEEAVKAKKTRLFGANPPILYVLHYLGRKPWLCFRDYDCNWNVEILREFASDVAHARWWKVHNKMPKKLQSYCLLRSRLKAGLEWERRQAEKANFTDGHWKRNITDPRLKTCFEKFCFWESMLWHWGENKTNSTKNNPAPAPPTASLSSS

SEQ ID NO: 1509 - DNA, 1902 bp, Sorghum bicolor
  misc_feature (1)..(1902): Ceres Annot ID no. 8669878
  misc_feature (1)..(1902): Encodes the peptide sequence at SEQ ID NO. 1510
atgggttccttggaggcccggtatcggccggccggggcagctgaggacacagctaagagaaggacccagaaaagcaaaagtttcaaagaggttgaaaaatttgatgtttttgtgctggagaaaagttcaggttgcaaattccgatcgttgcaacttttgctcttcgctatcatgtctgctgcatttctaacactcctatacacaccatctgtgtatgaacatcagttgcagtcaagctctcggcttgtcaatgggtggatatgggataagagaagttctgatccccgatatgtatcttctgccagcattcaatgggaggatgtgtataaaagtatccaaaatctgaatgttggtgaacaaaagctcagtgttggactcctgaattttaatagaactgagtttggcgcttggacacatatgctcccagaaagtgatttttcaatcataaggctagagcatgccaatgaaagcattacctggcagactctgtatcctgaatggatagatgaggaggaagaaacagagataccatcttgcccttcgcttccagatccaagttttccaagagcgacacattttgatgttgttgctgttaagcttccctgttctcgtgtggcgggttggtcaagagatgttgcaaggctgcatttgcagttgtcagcagcaaaattagcggcagccacaacaagaggcaatagtggaatccatgtgctgtttgtgactgattgcttcccaattccaaatctcttctcttgcaaggacctagtgaaacgtgaaggcaatgcatggctgtacaaacctgacgtgaaggctctgaaggagaagctcaggctgcctgttggttcatgtgagcttgctgttcctctcaacgcaaaagcacgactctacacagtagacagacgcagagaagcatatgctacaatactgcattcagcaagtgaatatgtttgcggtgcaatcacagcagctcaaagcattcgtcaagcaggatcaacaagagaccttgttattcttgttgatgacaccataagtgaccaccaccgcaaggggctggaatctgcggggtggaaggtcaggataatagagaggatccggaatcccaaagctgaacgtgatgcctacaatgaatggaactacagcaaattcaggctatggcagcttacagattatgacaaggttatttttattgatgctgatctcctcatactgaggaacattgacttcttgtttgcaatgcctgaaatcactgcaactgggaacaatgcgacactcttcaactccggagtgatggtcattgagccttcaaactgcacattccagttactgatggagcacatcaatgagataacatcttacaatggtggtgaccaaggatacctcaatgagatattcacatggtggcatcggattccaaaacacatgaatttcttgaagcatttctgggagggtgatgaagaggaggtgaaagccaagaagactcgtttgtttggtgctaacccaccgatcctctatgtccttcactacttgggccgaaagccgtggttgtgttttcgggactatgattgtaactggaatgttgaaatcctgcgggagtttgcgagtgatgtagcgcatgctcgctggtggaaggtgcacaacaagatgcccaagaagcttcagagctattgccttctgaggtcaaggttgaaggctgggttggagtgggagcggcggcaggctgagaaagcaaacttcactgatgggcattggaaacggaacataactgatccgaggctgaaaacttgctttgagaagttctgcttctgggagagcatgctatggcattggggtgagaacaagaacaactcgacgcagaacagtgcagtgccggcaacacctactgcgagcctgtcgagctcatga

SEQ ID NO: 1510 - protein, 633 aa, Sorghum bicolor
  misc_feature (306)..(518): Pfam Name: Glyco_transf_8 Pfam Description: Glycosyl transferase family 8
  misc_feature (1)..(633): Ceres Annot ID no. 8669878
  misc_feature (1)..(633): Bit score of 1231.7 for HMM based on sequences of Figure 2
  misc_feature (1)..(633): Functional Homolog Of SEQ ID NO. 1489
MGSLEARYRPAGAAEDTAKRRTQKSKSFKEVEKFDVFVLEKSSGCKFRSLQLLLFAIMSAAFLTLLYTPSVYEHQLQSSSRLVNGWIWDKRSSDPRYVSSASIQWEDVYKSIQNLNVGEQKLSVGLLNFNRTEFGAWTHMLPESDFSIIRLEHANESITWQTLYPEWIDEEEETEIPSCPSLPDPSFPRATHFDVVAVKLPCSRVAGWSRDVARLHLQLSAAKLAAATTRGNSGIHVLFVTDCFPIPNLFSCKDLVKREGNAWLYKPDVKALKEKLRLPVGSCELAVPLNAKARLYTVDRRREAYATILHSASEYVCGAITAAQSIRQAGSTRDLVILVDDTISDHHRKGLESAGWKVRIIERIRNPKAERDAYNEWNYSKFRLWQLTDYDKVIFIDADLLILRNIDFLFAMPEITATGNNATLFNSGVMVIEPSNCTFQLLMEHINEITSYNGGDQGYLNEIFTWWHRIPKHMNFLKHFWEGDEEEVKAKKTRLFGANPPILYVLHYLGRKPWLCFRDYDCNWNVEILREFASDVAHARWWKVHNKMPKKLQSYCLLRSRLKAGLEWERRQAEKANFTDGHWKRNITDPRLKTCFEKFCFWESMLWHWGENKNNSTQNSAVPATPTASLSSS

SEQ ID NO: 1511 - protein, 635 aa, Oryza sativa subsp. japonica
  misc_feature (309)..(521): Pfam Name: Glyco_transf_8 Pfam Description: Glycosyl transferase family 8
  misc_feature (1)..(635): Public GI ID no. 115441423
  misc_feature (1)..(635): Bit score of 1242.6 for HMM based on sequences of Figure 2
  misc_feature (1)..(635): Functional Homolog Of SEQ ID NO. 1489
MGSLETTNTRYRPAGAADDTAKRRTQKSKSFKEVEKFDVFVLEKSSGCKFRSLQLLLFAIMSAAFLTLLYTPSVYDHQMQSSSRFVSGWIWDKTIPDPRYVSSLGVQWEDVYKTVENLNDGERKLKVGLLNFNSTEIGSWTQLLPDSDFSIIRLEHAKESITWQTLYPEWIDEEEETEIPSCPSLPDPIFPRGTHFDVVAVKLPCTRAGGWSRDVARLHLQLSAAKVAVTASRGNRGIHVLFVTDCFPIPNLFSCKNLVKHEGNAWMYKPDLKALREKLRLPVGSCELAVPLKAKARLYSVDRRREAYATILHSASEYVCGAITAAQSIRQAGSTRDFVILVDETISNHHRKGLEAAGWKVRIIQRIRNPKAERDAYNEWNYSKFRLWQLTDYDKIIFIDADLLILRNVDFLFAMPEITATGNNATLFNSGVMVIEPSNCTFQLLMDHINEITSYNGGDQGYLNEIFTWWHRIPKHMNFLKHFWEGDEEEVKVKKTRLFGADPPILYVLHYLGLKPWLCFRDYDCNWNNPILREFASDVAHARWWKVHDKMPKKLQHYCLLRSRQKAGLEWDRRQAEKANFTDGHWRRNITDPRLKTCFEKFCFWESMLWHWGESKNSTKENPVPATPTASLTSS

SEQ ID NO: 1512 - DNA, 1935 bp, Sorghum bicolor
  misc_feature (1)..(1935): Ceres Annot ID no. 8679606
  misc_feature (1)..(1935): Encodes the peptide sequence at SEQ ID NO. 1513
atgaagtcgtcagcgataacgaaaggtagcagtttgagcaggaaggattgcatcgggagctactacgccaaggatgccaagtacaggccgttcagcgcgctgctgcccgaaggctggagcggcaaggttctgtacgtgaagctcgtgctcgtcctcctcatgtgcggctccttcatgggcctcctcaactcgccgtccatccacctcgccgacgagcaccaccaccacaccacacagccagaggcggcgtcgaaatcgagctggatgtcgcacccggacgcggcgaactcggggtacgcgtcgagcctgaggatcgactggtcgcagatcgagacggcggcggagcactttgctccggcagcggcggacggcggcggcacgtcgcggacgcggacgcgggttgcgctgctcaacttcgacgacggcgaggtcgaggagtggaaggcgcggatgccgcacacggacgcctccgcggtgcgcctggaccacgtcggcagcgacgtcacctgggagcacctgtacccggagtggatcgacgaggaggagcgctacggcgcgccggcgtgcccggacctgccggagccatcggtggagtcggaggaggcgaggtacgacgtcgtcgcggtgaagctcccgtgcgggcgcgcggcgagctggtccaaggacgtggcgcggctccacctgcagctggccgcggcgcgtctcgccgcgcgcgcgcgccacggcggtgggccggcggcggcgcacgtgctcgtggtgagccggtgcttcccgatgcctaacctgttcaggtgccgggacgaggtggcgcgcgacggcgacgtgtggctgtacaggccggacgtgagcgacctccgccggaagctggagctccccgtggggtcctgcaagctggccatgccgttcagagcgctcggcgagccgtacgtctccgcggcgccgcagcgcgaggcgtacgcgacgatcctgcactcggagcagctgtacgcgtgcggcgccatcacggcggcgcggagcatccggatggccgggtccggtcgggacatggtggctctggtggacgagacgatcagcgcgcggcaccgcggcgcgctggaggcggccgggtgggtggtgcggacgatccggcggatccggaacccgcgggcgtcgcgggacgcgtacaacgagtggaactacagcaagttctggctgtggacgctgacggaatacgagcgggtcatcttcctggacgccgacctgctggtgcagcggcccatggagccgctgttcgcgatgccggaggtgagcgccacggggaaccacggcgcctacttcaactcgggggtcatggtggtggagccctgcaactgcacgttccggctgctggcggaccacgtcggcgacatcgagtcgtacaacggcggcgaccaggggtacctgaacgaggtgttcgcgtggtggcaccgcctgccgtcgcacgccaactacatgaagcacttctggggcggggacacggcggagcgcgccgccgccaagcgccgcgtgctggcggccgacccgcccgtggcgctcgccgtgcacttcgtcggactcaagccctggttctgcttccgggactacgactgcaactggaacgtgccggcgctgcgccagttcgccagcgacgaggcgcacgcgcggtggtggaaggtgcacgacgccatgccgccgcggctccaggggttctgcctgctggacgagcggcagaaggcgctgctgcggtgggacgtcgcgcgggcgagggaggccaacttctccgacggacactggagcgcgcggatcgccgacccgcgacggagcatctgcgcaggcggcggcgacgccgaggcctgccgcgagagggagatcgccggccgccgggtggaagggaaccggatcaccacgtcgtacgccaagctaattgacagtttctga

SEQ ID NO: 1513 - protein, 644 aa, Sorghum bicolor
  misc_feature (320)..(532): Pfam Name: Glyco_transf_8 Pfam Description: Glycosyl transferase family 8
  misc_feature (1)..(644): Ceres Annot ID no. 8679606
  misc_feature (1)..(644): Bit score of 919.3 for HMM based on sequences of Figure 2
  misc_feature (1)..(644): Functional Homolog Of SEQ ID NO. 1489
MKSSAITKGSSLSRKDCIGSYYAKDAKYRPFSALLPEGWSGKVLYVKLVLVLLMCGSFMGLLNSPSIHLADEHHHHTTQPEAASKSSWMSHPDAANSGYASSLRIDWSQIETAAEHFAPAAADGGGTSRTRTRVALLNFDDGEVEEWKARMPHTDASAVRLDHVGSDVTWEHLYPEWIDEEERYGAPACPDLPEPSVESEEARYDVVAVKLPCGRAASWSKDVARLHLQLAAARLAARARHGGGPAAAHVLVVSRCFPMPNLFRCRDEVARDGDVWLYRPDVSDLRRKLELPVGSCKLAMPFRALGEPYVSAAPQREAYATILHSEQLYACGAITAARSIRMAGSGRDMVALVDETISARHRGALEAAGWVVRTIRRIRNPRASRDAYNEWNYSKFWLWTLTEYERVIFLDADLLVQRPMEPLFAMPEVSATGNHGAYFNSGVMVVEPCNCTFRLLADHVGDIESYNGGDQGYLNEVFAWWHRLPSHANYMKHFWGGDTAERAAAKRRVLAADPPVALAVHFVGLKPWFCFRDYDCNWNVPALRQFASDEAHARWWKVHDAMPPRLQGFCLLDERQKALLRWDVARAREANFSDGHWSARIADPRRSICAGGGDAEACREREIAGRRVEGNRITTSYAKLIDSF

SEQ ID NO: 1514 - protein, 671 aa, Oryza sativa subsp. japonica
  misc_feature (350)..(562): Pfam Name: Glyco_transf_8 Pfam Description: Glycosyl transferase family 8
  misc_feature (1)..(671): Public GI ID no. 46391126
  misc_feature (1)..(671): Bit score of 1186.4 for HMM based on sequences of Figure 2
  misc_feature (1)..(671): Functional Homolog Of SEQ ID NO. 1489
MGSLETRYRPAGAPSIWRFDLFVDQPLNLLDDAMVPRGCRLWLMLPSGDLSVLGSSHRLDDTTKRRTPKSRIYKDVENFGVLVLEKNSGCKFKTLRYLLLAITSATFLTLLTPTFYEHQLQSSRYVDVGWIWDKPSYDPRYVSSVDVQWEDVYKALENLNDGSQKLKVGLLNFNSTEYGSWAQLLPGSAVSIVRLEHAKDSITWDTLYPEWIDEEEETDIPACPSLPDPNVRKGSHFDVIAVKLPCTRVGGWSRDVARLHLQLSAAKLAVASSKGNQKVHVLFVTDCFPIPNLFPCKNLVKHEGNAWLYSPDLKALREKLRLPVGSCELAVPLKAKARLYSVDRRREAYATILHSASEYVCGAISAAQSIRQAGSTRDLVILVDDTISDHHRKGLEAAGWKVRVIQRIRNPKAERDAYNEWNYSKFRLWQLTDYDKIIFIDADLLILRNVDFLFAMPEITATGNNATLFNSGVMVIEPSNCTFQLLMDHINEITSYNGGDQGYLNEIFTWWHRIPKHMNFLKHFWEGDDDSAKAKKTELFGADPPILYVLHYLGMKPWLCFRDYDCNWNIPLMREFASDVAHARWWKVHDNMPEKLQSYCLLRSKLKAGLEWERRQAEKANLEDGHWRRNITDPRLTICYEKFCYWESMLLHWGEKNPTNNNPVPATISSS

SEQ ID NO: 1515 - DNA, 2707 bp, Panicum virgatum
  misc_feature (1)..(2707): Ceres Clone ID no. 1792549
  misc_feature (1)..(2707): Encodes the peptide sequence at SEQ ID NO. 1516
atcactcaatctacaaccattacgcatttctcatccccactctatcctacaagtgccgagttactcaatccgaataaattctcccgcatatctcccttccaaaaaaacaaagttctctcgagattttggatgcttttccctggaagacatttattcttccaaggcaaaatttcccaccaaaagctaatcgcgtctcccaggtagaggtagcgcatggccacccgtaaagattaggcgtcctaataattggcagcggaccgggcaatccatcgccattgccgcccctcgcgcagtcgcatcctccgtctcgccgcctgggggctgcacaattcgtcttcccgcacatatataaagcttctcgccctcctgagctcccacgccgagttctctcttcagaaagagagagaaagtgagagttccagcgaagcagccagccagccagccacgccttccttcttcctctcgcggattccgagctccagaccctccttcgtgggtggcgaagcggcgcaacggcggcggcggcgacagcgtgatcgccttcccggaagcgggaagcttgagttgagcggcggcgcgacgtacggccgccgatggggccaatggagccgcgctaccgttcccccgccggcgcccctgaggatacaactaagcgaaggacctctaaaagcaaaagcttcagagatgttgaaaattttgaagttcttgtccttgaaaagaactgtggttgcaagttcaaatctttgaagatcatgatcatagctatcatttctgcaacagttcttacccttataaccccaaccttgtatgagcaccaattgcagtcagcctcccggtatgtggatgtcggttggatgtgggacaaaacaagttctgacccgcgatatgcatcctctgttgatgttcagtgggatgatgtatatagagcattgagaaatctaaaaagtggtaatccagatctcaaagttggactcttgaattttaatagcactgagtatggctcttggacacagttgttgccggacagccatgtttccattataatacttgagaatgcccaggacatcattacttggcagacactgtatcctgaatggatcgatgaggaggaagaaacggagataccctcctgtccatctctcccagagcccaatgttcgaaaaggtgtacgctttgatgtcattgccgtgaagctgccttgtacccgtgttgcgggttggtcaagagacgttgcacggctccatttgcagctctcagcagcaaaattggctgtggcctcttcgaagcgcaatcacaaggtccatgtgctttttgtaagtgactgcttcccaattccgaatctcttcccgtgcaagaaccttgtgagacatgaaggcaatgcttggttatatagtcctgactcgaaagcattaagggaaaagctccggcttccagtcggatcttgtgagcttgctgttcctctcaaagcaaaatcgagacttttctcagtagatcgacgaagagaagcatatgcaacaatactgcattcagcaagtgagtatgtctgcggtgctatctcagcagctcaaagcattcgccaagcaggatcgactagggatctggtcatccttgttgacgagaccataagtgatcaccaccggagaggattggaatctgcagggtggaaggtcagaataatccaaagaatcaggaacccgaaagctgcgcgtgatgcttacaacgagtggaactacagcaagttcaggttgtggcagctgaccgactacgacaagatcatcttcatcgacgctgacctcctcatcctaaggaatgttgacttcctgttcgccatgccagagatcactgcgactagcaacaacgcaacgctcttcaactccggcgtcatgatcatagagccttccaactgcacgttccagctgctgatggaccacatcaacgagatcacgtcgtacaacggcggggaccaaggttacctgaacgagattttcacatggtggcaccgcatccccaagcacatgaacttcctgaagcacttctgggagggcgacagcgaggagatgaaggcgaagaagactcagctgttcggcgccgatcccccggtcctctacgttctccactacctcggcctgaagccatggctgtgcttcagggactatgactgcaactggaacaacccctcgatgcgcgaattcgctagtgatgtcgcgcacgcccggtggtggaaggtgcacgacaagatgccccgggagctccagtcctactgcctcctgaggtcacggcagaaggccgggctggagtgggaccggaggcaggctgagaaggccaactctgaagacggccattggcgccgcaacatcaccgactccaggctgaagacctgctttgagaagttctgcttctgggagagcatgctgtggcactggggcgagaacagtaacaggacgaagagcagccccgcgacggtgacgacgacggcgagcttggcgagctcatgatctgtagatatacaaacaacttcccatatggcaaccatatatacatgcatagctttagtttgtataggtaccaatgcttcttaggtctctgctatacaaaacacacccctccctgttgctgtcatggctgcagctcgatgtcagctgccggcctgcctcgatggctaacgattcttttgggttggctgagataataagttacttttacatgc

SEQ ID NO: 1516 - protein, 633 aa, Panicum virgatum
  misc_feature (307)..(519): Pfam Name: Glyco_transf_8 Pfam Description: Glycosyl transferase family 8
  misc_feature (1)..(633): Ceres Clone ID no. 1792549
  misc_feature (1)..(633): Bit score of 1174.9 for HMM based on sequences of Figure 2
  misc_feature (1)..(633): Functional Homolog Of SEQ ID NO. 1489
MGPMEPRYRSPAGAPEDTTKRRTSKSKSFRDVENFEVLVLEKNCGCKFKSLKIMIIAIISATVLTLITPTLYEHQLQSASRYVDVGWMWDKTSSDPRYASSVDVQWDDVYRALRNLKSGNPDLKVGLLNFNSTEYGSWTQLLPDSHVSIIILENAQDIITWQTLYPEWIDEEEETEIPSCPSLPEPNVRKGVRFDVIAVKLPCTRVAGWSRDVARLHLQLSAAKLAVASSKRNHKVHVLFVSDCFPIPNLFPCKNLVRHEGNAWLYSPDSKALREKLRLPVGSCELAVPLKAKSRLFSVDRRREAYATILHSASEYVCGAISAAQSIRQAGSTRDLVILVDETISDHHRRGLESAGWKVRIIQRIRNPKAARDAYNEWNYSKFRLWQLTDYDKIIFIDADLLILRNVDFLFAMPEITATSNNATLFNSGVMIIEPSNCTFQLLMDHINEITSYNGGDQGYLNEIFTWWHRIPKHMNFLKHFWEGDSEEMKAKKTQLFGADPPVLYVLHYLGLKPWLCFRDYDCNWNNPSMREFASDVAHARWWKVHDKMPRELQSYCLLRSRQKAGLEWDRRQAEKANSEDGHWRRNITDSRLKTCFEKFCFWESMLWHWGENSNRTKSSPATVTTTASLASS

SEQ ID NO: 1517 - protein, 566 aa, Arabidopsis thaliana
  misc_feature (281)..(486): Pfam Name: Glyco_transf_8 Pfam Description: Glycosyl transferase family 8
  misc_feature (1)..(566): Public GI ID no. 186478283
  misc_feature (1)..(566): Bit score of 693.6 for HMM based on sequences of Figure 2
  misc_feature (1)..(566): Functional Homolog Of SEQ ID NO. 1489
MGAKSKSSSTRFFMFYLILISLSFLGLLLNFKPLFLLNPMIASPSIVEIRYSLPEPVKRTPIWLRLIRNYLPDEKKIRVGLLNIAENERESYEASGTSILENVHVSLDPLPNNLTWTSLFPVWIDEDHTWHIPSCPEVPLPKMEGSEADVDVVVVKVPCDGFSEKRGLRDVFRLQVNLAAANLVVESGRRNVDRTVYVVFIGSCGPMHEIFRCDERVKRVGDYWVYRPDLTRLKQKLLMPPGSCQIAPLGQGEAWIQDKNRNLTSEKTTLSSFTAQRVAYVTLLHSSEVYVCGAIALAQSIRQSGSTKDMILLHDDSITNISLIGLSLAGWKLRRVERIRSPFSKKRSYNEWNYSKLRVWQVTDYDKLVFIDADFIIVKNIDYLFSYPQLSAAGNNKVLFNSGVMVLEPSACLFEDLMLKSFKIGSYNGGDQGFLNEYFVWWHRLSKRLNTMKYFGDESRHDKARNLPENLEGIHYLGLKPWRCYRDYDCNWDLKTRRVYASESVHARWWKVYDKMPKKLKGYCGLNLKMEKNVEKWRKMAKLNGFPENHWKIRIKDPRKKNRLSQ

SEQ ID NO: 1518 - protein, 652 aa, Vitis vinifera
  misc_feature (323)..(535): Pfam Name: Glyco_transf_8 Pfam Description: Glycosyl transferase family 8
  misc_feature (1)..(652): Public GI ID no. 157335049
  misc_feature (1)..(652): Bit score of 1418.2 for HMM based on sequences of Figure 2
  misc_feature (1)..(652): Functional Homolog Of SEQ ID NO. 1489
MLYVHVYLIVPYIKSYNFRLASDCLLLGYEEGSKRRLQRSKDSKDVEKASHVPIQERNSNCKFPTLKLVLVIIICGTFVTLLHSPAVHNTDGPSDSLSRKSFVDRWIRDADDPRYTSSLQINWDQISKVIEKLDDRNEYQGVGLLNFNDKENDDWKQLLPDAEHIVLHLDHVLNNITWESLYPEWIDEEEEFEVPSCPSLPRLPVPGKPRIDLIAVKLPCNKSGDWARDVARLHLQLAAARLAATAKSYHPVRVLLVTECFPIPNLFTCKELVAREGNIWLYEPNLNTMRGKLQLPVGSCELSVPLQAKDRFYSASAHREAYATILHSAHVYVCGAIAAAQSIRMAGSTRDLVILVDKTISEYHRGGLEAAGWKIHTIERIRNPKAERDAYNEWNYSKFRLWQLTDYDKIIFIDADLLILRNIDFLFEMPEISAIGNNATLFNSGVMVIEPSNCTFQLLMDHINEIESYNGGDQGYLNEIFTWWHRIPKHMNFLKHFWEGDEEEKKEMKTRLFGADPPVLYVLHYLGLKPWLCFRDYDCNWNVDILQEFASNVAHKRWWKIHDAMPENLQKFCLLRSKQKAALEWDRRQAEKGNYTDGHWKIKIKDPRLQTCFEDFCFWESMLWHWGETNWTDNATATLPPPTTTTASLPSL

SEQ ID NO: 1519 - protein, 654 aa, Oryza sativa subsp. japonica
  misc_feature (318)..(538): Pfam Name: Glyco_transf_8 Pfam Description: Glycosyl transferase family 8
  misc_feature (1)..(654): Public GI ID no. 46389857
  misc_feature (1)..(654): Bit score of 823.2 for HMM based on sequences of Figure 2
  misc_feature (1)..(654): Functional Homolog Of SEQ ID NO. 1489
MVKTNRFINSLSKRGYIGSYHYEKDAKYRPFSALLPEGSNPKMLYVKLVLIILMCGSFVSLLNSPSIHHNDDHHTESSAGVPRVSYEPDDTRYVSDVTVDWPKISKAMQLVAGAEHGGGARVALLNFDDGEVQQWRTALPQTAAAVARLERAGSNVTWEHLYPEWIDEEELYHAPTCPDLPEPAVDADGDGEEVAVFDVVAVKLPCRRGGGWSKDVARLHLQLAAARLAATRGRGGAAAHVLVVSASRCFPIPNLFRCRDEVAPRDGDVWLYRPDADALRRDLALPVGSCRLAMPFSALAAPHVAAASAPPPRREAYATILHSEELYACGALVAAQSIRMASASGAPSEPERDMVALVDETISARHRGALEAAGWKVRAIRRVRNPRAAADAYNEWNYSKFWLWSLTEYDRVVFLDADLLVQRPMSPLFAMPEVSATANHGTLFNSGVMVVEPCGCTLRLLMDHIADIDSYNGGDQGYLNEVFSWWHRLPSHANFMKHFWEGDSGERLAAARRAVLAAEPAVALAVHFVGMKPWFCFRDYDCNWNSPQLRQFASDEAHARWWRAHDAMPAALQGFCLLDERQKALLRWDAAEARAANFSDGHWRVPIADPRRNICATAAGDGEAAAACVEREIENRRVEGNRVTTSYAKLIDNF

SEQ ID NO: 1520 - protein, 557 aa, Arabidopsis thaliana
  misc_feature (274)..(477): Pfam Name: Glyco_transf_8 Pfam Description: Glycosyl transferase family 8
  misc_feature (1)..(557): Public GI ID no. 15221943
  misc_feature (1)..(557): Bit score of 665.8 for HMM based on sequences of Figure 2
  misc_feature (1)..(557): Functional Homolog Of SEQ ID NO. 1489
MGTKTHNSRGKIFMIYLILVSLSLLGLILPFKPLFRITSPSSTLRIDLPSPQVNKNPKWLRLIRNYLPEKRIQVGFLNIDEKERESYEARGPLVLKNIHVPLDHIPKNVTWKSLYPEWINEEASTCPEIPLPQPEGSDANVDVIVARVPCDGWSANKGLRDVFRLQVNLAAANLAVQSGLRTVNQAVYVVFIGSCGPMHEIFPCDERVMRVEDYWVYKPYLPRLKQKLLMPVGSCQIAPSFAQFGQEAWRPKHEDNLASKAVTALPRRLRVAYVTVLHSSEAYVCGAIALAQSIRQSGSHKDMILLHDHTITNKSLIGLSAAGWNLRLIDRIRSPFSQKDSYNEWNYSKLRVWQVTDYDKLVFIDADFIILKKLDHLFYYPQLSASGNDKVLFNSGIMVLEPSACMFKDLMEKSFKIESYNGGDQGFLNEIFVWWHRLSKRVNTMKYFDEKNHRRHDLPENVEGLHYLGLKPWVCYRDYDCNWDISERRVFASDSVHEKWWKVYDKMSEQLKGYCGLNKNMEKRIEKWRRIAKNNSLPDRHWEIEVRDPRKTNLLVQ

SEQ ID NO: 1521 - protein, 649 aa, Populus tremula x Populus tremuloides
  misc_feature (320)..(532): Pfam Name: Glyco_transf_8 Pfam Description: Glycosyl transferase family 8
  misc_feature (1)..(649): Public GI ID no. 60657590
  misc_feature (1)..(649): Bit score of 1328.6 for HMM based on sequences of Figure 2
  misc_feature (1)..(649): Functional Homolog Of SEQ ID NO. 1489
MRGVGVTSPSSSSAEPRHRSSAFNEDASRRRFLRGRDLRDVEKAFQVPIQYKNLNCKISTLKVVLLIIAFGTLVTFYHSPVVYIADQPSTSGSRPSFVDRWTRDGAAVDPRYISNLDINWDQISDNIVKLDDSNEYQGIGLLNFNESEINNWKLMLLDVEHVVLHLEHVAEDVTWESLYPEWIDEEEEFEVPTCPVLPKLKVPGKPRIDIIAVKLPCNKSGKWSRDVARLHLQLAAANLAASAKSYHPVRVLLVTDCFPTPNLFTCKELIWHEGNLWMYQPNLNVLREKIQLPVGSCELSVPLKAKEHFYSERAHREAYATILHSAHVGVCGAIAAAQSIRLSGSTRDLVILVDETISVYHRSGLEAAGWKIRTIQRIRNPKAEKDAYNEWNYSKFRLWQLTDYDKIIFIDADLLILRNIDFLFGMPEISATGNNATLFNSGVMVIEPSNCTFNLLMEHINEIESYNGGDQGYLNEIFTWWHRIPKHMNFLKHFWIGDEEEVKQKKTSLFGAEPPILYVLHYLGVKPWLCFRDYDCNWNVDIFQEFASDTAHEKWWRVYDAMPEQLHQFCSLKSKQKAQLEYDRREAEKANYTDDHWKIKVQDRRLKKCIDNVCNWKSMLKHWGETNWTDDEFLNPSPPAISTASLSGL

SEQ ID NO: 1522 - DNA, 1956 bp, Populus balsamifera subsp. trichocarpa
  misc_feature (1)..(1956): Ceres Annot ID no. 1505332
  misc_feature (1)..(1956): Encodes the peptide sequence at SEQ ID NO. 1523
atgagaggagtcggagtgacctcccctagttctagttctagttctgcagagcccagactccgaccctttgctttgaatgaagatgcaagcagaaggaggttcttaagaggtagggatcttagagatgttgagaaggccttccaggttcccatccaatataagaatttgaactgcaaaatatctacactgaaagtcgtgctcttaataattgcttttggaaccttggtgacattctatcattctccagtagtttatattgcagaccagccatccacttctggatctcggccaagttttgttgatcgatggacaagagatggtgctgccgtggatccacgctatatctctaaattagatgttaactgggaccagatttccgatattattgtcaaactagatgacagcaatgagtatcagggaattggcttgttaaacttcaatgaaagtgagattaataattggaagctgatgttactggatgttgagcacgttgttctgcatctagagcatgtagcggaagatgtaacttgggaatccctttaccctgaatggatagatgaagaggaagaatttgaggttcccacttgtcctgttctgcccaaacttaaagttcctggcaagccacgcattgatataattgccgtgaagcttccatgcaacaagtcagggaaatggtcaagagatgtggctcgtttgcacttgcagcttgcggctgcaaatcttgctgcttctgctaaaagttatcatcctgtgcgtgtgcttttggtgactgactgcttcccgaccccaaatctgttcacttgcaaggagcttatttggcatgaagggaatttatggatgtatcaacccaacctcaatgtgttgagagaaaagatacaactcccagtagggtcatgtgaactttcagttcctctcaaggctaaagaacatttttactcagaaagagcacaccgggaagcgtatgcaacgattctgcattctgcaaacttttatgtttgtggggccattgctgcagctcagagtatccgcatggcaggttcaacacgggatcttgtgatacttgttgatgaaacaattactgactatcatagggaaggtttagcagctgcaggttggaaaatccatactatccaaagaatcaggaacccaaaagctgaacgagatgcttacaatgaatggaactacagtaaatttcgtctctggcaattgacagattatgacaagatcatcttcattgatgctgacatgctcatacttagaaatatcgatttcttgtttgagatgccagaaatatctgctacaggaaacaatgctaccctgttcaactctggtgtgatggtggttgaaccatcaaattgtacattccagctgttaatggatcatatcaatgagattgagtcctacaatggcggggaccagggatatctaaatgaaatcttcacgtggtggcaccggattcctaaacacatgaacttcttgaaacacttttgggaaggtgacgaggaggagaagaaacagatgaaaactcaactctttggagctgatccgccaatcctttacgttctccactatctgggcaataaaccatggatatgtttccgagattatgattgcaactggaatgtggacattttgcaggagtttgctagtgatgttgctcacaaaacatggtggaaggtgcatgatgccatgccagagaacttgcacaagtactgcttgcttaggtccaagcaaaaggcagcattagagtgggatcggaggcaagccgagaaagccaattacactgatggtcattggaagattaagataaaagacaaacgcttggaaacctgctatgagaatttctgcttctgggagagcatgctatggcattggggtgaaaagaattggacagataatgcaactgttactccatcaccgccagctgttacaactacatctctcccctctttgtga

SEQ ID NO: 1523 - protein, 651 aa, Populus balsamifera subsp. trichocarpa
  misc_feature (322)..(534): Pfam Name: Glyco_transf_8 Pfam Description: Glycosyl transferase family 8
  misc_feature (1)..(651): Ceres Annot ID no. 1505332
  misc_feature (1)..(651): Bit score of 1420.3 for HMM based on sequences of Figure 2
  misc_feature (1)..(651): Functional Homolog Of SEQ ID NO. 1489
MRGVGVTSPSSSSSSAEPRLRPFALNEDASRRRFLRGRDLRDVEKAFQVPIQYKNLNCKISTLKVVLLIIAFGTLVTFYHSPVVYIADQPSTSGSRPSFVDRWTRDGAAVDPRYISKLDVNWDQISDIIVKLDDSNEYQGIGLLNFNESEINNWKLMLLDVEHVVLHLEHVAEDVTWESLYPEWIDEEEEFEVPTCPVLPKLKVPGKPRIDIIAVKLPCNKSGKWSRDVARLHLQLAAANLAASAKSYHPVRVLLVTDCFPTPNLFTCKELIWHEGNLWMYQPNLNVLREKIQLPVGSCELSVPLKAKEHFYSERAHREAYATILHSANFYVCGAIAAAQSIRMAGSTRDLVILVDETITDYHREGLAAAGWKIHTIQRIRNPKAERDAYNEWNYSKFRLWQLTDYDKIIFIDADMLILRNIDFLFEMPEISATGNNATLFNSGVMVVEPSNCTFQLLMDHINEIESYNGGDQGYLNEIFTWWHRIPKHMNFLKHFWEGDEEEKKQMKTQLFGADPPILYVLHYLGNKPWICFRDYDCNWNVDILQEFASDVAHKTWWKVHDAMPENLHKYCLLRSKQKAALEWDRRQAEKANYTDGHWKIKIKDKRLETCYENFCFWESMLWHWGEKNWTDNATVTPSPPAVTTTSLPSL

SEQ ID NO: 1524 - protein, 546 aa, Vitis vinifera
  misc_feature (265)..(466): Pfam Name: Glyco_transf_8 Pfam Description: Glycosyl transferase family 8
  misc_feature (1)..(546): Public GI ID no. 225450971
  misc_feature (1)..(546): Bit score of 778.4 for HMM based on sequences of Figure 2
  misc_feature (1)..(546): Functional Homolog Of SEQ ID NO. 1489
MAPSLKPFNFKPKFFIFFLLVLSLALLFLTLSLRPLYLLETSLRNPKWLGIASKELNGRRVKIGLVNVGDQDFGELYGLRDQVHVPFDRVAGDVKWGDLFPEWIDEDQKWAAPRCPDIPMPRLELYEDLDVVVARVPCGHGVVEGRKGVRDVFRVQVNLVVANLAVKSGLTRGDIDQTVIVVFVGSCGPMREIFRCDDLVEHGEDYWVYRPDLRKLKHKLVMPVGSCQLAPPYAEFGKERWRRYISQSTPSSLNYAINKPREAYATILHSSEAYVCGAIALAQSITQTGSTKDLVLLADNSITSRSLQGLRAAGWKIKHIERIRSPNAKKNAYNEWNYSKLRLWQLTEYDKIIFIDADFIVLNNMDSLFVYPQLSAVGNNRVLFNSGIMVVEPSECMFQTLMEKSQTMVSYNGGDQGFLNEVFTWWHRWPRRLNFLKIFKEKNEHEIPANVYAIHYLGVKPWMCYRDYDCNWDKLDHHPFASDSAHRRWWEVYDAMPEGLWGYCGLTKKKDERIRKWRKIAQKKNLSDGHWKMEVRDPRQKMLVDL

SEQ ID NO: 1525 - DNA, 2028 bp, Populus balsamifera subsp. trichocarpa
  misc_feature (1)..(2028): Ceres Annot ID no. 1452239
  misc_feature (1)..(2028): Encodes the peptide sequence at SEQ ID NO. 1526
atgagaggagtcggagtgacctcccctagttctagttctagttctgcagagcccagactccgaccctttgctttgaatgaagatgcaagcagaaggaggttcttaagaggtagggatcttagagatgttgagaaggccttccaggttcccatccaatataagaatttgaactgcaaaatatctacactgaaagtcgtgctcttaataattgcttttggaaccttggtgacattctatcattctccagtagtttatattgcagaccagccatccacttctggatctcggccaagttttgttgatcgatggacaagagatggtgctgccgtggatccacgctatatctctaaattagatgttaactgggaccagatttccgatattattgtcaaactagatgacagcaatgagtatcagggaattggcttgttaaacttcaatgaaagtgagattaataattggaagctgatgttactggatgttgagcacgttgttctgcatctagagcatgtagcggaagatgtaacttgggaatccctttaccctgaatggatagatgaagaggaagaatttgaggttcccacttgtcctgttctgcccaaacttaaagttcctggcaagccacgcattgatataattgccgtgaagcttccatgcaacaagtcagggaaatggtcaagagatgtggctcgtttgcacttgcagcttgcggctgcaaatcttgctgcttctgctaaaagttatcatcctgtgcgtgtgcttttggtgactgactgcttcccgaccccaaatctgttcacttgcaaggagcttatttggcatgaagggaatttatggatgtatcaacccaacctcaatgtgttgagagaaaagatacaactcccagtagggtcatgtgaactttcagttcctctcaaggctaaagattgcattggctttctcactgcaaagttaatgcaaaatcttaaatcgaaattcactgaatgtttttcaacagaacatttttactcagaaagagcacaccgggaagcgtatgcaacgattctgcattctgcaaacttttatgtttgtggggccattgctgcagctcagagtatccgcatggcaggttcaacacgggatcttgtgatacttgttgatgaaacaattactgactatcatagggaaggtttagcagctgcaggttggaaaatccatactatccaaagaatcaggaacccaaaagctgaacgagatgcttacaatgaatggaactacagtaaatttcgtctctggcaattgacagattatgacaagatcatcttcattgatgctgacatgctcatacttagaaatatcgatttcttgtttgagatgccagaaatatctgctacaggaaacaatgctaccctgttcaactctggtgtgatggtggttgaaccatcaaattgtacattccagctgttaatggatcatatcaatgagattgagtcctacaatggcggggaccagggatatctaaatgaaatcttcacgtggtggcaccggattcctaaacacatgaacttcttgaaacacttttgggaaggtgacgaggaggagaagaaacagatgaaaactcaactctttggagctgatccgccaatcctttacgttctccactatctgggcaataaaccatggatatgtttccgagattatgattgcaactggaatgtggacattttgcaggagtttgctagtgatgttgctcacaaaacatggtggaaggtgcatgatgccatgccagagaacttgcacaagtactgcttgcttaggtccaagcaaaaggcagcattagagtgggatcggaggcaagccgagaaagccaattacactgatggtcattggaagattaagataaaagacaaacgcttggaaacctgctatgagaatttctgcttctgggagagcatgctatggcattggggtgaaaagaattggacagataatgcaactgttactccatcaccgccagctgttacaactacatctctcccctctttgtga

SEQ ID NO: 1526 - protein, 519 aa, Populus balsamifera subsp. trichocarpa
  misc_feature (190)..(402): Pfam Name: Glyco_transf_8 Pfam Description: Glycosyl transferase family 8
  misc_feature (1)..(519): Ceres Annot ID no. 1452239
  misc_feature (1)..(519): Bit score of 1201.1 for HMM based on sequences of Figure 2
  misc_feature (1)..(519): Functional Homolog Of SEQ ID NO. 1489
MLLDVEHVVLHLEHVAEDVTWESLYPEWIDEEEEFEVPTCPVLPKLKVPGKPRIDIIAVKLPCNKSGKWSRDVARLHLQLAAANLAASAKSYHPVRVLLVTDCFPTPNLFTCKELIWHEGNLWMYQPNLNVLREKIQLPVGSCELSVPLKAKDCIGFLTAKLMQNLKSKFTECFSTEHFYSERAHREAYATILHSANFYVCGAIAAAQSIRMAGSTRDLVILVDETITDYHREGLAAAGWKIHTIQRIRNPKAERDAYNEWNYSKFRLWQLTDYDKIIFIDADMLILRNIDFLFEMPEISATGNNATLFNSGVMVVEPSNCTFQLLMDHINEIESYNGGDQGYLNEIFTWWHRIPKHMNFLKHFWEGDEEEKKQMKTQLFGADPPILYVLHYLGNKPWICFRDYDCNWNVDILQEFASDVAHKTWWKVHDAMPENLHKYCLLRSKQKAALEWDRRQAEKANYTDGHWKIKIKDKRLETCYENFCFWESMLWHWGEKNWTDNATVTPSPPAVTTTSLPSL

SEQ ID NO: 1527 - DNA, 1947 bp, Solanum lycopersicum
  misc_feature (1)..(1947): Ceres Annot ID no. 8462522
  misc_feature (1)..(1947): Encodes the peptide sequence at SEQ ID NO. 1528
atgagaggaagtttagctggtggaccacctagtcctattgaacctagacagaggctttctgtattcaccgaggaaacaagcaaaagaaggttcttgagaagtaaagttttcagagatggggagagagctcttcatagtcccaccaaaaacaggaattttacctgcaagttcccaactataaagctcatattgggttttattgctctggttgcaatttggtcactttggcattctccagcaatttataacacggaatacatatctcgttcaggctcgcgggctgctttggtgcacagagagttaagcgatcatccttcagctgatcaacgttatacatcacttttagatattgactgggaccaaatttcccaagttattgagaaactggccgataggcatgagtatcagggcatcgggatattaaacttcaatgacagtgaaattgatcagttgaaggagttattaccggacgctgagcatgtgatcttgaacctggatcacgtcccaaataatataacatgggaaacattatatcctgaatggatagatgaagaagaagaatttgaggtccccacttgtccttctctgcccaaaattcagtttctgggtaaaccaaggattgatctcatagttgtaaagcttccatgcaagaagtctaaggactggtatagagatgtagctcgttttcacttgcagcttgcagcagcaaggctggctgccagtaataaagggtatcatccaatacatgtgcttctggttactgagcatttcccaacccccaatctgttcacctgtaaagagttagttgtacgtgaaggcaatgcatggctatatgaacctaatttgaacactttaagagagaagctccacctccctgttggatcatgtgaacttgcagttcctctcaaggctaaagcaagttggcactctggaaatgtaagaagagaagcctatgcaactattctccactcagctaatttttatgtatgtggagccatagctgcagctcagagtatccgcttggcaggttcaacccgagatcttgtgatacttgttgatgagtctatcagtgactaccacaggggtggtttggaggctgctggatggaagatccacacgataaagagaataaggaatcctaaagctgaacaggatgcctacaatgagtggaactatagcaaatttcgtctttggcagctgacagattatgacaaaatcatcttcattgatgcagatttgttaatattgagaaatattgattttctctttgagatgcctgaaataactgcaataggaaataatgcaaccctttttaattcaggtgtgatggtcgttgaaccatcaaattgcacatttcagctgttgatggatcatattaatgagattgaatcgtacaatggtggggatcaggggtatctgaacgaaatcttcacctggtggcataggatcccaaaacacatgaactttttgaaacattattgggaaggtgatgaggaggagaaaaagcaaatgaaaacatctctttttggtgctgatcctccagttctttatgtcctgcactacttaggcctgaaaccttggttatgcttcagggactacgattgcaactggaatgtgggtaagttgcaggagtttgcaagtgatgtggcacacaggacgtggtggaaggtccatgatgccatgccagataacttacataaatattgtttgcttaggtctaaacagaaggctgcattagagtgggatcgaagagaagctgagaaagctaactattcagatggtcattggaagatcaaaataaaagacccacgtttggaaacttgttttgaagaattttgcttctgggaaagcatgttatggcactggggggaaacaaactggacagataatgccacctcttcaccaacacctcccatggtcaatactgcttcactttcttctttgtaa

SEQ ID NO: 1528 - protein, 648 aa, Solanum lycopersicum
  misc_feature (319)..(531): Pfam Name: Glyco_transf_8 Pfam Description: Glycosyl transferase family 8
  misc_feature (1)..(648): Ceres Annot ID no. 8462522
  misc_feature (1)..(648): Bit score of 1382.3 for HMM based on sequences of Figure 2
  misc_feature (1)..(648): Functional Homolog Of SEQ ID NO. 1489
MRGSLAGGPPSPIEPRQRLSVFTEETSKRRFLRSKVFRDGERALHSPTKNRNFTCKFPTIKLILGFIALVAIWSLWHSPAIYNTEYISRSGSRAALVHRELSDHPSADQRYTSLLDIDWDQISQVIEKLADRHEYQGIGILNFNDSEIDQLKELLPDAEHVILNLDHVPNNITWETLYPEWIDEEEEFEVPTCPSLPKIQFLGKPRIDLIVVKLPCKKSKDWYRDVARFHLQLAAARLAASNKGYHPIHVLLVTEHFPTPNLFTCKELVVREGNAWLYEPNLNTLREKLHLPVGSCELAVPLKAKASWHSGNVRREAYATILHSANFYVCGAIAAAQSIRLAGSTRDLVILVDESISDYHRGGLEAAGWKIHTIKRIRNPKAEQDAYNEWNYSKFRLWQLTDYDKIIFIDADLLILRNIDFLFEMPEITAIGNNATLFNSGVMVVEPSNCTFQLLMDHINEIESYNGGDQGYLNEIFTWWHRIPKHMNFLKHYWEGDEEEKKQMKTSLFGADPPVLYVLHYLGLKPWLCFRDYDCNWNVGKLQEFASDVAHRTWWKVHDAMPDNLHKYCLLRSKQKAALEWDRREAEKANYSDGHWKIKIKDPRLETCFEEFCFWESMLWHWGETNWTDNATSSPTPPMVNTASLSSL

SEQ ID NO: 1529 - protein, 546 aa, Vitis vinifera
  misc_feature (265)..(466): Pfam Name: Glyco_transf_8 Pfam Description: Glycosyl transferase family 8
  misc_feature (1)..(546): Public GI ID no. 147866346
  misc_feature (1)..(546): Bit score of 780.0 for HMM based on sequences of Figure 2
  misc_feature (1)..(546): Functional Homolog Of SEQ ID NO. 1489
MAPSLKPFNFKPKFFIFFLLVLSLALLFLTLSLRPLYLLETSLRNPKWLGIASKELNGRRVKIGLVNVGDQDFGELYGLRDQVHVPFDRVAGDVKWGDLFPEWIDEDQKWAAPRCPDIPMPRLELYKDLDVVVARVPCGDGVVEGRKGVRDVFRVQVNLVVANLAVKSGLTRGDIDQTVIVVFVGSCGPMREIFRCDDLVEHGEDYWVYRPDLRKLKHKLVMPVGSCQLAPPYAEFGKERWRRYISQSTPSSLNYAINKPREAYATILHSSEAYVCGAIALAQSITQTGSTKDLVLLADNSITSRSLQGLRAAGWKIKHIERIRSPNAKKNAYNEWNYSKLRLWQLTEYDKIIFIDADFIVLNNMDSLFVYPQLSAVGNNRVLFNSGIMVVEPSECMFQTLMEKSQTMVSYNGGDQGFLNEVFTWWHRWPRRLNFLKIFKEKNEHETPANVYAIHYLGLKPWMCYRDYDCNWDRLDHHPFASDSAHRRWWEVYDAMPEGLWGYCGLTKKKDERIRKWRKIAQKKNLSDGHWKMEVRDPRQKMLVDL

SEQ ID NO: 1530 - protein, 552 aa, Physcomitrella patens subsp. patens
  misc_feature (241)..(452): Pfam Name: Glyco_transf_8 Pfam Description: Glycosyl transferase family 8
  misc_feature (1)..(552): Public GI ID no. 168006895
  misc_feature (1)..(552): Bit score of 855.3 for HMM based on sequences of Figure 2
  misc_feature (1)..(552): Functional Homolog Of SEQ ID NO. 1489
MRNCRPRVRSDPCTSNLPEVNDIDDGGRGASSDGKSITGNVALLLGQNLQLGKRPSIGLLNIGKDEALGWQEYAHGRIPIFFPFAQVNQSLAWSDFYPEWIDEEELFETPMCPSLPFPCVREKTKLDLLVAKVSCQNPQESGGERNVQRLQLFLSAASIASQTGDEAMDVLIISECRPPLNIFPCGELLEHEGKMWLYHVNLVNMRSRLVLPVGSCELSLSINYPEQLAARTGNERRQAYVSMVHTDASYVCGAIVLAHSIRLSGSTRDLVMLVDSSILPEQRRALQAAGWQVREIERIRNPYAEKDRYNEWNYSKFRLWQITEYDKIVFIDSDLLVLRNIDFLFQLPEISATGNDQNRFNSGVMVIEPSNCTFGILLDQIMDTRSYNGGDQGYLNEIFPWWHRLPKRVNFLKHFWSNDTDELETKTRLFGEDPPELYVLHYLGMKPWVCFRDYDCNWNLKEQQKYASDSAHATWFKIHDSMPENLQRQCWLRTLAKAAREVERREAEAGSYSDGHWKIKIRDPRLELCPTPEHCDWEEMIRHWNEPPPQAL

SEQ ID NO: 1531 - protein, 618 aa, Arabidopsis thaliana
  misc_feature (288)..(501): Pfam Name: Glyco_transf_8 Pfam Description: Glycosyl transferase family 8
  misc_feature (1)..(618): Public GI ID no. 22330689
  misc_feature (1)..(618): Bit score of 1226.1 for HMM based on sequences of Figure 2
  misc_feature (1)..(618): Functional Homolog Of SEQ ID NO. 1489
MIPSSSPMESRHRLSFSNEKTSRRRFQRIEKGVKFNTLKLVLICIMLGALFTIYRFRYPPLQIPEIPTSFGLTTDPRYVATAEINWNHMSNLVEKHVFGRSEYQGIGLINLNDNEIDRFKEVTKSDCDHVALHLDYAAKNITWESLYPEWIDEVEEFEVPTCPSLPLIQIPGKPRIDLVIAKLPCDKSGKWSRDVARLHLQLAAARVAASSKGLHNVHVILVSDCFPIPNLFTGQELVARQGNIWLYKPNLHQLRQKLQLPVGSCELSVPLQAKDNFYSAGAKKEAYATILHSAQFYVCGAIAAAQSIRMSGSTRDLVILVDETISEYHKSGLVAAGWKIQMFQRIRNPNAVPNAYNEWNYSKFRLWQLTEYSKIIFIDADMLILRNIDFLFEFPEISATGNNATLFNSGLMVVEPSNSTFQLLMDNINEVVSYNGGDQGYLNEIFTWWHRIPKHMNFLKHFWEGDEPEIKKMKTSLFGADPPILYVLHYLGYNKPWLCFRDYDCNWNVDIFQEFASDEAHKTWWRVHDAMPENLHKFCLLRSKQKAQLEWDRRQAEKGNYKDGHWKIKIKDKRLKTCFEDFCFWESMLWHWGETNSTNNSSTTTTSSPPHKTALPSL

SEQ ID NO: 1532 - protein, 614 aa, Cucumis melo
  misc_feature (328)..(530): Pfam Name: Glyco_transf_8 Pfam Description: Glycosyl transferase family 8
  misc_feature (1)..(614): Public GI ID no. 150036251
  misc_feature (1)..(614): Bit score of 713.0 for HMM based on sequences of Figure 2
  misc_feature (1)..(614): Functional Homolog Of SEQ ID NO. 1489
MAFFTRKQPLLNSLPQSHSPSSSSSSSSSSSSSSSSQNLFKFINKLRRSRSSSLILFFIFLFFILLLCFLFLISFTLLSSNSNSNSTTITNSLREIPTVIDSEFQETIKIGLINISTDDKDEIHDTLHLLGLIENRRSRIETVTVDFDRIEKEFEWERLFPEWIDEDEKYKSSPKCPNIPMPKTEDYSDLNIVVLRIPCKRGILTSRDVFRLQANLAAARVAVASGWVEEEIYRTVYVVFLGECGAMREIFRCDDLVIKDDRTVENVWVYKPEIKRLKQKILLPFGSCQLAPVYARTGREVWRHFMLQKPPKTNSTTTHYHKPKQAYVTILHSSEAYVCGAIALAQSLLQTNTSKDLILLADNSISPNSIQALKDAGWYVMRIDRIRSPFSEKGSYNEWNYSKLRIWQLTMYDKIVFIDADLLVLKNIDQFFALPQLSAAANNKMRFNSGVMIVEPSACLFEELMEKSFELKSYNGGDQGFLNEVFTWWHRLPSRVNYLKIFLKENSENDSGTDPYAIHYLGLKPWMCYKDYDCNWDMEDHQIFASDSAHAKWWQIYESMPTELQHFCGLTKKMDSRIRKWRRIARNNSTFADAHWKIKITDPRRHRLMDDHAP

SEQ ID NO: 1533 - DNA, 1716 bp, Arabidopsis thaliana
  misc_feature (1)..(1716): Ceres Annot ID no. 542553
  misc_feature (1)..(1716): Encodes the peptide sequence at SEQ ID NO. 1534
atgggggccaaaagcaaaagttcgagtacgagattttttatgttttatcttatactaatatcattgtcgtttttgggtttgctcttaaactttaaacctctgtttctgctcaaccccatgatcgcttctccttcgatagttgagattcgttattctttgccggaaccggttaaacggactccgatatggctccgactcattagaaactatcttccggatgagaaaaagatccgagtgggtcttctcaacatcgcagagaacgagcgagagagctacgaggcaagcgggacgtcgatcttggagaatgtccacgtgtcgctcgatcctcttccgaacaatctgacatggacgagtttattcccggtttggatcgacgaggatcacacgtggcacattcctagttgtccagaagtccctctccctaagatggaaggttccgaagctgacgtggacgtcgtcgttgtcaaagtcccgtgcgatggtttctcggagaagagagggttaagagacgttttcaggctacaggtgaatctggcggcagcgaatcttgtggtggagagtggtcggaggaatgttgatcggactgtgtacgttgtcttcatcggatcttgtgggcctatgcatgagatctttaggtgtgatgagcgcgtgaagcgcgtgggggactattgggtctataggcctgatcttacgaggttgaagcagaagcttctcatgcctcctggttcatgtcagattgctccgctaggtcaatatgttttcttcatttatttatttatttattgtcgcatgcatgatgacataatgcatagtcaaggagaagcatggatacaagacaagaacagaaatctcacatccgaaaaaactacattatcatcatttactgcccaacgtgtcgcttacgtgacgttactacactcatcggaggtatacgtatgcggagcaatagccttagcacaaagcataaggcaatctggatcaaccaaggacatgattctcctccacgatgactctataaccaacatctctctcattggcctaagccttgctggctggaaactacggcgagtggagagaattcgtagtcctttttccaagaagcgttcttacaatgagtggaactacagtaagttacgtgtgtggcaagtgacagattacgacaaactagtgtttatagacgcagacttcatcatcgtcaagaatattgattaccttttctcctatcctcaactttctgccgctggcaataacaaagtcttgttcaactcaggagtcatggttctggagccatcagcttgtttattcgaggatttgatgcttaaatcattcaagatcgggtcatacaacgggggagaccaaggatttctgaacgaatatttcgtgtggtggcataggcatgataaagcgcgcaatcttccagaaaatttagagggcatacactacttgggactaaaaccatggcgatgttacagagactacgattgtaactgggacttgaaaacgcgacgtgtgtatgcaagcgagtcggtgcatgcgagatggtggaaagtgtacgacaagatgcctaagaagctgaaaggttattgtggtttgaatcttaagatggagaagaacgttgagaagtggaggaaaatggctaagctcaatggttttcctgaaaatcattggaaaattagaataaaagatcctaggaagaagaaccgtctaagtcaatga

SEQ ID NO: 1534 - protein, 571 aa, Arabidopsis thaliana
  misc_feature (302)..(491): Pfam Name: Glyco_transf_8 Pfam Description: Glycosyl transferase family 8
  misc_feature (1)..(571): Ceres Annot ID no. 542553
  misc_feature (1)..(571): Bit score of 642.3 for HMM based on sequences of Figure 2
  misc_feature (1)..(571): Functional Homolog Of SEQ ID NO. 1489
MGAKSKSSSTRFFMFYLILISLSFLGLLLNFKPLFLLNPMIASPSIVEIRYSLPEPVKRTPIWLRLIRNYLPDEKKIRVGLLNIAENERESYEASGTSILENVHVSLDPLPNNLTWTSLFPVWIDEDHTWHIPSCPEVPLPKMEGSEADVDVVVVKVPCDGFSEKRGLRDVFRLQVNLAAANLVVESGRRNVDRTVYVVFIGSCGPMHEIFRCDERVKRVGDYWVYRPDLTRLKQKLLMPPGSCQIAPLGQYVFFIYLFIYCRMHDDIMHSQGEAWIQDKNRNLTSEKTTLSSFTAQRVAYVTLLHSSEVYVCGAIALAQSIRQSGSTKDMILLHDDSITNISLIGLSLAGWKLRRVERIRSPFSKKRSYNEWNYSKLRVWQVTDYDKLVFIDADFIIVKNIDYLFSYPQLSAAGNNKVLFNSGVMVLEPSACLFEDLMLKSFKIGSYNGGDQGFLNEYFVWWHRHDKARNLPENLEGIHYLGLKPWRCYRDYDCNWDLKTRRVYASESVHARWWKVYDKMPKKLKGYCGLNLKMEKNVEKWRKMAKLNGFPENHWKIRIKDPRKKNRLSQ

SEQ ID NO: 1535 - DNA, 1707 bp, Populus balsamifera subsp. trichocarpa
  misc_feature (1)..(1707): Ceres Annot ID no. 1488968
  misc_feature (1)..(1707): Encodes the peptide sequence at SEQ ID NO. 1536
atggcctcctctaagcattcatgtcaaaaactcttcatttcttctctcttactcctctctgtatccctgacgttcctagtcttctctttccacccaaaaccagaccatgagtttgatgatcaccgacgtcaaacagtaccccatcaccataaaaaacctttgtcgattatcaactcccagaaatcatggttcgatgatcttattgagaggaaaatctttagccaaagaatcaagattggttttgtcaatgttgatgataatgtcaaacatgcatatgatcatatgcatggagaagtcgagactgttaacgtggatttcaggcctgtatccaaggagttaaaatgggagaaatttttcccggagtggattgatgaagacgcgaggtggcacgaaccatcatgcccggaggtcccaatgcctaggctagaggattaccgtgacctagacgttatcgtggctagggttccttgtggtagtggaatagaaaagcaagggattagggatgtgtttaggttgcaagtgaacttggtggtggctaaccttgtggtggccaatggattgaccgagggtggcgatgatcggacggtgtctgttattttcatagggtcttgtggacccatgcaagagatatttaggtgtgatgatttgatgactcatttaggtgagtattgggtgtacaagcccgagttgaggcgactcagacagaaggtgcaaatgcctgttgggtcatgccagattgctcctctccatagagatcagacaggtaacatggaaattcagagatataaaatggcagaatattcaacaacaagaaaactcaatgaccacaaattgtatcatcaaagggttgcctatgcaacagtcctccattcctccgaagcttatgtctgtggagcaattgcactggctcaaagtataatacagaacaactctactaacgacctagtcctcctccacgactcatcgttaagtcagaagtctctacagggtctcagagatgccggatggaagacaaagcaaatacagcctatccggagcccctttgctcggaaaaactcttacaatgaatggaactatagcaaactcagactctggcaactcacagattatgacaaagtcattttcatagatgctgatcttataatcctcaaaaacatcgacaaattctttgcttacccgcaattgtcagcagctccaaatgacaaggtgttattcaactcggggattatggtgattgagccatcaacgtgcttgttcgaagacatgatgtcaaagagtaggaggttgatgtcatacaatgggggtgatcaaggttttcttaacgaggtctttacatggtggcatcggttgcctggaaaactgaattatctcaagatttgcaagagacaagacaatccaaatcatgaaatggagaagggcacctacacaatccatttcctgggactaaagccatgggcatgctataaagattatgattgtaattgggacatggcgaatcgccatatttttgctagtgactcggctcacaagaggtggtggaaggtttatgacgccatgccaaagaaattgcagcaatattgtggactcacgaagcacatggatgcaaggataaagaaatggagaggcaaagctaagaatgcaaacttgccggatggtcattggaagattagtgtcaaagaccctagacaataccatctcatcgattaa

SEQ ID NO: 1536 - protein, 430 aa, Populus balsamifera subsp. trichocarpa
  misc_feature (148)..(351): Pfam Name: Glyco_transf_8 Pfam Description: Glycosyl transferase family 8
  misc_feature (1)..(430): Ceres Annot ID no. 1488968
  misc_feature (1)..(430): Bit score of 472.7 for HMM based on sequences of Figure 2
  misc_feature (1)..(430): Functional Homolog Of SEQ ID NO. 1489
MPRLEDYRDLDVIVARVPCGSGIEKQGIRDVFRLQVNLVVANLVVANGLTEGGDDRTVSVIFIGSCGPMQEIFRCDDLMTHLGEYWVYKPELRRLRQKVQMPVGSCQIAPLHRDQTGNMEIQRYKMAEYSTTRKLNDHKLYHQRVAYATVLHSSEAYVCGAIALAQSIIQNNSTNDLVLLHDSSLSQKSLQGLRDAGWKTKQIQPIRSPFARKNSYNEWNYSKLRLWQLTDYDKVIFIDADLIILKNIDKFFAYPQLSAAPNDKVLFNSGIMVIEPSTCLFEDMMSKSRRLMSYNGGDQGFLNEVFTWWHRLPGKLNYLKICKRQDNPNHEMEKGTYTIHFLGLKPWACYKDYDCNWDMANRHIFASDSAHKRWWKVYDAMPKKLQQYCGLTKHMDARIKKWRGKAKNANLPDGHWKISVKDPRQYHLID

SEQ ID NO: 1537 - protein, 493 aa, Zea mays
  misc_feature (206)..(417): Pfam Name: Glyco_transf_8 Pfam Description: Glycosyl transferase family 8
  misc_feature (1)..(493): Bit score of 1307.2 for HMM based on sequences of Figure 2
  misc_feature (1)..(493): Functional Homolog Of SEQ ID NO. 1489
MFDELRGRLRMGLVNIGRDELLALGVEGDAVRVDFERVSDAFRWSDLFPEWIDEEEDDEGPSCPELPMPDWARYGGDVDVVVASLPCNRSAPGWNRDVFRLQVHLVAAQVAARKGRRDGAGAVRVVLRSQCEPMMDLFRCDEEVGREGDWYMYKVDVPRLEEKLRLPVGSCNLAMPLWGSGGRGIHEVLNATSWSGGRRPRREAYATVLHSSDTYLCGAIVLAQSIRRAGSTRDLVLLHDHTVSRPALRALSAAGWTPRRIKRIRNPRAARGTYNEYNYSKFRLWQLADYDRVVFVDADILVLRDLDALFAFPQLAAVGNDGSLFNSGVMVIEPSACTFDALMRGRRTVRSYNGGDQGFLNEVFVWWHRLPRRVNYLKNFWANTTGERALKERLFRADPPEVWSVHYLGMKPWTCYRDYDCNWNVADQRVYASDEAHARWWQVYDQMGDHMRGPCRLSERRKVEIAWDRHVAEELGYTDQHWKINITDPRKWD

SEQ ID NO: 1538 - protein, 500 aa, Oryza sativa
  misc_feature (213)..(424): Pfam Name: Glyco_transf_8 Pfam Description: Glycosyl transferase family 8
  misc_feature (1)..(500): Bit score of 1314.1 for HMM based on sequences of Figure 2
  misc_feature (1)..(500): Functional Homolog Of SEQ ID NO. 1489
MFDELRGRLRMGLVNIGRDELLALGVEGDAVGVDFERVSDMFRWSDLFPEWIDEEEDDEGPSCPELPMPDFSRYGDVDVVVASLPCNRSDAAWNRDVFRLQVHLVTAHMAARKGLRHDAGGGGGGGRVRVVVRSECEPMMDLFRCDEAVGRDGEWWMYMVDVERLEEKLRLPVGSCNLALPLWGPGGIQEVFNVSELTAAAATAGRPRREAYATVLHSSDTYLCGAIVLAQSIRRAGSTRDLVLLHDHTVSKPALAALVAAGWTPRKIKRIRNPRAERGTYNEYNYSKFRLWQLTDYDRVVFVDADILVLRDLDALFGFPQLTAVGNDGSLFNSGVMVIEPSQCTFQSLIRQRRTIRSYNGGDQGFLNEVFVWWHRLPRRVNYLKNFWANTTAERALKERLFRADPAEVWSIHYLGLKPWTCYRDYDCNWNIGDQRVYASDAAHARWWQVYDDMGEAMRSPCRLSERRKIEIAWDRHLAEEAGFSDHHWKINITDPRKWE

SEQ ID NO: 1539 - protein, 542 aa, Oryza sativa
  misc_feature (290)..(466): Pfam Name: Glyco_transf_8 Pfam Description: Glycosyl transferase family 8
  misc_feature (1)..(542): Bit score of 1275.7 for HMM based on sequences of Figure 2
  misc_feature (1)..(542): Functional Homolog Of SEQ ID NO. 1489
MGVTGGAGEAVKPSSSSSLSPVAGLRAAAIVKLNAAFLAFFFLAYMALLLHPKYSYLLDRGAASSLVRCTAFRDACTPATTTTAQLSRKLGGVAANKAVAAAAERIVNAGRAPAMFDELRGRLRMGLWIDEEEDDEGPSCPELPMPDFSRYGDVDVVVASLPCNRSDAAWNRDVFRLQVHLVTAHMAARKGLRHDAGGGGGGGRVRVVVRSECEPMMDLFRCDEAVGRDGEWWMYMVDVERLEEKLRLPVGSCNLALPLWGPGGIQEVFNVSELTAAAATAGRPRREAYATVLHSSDTYLCGAIVLAQSIRRAGSTRDLVLLHDHTVSKPALAALLTDYDRVVFVDADILVLRDLDALFGFPQLTAVGNDGSLFNSGVMVIEPSQCTFQSLIRQRRTIRSYNGGDQGFLNEVFVWWHRLPRRVNYLKNFWANTTAERALKERLFRADPAEVWSIHYLGLKPWTCYRDYDCNWNIGDQRVYASDAAHARWWQVYDDMGEAMRSPCRLSERRKIEIAWDRHLAEEAGFSDHHWKINITDPRKWE

SEQ ID NO: 1540 - DNA, 1284 bp, Panicum virgatum
  misc_feature (1)..(1284): Ceres Clone ID no. 1792015
  misc_feature (1)..(1284): Encodes the peptide sequence at SEQ ID NO. 1541
aaaccaacccgtgcgaaccatttctcaactacacgtagtacgtcatggtacaaatggcctcctcgaagctcatcgcagtagcttttctctcctctcttgtggctgctccaacgatgaccactgcagcaaactccaacctcttcagagactacatcggcgccatcttcaatggcgtcaggttcaccgacgtgcccatcaaccccggcgtccggttcgacttcatcctcgccttcgtcatcgactacaccaccgcgacggagccgcccaccccgaccgacggccggttcaacatcttctggcagagctcggtgctgagcgcctccgcggtggcctccatcaagcagagcaaccccaacgtgcgggtcgccgtcagcctcggcggcgccaccgtgaacggccgcccggtgttcttcaacatcacctccgtcgactcgtgggtccagaacgccgtcgcctccctcaccggcatcgtccaggagtacaacctcgacggcatcgacatcgactacgagcagttccaggtcgacccggccaccttcgccgagtgcgtcggccgcctggtgacggcgctcaagagcaacggcgtgatcaagttcgcgtccatcgcgccgttcgacaacgccgacgtgcagcgccattaccaggcgctgtgggcgggctacgggagcgtgatcgactacgtcaacttccagttctacgcgtacagcgccagcacgacggaggcgcagtacgtgagccacttcgacgaccagatcgccaactaccccggggggaacatcctggcgagcttcaccacggcgccgacgaccacctcagtgcccatcaacacgtcgctgaacgcctgccggacgctgcagtcgcaggggaagctctacggcatcttcatctgggctgcggatcattccaggagccaagggttcagattcgacacgcaggcgcaggcgctgctcgccaacgcccccagctactagccaccttgcttcattttgttccagtttgattttccatcagggggctatatatttagtggattaataatattgttggagcaagaatggggaataaaatttcaattgtaatgcagctatgctttatttaaataaactgttagcagagctctccgaatttcgctgaataaactgttgtagtttgtgtgcttcgtttactctgccttttattttcctattgtaatgcagctgtgctttgagaatcatttgttttttgctaggtccagactaattgaataatacaaaaccaaatactattatttggtactattcattc

SEQ ID NO: 1541 - protein, 308 aa, Panicum virgatum
  misc_feature (36)..(287): Pfam Name: Glyco_hydro_18 Pfam Description: Glycosyl hydrolases family 18
  misc_feature (1)..(308): Ceres Clone ID no. 1792015
  misc_feature (1)..(308): Bit score of 758.5 for HMM based on sequences of Figure 6
  misc_feature (1)..(308): in Figure 6
MVQMASSKLIAVAFLSSLVAAPTMTTAANSNLFRDYIGAIFNGVRFTDVPINPGVRFDFILAFVIDYTTATEPPTPTDGRFNIFWQSSVLSASAVASIKQSNPNVRVAVSLGGATVNGRPVFFNITSVDSWVQNAVASLTGIVQEYNLDGIDIDYEQFQVDPATFAECVGRLVTALKSNGVIKFASIAPFDNADVQRHYQALWAGYGSVIDYVNFQFYAYSASTTEAQYVSHFDDQIANYPGGNILASFTTAPTTTSVPINTSLNACRTLQSQGKLYGIFIWAADHSRSQGFRFDTQAQALLANAPSY

SEQ ID NO: 1542 - protein, 309 aa, Zea mays
  misc_feature (42)..(287): Pfam Name: Glyco_hydro_18 Pfam Description: Glycosyl hydrolases family 18
  misc_feature (1)..(309): Public GI ID no. 194708348
  misc_feature (1)..(309): Bit score of 776.3 for HMM based on sequences of Figure 6
  misc_feature (1)..(309): Functional Homolog Of SEQ ID NO. 1541
  misc_feature (1)..(309): in Figure 6
MGYSKRIALVLVAAVVALHVHVPMATAANSNLFRDYIGAIFNGVKFTDVPINPRVRFDYILAFVIDYTTATEPPTPTNGQFNIFWQDSVLTASAVAAIKQSNPNVRVAVSIGGATVNDRPVFFNITSVDSWVQNAVSSLTTIIQKYNLDGIDIDYEQFQADPATFAECIGRLVTTLKSNGVISFASIAPFDNADVQRHYQALWATYGSVIDYVNFQFYAYGASTTEAQYVDFFNQQLVNYPGGNILASFTTAPTTTSVPINTSLSACQTLQSQGKLYGIFIWAADHSRSQGFKYDTQAQALLANAPAGY

SEQ ID NO: 1543 - DNA, 933 bp, Sorghum bicolor
  misc_feature (1)..(933): Ceres Annot ID no. 8636073
  misc_feature (1)..(933): Encodes the peptide sequence at SEQ ID NO. 1544
atgggctactcgaagctgattgcattattagtacttgtcccggctcttgtagccgtccatgtccatgtcccaatggccagcgcagcgaactccaacctgttccgggactacatcggcgccatcttcaatggcgtcaagttcaccgacgttcccatcaaccctagagtccgattcgacttcatcatggccttcgtcatcgactacaccaccgccacggagccgcccaccccgaccaacgggcagttcaacatcttctggcagaactcggtgctcaccgcctccgcggtggccggcatcaagcagagcaacccgaacgtgagggtggccatcagcctcggcggcgccaccgtgaacgaccggccggtgtacttcaacatcacctccgtggagtcctgggtcgagaacgccgtctcctccctgaccagcatcatccacgagtacaacctggacggcatcgacatcgactacgagcagttccaggcggacccggcgaccttcgccgagtgcatcggccgcctggtgaccacgctcaagagcaacggcgtgatcaagttcgcgtccatcgcgccgtacggcaacgccgacgtgcagcgccattaccaggcactgtgggcgagctacgggagcgtcatagactacgtcaactaccagttctacgcgtacggcgccagcacgacggaggcgcagtacgtggactacttcgaccagcagctcgtcaactaccccggaggcaacatcctggccagcttcacgacggcggccaccacgacgtcggtgtccatcaacacgtcgctcagcgcttgccagacgctgcagtcgcagggcaagctctacgggatcttcatctgggccgccgatcattccaggagccaaggattcaagtacgacacacaagcacaagcgctgctcgccaacgcccctgctggctactag

SEQ ID NO: 1544 - protein, 310 aa, Sorghum bicolor
  misc_feature (43)..(288): Pfam Name: Glyco_hydro_18 Pfam Description: Glycosyl hydrolases family 18
  misc_feature (1)..(310): Ceres Annot ID no. 8636073
  misc_feature (1)..(310): Bit score of 778.2 for HMM based on sequences of Figure 6
  misc_feature (1)..(310): Functional Homolog Of SEQ ID NO. 1541
  misc_feature (1)..(310): in Figure 6
MGYSKLIALLVLVPALVAVHVHVPMASAANSNLFRDYIGAIFNGVKFTDVPINPRVRFDFIMAFVIDYTTATEPPTPTNGQFNIFWQNSVLTASAVAGIKQSNPNVRVAISLGGATVNDRPVYFNITSVESWVENAVSSLTSIIHEYNLDGIDIDYEQFQADPATFAECIGRLVTTLKSNGVIKFASIAPYGNADVQRHYQALWASYGSVIDYVNYQFYAYGASTTEAQYVDYFDQQLVNYPGGNILASFTTAATTTSVSINTSLSACQTLQSQGKLYGIFIWAADHSRSQGFKYDTQAQALLANAPAGY

SEQ ID NO: 1545 - protein, 307 aa, Oryza sativa subsp. japonica
  misc_feature (40)..(285): Pfam Name: Glyco_hydro_18 Pfam Description: Glycosyl hydrolases family 18
  misc_feature (1)..(307): Public GI ID no. 115482024
  misc_feature (1)..(307): Bit score of 768.8 for HMM based on sequences of Figure 6
  misc_feature (1)..(307): Functional Homolog Of SEQ ID NO. 1541
  misc_feature (1)..(307): in Figure 6
MGSAKLIAVVLLPALLAFQAPMATAVNSNLFRDYIGAIFNGVKFTDVPINPKVRFDFILAFIIDYTTETNPPTPTNGKFNIFWQNTVLTPSAVASIKQSNPNVRVAVSMGGATVNDRPVFFNITSVDSWVNNAVESLTGIIQDNNLDGIDIDYEQFQVDPDTFTECVGRLITVLKAKGVIKFASIAPFGNAEVQRHYMALWAKYGAVIDYINFQFYAYGASTTEAQYVDFFNQQIVNYPGGNILASFTTAATTTSVPVETALSACRTLQKEGKLYGIFIWAADHSRSQGFKYETESQALLANATISY

SEQ ID NO: 1546 - DNA, 1055 bp, Triticum aestivum
  misc_feature (1)..(1055): Ceres Clone ID no. 703931
  misc_feature (1)..(1055): Encodes the peptide sequence at SEQ ID NO. 1547
aaaataccaatcgctcccacgaacaaaagccaccaatgggctccacaaagctcatcgcagcgactcttctccccgctttcctcgccctccatctacacgccccagcagcaatggccaccgcggcaggaagctccaactccaacctcttccgcgactacatcggcgccctctacaacggcgtcaggttcgccgacgtgccggtcgacccgcgcgcccgcttcgacttcatcctcgcgttcgtcatcgactacaccaccgcgacggagcccccgtccccgaccaacggccggttcaacgtcttctggcaggacacggtgctcacccctgacgcggtcgccgaggtcaagcggcggaaccccaaagtgcgcgtggccgtcagtctcggcggcgccacggtcaacggcaggcccgtgttcttcaacgtcacctccggcgtcgactcctgggtccgcaacgccgtcgactccctcaccggcatcatccggcggtacggcctggatggcatcgacatcgactacgagcagttccaggtggacccggccaccttcgccgagtgcgccggccgtctcgtggcggcgctcaagagcaacggcgtcatcagcttcgcgtccatcgcgccgtacggcaacgccgacgtgcaacgctactaccggacgctgtgggcggcgcacggggccgcaatagactacgtcaacttccagttctacgcctacggtgctagcaccaccgcggcgcagtacgtcagcctcttcgacgagcagatcgccaactaccctggagccaacatcctggccagcttcaccacggcggcgacgaacacctcggtgccggtcgacaccgcgcttagtgcttgccggactctgcaggggcagggtaagctctacggcatatttgtctgggctgcagaccattccaggaaccaaggattcaagtatgagacacagtcgcaggccctgttgactgatgccaccacgtactagttacccacagcttcttggtttgcgtatatctatcttttagtgaaatcatatggaataaaacgagcatccgatttt

SEQ ID NO: 1547 - protein, 314 aa, Triticum aestivum
  misc_feature (41)..(293): Pfam Name: Glyco_hydro_18 Pfam Description: Glycosyl hydrolases family 18
  misc_feature (1)..(314): Ceres Clone ID no. 703931
  misc_feature (1)..(314): Bit score of 731.8 for HMM based on sequences of Figure 6
  misc_feature (1)..(314): Functional Homolog Of SEQ ID NO. 1541
  misc_feature (1)..(314): in Figure 6
MGSTKLIAATLLPAFLALHLHAPAAMATAAGSSNSNLFRDYIGALYNGVRFADVPVDPRARFDFILAFVIDYTTATEPPSPTNGRFNVFWQDTVLTPDAVAEVKRRNPKVRVAVSLGGATVNGRPVFFNVTSGVDSWVRNAVDSLTGIIRRYGLDGIDIDYEQFQVDPATFAECAGRLVAALKSNGVISFASIAPYGNADVQRYYRTLWAAHGAAIDYVNFQFYAYGASTTAAQYVSLFDEQIANYPGANILASFTTAATNTSVPVDTALSACRTLQGQGKLYGIFVWAADHSRNQGFKYETQSQALLTDATTY

SEQ ID NO: 1548 - protein, 304 aa, Medicago truncatula
  misc_feature (39)..(285): Pfam Name: Glyco_hydro_18 Pfam Description: Glycosyl hydrolases family 18
  misc_feature (1)..(304): Public GI ID no. 87240452
  misc_feature (1)..(304): Bit score of 748.5 for HMM based on sequences of Figure 6
  misc_feature (1)..(304): Functional Homolog Of SEQ ID NO. 1541
  misc_feature (1)..(304): in Figure 6
MELHIPKPCFILLILTTSLFASTILAANSNLFREYIGAQFKGVKFSDVPINPNVNFHFILSFAIDYDTSSPPSPTNGNFNIFWDTQNLSPSEVSFIKNQNPNVKVALSLGGDTVQGDPVNFIPSSIDSWVSNAVSSLTSIIKTYNLDGIDVDYEHFIGDPNTFAECIGRLITTLKNNNVISFASIAPFDDAEVQNHYLALWKSYSNIIDYVNFQFYAYDKSTTVAQFIDYYNKQSSNYNSEKVLVSFVSDGSTGLGPGNGFLDGCRMLKSQQKLNGIFVYSADDSKADGFRYEKEAQEVLASPN

SEQ ID NO: 1549 - DNA, 1174 bp, Glycine max
  misc_feature (1)..(1174): Ceres Clone ID no. 529175
  misc_feature (1)..(1174): Encodes the peptide sequence at SEQ ID NO. 1550
gaaccaaatatttgcctgctccaccattcctacttctcatatctctatcgttagtcccttgtttaattactctcatatcatagcagttgctgaatctagcttttctaagtttttttcaaaaatcaaaatggcacttcccaatctttgctttgtcgttttaatcctaaaagtttccttttttctccttgcatcaacccaagttagagccgccacctctgactcaagcttgttccgagaatacattggagcattgttcaatggtgtcaaattctcagatgtacccataaacccaaatgtaaattttcacttcattttgtccttcgctattgactacgacacatcatctggttcaccttctcccaccaacggaaaatttaacatcttttgggacaaccaaaacctcacccctacccaagtttcttccattaaggccaaaaatccaaacgttaaggtagcccttagtctcggaggagacactgtttcaagtgcttttgcttactttgatccaacttcagttgattcatgggtttccaacgcggtttcttcactcaccaacataatcaaagagtacaacttggacggaatcgacattgactatgagcatttcaaggcagattctgaaacttttgctcagagcattggaaaattgatacaaactctgaaaagcagaggggtcattacttttgcttcaattgctccttttgataatgatgaagttcagagtcattatttggccttgtggaagagttatgggcacatcatagattacgttaattttcagttttatgcatatgacagaagcaccaccgtatctcagtttattgattactttaacaaacaaagctcgaattataatggtgggaaggtcttggtgagtttcaatagtgatgggagtcgagggttgatccctgataatggattcttcactgcgtgtagtatgctcaagactcagcaaaaacttcatggtatctttgtgtggtgtgctgatgactccaaggcaaatggtttcagctatgagaagcaatcacaggaccttttggtgactgccaattaggttttgaagtagaccaattttaatatgttagtgcgcttgatggctattacatttaaattaataacgtttgtgtgtgtaatgatgtatacatacatgtaacctgatgtaggcatgtagctc

SEQ ID NO: 1550 - protein, 308 aa, Glycine max
  misc_feature (44)..(289): Pfam Name: Glyco_hydro_18 Pfam Description: Glycosyl hydrolases family 18
  misc_feature (1)..(308): Ceres Clone ID no. 529175
  misc_feature (1)..(308): Bit score of 760.5 for HMM based on sequences of Figure 6
  misc_feature (1)..(308): Functional Homolog Of SEQ ID NO. 1541
  misc_feature (1)..(308): in Figure 6
MALPNLCFVVLILKVSFFLLASTQVRAATSDSSLFREYIGALFNGVKFSDVPINPNVNFHFILSFAIDYDTSSGSPSPTNGKFNIFWDNQNLTPTQVSSIKAKNPNVKVALSLGGDTVSSAFAYFDPTSVDSWVSNAVSSLTNIIKEYNLDGIDIDYEHFKADSETFAQSIGKLIQTLKSRGVITFASIAPFDNDEVQSHYLALWKSYGHIIDYVNFQFYAYDRSTTVSQFIDYFNKQSSNYNGGKVLVSFNSDGSRGLIPDNGFFTACSMLKTQQKLHGIFVWCADDSKANGFSYEKQSQDLLVTAN

SEQ ID NO: 1551 - DNA, 918 bp, Populus balsamifera subsp. trichocarpa
  misc_feature (1)..(918): Ceres Annot ID no. 1468685
  misc_feature (1)..(918): Encodes the peptide sequence at SEQ ID NO. 1552
atggagttttcaatgttgttcatcacccttcttattcttcaagctatcttcccctctcaagcatcgatccaagcagcccctgcaaaatcagacctcttccgtgaatacataggggccgagttcaataatgtcagattcaccgatgtccctgtaaaccctaatgttgaattccatttcatcctctcttttgccattgactatgacacctctagctctccctcccccaccaatggaaaattcaacatcttttgggacaccgataatctaagcccttcccaggtttcttctatcaagaaccaacattccaatgtcaaagttgccttgagccttgggggggatagtgtagcgaatggctatgcttactttaatccttcctctgttgattcttgggtttctaatgctgtttcttcactcacacggatcattcagcagtataacttggatgggattgatattgattacgagcacttccaagctgatcctgatacatttacagagtgtataggacaactcattacagccctcaagagaaatggagtcatctcgtttgcctctatagctccttttgatgatgatcaagttcagagccactacttggccttgtggaggaaatatgggcatcagatagactatgtcaacttccaattttatgcatatgataaggggacctcggtggctcagtttctgaattacttcaacacgcagagttctaattataatggtggtaaagtattggtgagctttatcagtgatggaagcggagggttatctccagcaaatggcttctttacagcctgcagtaagcttaagagtcagaaccaactccatgggattttcgtttggtcggcagatgactctaaggctggtggtttccgctacgaaaagcagtcacaagctctgctggcaattcctcactaa

SEQ ID NO: 1552 - protein, 301 aa, Populus balsamifera subsp. trichocarpa
  misc_feature (39)..(282): Pfam Name: Glyco_hydro_18 Pfam Description: Glycosyl hydrolases family 18
  misc_feature (1)..(301): Ceres Annot ID no. 1468685
  misc_feature (1)..(301): Bit score of 749.0 for HMM based on sequences of Figure 6
  misc_feature (1)..(301): Functional Homolog Of SEQ ID NO. 1541
  misc_feature (1)..(301): in Figure 6
MLFITLLILQAIFPSQASIQAAPAKSDLFREYIGAEFNNVRFTDVPVNPNVEFHFILSFAIDYDTSSSPSPTNGKFNIFWDTDNLSPSQVSSIKNQHSNVKVALSLGGDSVANGYAYFNPSSVDSWVSNAVSSLTRIIQQYNLDGIDIDYEHFQADPDTFTECIGQLITALKRNGVISFASIAPFDDDQVQSHYLALWRKYGHQIDYVNFQFYAYDKGTSVAQFLNYFNTQSSNYNGGKVLVSFISDGSGGLSPANGFFTACSKLKSQNQLHGIFVWSADDSKAGGFRYEKQSQALLAIPH

SEQ ID NO: 1553 - protein, 280 aa, Picea sitchensis
  misc_feature (5)..(263): Pfam Name: Glyco_hydro_18 Pfam Description: Glycosyl hydrolases family 18
  misc_feature (1)..(280): Public GI ID no. 116785783
  misc_feature (1)..(280): Bit score of 679.8 for HMM based on sequences of Figure 6
  misc_feature (1)..(280): Functional Homolog Of SEQ ID NO. 1541
  misc_feature (1)..(280): in Figure 6
MGVKANLFADYIGALFKGVKFSDVPINPAVEFHFILAFAIDYTTESGSPVPTDGNFNIFWDTGNLSPEAVQAIKAQHTNVKVALSLGGDSVDSQPAEFKPSSVSSWVDNAVSSLSKIIEEYHLDGIDIDYEHFQANNDTFAECIGQLITRLKQSNAISFASIAPYDDQEVQSHYLALWNKYEHVIDYVNFQFYAYDSSTTISQFIGYYNTQASQYSGGKVLVSFSSATGAGGLLPENGFFEACRMLKQNGELKGIFVWCADWSKANGFKYEIESQDLLAS

SEQ ID NO: 1554 - DNA, 1036 bp, Gossypium hirsutum
  misc_feature (1)..(1036): Ceres Clone ID no. 1832487
  misc_feature (1)..(1036): Encodes the peptide sequence at SEQ ID NO. 1555
aatagcagcaatggaatttcacaggcttcttttcacttttttcatttttcaagctctaattatctcccagatatcaatcctatgtactgcaaactcaaagcttttcagggaatacataggagctgagttcaaagccgtgaagttttctgatgtccccattaaccgaaatgttgattttcatttcattctctcctttgccatagactatgacacctcaacttctccttcacccaccaatggaaaattcaatgtgttctgggactccaccaatctcagcccctcccatgtttcttccatcaagtctaagcatccaaatgttaaagttgcaataagcctaggaggttacactgtaggcagtcaatttgcttacttcaagccttcctcagtcagatcctgggtctccaatgctgttacttcacttacaagtatcataaagaaatacaatctggatggaatcgatatcgactacgaacacttccaagctgaccctcaaacgtttgcagagtccatagggttgctcataaaggccctgaagaggaataaggtaatctcctttgcttctatagctccatatgctgataatgaagttcagagacagtacttggccttgtggaacaaatatggggacatcattgattatgcgaacttccaattctatgcatatgataaaggaacgaccattccacagttcttaagttatttcaacaaccaaatctccaattacaatggtggtaaggtgttggtgagcttccaaagtgatgtgagacgtgggttaactccagaggatgggtttttcgatgcctgcaatatgcttaagagtcagcaaaggcttcatggtatctttgtatggagtgcagatgactccaaagcagatggttttatatatgagaagcaattccaggaaatattagactaactagtttatgctgccctatgggaaagatgtaatgagttaatgtagtttatgtaccaaaatatatataattatatatgtcatgtaatttatttataattttagctgccgtttgacagttat

SEQ ID NO: 1555 - protein, 301 aa, Gossypium hirsutum
  misc_feature (39)..(285): Pfam Name: Glyco_hydro_18 Pfam Description: Glycosyl hydrolases family 18
  misc_feature (1)..(301): Ceres Clone ID no. 1832487
  misc_feature (1)..(301): Bit score of 741.1 for HMM based on sequences of Figure 6
  misc_feature (1)..(301): Functional Homolog Of SEQ ID NO. 1541
  misc_feature (1)..(301): in Figure 6
MEFHRLLFTFFIFQALIISQISILCTANSKLFREYIGAEFKAVKFSDVPINRNVDFHFILSFAIDYDTSTSPSPTNGKFNVFWDSTNLSPSHVSSIKSKHPNVKVAISLGGYTVGSQFAYFKPSSVRSWVSNAVTSLTSIIKKYNLDGIDIDYEHFQADPQTFAESIGLLIKALKRNKVISFASIAPYADNEVQRQYLALWNKYGDIIDYANFQFYAYDKGTTIPQFLSYFNNQISNYNGGKVLVSFQSDVRRGLTPEDGFFDACNMLKSQQRLHGIFVWSADDSKADGFIYEKQFQEILD

SEQ ID NO: 1556 - protein, 307 aa, Oryza sativa subsp. indica
  misc_feature (38)..(285): Pfam Name: Glyco_hydro_18 Pfam Description: Glycosyl hydrolases family 18
  misc_feature (1)..(307): Public GI ID no. 125531919
  misc_feature (1)..(307): Bit score of 767.6 for HMM based on sequences of Figure 6
  misc_feature (1)..(307): Functional Homolog Of SEQ ID NO. 1541
MGSSKLIAVVLLPALLAFQAPMATAVNSNLFRDYIGANFNGVKFTDVPINPKVRFDFILAFIIDYTTETNPPTPTNGKFNIFWQNTVLTPSAVASIKQSNPNVRVAVSMGGATVNDRPVFFNITSVDSWVNNAVESLTGIIQDNNLDGIDIDYEQFQVDPDTFTECVGRLITVLKAKGVIKFASIAPFGNAEVQRHYMALWAKYGAVIDYINFQFYAYGASTTEAQYVDFFNQQIVNYPGGNILASFTTAATTTSVPVETALSACRTLQKEGKLYGIFIWAADHSRSQGFKYETESQALLANATISY

SEQ ID NO: 1557 - protein, 307 aa, Vitis vinifera
  misc_feature (40)..(288): Pfam Name: Glyco_hydro_18 Pfam Description: Glycosyl hydrolases family 18
  misc_feature (1)..(307): Public GI ID no. 147820457
  misc_feature (1)..(307): Bit score of 667.5 for HMM based on sequences of Figure 6
  misc_feature (1)..(307): Functional Homolog Of SEQ ID NO. 1541
MELLKLFISLFILQALCISPRSMQAAAQNSKLFREYIGAQFNNVKFSDVPINPDVEFHFILAFAIDYSSPSTSSNFPTNGKFNIFWDEQYLTPAHVSSIKSRHSNVKVGLSLGGATVGGKPVYFKPSSVDSWVSNAVTSLTKIIKQFHLDGIDVDYEQFSADPDSFTHCIGRLITTLKNNGVISYASIAPYNDDQAQSHYKALWRSYGHHIDYVNFQFYSYDTSTTVTQFLKYFEEQSSNYEGGKVLVSFLSHESGGLAPNKGFFTACERLKSQHKLHGIFVWCADDSLANGFPYEKKAQSLLASAS

SEQ ID NO: 1558 - protein, 305 aa, Vitis vinifera
  misc_feature (40)..(286): Pfam Name: Glyco_hydro_18 Pfam Description: Glycosyl hydrolases family 18
  misc_feature (1)..(305): Public GI ID no. 225435151
  misc_feature (1)..(305): Bit score of 651.6 for HMM based on sequences of Figure 6
  misc_feature (1)..(305): Functional Homolog Of SEQ ID NO. 1541
MDSTKLLVSLLFLQALFTTSTSISAAPATAKLFREYIGAESKHVLFSDVPISPQVEFHFILSFAIDYTPSSSPSPTNGDFNIFWDSQNLTPSQVSSIKARHGNVKVAMSLGGDTVAGRFASFKPASINSWVRNAINSITQIVKDYNLDGIDVDYEHFDTDTDTFAECIGRLFFYLKQNGIVSFTSIAPYDNESVQPYYLALWKKYGHLIDYVNFQFYAYDKGTTISQFLQHFETQRSNYNGGKVLVSFGTDGSGGLSPQNGFFKACGTLKNQGKLHGIFIWSADDSKKENFRFEKQSQDFLAAAN

SEQ ID NO: 1559 - protein, 423 aa, Pteris ryukyuensis
  misc_feature (158)..(404): Pfam Name: Glyco_hydro_18 Pfam Description: Glycosyl hydrolases family 18
  misc_feature (1)..(423): Public GI ID no. 110556116
  misc_feature (1)..(423): Bit score of 456.3 for HMM based on sequences of Figure 6
  misc_feature (1)..(423): Functional Homolog Of SEQ ID NO. 1541
MARFSSVQLLALCLFALALHHESLLVVADCTTYTVKSGDTCYAISQANGISLSDFESWNAGIDCNNLQIGQSVCISQPTASSPSSSSCTTYTIKSGDTCYAISQARGISLSDFESWNAGIDCNNLQIGQVVCVSKPSTSTTPSPTPSSSSNGKVFREYIGALYNGVQFTDVPINSGVTFHFILAFAIDYTSAAAATNGVFNIYWQNSVLTPAAVQAIKAQHSNVKVMVSLGGDTISGSPVQFTATSVSSWVANAVSSLTSLINQYHLDGIDIDYEHFDQVSTSTFVSCIGQLITQLKANNVISVASIAPFDGVESQYTALFGQYSSVIDLVNFQFYSYGAGTSASQYVSLYNTAASKYGGGAKVLASFSTGGVGPAPSTVLSACQQLKSSGTLPGIFIFSADGSYASSAKFQYEQQAQTLLTS

SEQ ID NO: 1560 - DNA, 1014 bp, Sorghum bicolor
  misc_feature (1)..(1014): Ceres Annot ID no. 8723603
  misc_feature (1)..(1014): Encodes the peptide sequence at SEQ ID NO. 1561
atggcttctcccaacctgttgatcgctgctgcgctcgttgtcgtcgcggcctccacggcggcagcagcagcggctgcggcgagctgggcaccaccgtcgtcgtcgtcgccgccgccgcgccctctgttccgtgagtacatcggcgcgatgggcaggaacgtgacgttcgcggacgtgccggtgcacccgggcgtggacttcgacttcatcctctccttcgccatcgactacgccgccgccgacgccgacgccgccaacgcctccgcggcgccgccggttcccaccgacggccgcttcgccgtcttctgggacgaggtgaacctcaccccggctgccgtggccgccatcaagtcctcctcctcctcctcctccgtccgcgtcgcgctcagcctcggcggcgacaccgtgttcggcgccaacgcgacgttccgcgcgtcctccgtcgacgtgtgggtggacaacgcggtggcgtcgctgacggccatcctcacccggtacggcctcgacggggtggacgtcgactacgagcacttcggggagcgcgagacgccggaggtcttcgcggagtgcatcggccgcctcgtgcgcgcgttgaaggccaccggcgtcatctccgtcgcgtccatggcgcccttcgccaacccggacgtgcaggcgcactacggcgagctgtggcgccgctacggccgcgacttcgactacgtcaacttccagttctacgcgtacccgtccaacaccacggtgccggagttcctgggatactactacgagcagagcggacggtacgccggcgccggcggcgggggcaaagtgctcgtcagcttcgggacggacccggccagcaacgggctgaggcccgggaaggggttcttcagggcgtgccgggagctgcgccgccaggggaggctccacggcatcttcgtctgggccgccgataactccatcgacgacgggttccgctacgagcgccgagcgcagaggttcctcgccggcgccgcaccgggtttcccgtga

SEQ ID NO: 1561 - protein, 337 aa, Sorghum bicolor
  misc_feature (51)..(314): Pfam Name: Glyco_hydro_18 Pfam Description: Glycosyl hydrolases family 18
  misc_feature (1)..(337): Ceres Annot ID no. 8723603
  misc_feature (1)..(337): Bit score of 492.9 for HMM based on sequences of Figure 6
  misc_feature (1)..(337): Functional Homolog Of SEQ ID NO. 1541
MASPNLLIAAALVVVAASTAAAAAAAASWAPPSSSSPPPRPLFREYIGAMGRNVTFADVPVHPGVDFDFILSFAIDYAAADADAANASAAPPVPTDGRFAVFWDEVNLTPAAVAAIKSSSSSSSVRVALSLGGDTVFGANATFRASSVDVWVDNAVASLTAILTRYGLDGVDVDYEHFGERETPEVFAECIGRLVRALKATGVISVASMAPFANPDVQAHYGELWRRYGRDFDYVNFQFYAYPSNTTVPEFLGYYYEQSGRYAGAGGGGKVLVSFGTDPASNGLRPGKGFFRACRELRRQGRLHGIFVWAADNSIDDGFRYERRAQRFLAGAAPGFP

SEQ ID NO: 1562 - DNA, 1064 bp, Zea mays
  misc_feature (1)..(1064): Ceres Clone ID no. 1674549
  misc_feature (1)..(1064): Encodes the peptide sequence at SEQ ID NO. 1563
cggcactagcagcgacacaataattaatcagggctcatcatctcgcaatctccatctaggtcaaccatgacgaacggcttcctgtttcgggagtacatcggcgcgcagttcaccggcgtccagttcagcgacgtgcccatcaactccaagctcgccttcaacttcatcctcgccttcgccatggactacacgccggtgaaccagcatcccacgccggcgcccaccaacggcgtgttcagcccgttctgggacacggggaacctgtccccggccgccgtggccgccatcaaggccgcgcacccgaacgtggccgtcatggcggggctcggcggcgacagcgtgcaggacatcgtcaaggccgtcttcaccccgacctccatcgactcgtgggtggccaacgccgtgacgtcgctcacgggcatcatcaacacgtacgggctcgacggcgtcgacgtcgattacgagcacttcgcccgcggcgctgacgtgaacaccttcgtcgagtgcatcggccgcctcctgacgcagctcaagaagaacatgccgtggatcaccacctccatcgcgccgttcgaggaccccgtggtccagaagtactaccagtcgctgtggcgcaagtactccggcgtcatcgactacgtcaacttccagttctacggctacggcgacaacaccgacgtcgccacgtacgtccagttctacgaccagcagtcggcgaactaccccggcggcaaggtcctcgccagcttcatgaccggcaacaccaccggcctgatctcgccggacctcggcatcagcgccgccaaggagctgcagcggcagaacaagctgccgggcctcttcatctggtcagccgacagctccaagaggagcagctttggcttcaagtacgagatcgaggggcagcagatcattgccaaccattgatctcggatccgaatatcgtatggggcctcgccacgctgtgatggatgaaatataaaatgaatttatcaaggaataggcacgctgctacgtgtactatttctatgaatgatgaataaataaagagattgcattgagcg

SEQ ID NO: 1563 - protein, 286 aa, Zea mays
  misc_feature (9)..(266): Pfam Name: Glyco_hydro_18 Pfam Description: Glycosyl hydrolases family 18
  misc_feature (1)..(286): Ceres Clone ID no. 1674549
  misc_feature (1)..(286): Bit score of 445.6 for HMM based on sequences of Figure 6
  misc_feature (1)..(286): Functional Homolog Of SEQ ID NO. 1541
MTNGFLFREYIGAQFTGVQFSDVPINSKLAFNFILAFAMDYTPVNQHPTPAPTNGVFSPFWDTGNLSPAAVAAIKAAHPNVAVMAGLGGDSVQDIVKAVFTPTSIDSWVANAVTSLTGIINTYGLDGVDVDYEHFARGADVNTFVECIGRLLTQLKKNMPWITTSIAPFEDPVVQKYYQSLWRKYSGVIDYVNFQFYGYGDNTDVATYVQFYDQQSANYPGGKVLASFMTGNTTGLISPDLGISAAKELQRQNKLPGLFIWSADSSKRSSFGFKYEIEGQQIIANH

SEQ ID NO: 1564 - protein, 288 aa, Oryza sativa subsp. indica
  misc_feature (9)..(268): Pfam Name: Glyco_hydro_18 Pfam Description: Glycosyl hydrolases family 18
  misc_feature (1)..(288): Public GI ID no. 125531926
  misc_feature (1)..(288): Bit score of 434.6 for HMM based on sequences of Figure 6
  misc_feature (1)..(288): Functional Homolog Of SEQ ID NO. 1541
MTNGYLFREYIGAQFTGVRFSDVPINPNLSFNFILSFAIDYTSPAGGATPAPTNGVFSPYWDTANLSPADVAAVKAAHPNVSVMVGLGGDSVQDTAKVFFSPTSVDSWVANAVASVSGIIDAYGLDGVDVDYEHFNDDGGAGVDTFVECIGRLLTELKARHPNITTSIAPFEDAVVQRYYQPLWRRYAGVIDLVNFQFYGYGDNTDVPTYVMFYDEQAANYPGGKVLASFKTGDVAGLLSPEQGIAGAKELQRQGKLPGLFIWSADSSKVSSYGFEYEIKAQEIIANH

SEQ ID NO: 1565 - protein, 286 aa, Zea mays
  misc_feature (14)..(266): Pfam Name: Glyco_hydro_18 Pfam Description: Glycosyl hydrolases family 18
  misc_feature (1)..(286): Public GI ID no. 212721998
  misc_feature (1)..(286): Bit score of 441.5 for HMM based on sequences of Figure 6
  misc_feature (1)..(286): Functional Homolog Of SEQ ID NO. 1541
MTNGYLFREYIGAQSTGVQFSDVPINAFVSFHFILSFAIDYTPVGQQPKPVPTNGVFSPFWDTGNLSPAAVAAIKASHPNVAVMAGLGGASVLDIVNAVFTPTSVDTWVANAVTSLTGIINRYGLDGVDVDYEHFADGADVNTFVECIGRLLTQLKQTMPNIATSIAPFEDPVVQKYYQALWSKYSGVIDYVNFQFYAYGDNTDVPTYVMFYNNQLANYPGGKVLASFKTGNVTGLLSPDQGISGAKELQRQNKLPGLFIWSADSSKKSSYGFKYETEAQQIIANH

SEQ ID NO: 1566 - DNA, 1136 bp, Panicum virgatum
  misc_feature (1)..(1136): Ceres Clone ID no. 1962414
  misc_feature (1)..(1136): Encodes the peptide sequence at SEQ ID NO. 1567
atttatgcacggcactacttgcttgctcatctcgcaatctcggccagcatcagccatgacgaacgggtacctgttccgggagtacatcggcgcgcagttcaccggcgtccagttcgccgacgtgcccatcaacgccatgctcagcttccacttcatcctcgccttcgccatcgactacacccccgtggggcagccgacgccgccggcgccgaccaacggcgtgttccgcccgttctgggacacggccaacctgtccccctccgccgtggccgccttcaaggccgcgcacccgaacgtcgccgttatggcggggctcggcggcgacagcgtgcaggacgtcgtcaaggccgtcttcaccccgacctccgtcgactcgtgggtgtccaacgccgcggcgtcgctgaccgccatcatcaacgcgtacgggctcgacggcgtggatgtcgactacgagcacttcgccgccggcgccgacgtgggcacgttcgtcgagtgcgtcggccagctcctgacgcggctcaagaggacgatgccgtggatcaccacctccatcgcgccgttcgaggaccccgtgatccagcgctactaccagccgctgtggcgcaagtacggcggcgtcatcgactacgtcaacttccagttctacggctacggcgccaacaccgacgtgcccctgtacgtccggttctacgacgagcagacggcgaactaccccggcgccagggtgctcgccagcttcatgaccggcaacacgaccgggctgatctcgccggacctcggcatcagtgcggccaaggagctgcagcggcagaacaagctgccggggctcttcatctggtcagcggacagctccaagaagagcagctacggcttcaagtacgagatccaggggcagcagatcatcgccgaccattgatttctgatccgacggtgccgatactactctgctatggatgggcacacaaaatatttattactttgctacggactagtaaggaataatcacgttgctgcgcctacgtgcactactggtgttgttgtggtatgaataatgggttttgtttccatgtatgcagaaatttgtatgctcatatttcctaaatttggcaatttcaagtaacaagcatgattttttt

SEQ ID NO: 1567 - protein, 303 aa, Panicum virgatum
  misc_feature (26)..(283): Pfam Name: Glyco_hydro_18 Pfam Description: Glycosyl hydrolases family 18
  misc_feature (1)..(303): Ceres Clone ID no. 1962414
  misc_feature (1)..(303): Bit score of 463.7 for HMM based on sequences of Figure 6
  misc_feature (1)..(303): Functional Homolog Of SEQ ID NO. 1541
MHGTTCLLISQSRPASAMTNGYLFREYIGAQFTGVQFADVPINAMLSFHFILAFAIDYTPVGQPTPPAPTNGVFRPFWDTANLSPSAVAAFKAAHPNVAVMAGLGGDSVQDVVKAVFTPTSVDSWVSNAAASLTAIINAYGLDGVDVDYEHFAAGADVGTFVECVGQLLTRLKRTMPWITTSIAPFEDPVIQRYYQPLWRKYGGVIDYVNFQFYGYGANTDVPLYVRFYDEQTANYPGARVLASFMTGNTTGLISPDLGISAAKELQRQNKLPGLFIWSADSSKKSSYGFKYEIQGQQIIADH

SEQ ID NO: 1568 - protein, 288 aa, Oryza sativa subsp. japonica
  misc_feature (9)..(268): Pfam Name: Glyco_hydro_18 Pfam Description: Glycosyl hydrolases family 18
  misc_feature (1)..(288): Public GI ID no. 115482030
  misc_feature (1)..(288): Bit score of 431.5 for HMM based on sequences of Figure 6
  misc_feature (1)..(288): Functional Homolog Of SEQ ID NO. 1541
MTNGYLFREYIGAQFTGVRFSDVPINPNLSFNFILSFAIDYTSPAGGATPAPTNGVFSPYWDTANLSPADVAAVKAAHPNVSVMVGLGGDSVQDTAKVFFSPTSVDSWVANAVASVSGIIDAYGLDGVDVDYEHFNDDGGAGVDTFVECIGRLLTELKARHPNITTSIAPFEDAVVQRYYQPLWRRYAGVIDLVNFQFYGYGDNTDVPTYVMFYDEQAANYPGGKVLASFKTGDVAGLLWPEQGIAGAKELQRQGKLPGLFIWSADSSKVSSYGFEYEIKAQEIIANH

SEQ ID NO: 1569 - DNA, 861 bp, Sorghum bicolor
  misc_feature (1)..(861): Ceres Annot ID no. 8684516
  misc_feature (1)..(861): Encodes the peptide sequence at SEQ ID NO. 1570
atgacgaacggctacctgttccgtgagtacatcggcgcgcagtccaccggcgtgcagttctccgacgtgcccatcaacgccttgctcagcttccacttcatcctctccttcgccatcgactacacgccggtggggcagcagccgaagccggtgccgaccaacggcgtgttcagcccgttctgggacactggcaacctgaccccggccgccgtggccgccatcaaggccgcgcaccccaacgtcgccgtcatggcggggctcggcggcgacagcgtgcaggacatcgtcaaggccgtcttcaccccgacctccgtcgactcgtgggtgggcaacgccgtggcgtcgctcacgggcatcatcaacacgtacgggctcgacggcgtggacgtggactacgagcacttcgccgacggcgccgacgtcgacacgttcgtcgagtgcatcggccgactcctgacgcagctcaagcagaagatgcccaacatcgccacctccatcgcgccgttcgaggaccccgtggttcagaagtactaccagccgctctggagcaagtactccggcgtcatcgactacgtcaacttccagttctacggctacggcgccaacaccgacgtgcagacgtacgtcatgttctacaacaaccagtcggcgaactaccccggcggcaaggtcctcgccagcttcaagaccggcaacgtcaccggactgctctcgccggagcagggcatcagtgcggccaaggagctgcagcggcagaacaagctgcccgggctgttcatctggtcagcggacagctccaagcagagcagctacggcttcaagtacgagacggaggcgcagcagatcattgccaaccactga

SEQ ID NO: 1570 - protein, 286 aa, Sorghum bicolor
  misc_feature (4)..(266): Pfam Name: Glyco_hydro_18 Pfam Description: Glycosyl hydrolases family 18
  misc_feature (1)..(286): Ceres Annot ID no. 8684516
  misc_feature (1)..(286): Bit score of 440.5 for HMM based on sequences of Figure 6
  misc_feature (1)..(286): Functional Homolog Of SEQ ID NO. 1541
MTNGYLFREYIGAQSTGVQFSDVPINALLSFHFILSFAIDYTPVGQQPKPVPTNGVFSPFWDTGNLTPAAVAAIKAAHPNVAVMAGLGGDSVQDIVKAVFTPTSVDSWVGNAVASLTGIINTYGLDGVDVDYEHFADGADVDTFVECIGRLLTQLKQKMPNIATSIAPFEDPVVQKYYQPLWSKYSGVIDYVNFQFYGYGANTDVQTYVMFYNNQSANYPGGKVLASFKTGNVTGLLSPEQGISAAKELQRQNKLPGLFIWSADSSKQSSYGFKYETEAQQIIANH

SEQ ID NO: 1571 - protein, 286 aa, Oryza sativa subsp. japonica
  misc_feature (17)..(266): Pfam Name: Glyco_hydro_18 Pfam Description: Glycosyl hydrolases family 18
  misc_feature (1)..(286): Public GI ID no. 115482028
  misc_feature (1)..(286): Bit score of 408.8 for HMM based on sequences of Figure 6
  misc_feature (1)..(286): Functional Homolog Of SEQ ID NO. 1541
MVNGYLFREYIGAQFTGVRFSDVPVNPGLSFHFILAFAIDYFMATQSSKPAPANGVFAPYWDTANLSPAAVAAAKAAHPNLSVILALGGDTVQNTGVNATFAPTSSVDAWVRNAADSVSGLIDAYGLDGVDVDYEHFAAGVDTFVECIGRLLTELKARHPNIATSIAPFEHPVVQRYYQPLWRRYAGVIDYVNFQFYGYGANTDVATYVMFYDEQAANYPGSKLLASFKTGNVTGLLSPEQGIAGAKELQRQGKLPGLFIWSADSSMVSSYKFEYETKAQEIVANH

SEQ ID NO: 1572 - DNA, 1079 bp, Triticum aestivum
  misc_feature (1)..(1079): Ceres Clone ID no. 633976
  misc_feature (1)..(1079): Encodes the peptide sequence at SEQ ID NO. 1573
gtcattcgatccaccgagctacttagatttcattcgatccattgagctgagccagccatgacgaacgggtacctcttccgggagtacatcggcgcgcagttcaccggcgtccggttctccgacgtgcccgtgaacaccggcgtgagcttccacttcatcctcgccttcgccatcgactacctggcgagccagcagtccaagcccacgccgaccaacggcgtcttcaagccgttctgggacacgggcaacctcaccccggccgccatggccgccaccaaggcggcccaccctaacctgagcatcatggtcagcatcggcggcgacaccgtccagaacacgggcgtcaacgccacctacgccccgacctccgtcgactcgtgggtggccaacgccgtctcctccctctccgccatgatcaaccagtacgggctggacggcgtggacgtggactacgagcacttcggcaccgacgtggacaccttcgtggagggcatcggccgcctgctcacccagctcaaggcccgcttccccaacatccgcacctccatcgcgccctacgagctcccggtcaaccagaagtactaccaggctctgtggaggaagtactccggggtcatcgactacgtcaacttccagttctacggctacggcgccaacaccgtcgtccagtactacgtgcagttctacgacgagcaggcgcgcaactaccccggctccggcggcaccaagctgctcgccagcttcaagaccggcaacgtcaccggcctgctctcgccggatcaaggcatcagcggcgccaaggagctccagcggcagggcaagctgccggggatcttcatcttttcggcggatagctctaagatgagcccctacctgttcaagtatgagacccaggcgcagcagctcgtcgccaaccactaactaagtggtggattcgatccgctaataagtgagtaagacaagtttgctgcatacagcatacgtacggggtcatgtatatcccggatatgtactgggactaaataaatgccgtgtacgtactcaagcttgaataagcggcacctactttggtttgctct

SEQ ID NO: 1573 - protein, 287 aa, Triticum aestivum
  misc_feature (9)..(267): Pfam Name: Glyco_hydro_18 Pfam Description: Glycosyl hydrolases family 18
  misc_feature (1)..(287): Ceres Clone ID no. 633976
  misc_feature (1)..(287): Bit score of 410.4 for HMM based on sequences of Figure 6
  misc_feature (1)..(287): Functional Homolog Of SEQ ID NO. 1541
MTNGYLFREYIGAQFTGVRFSDVPVNTGVSFHFILAFAIDYLASQQSKPTPTNGVFKPFWDTGNLTPAAMAATKAAHPNLSIMVSIGGDTVQNTGVNATYAPTSVDSWVANAVSSLSAMINQYGLDGVDVDYEHFGTDVDTFVEGIGRLLTQLKARFPNIRTSIAPYELPVNQKYYQALWRKYSGVIDYVNFQFYGYGANTVVQYYVQFYDEQARNYPGSGGTKLLASFKTGNVTGLLSPDQGISGAKELQRQGKLPGIFIFSADSSKMSPYLFKYETQAQQLVANH

SEQ ID NO: 1574 - DNA, 894 bp, Populus balsamifera subsp. trichocarpa
  misc_feature (1)..(894): Ceres Annot ID no. 1488712
  misc_feature (1)..(894): Encodes the peptide sequence at SEQ ID NO. 1575
atgaggttggtcaaggttcatctctttctcctctgtgttgctggagttgctctccttggtcaccaatgctgtgatgcgaaggtgatgatggagtacattggtgccacaggccaacccgtgacatttaatcctgttccagttgaagacaacattgacttccatttcatacttagttttgccattgatgcagatacatctgctaagcctcaaaatggaaaattctcaccatattgggtagacacattaaccccacaatcagtggcagctatcaaggagcgtcaccctaatgtgaaagccttggcaagtctttctggttggagtttaggtgacgaagtccttcgttggtacaaccctgaaaaccctcaactttggatcaataatgctttcacctctcttacatccttagctaaggaatatcatcttgatggtatcgacatcgattacgaaaacttccctagaaacaatgctagtttcgcttattgcataggcgagctcattaccttactgaaaaaccaaagtgtcatttctgtggccaccatcgcaccttttcacaccactgttttgccctatattgagctctttaataagtatggagatgttattgactatgttaatcatcaattttatactgataaagttacgagcccaaaagggtatttagcagcatttcggcttcgagccacgcaattcgataaggataaattgttacctagctatgaagtgaatggaaggggtattcaaggagacgcattttttgatgctttaaatctgctggaggcaaatggatttgatgtcaatggagtgatgatcttctcagcagatgcttcttcttctaataactattactatgagaggaaatcccaagctttcttgaccaattctacaagtgtgtga

SEQ ID NO: 1575 - protein, 297 aa, Populus balsamifera subsp. trichocarpa
  misc_feature (34)..(276): Pfam Name: Glyco_hydro_18 Pfam Description: Glycosyl hydrolases family 18
  misc_feature (1)..(297): Ceres Annot ID no. 1488712
  misc_feature (1)..(297): Bit score of 271.1 for HMM based on sequences of Figure 6
  misc_feature (1)..(297): Functional Homolog Of SEQ ID NO. 1541
MRLVKVHLFLLCVAGVALLGHQCCDAKVMMEYIGATGQPVTFNPVPVEDNIDFHFILSFAIDADTSAKPQNGKFSPYWVDTLTPQSVAAIKERHPNVKALASLSGWSLGDEVLRWYNPENPQLWINNAFTSLTSLAKEYHLDGIDIDYENFPRNNASFAYCIGELITLLKNQSVISVATIAPFHTTVLPYIELFNKYGDVIDYVNHQFYTDKVTSPKGYLAAFRLRATQFDKDKLLPSYEVNGRGIQGDAFFDALNLLEANGFDVNGVMIFSADASSSNNYYYERKSQAFLTNSTSV

SEQ ID NO: 1576 - protein, 411 aa, Vitis vinifera
  misc_feature (148)..(390): Pfam Name: Glyco_hydro_18 Pfam Description: Glycosyl hydrolases family 18
  misc_feature (1)..(411): Public GI ID no. 147819531
  misc_feature (1)..(411): Bit score of 250.9 for HMM based on sequences of Figure 6
  misc_feature (1)..(411): Functional Homolog Of SEQ ID NO. 1541
MVEKMRGSKPTKMKNTDYRDGLHLVVASRIPQVLAGDGTEQHEEEVESPDSSTAVIDGERRIPQVLAGDGTEQHEEEAESPDSSTAVIDGERRNLYNLTYICFISTFNHTDSRRRMIKLHFFVLLVGLIFALIFLRFSDGKVMMEYIGATGVPVTFDDVPIEKDIDFHFILGFAIDADESGNAQNGIFSPYWASTLTPDSVADIKAQHPNVRALASLSGWSLGEKILRWYDPKDPELWISNAFTSLQSLIVTYNLDGIDIDYENFPKRNSTFPYCIGELISLLKNQSVISVATIAPFNSRAVPYIQLCDGYGDLIDYVNYQFYTDKVSTPKRYLEAFKLRAKQFDQEKLLPSYEVDGRGIQGEAFFDALKLLEKNGIDVKGVMIFSADASSANGYYYERKSQAFLLNSTRI

SEQ ID NO: 1577 - DNA, 888 bp, Solanum lycopersicum
  misc_feature (1)..(888): Ceres Annot ID no. 8458360
  misc_feature (1)..(888): Encodes the peptide sequence at SEQ ID NO. 1578
atggctaaaattctcttcattttccttcatctctttgctttattattaagaattcgacaattttgtgatgggaaggtaatgatggagtatattggagcaacaggcaaaccaataacatttgatgatgttccaattgatgaaggaattgactttcatttcattcttagttttgctattgatgctgactctctagggaacccacaaaatggcaaattctcaccttgttgggcatcaacattaaccccaaactcagttgcatcaattaaatccaaataccctaatgtcaaagtcttggctagcctttctggttggagtataggttcaaaagtccttagctggtacaagcctattgacactcaacagtggatatcaaatgcattcacttccctcaaatcaattgtcaacacatataaccttgatggaattgacattgactatgagagattcccaaaacacagtgaaagtttctctcattgcataggagaattaataactctcttaaagaaccaaagtgttatatctatagcaacaattgcaccatattatagaacaattttaccatacatagagctatacaacaactatggagaatcaattgactatgtaaatcatcaattttatacagataaagttagtacaccaagaggttatttgaaggcttttgttctaagaagtgaacaatttaataaagagaaagtaattcctagctatgaagtggatggaagaggaattcaaggtgatgcattttttgatggattgaaattactggaaactaatggatttcatgttaatggtgcaatgatttactctgctgatgcttcatctgaggataattacatttatgagaggaaaattcaagcattcttgttaaattctactagtgtatga

SEQ ID NO: 1578 - protein, 295 aa, Solanum lycopersicum
  misc_feature (24)..(274): Pfam Name: Glyco_hydro_18 Pfam Description: Glycosyl hydrolases family 18
  misc_feature (1)..(295): Ceres Annot ID no. 8458360
  misc_feature (1)..(295): Bit score of 258.8 for HMM based on sequences of Figure 6
  misc_feature (1)..(295): Functional Homolog Of SEQ ID NO. 1541
MAKILFIFLHLFALLLRIRQFCDGKVMMEYIGATGKPITFDDVPIDEGIDFHFILSFAIDADSLGNPQNGKFSPCWASTLTPNSVASIKSKYPNVKVLASLSGWSIGSKVLSWYKPIDTQQWISNAFTSLKSIVNTYNLDGIDIDYERFPKHSESFSHCIGELITLLKNQSVISIATIAPYYRTILPYIELYNNYGESIDYVNHQFYTDKVSTPRGYLKAFVLRSEQFNKEKVIPSYEVDGRGIQGDAFFDGLKLLETNGFHVNGAMIYSADASSEDNYIYERKIQAFLLNSTSV

SEQ ID NO: 1579 - DNA, 558 bp, Arabidopsis thaliana
  misc_feature (1)..(558): Ceres Annot ID no. 1298824
  misc_feature (1)..(558): Encodes the peptide sequence at SEQ ID NO. 1592
atgtattgcagcgatcctccccatcccttgcacttagtggcatcagacaaacaacaaaaagaccacaaactgatcctttcctggaagaaaccaacaatggactcagacccactcggtgttttcccaaattctcccaagtatcatccatattactcgcagaccacggagtttggtggcgtaatcgatttaggtctcagcctgagaaccatacaacatgagatttaccactcatctggccaaagatattgtagtaatgaaggatacagacggaagtggggttatgtaaaggtcaccatggatggtttggtggtaggtcgcaaggtctgtgttcttgatcatggaagctattcaactcttgctcatcaactcgaggacatgtttgggatgcagagtgtgtcgggattgaggttgttccagatggagtctgagttctgtttggtctacagagacgaagaaggtctgtggagaaatgctggggatgttccatggaatgagttcatagaaagcgtggagcggctgagaatcacaagaagaaacgatgctgtacttcccttttaa

SEQ ID NO: 1580 - protein, 185 aa, Arabidopsis thaliana
  misc_feature (1)..(185): Ceres SEED LINE ID no. CW00817
  misc_feature (10)..(184): Pfam Name: AUX_IAA Pfam Description: AUX/IAA family
  misc_feature (1)..(185): Ceres Annot ID no. 1298824
  misc_feature (1)..(185): Bit score of 393.9 for HMM based on sequences of Figure 23
  misc_feature (1)..(185): in Figure 23
MYCSDPPHPLHLVASDKQQKDHKLILSWKKPTMDSDPLGVFPNSPKYHPYYSQTTEFGGVIDLGLSLRTIQHEIYHSSGQRYCSNEGYRRKWGYVKVTMDGLVVGRKVCVLDHGSYSTLAHQLEDMFGMQSVSGLRLFQMESEFCLVYRDEEGLWRNAGDVPWNEFIESVERLRITRRNDAVLPF

SEQ ID NO: 1581 - DNA, 585 bp, Populus balsamifera subsp. trichocarpa
  misc_feature (1)..(585): Ceres Annot ID no. 1463921
  misc_feature (1)..(585): Encodes the peptide sequence at SEQ ID NO. 1582
atggattctaatgcatcaggcttccttctaaaccctccagctcttcactctacttactatcagcctagggaagatgatggtattattgatctgggtctcagtctcagaactttgaagcctgaggcttatcatccatctggacatctggtaggcctggagggatatggtgacctgatggactggcctcgggcaaactcaccactaaaacactccacttcaagctacattagatttaccccacaagattgtgacgaggaggcagagggagttcagagcaaagacaggtgggcttatgtgaaggtaaacatggatggggtgattgttggtaggaaaatatgcatgctagatcatggtggttactcaagcctcgcacttcagctcgaagacatgtttggaagacaatctgcatctgggttaaggctgttccaagcaggttctgaattctgcctgttctataaggacagagaggagaattggagaaccgttggtgatgttccttggaaggagtttgtagaaagcgtcaagcggctgaggattgcacgaaaaagcgaacctcttcttccatattcaccggccttctcctga

SEQ ID NO: 1582 - protein, 194 aa, Populus balsamifera subsp. trichocarpa
  misc_feature (2)..(188): Pfam Name: AUX_IAA Pfam Description: AUX/IAA family
  misc_feature (1)..(194): Ceres Annot ID no. 1463921
  misc_feature (1)..(194): Bit score of 463.2 for HMM based on sequences of Figure 23
  misc_feature (1)..(194): Functional Homolog Of SEQ ID NO. 1592
MDSNASGFLLNPPALHSTYYQPREDDGIIDLGLSLRTLKPEAYHPSGHLVGLEGYGDLMDWPRANSPLKHSTSSYIRFTPQDCDEEAEGVQSKDRWAYVKVNMDGVIVGRKICMLDHGGYSSLALQLEDMFGRQSASGLRLFQAGSEFCLFYKDREENWRTVGDVPWKEFVESVKRLRIARKSEPLLPYSPAFS

SEQ ID NO: 1583 - protein, 132 aa, Vitis vinifera
  misc_feature (2)..(188): Pfam Name: AUX_IAA Pfam Description: AUX/IAA family
  misc_feature (1)..(132): Public GI ID no. 157338847
  misc_feature (1)..(132): Bit score of 267.9 for HMM based on sequences of Figure 23
  misc_feature (1)..(132): Functional Homolog Of SEQ ID NO. 1592
MDSHSQGFLWSPPSLHPVYYQTKEDDGIIDLGLSLRTLQPQVYHPTGHKETEGVQSKERWAYVKVNMDGVVIGRKICVLDLAGYSSLALQLEDMFGRDSLSGLRLFQRESEFALFYKDREENWRTVGDVPWK

SEQ ID NO: 1584 - DNA, 567 bp, Solanum lycopersicum
  misc_feature (1)..(567): Ceres Annot ID no. 8458737
  misc_feature (1)..(567): Encodes the peptide sequence at SEQ ID NO. 1585
atggattcaaattcttctgaatatcttctaaaccatgcaacaactcttccttctgtttattatcaaaccaataataaagagaatggtaattttattgatttgggactaagtcttagagctttgcagcctgaggcctattatccatctactcatggtggctatgatgagttgatagattggcaacatttgcatccacaattaagcaaaaattcaagaagtgaatatcctacaaattttaataattatgatgatgaaagtgaagggattcaaagcaaagagagatgggaatatgtgaaggttaatatggatggagttattgttggaagaaaaatttgtcttcttgaacattcaagctattctagcattgcaacacaacttgaagacatgtttggtaaacaaaatatggatgggctaaggctattccaagatggttcagagttctcattattttacaaagataggaatgaccaatggaggattgttggtgatgttccatggaacgaatttgcagatcgagtgaagaggctaagaattatgaggaaagatgaagcattcttccccaattga

SEQ ID NO: 1585 - protein, 188 aa, Solanum lycopersicum
  misc_feature (2)..(187): Pfam Name: AUX_IAA Pfam Description: AUX/IAA family
  misc_feature (1)..(188): Ceres Annot ID no. 8458737
  misc_feature (1)..(188): Bit score of 462.4 for HMM based on sequences of Figure 23
  misc_feature (1)..(188): Functional Homolog Of SEQ ID NO. 1592
  misc_feature (1)..(188): in Figure 23
MDSNSSEYLLNHATTLPSVYYQTNNKENGNFIDLGLSLRALQPEAYYPSTHGGYDELIDWQHLHPQLSKNSRSEYPTNFNNYDDESEGIQSKERWEYVKVNMDGVIVGRKICLLEHSSYSSIATQLEDMFGKQNMDGLRLFQDGSEFSLFYKDRNDQWRIVGDVPWNEFADRVKRLRIMRKDEAFFPN

SEQ ID NO: 1586 - DNA, 834 bp, Sorghum bicolor
  misc_feature (1)..(834): Ceres Annot ID no. 8682232
  misc_feature (1)..(834): Encodes the peptide sequence at SEQ ID NO. 1587
atgagaggaggaggagcggggcccacggcggcgttcatctccggcgacccgcctccagccgccgcggaggaggtggaggagaactccggtggcgagggggacgaggaggtggtggtggtggggcaggacgacgacgacctggagctggggctctgtctcggttccaagaagcagcagccgtcgccggcgccgtgccggatcctcacggcccgggaccttcagccggggtccctgtcgccggattcctccgtgtcctcttcctctcccgcggcaggtgcaggtgccgcagcgcccagcaagagggccaaggcggatgctgcccccaacgccaccacctcgccggggacggccgttcctggccatccacagagctatggagtagtgggatggccacccataagaactttcaggatgaacagcctatttaaccaggccaaagaaaatgcctctgaggctggcaccaagaagcccaccgttgaatctgacatgcaggaagacaaggaggagagcaagaaaggacgggtcgtcggttgggtgaaggtgaacatggaaggagatatcattggaaggaaggtggatctcaacgcccatcgatcttacaagacccttgcctcagcacttgagctcatgttcatgaagccgtccatcagtctttgcacttctagtagttctaagtctctaaagctattggacaactcatcggagtatcagctcacctatgaggacagggatggggactggatgctagttggagatgtaccctgggagatgtttgtaggttcagtgaagaggctcaagatcatgaggacctcagatgccaacggtctcggttag

SEQ ID NO: 1587 - protein, 277 aa, Sorghum bicolor
  misc_feature (40)..(277): Pfam Name: AUX_IAA Pfam Description: AUX/IAA family
  misc_feature (1)..(277): Ceres Annot ID no. 8682232
  misc_feature (1)..(277): Bit score of 52.1 for HMM based on sequences of Figure 23
  misc_feature (1)..(277): Functional Homolog Of SEQ ID NO. 1592
MRGGGAGPTAAFISGDPPPAAAEEVEENSGGEGDEEVVVVGQDDDDLELGLCLGSKKQQPSPAPCRILTARDLQPGSLSPDSSVSSSSPAAGAGAAAPSKRAKADAAPNATTSPGTAVPGHPQSYGVVGWPPIRTFRMNSLFNQAKENASEAGTKKPTVESDMQEDKEESKKGRVVGWVKVNMEGDIIGRKVDLNAHRSYKTLASALELMFMKPSISLCTSSSSKSLKLLDNSSEYQLTYEDRDGDWMLVGDVPWEMFVGSVKRLKIMRTSDANGLG

SEQ ID NO: 1588 - DNA, 1013 bp, Triticum aestivum
  misc_feature (1)..(1013): Ceres Clone ID no. 846036
  misc_feature (1)..(1013): Encodes the peptide sequence at SEQ ID NO. 1589
ctcgaggcgcctcccctctcctctcgcgcacagacacgcgagcgcagccaagaaaccggccgatgcgagggccaggaggaggagttgcggcgttcggccccggcgagccgcccccggccgcggaggaggtggtggaggagaactcctcccccgccgatgccaaggcgggggaggggcccgcgcccgccgcctcgccggggactctcccckscggscasccacagagcagctttggagtggtgggatggccaccaatargaasattcaggatgaacagcctgttcggccaggcgaaagacaatgcctccgatgccgaaaccaagaaggccgccgccgatgactccggctcgcggaaagacaaggaggagggcgagaagaagggccgggtgcccgggtgggtgaaggtgaacatggatggagaggtcattgggaggaaggtggacctcaacgcccatcgctcgtacaagacccttgccttggcccttgagatcatgttcaccaagccatccgccggtctttgcgcctctaatagcacgaagtctctgaagctgttagaaaactcttgtgaataccagatgacatacgaagacagggatggtgactggatgcttgttggagatgtcccttgggaaatgtttgttggctctgtgaagaggctaaggattatgaggacatcggacgccagtggtcttgggccgcgatttcaagccaaccacagaaccgcggcctcgacaagagggagatcatgagggcagcactcaagtgaagagtcatatatcaccatctctgatgaaactacgtgggagcgagcagcctgacggcgcctctggcgcagccgttgttattacttgtgtgcctagttgagatagcaggagctaagatgtgctcctgcctgatggtgacttcttctgagctagtatctattcttttcccagcccccttcagttctgtctacacttggtgaagtgctagcatatgtgctcctttttcgtcatatatgttttttgtgcgac

SEQ ID NO: 1589 - protein, 228 aa, Triticum aestivum
  misc_feature (13)..(214): Pfam Name: AUX_IAA Pfam Description: AUX/IAA family
  misc_feature (1)..(228): Ceres Clone ID no. 846036
  misc_feature (1)..(228): Bit score of 48.8 for HMM based on sequences of Figure 23
  misc_feature (1)..(228): Functional Homolog Of SEQ ID NO. 1592
  misc_feature (50)..(50): Xaa is any aa, unknown, or other
  misc_feature (51)..(51): Xaa is any aa, unknown, or other
  misc_feature (52)..(52): Xaa is any aa, unknown, or other
  misc_feature (66)..(66): Xaa is any aa, unknown, or other
  misc_feature (67)..(67): Xaa is any aa, unknown, or other
MRGPGGGVAAFGPGEPPPAAEEVVEENSSPADAKAGEGPAPAASPGTLPXXXPQSSFGVVGWPPIXXFRMNSLFGQAKDNASDAETKKAAADDSGSRKDKEEGEKKGRVPGWVKVNMDGEVIGRKVDLNAHRSYKTLALALEIMFTKPSAGLCASNSTKSLKLLENSCEYQMTYEDRDGDWMLVGDVPWEMFVGSVKRLRIMRTSDASGLGPRFQANHRTAASTRGRS

SEQ ID NO: 1590 - protein, 161 aa, Arabidopsis thaliana
  misc_feature (3)..(160): Pfam Name: AUX_IAA Pfam Description: AUX/IAA family
  misc_feature (1)..(161): Public GI ID no. 6899651
  misc_feature (1)..(161): Bit score of 292.8 for HMM based on sequences of Figure 23
  misc_feature (1)..(161): Functional Homolog Of SEQ ID NO. 1592
MYCSDPPHPLHLVASDKQQKDHKLILSWKKPTMDSDPLGVFPNSPKYHPYYSQTTEFGGVIDLGLSLRTIQHEIYHSSGQSRKVCVLDHGSYSTLAHQLEDMFGMQSVSGLRLFQMESEFCLVYRDEEGLWRNAGDVPWNEFIESVERLRITRRNDAVLPF

SEQ ID NO: 1591 - DNA, 576 bp, Arabidopsis thaliana
  misc_feature (1)..(576): Ceres Annot ID no. 1310682
  misc_feature (1)..(576): Encodes the peptide sequence at SEQ ID NO. 1592
atggacccaaacacacctgcagacttcttcaaaggttcttccaagtttcatacatattactcacagaccaaaaagggtggtggggtaatcgatctaggcctcagccttaggaccatacaacatgaaacttacctcccaccggcgcgaatgataggtctcgacgggtatggagagctcatagactggtcgcagcccagctataacagcattacacagttgaagagtgaggacactggacaccaaagacttgcccaaggatattacaataatgaaggagagagcagaggaaaatatgcttacgtaaaggtaaatctggatggcctagtggtagggcgcaaggtttgccttgttgatcaaggagcttacgcaactcttgctcttcagctcaatgatatgtttgggatgcagaccgtgtcgggattgaggttgttccagactgagtctgagttctctttggtctacagagacagagaaggcatttggaggaatgttggggatgttccatggaaggagtttgtcgaaagcgtggatcggatgcgaatcgcaagaagaaacgatgctcttcttcccttttaa

SEQ ID NO: 1592 - protein, 191 aa, Arabidopsis thaliana
  misc_feature (32)..(190): Pfam Name: AUX_IAA Pfam Description: AUX/IAA family
  misc_feature (1)..(191): Ceres Annot ID no. 1310682
  misc_feature (1)..(191): Ceres Seedline ID no. CW00716
  misc_feature (1)..(191): Bit score of 458.5 for HMM based on sequences of Figure 23
  misc_feature (1)..(191): in Figure 23
MDPNTPADFFKGSSKFHTYYSQTKKGGGVIDLGLSLRTIQHETYLPPARMIGLDGYGELIDWSQPSYNSITQLKSEDTGHQRLAQGYYNNEGESRGKYAYVKVNLDGLVVGRKVCLVDQGAYATLALQLNDMFGMQTVSGLRLFQTESEFSLVYRDREGIWRNVGDVPWKEFVESVDRMRIARRNDALLPF

SEQ ID NO: 1593 - protein, 179 aa, Vitis vinifera
  misc_feature (24)..(173): Pfam Name: AUX_IAA Pfam Description: AUX/IAA family
  misc_feature (1)..(179): Public GI ID no. 147787084
  misc_feature (1)..(179): Bit score of 252.0 for HMM based on sequences of Figure 23
  misc_feature (1)..(179): Functional Homolog Of SEQ ID NO. 1592
  misc_feature (2)..(2): Xaa is any aa, unknown, or other
  misc_feature (4)..(4): Xaa is any aa, unknown, or other
  misc_feature (6)..(6): Xaa is any aa, unknown, or other
  misc_feature (20)..(20): Xaa is any aa, unknown, or other
  misc_feature (22)..(22): Xaa is any aa, unknown, or other
MXEXNXSNVPLGNNCCQCDXTXRMSFEFSGEAWEGYGRHNGEPVDWPQLEAQSRNSNSGCPKVIPEDCEEETEGVQSKERWAYVKVNMDGVVIGRKICVLDLAGYSSLALQLEDMFGRDSLSGLRLFQRESEFALFYKDREENWRTVGDVPWKEFVDSIKRLRIVRKNEAHFPSSLECT

SEQ ID NO: 1594 - DNA, 1263 bp, Arabidopsis thaliana
  misc_feature (1)..(1263): Ceres Clone ID no. 13741
  misc_feature (1)..(1263): Encodes the peptide sequence at SEQ ID NO. 1595
gaaactctctttcagatttcaagaaacccttaaaatcctctctctgtctctttctgtttgtttgttttcttgtttccttctctctctctctttctttctttgtcttcctttcccaggttgtttttttttgctctctctgccttcttgactttcaaaagactctttctttcttttggattgattttggattctagggctctctttcttttagtgggtttttgttcttgttgtggtctctctgatgattactgaacttgagatggggaaaggtgagagtgagcttgagcttggtctagggctgagtcttggcggtggaacggcggccaagattggtaaatcaggtggtggtggcgcgtggggagagcgtggaaggcttttgacggstaaggattttycttctgttggttctaaacgtgctgctgattctgcttctcatgctggttcatctcctcctcgttcaagtcaagttgttggatggcctcctatagggtcacacaggatgaacagtttggttaataaccaagctacaaagtcagcaagagaagaagaagaagctggtaagaagaaagtgaaagatgatgaacctaaagatgtgacaaagaaagtgaatgggaaagtacaagttggatttattaaggtgaacatggatggagttgctataggaagaaaagtggatttgaatgctcattcttcttacgagaatttggcgcaaacattggaagatatgttctttcgcactaatccgggtactgtcgggttaaccagtcagttcactaaaccgttgaggcttttagatggatcgtctgagtttgtacttacttatgaagataaggaaggagattggatgcttgttggtgatgttccatggagaatgttcatcaactcggtgaaaaggctacgtgtgatgaaaacctctgaagctaatggactcgctgcacgaaatcaagaaccaaacgagagacagcgaaagcagccggtttagatctcttttcgacgttacggtgttacaggttttatattttggggttttgcaagtctgagatacttctgaagcaagcataagctagattgatcttatatccagtttgtgtattttcttggttcttataatggtttttactggttttctttagtttttttttttgctgtcttttaattttcggttgcgatttcactatatactatggatggaagagaatgctctttatatcttttactacactgtaaatatttgaagcttatctaatatcgtttttaagggtc

SEQ ID NO: 1595 - protein, 246 aa, Arabidopsis thaliana
  misc_feature (15)..(234): Pfam Name: AUX_IAA Pfam Description: AUX/IAA family
  misc_feature (1)..(246): Ceres Clone ID no. 13741
  misc_feature (1)..(246): Bit score of 62.8 for HMM based on sequences of Figure 23
  misc_feature (1)..(246): Functional Homolog Of SEQ ID NO. 1592
  misc_feature (48)..(48): Xaa is any aa, unknown, or other
  misc_feature (52)..(52): Xaa is any aa, unknown, or other
MITELEMGKGESELELGLGLSLGGGTAAKIGKSGGGGAWGERGRLLTXKDFXSVGSKRAADSASHAGSSPPRSSQVVGWPPIGSHRMNSLVNNQATKSAREEEEAGKKKVKDDEPKDVTKKVNGKVQVGFIKVNMDGVAIGRKVDLNAHSSYENLAQTLEDMFFRTNPGTVGLTSQFTKPLRLLDGSSEFVLTYEDKEGDWMLVGDVPWRMFINSVKRLRVMKTSEANGLAARNQEPNERQRKQPV

SEQ ID NO: 1596 - DNA, 1263 bp, Arabidopsis thaliana
  misc_feature (1)..(1263): Ceres Clone ID no. 147816
  misc_feature (1)..(1263): Encodes the peptide sequence at SEQ ID NO. 1597
gaaactctctttcagatttcaagaaacccttaaaatcctctctctgtctctttctgtttgtttgttttcttgtttccttctctctctctctttctttctttgtcttcctttcccaggttgtttttttttgctctctctgccttcttgactttcaaaagactctttctttcttttggattgattwtggattctagggctctctttcttttagtgggtttttgttcttgttgtggtctctctgatgattactgaacttgagatggggaaaggtgagagtgagcttgagcttggtctagggctgagtcttggcggtggaacggcggccaagattggtaaatcaggtggtggtggcgcgtggggagagcgtggaaggcttttgacggctaaggattttccttctgttggttctaaacgtgctgctgattctrcttctcatgctggttcatctcctcctcgttcaagtcaagttgttggatggcctcctatagggtcacacaggatgaacagtttggttaataaccaagctacaaagtcagcaagagaagaagaagaagctggtaagaagaaagtgaaagatgatgaacctaaagatgtgacaaagaaagtgaatgggaaagtacaagttggatttattaaggtgaacatggatggagttgctataggaagaaaagtggatttgaatgctcattcttcttacgagaatttggcgcaaacattggaagatatgttctttcgcactaatccgggtactgtcgggttaaccagtcagttcactaaaccgttgaggcttttagatggatcgtctgagtttgtacttacttatgaagataaggaaggagattggatgcttgttggtgatgttccatggagaatgttcatcaactcggtgaaaaggctacgtgtgatgaaaacctctgaagctaatggactcgctgcacgaaatcaagaaccaaacgagagacagcgaaagcagccggtttagatctcttttcgacgttacggtgttacaggttttatattttggggttttgcaagtctgagatacttctgaagcaagcataagctagattgatcttatatccagtttgtgtattttcttggttcttataatggtttttactggttttctttagtttttttttttgctgtcttttaattttcggttgcgatttcactatatactatggatggaagagaatgctctttatatcttttactacactgtaaatatttgaagcttatctaatatcgtttttaagggtc

SEQ ID NO: 1597 - protein, 246 aa, Arabidopsis thaliana
  misc_feature (7)..(234): Pfam Name: AUX_IAA Pfam Description: AUX/IAA family
  misc_feature (1)..(246): Ceres Clone ID no. 147816
  misc_feature (1)..(246): Bit score of 65.2 for HMM based on sequences of Figure 23
  misc_feature (1)..(246): Functional Homolog Of SEQ ID NO. 1592
  misc_feature (63)..(63): Xaa is any aa, unknown, or other
MITELEMGKGESELELGLGLSLGGGTAAKIGKSGGGGAWGERGRLLTAKDFPSVGSKRAADSXSHAGSSPPRSSQVVGWPPIGSHRMNSLVNNQATKSAREEEEAGKKKVKDDEPKDVTKKVNGKVQVGFIKVNMDGVAIGRKVDLNAHSSYENLAQTLEDMFFRTNPGTVGLTSQFTKPLRLLDGSSEFVLTYEDKEGDWMLVGDVPWRMFINSVKRLRVMKTSEANGLAARNQEPNERQRKQPV

SEQ ID NO: 1598 - DNA, 1715 bp, Panicum virgatum
  misc_feature (1)..(1715): Ceres Clone ID no. 1780416
  misc_feature (1)..(1715): Encodes the peptide sequence at SEQ ID NO. 1599
acacacgacacacagattacagcgctctcgctcgcacttcctccgctcgtctgacatctcctcccgtcctttcctttcgaagcctcggggatcccggcgatggccaccgccgccaccctggtgtcggtcgacgacaagctcgaccagcttcgcgccgaggtcgccaagctcgaccagatcagcgagaacgagaagtccgggttcatcagcctcgtgtcgcgctacctcagtggggaggcggagcagatcgagtggagcaagatccagaccccgaccgatgaggtggtgatgccgtacgacaccctcgcgtcgcctcccgaagatctcgaggagacgaagaagctgctggacaagctcgttgtgctcaagcttaatggagggctcgggacgaccatgggctgcactggccccaagtctgtcattgaggtccgcaacgggttcacattccttgaccttattgtgattcaaattgagtctttgaacaagaagtatggatgcagtgtccctttacttctgatgaactctttcaacactcatgatgacacacagaagattgttgagaagtatgccaactccaacattgagattcacactttcaatcagagccagtatcctcgcattgatactgaagacttctcgctacttccaatcaagaaatctgggaaggatggctggtatcctccaggccatggtgatgtgttcccctctttgaacaacagtgggaaacttgacctcttattggctcagggcaaggagtatgtctttgttgcaaactcagacaacttgggtgctatagttgacatcaaaatcctaaaccatctgatcaacaaccagaatgagtactgcatggaggttactccaaagactctggctgatgttaagggtggtaccctcatctcttacgaaggaagggttcagcttttggagattgcccaagtacctgatgagcatgtgaatgaattcaaatcaattgagaagtttaagatattcaacactaacaacttgtgggtgaacctaaaagctatcaagagacttgtagaagctgatgcacttaagatggaaattattccaaaccccaaggaagttgatggtgtgaaagttcttcaactcgaaactgcagctggcgcagctattaggttcttcgacaaagcgattggaattaatgttccccgctcaaggtttctcccagtgaaggctacatctgatttgttgcttgtgcagtctgatctttacaccttggttgatggctttgtcacccgcaacccagccagagcaaatccagctaacccttcaattgagcttggtcctgagttcaagaaggttgccaacttccttgcccggttcaagtccatccccagcattgtcgaccttgatagcttgaaggtttctggtgacgtctggtttggctctggaattacactcaagggcaaggtgaccatcaccgccaagcccggagtgaagttggagattccagatggagctgtgcttgagaacaaggacgtcaggggcccccaggatctctgagcgatgcgtaccgtcgtcaccagtttttccgaggaccttttgcaggagccgccgccctagtcaatccgctgagctttgtcttttgtaagtgtcatgtgcattaccgctgtgagggtcttgtgagcccgctacagaataattgtaatcctctttacttgtgtttttggcgcaccagggacgaatattttgct

SEQ ID NO: 1599 - protein, 474 aa, Panicum virgatum
  misc_feature (31)..(442): Pfam Name: UDPGP Pfam Description: UTP--glucose-1-phosphate uridylyltransfera
  misc_feature (1)..(474): Ceres Clone ID no. 1780416
  misc_feature (1)..(474): Bit score of 1310.5 for HMM based on sequences of Figure 17
  misc_feature (1)..(474): in Figure 17
MATAATLVSVDDKLDQLRAEVAKLDQISENEKSGFISLVSRYLSGEAEQIEWSKIQTPTDEVVMPYDTLASPPEDLEETKKLLDKLVVLKLNGGLGTTMGCTGPKSVIEVRNGFTFLDLIVIQIESLNKKYGCSVPLLLMNSFNTHDDTQKIVEKYANSNIEIHTFNQSQYPRIDTEDFSLLPIKKSGKDGWYPPGHGDVFPSLNNSGKLDLLLAQGKEYVFVANSDNLGAIVDIKILNHLINNQNEYCMEVTPKTLADVKGGTLISYEGRVQLLEIAQVPDEHVNEFKSIEKFKIFNTNNLWVNLKAIKRLVEADALKMEIIPNPKEVDGVKVLQLETAAGAAIRFFDKAIGINVPRSRFLPVKATSDLLLVQSDLYTLVDGFVTRNPARANPANPSIELGPEFKKVANFLARFKSIPSIVDLDSLKVSGDVWFGSGITLKGKVTITAKPGVKLEIPDGAVLENKDVRGPQDL

SEQ ID NO: 1600 - protein, 473 aa, Zea mays
  misc_feature (29)..(441): Pfam Name: UDPGP Pfam Description: UTP--glucose-1-phosphate uridylyltransfera
  misc_feature (1)..(473): Public GI ID no. 212275438
  misc_feature (1)..(473): Bit score of 1328.4 for HMM based on sequences of Figure 17
  misc_feature (1)..(473): Functional Homolog Of SEQ ID NO. 1599
  misc_feature (1)..(473): in Figure 17
MATTAVSVDEKLDKLRAEVAKLDQISENEKSGFISLVSRYLSGEAEQIEWSKIQTPTDEVVVPYDTVASPPEDLEETKKLLDKLVVLKLNGGLGTTMGCTGPKSVIEVRNGFTFLDLIVIQIESLNKKYGCNVPLLLMNSFNTHDDTQKIVEKYSNSNIEIHTFNQSQYPRIVTEDFLPLPSKGKSGKDGWYPPGHGDVFPSLNNSGKLDILLAQGKEYVFVANSDNLGAIVDIKILNHLINNQNEYCMEVTPKTLADVKGGTLISYEGRVQLLEIAQVPDEHVNEFKSIEKFKIFNTNNLWVNLKAIKRLVEAEALKMEIIPNPKEVDGVKVLQLETAAGAAIRFFDKAIGINVPRSRFLPVKATSDLLLVQSDLYTLVDGFVIRNPSRANPANPSIELGPEFKKVANFLARFKSIPSIVELDSLKVSGDVWFGSGITLKGKVTIIAKPGVKLEIPDGDVLENKDVNGPEDL

SEQ ID NO: 1601 - DNA, 1425 bp, Sorghum bicolor
  misc_feature (1)..(1425): Ceres Annot ID no. 8655553
  misc_feature (1)..(1425): Encodes the peptide sequence at SEQ ID NO. 1602
atggccgctgccgccgctgccgcggtgtcggtcgacgagaagctcgacaagcttcgcgccgaggtcgccaagctcgaccagatcagcgagaacgagaagtccgggttcctcagcctcgtgtcacgctacctcagtggggaggcggagcagatcgagtggagcaagatccagaccccgactgatgaggtggtggtgccgtacgataccctcgcgtcgcctcccgaagatctcgaggagacgaagaagctgctggacaagctcgttgtgctcaagcttaacggagggctcgggacgaccatgggctgcactgggcccaagtctgtcattgaagtccgcaatgggttcacattccttgatcttattgtgatccaaattgagtccctgaacaagaagtatggatgcagtgtccctttacttctgatgaactctttcaacacccatgatgacacacagaagattgttgaaaagtattccaactccaacattgaaattcatactttcaatcagagccagtatcctcgcattgttaccgaggacttcttgccacttccaagcaaagggaactctgggaaggatggctggtatcctccaggccatggtgatgtgttcccctctctgaataacagcggaaaacttgacatcttattggctcagggcaaggagtatgtcttcgttgcaaactcagacaacttgggtgctatagtcgacatcaagatcctaaaccatctgatcaataaccagaacgagtattgcggaggtatggaagacagccttgttactccaaagacgctggctgatgttaagggcggtacactcatctcttacgaaggaagagttcagcttttggagattgcccaagtacctgatgagcatgtcaatgaatttaaatcaatcgagaagtttaagatattcaacactaacaacttgtgggtgaaccttaaagctatcaagagactcgtagaggctgaggctcttaagatggaaattattccaaaccccaaggaagttgatggtgtaaaggtccttcaactcgaaactgcagctggtgcagctattcggttcttcgacaaagcgattggaattaatgttccccgctcaaggtttctcccagtgaaggctacatctgatttgttgcttgtgcagtctgatctttacaccttggttgatggctttgtcatccgcaacccagccagagcgaatccagctaacccttcgattgagcttggacctgagttcaagaaggttgccaatttccttgctcggttcaagtccatccccagcatcgtcgagcttgacaacttgaaggtttctggtgatgtctggtttggctctggaattacactcaagggcaaggtgacaatcactgccaagtctggagtgaagttggagattccagatggagctgtacttgagaacaaggtataa

SEQ ID NO: 1602 - protein, 474 aa, Sorghum bicolor
  misc_feature (32)..(449): Pfam Name: UDPGP Pfam Description: UTP--glucose-1-phosphate uridylyltransfera
  misc_feature (1)..(474): Ceres Annot ID no. 8655553
  misc_feature (1)..(474): Bit score of 1284.3 for HMM based on sequences of Figure 17
  misc_feature (1)..(474): Functional Homolog Of SEQ ID NO. 1599
  misc_feature (1)..(474): in Figure 17
MAAAAAAAVSVDEKLDKLRAEVAKLDQISENEKSGFLSLVSRYLSGEAEQIEWSKIQTPTDEVVVPYDTLASPPEDLEETKKLLDKLVVLKLNGGLGTTMGCTGPKSVIEVRNGFTFLDLIVIQIESLNKKYGCSVPLLLMNSFNTHDDTQKIVEKYSNSNIEIHTFNQSQYPRIVTEDFLPLPSKGNSGKDGWYPPGHGDVFPSLNNSGKLDILLAQGKEYVFVANSDNLGAIVDIKILNHLINNQNEYCGGMEDSLVTPKTLADVKGGTLISYEGRVQLLEIAQVPDEHVNEFKSIEKFKIFNTNNLWVNLKAIKRLVEAEALKMEIIPNPKEVDGVKVLQLETAAGAAIRFFDKAIGINVPRSRFLPVKATSDLLLVQSDLYTLVDGFVIRNPARANPANPSIELGPEFKKVANFLARFKSIPSIVELDNLKVSGDVWFGSGITLKGKVTITAKSGVKLEIPDGAVLENKV

SEQ ID NO: 1603 - protein, 473 aa, Bambusa oldhamii
  misc_feature (29)..(441): Pfam Name: UDPGP Pfam Description: UTP--glucose-1-phosphate uridylyltransfera
  misc_feature (1)..(473): Public GI ID no. 37729658
  misc_feature (1)..(473): Bit score of 1334.4 for HMM based on sequences of Figure 17
  misc_feature (1)..(473): Functional Homolog Of SEQ ID NO. 1599
  misc_feature (1)..(473): in Figure 17
MAAAVAAADEKLEKLRDAVAQLDQISENEKAGFTSLVSRYLSGEAEQIEWSKIQTPTDEVVVPYDTLAPAPEDLDATKKLLDKLVVLKLNGGLGTTMGCTGPKSVIEVRNGFTFLDLIVIQIESLNKKYGCNVPLLLMNSFNTHDDTQKIVEKYSNSNIEIHTFNQSQYPRIVTEDFLPLPSKGKTGKDGWYPPGHGDVFPSLNNSGKLDTLLSQGKEYVFVANSDNLGAIVDIKILNHLIHNQNEYCMEVTPKTLADVKGGTLISYEGRVQLLEIAQVPDEHVNEFKSIEKFKIFNTNNLWVNLKAIKRLVEAEALKMEIIPNPKEVDGVKVLQLETAAGAAIRFFEKAIGINVPRSRFLPVKATSDLLLVQSDLYTLVDGFVIRNPARANPANPSIELGPEFKKVANFLARFKSIPSIVELDSMKVSGDVWFGSGITLKGKVTISAKSGVKLEIPDGTVLENKDINGPEDL

SEQ ID NO: 1604 - protein, 473 aa, Dendrocalamus sinicus
  misc_feature (29)..(441): Pfam Name: UDPGP Pfam Description: UTP--glucose-1-phosphate uridylyltransfera
  misc_feature (1)..(473): Public GI ID no. 158705664
  misc_feature (1)..(473): Bit score of 1328.1 for HMM based on sequences of Figure 17
  misc_feature (1)..(473): Functional Homolog Of SEQ ID NO. 1599
  misc_feature (1)..(473): in Figure 17
MAAAVAAADEKLEKLRDAVAKLDQISENEKAGFTSLVSRYLSGEAEQIEWSKIQTPTDEVVVPYDTLAPAPEDLDATKKLLDKLVVLKLNGGLGTTMGCTGPKSVIEVRNGFTFLDLIVIQIESLNKKYGCNVPLLLMNSFNTHDDTQKIVEKYSSSNIEIHTFNQSQYPRIVTEDFLPLPSKGKSGKDGWYPPGHGDVFPSLNNSGKLDTLLSQGKEYVFVANSDNLGAIVDIKILNHLIHNQNEYCMEVTPKTLADVKGGTLISYEGRVQLLEIAQVPDEHVNEFKSIEKFKIFNTNNLWVNLKAIKRLVEGEALKMEIIPNPKEVDGVKVLQLETAAGAAIRFFDKAIGINVPRSRFLPVKATSDLLLVQSDLYTLVDGFVISNPARANPSNPSIELGPEFKKVANFLARFKSIPSIVELDSLKVSGDVWFGSGITLKGKVTITAKSGVKLEISDGAVLENKDINGPEDL

SEQ ID NO: 1605 - protein, 469 aa, Oryza sativa subsp. japonica
  misc_feature (26)..(438): Pfam Name: UDPGP Pfam Description: UTP--glucose-1-phosphate uridylyltransfera
  misc_feature (1)..(469): Public GI ID no. 115480571
  misc_feature (1)..(469): Bit score of 1319.0 for HMM based on sequences of Figure 17
  misc_feature (1)..(469): Functional Homolog Of SEQ ID NO. 1599
  misc_feature (1)..(469): in Figure 17
MAVTADVKLEGLRAATDKLDQISENEKSGFISLVSRYLSGEAEQIEWSKIQTPTDEVVVPYDTLSAAPEDLNETKKLLDKLVVLKLNGGLGTTMGCTGPKSVIEVRNGFTFLDLIVIQIESLNKKYGCNVPLLLMNSFNTHDDTQKIVEKYSNSNIEIHTFNQSQYPRIVTEDFLPLPSKGKTGKDGWYPPGHGDVFPSLNNSGKLDTLLAQGKEYVFVANSDNLGAIVDIKILNHLIHNQNEYCMEVTPKTLADVKGGTLISYEGRVQLLEIAQVPDEHVNEFKSIEKFKIFNTNNLWVNLKAIKRLVEAEALKMEIIPNPKEVDGVKVLQLETAAGAAIRFFEKAIGINVPRSRFLPVKATSDLLLVQSDLYTLVDGFVIRNPARTNPSNPSIELGPEFKKVANFLARFKSIPSIVELDTLKVSGDVWFGSGVTLKGKVTITAKSGKLEIPDGAVLENKDINGPEDL

SEQ ID NO: 1606 - protein, 473 aa, Hordeum vulgare
  misc_feature (29)..(441): Pfam Name: UDPGP Pfam Description: UTP--glucose-1-phosphate uridylyltransfera
  misc_feature (1)..(473): Public GI ID no. 6136111
  misc_feature (1)..(473): Bit score of 1315.8 for HMM based on sequences of Figure 17
  misc_feature (1)..(473): Functional Homolog Of SEQ ID NO. 1599
  misc_feature (1)..(473): in Figure 17
MAAAAVAADSKIDGLRDAVAKLGEISENEKAGFISLVSRYLSGEAEQIEWSKIQTPTDEVVVPYDTLAPPPEDLDAMKALLDKLVVLKLNGGLGTTMGCTGPKSVIEVRNGFTFLDLIVIQIESLNKKYGCSVPLLLMNSFNTHDDTQKIVEKYSNSNIEIHTFNQSQYPRIVTEDFLPLPSKGQTGKDGWYPPGHGDVFPSLNNSGKLDTLLSQGKEYVFVANSDNLGAIVDIKILNHLIHNQNEYCMEVTPKTLADVKGGTLISYEGRVQLLEIAQVPDEHVDEFKSIEKFKIFNTNNLWVNLKAIKRLVDAEALKMEIIPNPKEVDGVKVLQLETAAGAAIRFFEKAIGINVPRSRFLPVKATSDLLLVQSDLYTLVDGYVIRNPARVKPSNPSIELGPEFKKVANFLARFKSIPSIVELDSLKVSGDVSFGSGVVLKGNVTIAAKAGVKLEIPDGAVLENKDINGPEDI

SEQ ID NO: 1607 - DNA, 1713 bp, Triticum aestivum
  misc_feature (1)..(1713): Ceres Clone ID no. 604729
  misc_feature (1)..(1713): Encodes the peptide sequence at SEQ ID NO. 1608
acctctcccttccagtcatctgacatctgctcccgtcctctcctcttctcttccccccgaagcagcagcgtccctcctctccgcccggatcgcgatggccgccgccgccgactccaagatcgacaacctccgcgacgccgtcgccaagctcggcgagatcagcgagaacgagaaggccggcttcatcagcctcgtctcgcgctacctcagcggcgaggcggagcagatcgagtggagcaagatccagacccccaccgatgaggtggtggtgccctacgacaccctcgcgccccctcccgaagatctcgacgccatgaaggctctgctcgacaagctcgtggtgctcaagctcaacggaggcctcggcaccaccatgggctgcaccggccccaagtccgtcattgaagttcgcaatgggtttacatttcttgaccttattgtgattcagattgagtccctgaacaagaagtatggatgcagtgttcctttgcttctaatgaactctttcaacactcatgacgacacacagaagattgttgagaagtactccaactccaacattgaaattcacactttcaaccagagccaataccctcgcattgttactgaagacttcttgccacttccaagcaaagggcagacagggaaggatggctggtaccccccaggccacggtgatgtgttcccctctttgaacaacagtggaaaactcgataccttactgtcacagggaaaggagtatgtcttcatggcgaactcagacaacttgggtgctatagttgacatcaagatactaaaccacctgatcactaaccagaatgagtactgcatggaagttactccaaaaacattggctgatgtcaaaggtggtaccctcatctcatacgaaggaagagtccagctcttggagattgcccaagtccctgatgagcatgtgaatgaattcaagtcgattgagaagttcaagatatttaacaccaacaacctgtgggtgaacttgaaggcgatcaagaggcttgtagatgctgaagcacttaagatggaaatcattcccaaccctaaggaagttgatggcgtgaaagtcctgcagctagaaaccgcagctggagcagcgatcaggttctttgagaaagcaatcggcatcaacgttccccgctcaaggtttctgcccgtgaaggctacatctgatttgttgcttgtgcagtctgatctctataccttggttgatggctacgtcatccgcaacccagccagagtgaagccatcgaacccttcaattgagcttggtcctgagttcaaaaaggttgccaacttccttgcccgtttcaagtcgatccccagcatcgttgagctcgacagcttgaaggtctctggtgatgtctcgtttggctctggagtcgtactcaagggcaacgtgaccatcgctgccaaggctggagtcaagttggagatcccagacggagctgtgctcgagaacaaggacatcaacggccctgaggatctttgagcgacgcccgccgccatcgccagtcgcattcccagaaaccttccggtcctccttcgctgagttaaccgtcctgtaattttcgtgtgcattctgctggagtgttgtcctgggatagcccctttacataataattgtaatcccctctgtgatgttcatctacacttgttcttcctgggtgtgccagggacgtaaaatttcttttggtc

SEQ ID NO: 1608 - protein, 470 aa, Triticum aestivum
  misc_feature (26)..(438): Pfam Name: UDPGP Pfam Description: UTP--glucose-1-phosphate uridylyltransfera
  misc_feature (1)..(470): Ceres Clone ID no. 604729
  misc_feature (1)..(470): Bit score of 1318.3 for HMM based on sequences of Figure 17
  misc_feature (1)..(470): Functional Homolog Of SEQ ID NO. 1599
  misc_feature (1)..(470): in Figure 17
MAAAADSKIDNLRDAVAKLGEISENEKAGFISLVSRYLSGEAEQIEWSKIQTPTDEVVVPYDTLAPPPEDLDAMKALLDKLVVLKLNGGLGTTMGCTGPKSVIEVRNGFTFLDLIVIQIESLNKKYGCSVPLLLMNSFNTHDDTQKIVEKYSNSNIEIHTFNQSQYPRIVTEDFLPLPSKGQTGKDGWYPPGHGDVFPSLNNSGKLDTLLSQGKEYVFMANSDNLGAIVDIKILNHLITNQNEYCMEVTPKTLADVKGGTLISYEGRVQLLEIAQVPDEHVNEFKSIEKFKIFNTNNLWVNLKAIKRLVDAEALKMEIIPNPKEVDGVKVLQLETAAGAAIRFFEKAIGINVPRSRFLPVKATSDLLLVQSDLYTLVDGYVIRNPARVKPSNPSIELGPEFKKVANFLARFKSIPSIVELDSLKVSGDVSFGSGVVLKGNVTIAAKAGVKLEIPDGAVLENKDINGPEDL

SEQ ID NO: 1609 - protein, 467 aa, Musa acuminata
  misc_feature (23)..(435): Pfam Name: UDPGP Pfam Description: UTP--glucose-1-phosphate uridylyltransfera
  misc_feature (1)..(467): Public GI ID no. 12585489
  misc_feature (1)..(467): Bit score of 1321.3 for HMM based on sequences of Figure 17
  misc_feature (1)..(467): Functional Homolog Of SEQ ID NO. 1599
  misc_feature (1)..(467): in Figure 17
MADAKIAKLQSAVAELNQISENEKSGFISLVSRYLSGEAEQIEWSKIQTPTDEVVVPYDTLSPPPEDLEATKKLLDKLAVLKLNGGLGTTMGCTGPKSVIEVRNGFTFLDLIVIQIESLNKKYGCNVPLLLMNSFNTHDDTQKIVEKYANSNIEIHTFNQSQYPRLVMEDFQPLPSKGHAGKDGWYPPGHGDVFPSLMNSGKLDALLSQGKEYVFIANSDNLGAIVDIKILNHLINNQNEYCMEVTPKTLADVKGGTLISYEGRVQLLEIAQVPDAHVNEFKSIEKFKIFNTNNLWVNLKAIKRLVEADALKMEIIPNPKEVDGVKVLQLETAAGAAIRFFDHAIGINVPRSRFLPVKATSDLLLVQSDLYMLVDGFVIRNKARTNPSNPSIELGPEFKKVANFLSRFKSIPSIVELDSLKVSGDVWFGEGVVLKGNVSIAAKSGVKLEISDGAVLENKVINGPEDI

SEQ ID NO: 1610 - protein, 469 aa, Populus tremula x Populus tremuloides
  misc_feature (25)..(437): Pfam Name: UDPGP Pfam Description: UTP--glucose-1-phosphate uridylyltransfera
  misc_feature (1)..(469): Public GI ID no. 82659609
  misc_feature (1)..(469): Bit score of 1324.6 for HMM based on sequences of Figure 17
  misc_feature (1)..(469): Functional Homolog Of SEQ ID NO. 1599
  misc_feature (1)..(469): in Figure 17
MATDTAKISQLKSAVANLDQISESEKTGFVNLVSRYLSGEAQQVEWSKIQTPTDEVVVPYDTLAPTPEDPEETKKLLDKLVVLKLNGGLGTTMGCTGPKSVIEVRNGLTFLDLIVIQIENLNKKYGCSVPLLLMNSFNTHDDTQKIVEKYSNSNIEIHTFNQSQYPRLVVDDFVPLPSKGHTDKDGWYPPGHGDVFPSLKNSGKLDDLLSQGKEYVFVANSDNLGAVVDLKILNHLIRNKNEYCMEVTPKTLADVKGGTLISYEGKVQLLEIAQVPDQHVNEFKSIEKFKIFNTNNLWVNLKAIKRLVEADALKMEIIPNPKEVDGVKVLQLETAAGAAIKFFDHAIGINAPRSRFLPVKATSDLLLVQSDLYTLVDGFVIRNPARTIPANPSIDLGPEYKKVANFLSRFKSIPSIIELDSLKVAGDVWFGAGITLKGKVSIVAKSGVKLEIPDGAVLQNKEINGPEDL

SEQ ID NO: 1611 - protein, 477 aa, Solanum tuberosum
  misc_feature (32)..(445): Pfam Name: UDPGP Pfam Description: UTP--glucose-1-phosphate uridylyltransfera
  misc_feature (1)..(477): Public GI ID no. 136739
  misc_feature (1)..(477): Bit score of 1303.5 for HMM based on sequences of Figure 17
  misc_feature (1)..(477): Functional Homolog Of SEQ ID NO. 1599
  misc_feature (1)..(477): in Figure 17
MATATTLSPADAEKLNNLKSAVAGLNQISENEKSGFINLVGRYLSGEAQHIDWSKIQTPTDEVVVPYDKLAPLSEDPAETKKLLDKLVVLKLNGGLGTTMGCTGPKSVIEVRNGLTFLDLIVKQIEALNAKFGCSVPLLLMNSFNTHDDTLKIVEKYANSNIDIHTFNQSQYPRLVTEDFAPLPCKGNSGKDGWYPPGHGDVFPSLMNSGKLDALLAKGKEYVFVANSDNLGAIVDLKILNHLILNKNEYCMEVTPKTLADVKGGTLISYEGKVQLLEIAQVPDEHVNEFKSIEKFKIFNTNNLWVNLSAIKRLVEADALKMEIIPNPKEVDGVKVLQLETAAGAAIKFFDRAIGANVPRSRFLPVKATSDLLLVQSDLYTLTDEGYVIRNPARSNPSNPSIELGPEFKKVANFLGRFKSIPSIIDLDSLKVTGDVWFGSGVTLKGKVTVAAKSGVKLEIPDGAVIANKDINGPEDI

SEQ ID NO: 1612 - protein, 477 aa, Solanum tuberosum
  misc_feature (32)..(445): Pfam Name: UDPGP Pfam Description: UTP--glucose-1-phosphate uridylyltransfera
  misc_feature (1)..(477): Public GI ID no. 1388021
  misc_feature (1)..(477): Bit score of 1301.2 for HMM based on sequences of Figure 17
  misc_feature (1)..(477): Functional Homolog Of SEQ ID NO. 1599
  misc_feature (1)..(477): in Figure 17
MVTATTLSPADAEKLNNLKSAVAGLNQISENEKSGFINLVGRYLSGEAQHIDWSKIQTPTDEVVVPYDKLAPLSEDPAETKKLLDKLVVLKLNGGLGTTMGCTGPKSVIEVRNGLTFLDLIVKQIEALNAKFGCSVPLLLMNSFNTHDDTLKIVEKYANSNIDIHTFNQSQYPRLVTEDFAPLPCKGNSGKDGWYPPGHGDVFPSLMNSGKLDALLAKGKEYVFVANSDNLGAIVDLKILNHLILNKNEYCMEVTPKTLADVKGGTLISYEGKVQLLEIAQVPDEHVNEFKSIEKFKIFNTNNLWVNLSAIKRLVEADALKMEIIPNPKEVDGVKVLQLETAAGAAIKFFDRAIGANVPRSRFLPVKATSDLLLVQSDLYTLTDEGYVIRNPARSNPSNPSIELGPEFKKVANFLGRFKSIPSIIDLDSLKVTGDVWFGSGVTLKGKVTVAAKSGVKLEIPDGAVIANKDINGPEDI

SEQ ID NO: 1613 - protein, 476 aa, Eucalyptus grandis
  misc_feature (32)..(444): Pfam Name: UDPGP Pfam Description: UTP--glucose-1-phosphate uridylyltransfera
  misc_feature (1)..(476): Public GI ID no. 192338746
  misc_feature (1)..(476): Bit score of 1311.7 for HMM based on sequences of Figure 17
  misc_feature (1)..(476): Functional Homolog Of SEQ ID NO. 1599
  misc_feature (1)..(476): in Figure 17
MAAAATLSAPDAAKLSQLKSAVSGLGQISESEKNGFINLVSRYLSGEAQHVDWSKIQTPTDEIVVPYDSLAPTPQDPAATKSLLDKLVVLKLNGGLGTTMGCTGPKSVIEVRNGLTFLDLIVIQIENLNTKYGCNVPLLLMNSFNTHDDTLKIVEKYANSNIDIHTFNQSQYPRLVVEDFMPLPCKGQTGKDGWYPPGHGDVFASLMNSGKLDALLSQGKEYVFAANSDNLGAIVDLKILNHLMTNKNEYCMEVTPKTLADVKGGTLISYEGKVQLLEIAQVPDEHINEFKSIEKFKIFNTNNLWVNLKAIKRLVEAQALKMEIIPNPKEVDGIKVLQLETAAGAAIKFFDNAIGINVPRSRFLPVKATSDLLLVQSDLYTLVDGFVERNKARTNPSNPSIELGPEFKKVGNFLSRFKSIPSIIELDSLKVSGDVWFGTGITLKGKVTIAAKPGVKLEIPDGVVLENKEIHGPEDL

SEQ ID NO: 1614 - DNA, 1733 bp, Gossypium hirsutum
  misc_feature (1)..(1733): Ceres Clone ID no. 1924295
  misc_feature (1)..(1733): Encodes the peptide sequence at SEQ ID NO. 1615
gacagagcttagataatttgttttgaaggtgaccaacaacagcacaccacacagcagcgcatttagtcttgttcttgttcttcttctagttgtttccaatggaaaagctggaacacctcaaatctgccgtcgctgctctttctgaaatcagtgaaaatgagaaaaacggattcatcaaccttgtctcccgctatctcagtggagaagctcagcacatagagtggagtaagatccagactccaactgatgaagtggttgttccttatgacaccttgtctccctctcctgatgatcctgctgaaaccaagaagctcttggacaaacttgttgtcttaaagcttaatggaggtctcggaaccactatgggatgtactggtcccaaatccgtcattgaagttcgcaatggcttgacttttcttgacctaattgttattcagatcgagaatcttaattctaaatacggatgtaatgttccgttggttctgatgaactcattcaacacccatgatgacacattgaagattgtcgacaagtactcaaattcaaacattgagattcatacttttaatcagagccaatatcctcgtctggttgttgaagattttgctccattaccaagcaaaggccagcatggcaaggatggatggtaccctcctggtcatggtgatgtgttcccatctctaatgaacagtggcaagcttgatgctttcttatcacagggcaaggagtatgtcttcgttgcaaattcagacaatttgggtgctattgttgacttgaaaatcttaaaccatttggtccaaaacaagaatgaatattgtatggaggttacacccaaaaccctagctgatgtcaagggtggtactcttatttcttatgaaggaaaagttcagctccttgaaattgctcaagtccctgatgaacatgtcaatgagttcaagtctatagaaaagtttaaaattttcaatacaaacaatttgtgggtcaacctgaatgctatcaagaggcttgtggaagctgatgaactcaagatggagatcattccaaacccaaaggaggtcaatggaatcaaggttcttcaactggaaactgcagctggtgcagcaattaggttctttgatcatgctattggtatcaacgtacctcgatcgcgattccttccagtgaaggcaacttcagatttgcttcttgttcagtctgacctttacaccttagttgatggatttgttatccggaataaagatagagcgaatcctacaaacccatccatagaattggggcctgaattcaagaaggttggtaacttcttaagtcgattcaagtcaatcccgagcatcattgagcttgatagccttaaggtgactggtgatgtttggtttggtgctggcattgtgctcaaggggaaagtgagtatcgctgcaaaacccggggtgaagttggagattcccgatggagctgtaattgagaacaaggaaattaatggccccgaagacatctgagagaggcccgtctgccagccgaagtttccctgattttggtgtgttgcagtagataacgaacgcatcttttatatagataggaagtaaaataaaataaaaatacttggaacagaagtagtatttgcgtttcatatcacatatatatgttgtatgtcttgcgggagtttcccttgaattactatttttcgaggtatgatgaaaaacagtgttctgaatgttgtatctactttttgcacc

SEQ ID NO: 1615 - protein, 465 aa, Gossypium hirsutum
  misc_feature (21)..(433): Pfam Name: UDPGP Pfam Description: UTP--glucose-1-phosphate uridylyltransfera
  misc_feature (1)..(465): Ceres Clone ID no. 1924295
  misc_feature (1)..(465): Bit score of 1310.2 for HMM based on sequences of Figure 17
  misc_feature (1)..(465): Functional Homolog Of SEQ ID NO. 1599
  misc_feature (1)..(465): in Figure 17
MEKLEHLKSAVAALSEISENEKNGFINLVSRYLSGEAQHIEWSKIQTPTDEVVVPYDTLSPSPDDPAETKKLLDKLVVLKLNGGLGTTMGCTGPKSVIEVRNGLTFLDLIVIQIENLNSKYGCNVPLVLMNSFNTHDDTLKIVDKYSNSNIEIHTFNQSQYPRLVVEDFAPLPSKGQHGKDGWYPPGHGDVFPSLMNSGKLDAFLSQGKEYVFVANSDNLGAIVDLKILNHLVQNKNEYCMEVTPKTLADVKGGTLISYEGKVQLLEIAQVPDEHVNEFKSIEKFKIFNTNNLWVNLNAIKRLVEADELKMEIIPNPKEVNGIKVLQLETAAGAAIRFFDHAIGINVPRSRFLPVKATSDLLLVQSDLYTLVDGFVIRNKDRANPTNPSIELGPEFKKVGNFLSRFKSIPSIIELDSLKVTGDVWFGAGIVLKGKVSIAAKPGVKLEIPDGAVIENKEINGPEDI

SEQ ID NO: 1616 - protein, 465 aa, Vitis vinifera
  misc_feature (21)..(433): Pfam Name: UDPGP Pfam Description: UTP--glucose-1-phosphate uridylyltransfera
  misc_feature (1)..(465): Public GI ID no. 225431563
  misc_feature (1)..(465): Bit score of 1298.7 for HMM based on sequences of Figure 17
  misc_feature (1)..(465): Functional Homolog Of SEQ ID NO. 1599
  misc_feature (1)..(465): in Figure 17
MEKLSQLRSAVAGLDQISENEKSGFINLVSRYLSGEAQHIEWSKIKTPTDEVVVPYDTLAPTPEDSVETKKLLDKLVVLKLNGGLGTTMGCTGPKSVIEVRNGLTFLDLIVIQIENLNNKYGCKVPLLLMNSFNTHDDTLKIVQKYEKSNIEIHTFNQSQYPRVVVDDFSPLPSKGNTGKDGWYPPGHGDVFPALMNSGKLEKLLSQGKEYVFVANSDNLGAVVDLKILNHLIKNKNEYCMEVTPKTLADVKGGTLISYEGKVQLLEIAQVPDEHVNEFKSIEKFKIFNTNNLWVNLNAIKRLVEADALKMEIIPNPKEVDGIKVLQLETAAGAAIRFFDNAIGINVPRSRFLPVKATSDLLLVQSDLYTLSDGFVVRNKARKNPENPVIELGPEFKKVGNFLSRFKSIPSIIELDSLKVAGDVWFGSGVILKGKVTIEAKAGVKLEIPNGAVVANKVINGPQDI

SEQ ID NO: 1617 - DNA, 1744 bp, Zea mays
  misc_feature (1)..(1744): Ceres Clone ID no. 220954
  misc_feature (1)..(1744): Encodes the peptide sequence at SEQ ID NO. 1618
aacagcaccccctcctcgctcgcactccgttcgtctgacatctcctcccgtcctttcctttctgaggctcgcgaaccccgacaatggccgcaaccgcggtgtcggtcgacgagaagctcgacaagcttcgcgccgaggtcgccaaactcagccagatcagcgagaacgagaaggccgggttcatcagcctcgtgtcacgctacctcagtggggaggcggagcagatcgagtggagcaagatccagaccccgaccgatgaggtagtggtgccgtacgataccctcacgtcgcctcctgaagatctcgaggagacgaagaagctgctggacaagctcgttgtgctcaagctcaacggagggctcgggacgaccatgggctgcaccggacccaagtctgtcattgaagtccgcaatgggttcacattccttgaccttattgtgattcaaatcgagtccctgaacaagaagtatggatgtaatgtccctttacttctgatgaactctttcaatacccatgatgacacacagaagatcgttgagaagtattccaactccaacattgaaattcatactttcaatcagagccagtatcctcgcattgttaccgaggacttcttgccacttccaagcaaagggaaatctgggaaggatggctggtatcctccaggccatggtgatgtgttcccctctttgaataacagtggaaaactcgacatcttattggctcagggcaaggagtatgtcttcgttgctaactcagacaacttgggtgctatagtcgacatcaagatcctgaaccatctgatcaataaccagaatgaatactgcatggaggttactccaaaaacattggctgatgttaaaggcggtactctcatctcttacgaaggaagagttcagcttttggagattgcccaagtacctgatgagcatgtgaatgagtttaaatcaatcgagaagtttaagatattcaacactaacaacttgtgggtgaaccttaaagctgtcaagagactagtagaggctgaggcacttaagatggaaattattccaaaccccaaggaagttgatggtgtgaaagtccttcaacttgaaactgcagctggtgcagctattcgtttctttgacaaagcgattggaattaatgttccccgctcaagatttctcccggtgaaggctacatctgatttattgcttgtgcagtctgatctttacaccttggttgatggctttgtcatccgcaatccatccagagcgaatccagctaacccttcgattgagcttggacctgagttcaagaaggttgccaatttccttgctcggttcaagtccatccccagcatcgtcgagcttgacagcttgaaggtttctggtgatgtctggtttggttctggaattacgctcaagggcaaggtgacaatcaccgccaagtctggagtgaagttggaggttccagatggagctgtatttgaaaacaaggatgtcaatggccctgaggatctttaagctatgcttgccgtcaccagtttttcccaaggatttgtcaataggagcagccaacccaaatcactcccactgagctctaccttttgtaattctcgtgccattccgctcccgctgtgagggtcctgtgagcccgctagagaatatgactgtaatcttctttggtgcgtctgcccttctgtttttgtgcgccagggacgtatattttgctgaaatgatactaccatagctttgcgtgccgg

SEQ ID NO: 1618 - protein, 473 aa, Zea mays
  misc_feature (29)..(441): Pfam Name: UDPGP Pfam Description: UTP--glucose-1-phosphate uridylyltransfera
  misc_feature (1)..(473): Ceres Clone ID no. 220954
  misc_feature (1)..(473): Bit score of 1323.5 for HMM based on sequences of Figure 17
  misc_feature (1)..(473): Functional Homolog Of SEQ ID NO. 1599
MAATAVSVDEKLDKLRAEVAKLSQISENEKAGFISLVSRYLSGEAEQIEWSKIQTPTDEVVVPYDTLTSPPEDLEETKKLLDKLVVLKLNGGLGTTMGCTGPKSVIEVRNGFTFLDLIVIQIESLNKKYGCNVPLLLMNSFNTHDDTQKIVEKYSNSNIEIHTFNQSQYPRIVTEDFLPLPSKGKSGKDGWYPPGHGDVFPSLNNSGKLDILLAQGKEYVFVANSDNLGAIVDIKILNHLINNQNEYCMEVTPKTLADVKGGTLISYEGRVQLLEIAQVPDEHVNEFKSIEKFKIFNTNNLWVNLKAVKRLVEAEALKMEIIPNPKEVDGVKVLQLETAAGAAIRFFDKAIGINVPRSRFLPVKATSDLLLVQSDLYTLVDGFVIRNPSRANPANPSIELGPEFKKVANFLARFKSIPSIVELDSLKVSGDVWFGSGITLKGKVTITAKSGVKLEVPDGAVFENKDVNGPEDL

SEQ ID NO: 1619 - protein, 469 aa, Oryza sativa subsp. indica
  misc_feature (26)..(438): Pfam Name: UDPGP Pfam Description: UTP--glucose-1-phosphate uridylyltransfera
  misc_feature (1)..(469): Public GI ID no. 88866516
  misc_feature (1)..(469): Bit score of 1319.8 for HMM based on sequences of Figure 17
  misc_feature (1)..(469): Functional Homolog Of SEQ ID NO. 1599
MAVAADVKLEGLRAATDKLDQISENEKSGFISLVSRYLSGEAEQIEWSKIQTPTDEVVVPYDTLSAAPEDLNETKKLLDKLVVLKLNGGLGTTMGCTGPKSVIEVRNGFTFLDLIVIQIESLNKKYGCNVPLLLMNSFNTHDDTQKIVEKYSNSNIEIHTFNQSQYPRIVTEDFLPLPSKGKTGKDGWYPPGHGDVFPSLNNSGKLDTLLAQGKEYVFVANSDNLGAIVDIKILNHLIHNQNEYCMEVTPKTLADVKGGTLISYEGRVQLLEIAQVPDEHVNEFKSIEKFKIFNTNNLWVNLKAIKRLVEAEALKMEIIPNPKEVDGVKVLQLETAAGAAIRFFEKAIGINVPRSRFLPVKATSDLLLVQSDLYTLVDGFVIRNPARTNPSNPSIELGPEFKKVANFLARFKSIPSIVELDTLKVSGDVWFGSGVTLKGKVTITAKSGKLEIPDGAVLENKDINGPEDL

SEQ ID NO: 1620 - protein, 467 aa, Oryza sativa subsp. japonica
  misc_feature (23)..(435): Pfam Name: UDPGP Pfam Description: UTP--glucose-1-phosphate uridylyltransfera
  misc_feature (1)..(467): Public GI ID no. 115443819
  misc_feature (1)..(467): Bit score of 1250.4 for HMM based on sequences of Figure 17
  misc_feature (1)..(467): Functional Homolog Of SEQ ID NO. 1599
MADEKLAKLREAVAGLSQISDNEKSGFISLVARYLSGEEEHVEWAKIHTPTDEVVVPYDTLAAPPEDLEETKKLLNKLAVLKLNGGLGTTMGCTGPKSVIEVRNGFTFLDLIVIQIESLNKKYGSNVPLLLMNSFNTHEDTLKIVEKYTNSNIEVHTFNQSQYPRVVADEFLPWPSKGKTCKDGWYPPGHGDIFPSLMNSGKLDLLLSQGKEYVFIANSDNLGAIVDMKILNHLIHKQNEYCMEVTPKTLADVKGGTLISYEDKVQLLEIAQVPDAHVNEFKSIEKFKIFNTNNLWVNLKAIKRLVEADALKMEIIPNPKEVDGVKVLQLETAAGAAIRFFDHAIGINVPRSRFLPVKATSDLQLVQSDLYTLVDGFVTRNPARTNPSNPSIELGPEFKKVGCFLGRFKSIPSIVELDTLKVSGDVWFGSSITLKGKVTITAQPGVKLEIPDGAVIENKDINGPEDL

SEQ ID NO: 1621 - protein, 467 aa, Oryza sativa subsp. indica
  misc_feature (23)..(435): Pfam Name: UDPGP Pfam Description: UTP--glucose-1-phosphate uridylyltransfera
  misc_feature (1)..(467): Public GI ID no. 7417426
  misc_feature (1)..(467): Bit score of 1247.1 for HMM based on sequences of Figure 17
  misc_feature (1)..(467): Functional Homolog Of SEQ ID NO. 1599
MADEKLAKLREAVAGLSQISDNEKSGFISLVARYLSGEEEHVEWAKIHTPTDEVVVPYDTLEAPPEDLEETKKLLNKLAVLKLNGGLGTTMGCTGPKSVIEVRNGFTFLDLIVIQIESLNKKYGSNVPLLLMNSFNTHEDTLKIVEKYTNSNIEVHTFNQSQYPRVVADEFLPWPSKGKTCKDGWYPPGHGDIFPSLMNSGKLDLLLSQGKEYVFIANSDNLGAIVDMKILNHLIHKQNEYCMEVTPKTLADVKGGTLISYEDKVQLLEIAQVPDAHVNEFKSIEKFKIFNTNNLWVNLKAIKRLVEADALKMEIIPNPKEVDGVKVLQLETAAGAAIRFFDHAIGINVPRSRFLPVKATSDLQLVQSDLYTLVDGFVTRNPARTNPSNPSIELGPEFKKVGCFLGRFKSIPSIVELDTLKVSGDVWFGSSITLKGKVTITAQPGVKLEIPDGAVIENKDINGPEDL

SEQ ID NO: 1622 - protein, 477 aa, Solanum tuberosum
  misc_feature (32)..(445): Pfam Name: UDPGP Pfam Description: UTP--glucose-1-phosphate uridylyltransfera
  misc_feature (1)..(477): Public GI ID no. 21599
  misc_feature (1)..(477): Bit score of 1296.0 for HMM based on sequences of Figure 17
  misc_feature (1)..(477): Functional Homolog Of SEQ ID NO. 1599
MATAATLSPADAEKLNNLKSAVAGLNQISDNEKSGFINLVGRYLSGEAQHIDWSKIQTPTDEVVVPYDKLAPLSEDPAETKNLLDKLVVLKLNGGLGTTMGCTGPKSVIEVRNGLTFLDLIVKQIEALNAKFGCSVPLLLMNSFNTHDDTLKIVEKYANSNIDIHTFNQSQYPRLVTEDFAPLPCKGNSGKDGWYPPGHGDVFPSLMNSGKLDALLAKGKEYVFVANSDNLGAIVDLKILNHLILNKNEYCMEVTPKTLADVKGGTLISYEGKVQLLEIAQVPDEHVNEFKSIEKFKIFNTNNLWVNLSAIKRLVEADALKMEIIPNPKEVDGVKVLQLETAAGAAIKFFDRAIGANVPRSRFLPVKATSDLLLVQSDLYTLTDEGYVIRNPARSNPSNPSIELGPEFKKVANFLGRFKSIPSIIDLDSLKVTGDVWFGSGVTLEGKVTIAAKSGVKLEIPDGAVIANKDINGPEDI

SEQ ID NO: 1623 - protein, 470 aa, Populus tremula x Populus tremuloides
  misc_feature (25)..(438): Pfam Name: UDPGP Pfam Description: UTP--glucose-1-phosphate uridylyltransfera
  misc_feature (1)..(470): Public GI ID no. 32527831
  misc_feature (1)..(470): Bit score of 1284.2 for HMM based on sequences of Figure 17
  misc_feature (1)..(470): Functional Homolog Of SEQ ID NO. 1599
MATDTEKISQLKSAVANLNQISESEKTGFVNLVSRYLSGEAQQVEWSKIQTPTDEVVVPYDTLESTPEDPEETKMLLDKLVVLKLNGGLGTTMGCTGPKSVIEVRNGLTFLDLIVIQIESLNKKYGCSVPLLLMNSFNTHDDTQKIIEKYSNSNIEIHTFNQSQYPRLVADDFVPLPSKGHTDKDGWYPPGHGDVFPSLKNSGKLDALLSQGKEYVFVANSDNLGAVVDLKILNHLIRNKNEYCMEVTPKTLADVKGGTLISYEGKVQLLEIAQVPDQHVNEFKSIEKFKIFNTNNLWVNLKAIKRLVEADALKMEIIPNPKEVDGVKVLQLETAAGAAIRFFDHAIGINVPRSRFLPVKASSDLLLVQSDIYTPVVDGFVIRNPGRANPANPSIELGPEFKKVASFLSRFKSIPSIIELDSLKVAGDVWFGVNVTLKGKVSIVVKSGVKLEIPEGVVLENKEINGPKDL

SEQ ID NO: 1624 - protein, 477 aa, Solanum tuberosum
  misc_feature (32)..(445): Pfam Name: UDPGP Pfam Description: UTP--glucose-1-phosphate uridylyltransfera
  misc_feature (1)..(477): Public GI ID no. 28863909
  misc_feature (1)..(477): Bit score of 1290.3 for HMM based on sequences of Figure 17
  misc_feature (1)..(477): Functional Homolog Of SEQ ID NO. 1599
MATATTLSPADAEKLNNLKSAVAGLNQISENEKSGFINLVGRYLSGEAQHIDWSKIQTPTDEVVVPYDKLAPLSEDPAETKKLLDKLVVLKLNGGLGTTMGCTGPKSVIEVRNGLTFLDLIVKQIEALDAKFGCSVPLLLMNSFNTRDDTLRIVEKYANSNIDIHTFNQSQYPRLVTEDFAPLPCKGNSGKDGWYPPGHGDVFPSLMNSGKLDALLAKGKEYVFVANSDNLGAIVDLKILNHLILNKNEYCMEVTPKTLADVKGGTLISYEGRVQLLEIAQVPDEHVNEFKSIEKFKIFNTNNLWVNLSAIKRLVEADALKMEIIPNPKEVDGVKVLQLETAAGAAIKFFDRAIGANVPRSRFLPVNATSDLLLVQSDLYTLTDEGYVIRNPARSNPSNPSIELGPEFKKVANFLGRFKSIPSIIDLDSLKVTGDVWFGSGVTLKGKVTVAAKSGVKLEIPDGAVIANKDINGPEDI

SEQ ID NO: 1625 - protein, 471 aa, Amorpha fruticosa
  misc_feature (27)..(439): Pfam Name: UDPGP Pfam Description: UTP--glucose-1-phosphate uridylyltransfera
  misc_feature (1)..(471): Public GI ID no. 17026394
  misc_feature (1)..(471): Bit score of 1275.5 for HMM based on sequences of Figure 17
  misc_feature (1)..(471): Functional Homolog Of SEQ ID NO. 1599
MAATATDNKLSNLKSAVAGLNQISENEKKGFINLVSRYLSGEAQHVEWSKIQTPTDEVVVPYESLAPTPDGSSEVKSLLDKLVVLKLNGGLGTTMGCTGPKSVIEVRDGLTFLDLIVIQIENLNSKYGSNVPLLLMNSFNTHDDTQKIIEKYKNSNIQIHTFNQSQYPRLVVDDFLPLPSKGHTGKDGWYPPGHGDVFPSLSNSGKLDALLSQGKEYVFVANSDNLGAIVDLKILNHLVKNKNEYCMEVTPKTLADVKGGTLISYEGRVQLLEIAQVPDEHVSEFKSIEKFKIFNTNNLWVNLKAIKRLVEADALKTEIIPNPKEVDGVKVLQLETAAGAAIRFFDKAIGINVPRSRFLPVKATSDLLLVQSDLYTLEDGFVIRNKARANPENPTVELGPEFKKVSNFLSRFKSIPSIVELDSLKVAGDVWFGPGIILKGKVSIVAKPGVKLEIPDGAVIANKEINGPEDL

SEQ ID NO: 1626 - protein, 476 aa, Cucumis melo
  misc_feature (32)..(444): Pfam Name: UDPGP Pfam Description: UTP--glucose-1-phosphate uridylyltransfera
  misc_feature (1)..(476): Public GI ID no. 90820120
  misc_feature (1)..(476): Bit score of 1265.0 for HMM based on sequences of Figure 17
  misc_feature (1)..(476): Functional Homolog Of SEQ ID NO. 1599
MASAATLSPADTEKLSKLKASVSGLTQISENEKSGFINLVSRYLSGEAQHVEWSKIQTPTDEVVVPYDSLAPVPNDPAETKKLLDKLVVLKLNGGLGTTMGCTGPKSVIEVRNGLTFLDLIVIQIENLNSKYGCNVPLLLMNSFNTHDDTQKIIEKYKGSNVDIHTFNQSQYPRLVAEDYLPLPSKGRTDKDGWYPPGHGDVFPSLKNSGKLDALIAQGKEYVFVANSDNLGAVVDLQILNHLIQNKNEYCMEVTPKTLADVKGGTLISYEGKVQLLEIAQVPDEHVNEFKSIQKFKIFNTNNLWVNLKAIKRLVEANALKMEIIPNPKEVDGIKVLQLETAAGAAIRFFDHAIGINVPRSRFLPVKATSDLLLVQSDLYTLVDGFVLRNKARKDPSNPSIELGPEFKKVGNFLSRFKSIPSIIELDSLKVVGDVSFGAGVVLKGKVTISAKPGTKLAVPDNAVIANKEINGPEDF

SEQ ID NO: 1627 - DNA, 1901 bp, Glycine max
  misc_feature (1)..(1901): Ceres Clone ID no. 577563
  misc_feature (1)..(1901): Encodes the peptide sequence at SEQ ID NO. 1628
gttccttcgtattcatcgggtttgagattcacgctcttttttattactctggcctaacggaaaagcctccacatctacatatataaatactaccaaaaattcagttgcacactctgctatttccaccaccataacctcgctctcttcaccctcttcttcttcttcttcttcttcactttgtaactttcgaatcttcttccttccaccgcaatggccaccgccacgcttagccccgccgacgccgacaagctctccaacctcaaatcctccgtcgctgcattgagccaaatcagtgagaatgagaagaatggattcacaagcctcgttgctcgttacctcagtggcgaagcacagcatgttgagtggagtaagatcgagacgcctacggatgaagtagtggtgccttatgactctttggcaccgactcctgacggttctttggaggtgaagaacctcttggacaagcttgtggtgttgaagctcaatggaggcttggggacaactatgggttgtactggcccaaaatctgtcattgaagttcgtgatgggttgacatttcttgatttaattgtcgtccaaattgagaacctcaattccaaatacggaagcaatgttccgttgcttttaatgaactcattcaacactcatgatgacactcaaaagattgttgagaaatataaaaactcaaatattgagattcatacgtttaaccagagtcaatatcctcgtttggttgttgatgactttttgccattcccatccaaggggcagacaggcagggacgggtggtaccctcctggccacggagacgtcttcccatcattagtgaatagtggaaagcttgatgtgctattatcacagggtaaggagtatgtgtttgttgccaattcagacaacctgggtgctgtagttgacttgaaaatcttaaatcatttgattgagcacaagaatgaatactgtatggaggtcactcccaagacattggctgacgtgaaaggtggcactctgatttcttatgaaggaagggttcagctcctggaaattgcccaagtaccagatgaacatgtcagtgaatttaagtctatagagaaattcaaaattttcaacacaaataatttgtgggtaaacttgaaagcaattaaaaggcttgttgaagctgatgctctgaagatggaaattattcccaatccaaaggaagtcgatggagtaaaagttcttcaattggaaactgcagctggtgcagcaataaggttctttgacaaagctattggaattaatgtgcctcgatctcgcttccttcccgtgaaggcaacttcagacttgcttcttgtccagtcggacctttacactttacaagatggattggttattaggaaccaagctagggcaaatcctgaaaatccttccattgaattggggccagaatttaagaaggttagcaatttcttgagccggttcaagtcaatccccagtattgttgagcttgacagtctaaaagtggcaggcgatgtatggtttggagctggtgtaatccttaagggaaaagcaagtattcttgcaaaaccgggtgtgaagctggaaatacctgacggagctgtgatcgcagacaaggaaattaatggccctgaggacctgtgagagaaagctgatgatgagttttgaaatccatgtgactgtgcaatctttgagtattgacagtcttaaactaaaatttgtgtattgcttctagtttggtaggggtaaaaataagaaggcagtttctactgagcatgtytgaagactaagctttgtatttctcataattttgtttttaaacatttcttacaaggactcaaggaggatccgatcatgtttcctttccatatcatattaagcgtttacgccttcatcttttgttgagg

SEQ ID NO: 1628 - protein, 475 aa, Glycine max
  misc_feature (31)..(443): Pfam Name: UDPGP Pfam Description: UTP--glucose-1-phosphate uridylyltransfera
  misc_feature (1)..(475): Ceres Clone ID no. 577563
  misc_feature (1)..(475): Bit score of 1257.7 for HMM based on sequences of Figure 17
  misc_feature (1)..(475): Functional Homolog Of SEQ ID NO. 1599
MATATLSPADADKLSNLKSSVAALSQISENEKNGFTSLVARYLSGEAQHVEWSKIETPTDEVVVPYDSLAPTPDGSLEVKNLLDKLVVLKLNGGLGTTMGCTGPKSVIEVRDGLTFLDLIVVQIENLNSKYGSNVPLLLMNSFNTHDDTQKIVEKYKNSNIEIHTFNQSQYPRLVVDDFLPFPSKGQTGRDGWYPPGHGDVFPSLVNSGKLDVLLSQGKEYVFVANSDNLGAVVDLKILNHLIEHKNEYCMEVTPKTLADVKGGTLISYEGRVQLLEIAQVPDEHVSEFKSIEKFKIFNTNNLWVNLKAIKRLVEADALKMEIIPNPKEVDGVKVLQLETAAGAAIRFFDKAIGINVPRSRFLPVKATSDLLLVQSDLYTLQDGLVIRNQARANPENPSIELGPEFKKVSNFLSRFKSIPSIVELDSLKVAGDVWFGAGVILKGKASILAKPGVKLEIPDGAVIADKEINGPEDL

SEQ ID NO: 1629 - protein, 471 aa, Pyrus pyrifolia
  misc_feature (26)..(439): Pfam Name: UDPGP Pfam Description: UTP--glucose-1-phosphate uridylyltransfera
  misc_feature (1)..(471): Public GI ID no. 6136112
  misc_feature (1)..(471): Bit score of 1252.7 for HMM based on sequences of Figure 17
  misc_feature (1)..(471): Functional Homolog Of SEQ ID NO. 1599
MAAVATGNVDKLKSDVASLSQISENEKNGFINLVSRYVSGEEAQHVEWSKIQTPTDEVVVPYDGLAPTPEDPEEIKKLLDKLVVLKLNGGLGTTMGCTGPKSVIEVRNGLTFLDLIVIQIENLNNKYGSCVPLLLMNSFNTHDDTQKIVEKYSKSNVQIHTFNQSQYPRLVVEDFSPLPSKGQTGKDGWYPPGHGDVFPSLKNSGKLDLLLSQGKEYVFIANSDNLGAVVDLKILHHLIQKKNEYCMEVTPKTLADVKGGTLISYEGRVQLLEIAQVPDQHVNEFKSIEKFKIFNTNNLWVNLNAIKRLVEADALKMEIIPNPKEVDGVKVLQLETAAGAAIRFFNHAIGINVPRSRFLPVKATSDLLLVQSDLYTLQDGFVTRNSARKNPENPTIELGPEFKKVGSYLSRFKSIPSILELESLKVSGDVWFGAGVVLKGKVTITAKSGVKLEIPDNAVIANKDINGPEDL

SEQ ID NO: 1630 - DNA, 1812 bp, Glycine max
  misc_feature (1)..(1812): Ceres Clone ID no. 713920
  misc_feature (1)..(1812): Encodes the peptide sequence at SEQ ID NO. 1631
gtccagaactaactacactggccttttgttctcgtgtcaatttctaaatccaccaccacaccctctcttctattctctattattattatctccacacccttcactctctctcactcttctctcgaatcttccaccgcaatggccaccgctgccgagaaactctccgctctcaaatccgccgtcgccggattgaacgaaatcagtgagaatgagaagaacggattcatcagcctcgtcggccgctatctcagtggcgaagcgcagcatgtggaatggagcaagatccagacgcctacggacgaagtggttgtgccttacgacactttggcgccaactcctgaaggttcttcggaggtgaagaatctattggacaagcttgtggtgttgaagctaaatggaggcttgggaacaactatgggttgcactggtcctaaatctgtaattgaagttcgtgatgggttgacatttctagatttaattgtcatccaaattgagaatctcaattccaaatatggaagcaatgttcctttgcttttgatgaattcattcaacactcatgatgacactcaaaagattgttgaaaaataccaaaactcaaatattgagattcatacttttaaccagagccagtatcctcgattggttgttgaggactttttgccattgccttccaaagggcatactgacaaggatggatggtaccctcctggccatggtgatgtcttcccatcattattgaacagtggcaaacttgatgcactattgtcacagggtaaagagtatgtgtttgttgccaattcggataacttgggagctatagttgacttgaaaatcttgaatcatttgatccagaacaagaatgaatactgtatggaggtgactcccaaaacattggctgatgtaaagggtggcactttgatttcttacgaaggaagggttcagctcctggaaattgcacaagtccccgatgaacatgtcaatgagttcaagtcaatagagaagttcaaaattttcaacacaaataatttgtgggtgaacttaaacgcagttaaaaggcttgttgaagctgatgctcttaagatggaaattattcccaatccaaaggaagttgacggaataaaagttcttcagctggaaactgcagctggtgctgcaataaggttctttgacaaggctattgggattaatgttcctcgatcacgattccttcctgtgaaggcaacttcagatttgcttcttgtccagtctgacctctacactttggaagacggatttgtcattcggaacaaagctagggaaaatcctgaaaacccttctattgaactgggaccagaatttaagaaggttagcaacttcttgggccgcttcaagtcaattcctagtatcgttgagcttgacagtctaaaagtggctggtgatgtatggtttggagctggtgttatcctcaaggggaaagtcagcattgtatcaaagcccggtgtaaagctggaagttcccgacggtgttgccattgtagacaaggaaattaatggcccagaggacctgtgaggaagacagatgactttaactaaagaatgaattgtatcagaccgtatcttatctatctatatggtctagtgtttttactactcccatgtttgataggtaaagaaaataagaagtctttttgttgagaggatgtcttggtgtggatctttactccattgtcttggaattctgtttagaacagcaaaaaaatgacaagtttggtgataagtttcatgtcatttggtacaatagcattgtgtccccctgtcgaacaaatcaaggcct

SEQ ID NO: 1631 - protein, 469 aa, Glycine max
  misc_feature (25)..(437): Pfam Name: UDPGP Pfam Description: UTP--glucose-1-phosphate uridylyltransfera
  misc_feature (1)..(469): Ceres Clone ID no. 713920
  misc_feature (1)..(469): Bit score of 1278.6 for HMM based on sequences of Figure 17
  misc_feature (1)..(469): Functional Homolog Of SEQ ID NO. 1599
MATAAEKLSALKSAVAGLNEISENEKNGFISLVGRYLSGEAQHVEWSKIQTPTDEVVVPYDTLAPTPEGSSEVKNLLDKLVVLKLNGGLGTTMGCTGPKSVIEVRDGLTFLDLIVIQIENLNSKYGSNVPLLLMNSFNTHDDTQKIVEKYQNSNIEIHTFNQSQYPRLVVEDFLPLPSKGHTDKDGWYPPGHGDVFPSLLNSGKLDALLSQGKEYVFVANSDNLGAIVDLKILNHLIQNKNEYCMEVTPKTLADVKGGTLISYEGRVQLLEIAQVPDEHVNEFKSIEKFKIFNTNNLWVNLNAVKRLVEADALKMEIIPNPKEVDGIKVLQLETAAGAAIRFFDKAIGINVPRSRFLPVKATSDLLLVQSDLYTLEDGFVIRNKARENPENPSIELGPEFKKVSNFLGRFKSIPSIVELDSLKVAGDVWFGAGVILKGKVSIVSKPGVKLEVPDGVAIVDKEINGPEDL

SEQ ID NO: 1632 - DNA, 1746 bp, Gossypium hirsutum
  misc_feature (1)..(1746): Ceres Clone ID no. 1926174
  misc_feature (1)..(1746): Encodes the peptide sequence at SEQ ID NO. 1633
acacacacacacacacacacacacacacacacacacacacacatccttcacgctccacactctatacacttagcacccttgtttttgtcattgttcttcgttactgttgtttccaatggagaaactcgatcatatcaaatctcaccttgctgcactttctcaaatcggtgaaaatgagaaaaacggattcatcaacctcgtctctcgctatctcagtggagaagcacaacacattgaatggagtaagatccaaacaccaactgatgaagtggttgtgccttatgataccttggctccgctttccgacgatcctgctgaaactaagaagctattggacaaacttgttgttttaaagcttaatggaggcctggggacaactatgggatgtactggtcctaaatctgtcattgaagttcgcaatggcttcacatttcttgacctaattgttcagcagattgagaatcttaataagaaatatggatgtaacgttccattggttctgatgaactcatttaacacccatgatgacacattgaagattgttgacaagtatgccaattcaaacattcaaattcatacatttaatcagagccaatatcctcgtctggtggctgaagattttactccatttccttgcaaaggccagcctggcaaggatggatggtatcctcctggtcatggtgatgtgttcccagctctaatgaacagtggcaagcttgctactttcttatcacaggacaaggagtatgcatttgttgccaactcagacaacttgggtgctattgttgacttgaaaatattgaaccatttggtcaaaaacaagaatgaatactgtatggaggttacacccaaaaccttagctgatgtgaagggtggtactcttatttcttatgaaggaaaagttcagctccttgaaattgcacaagtccctgatgcacatgtcaatgaattcaagtctatagagaaatttaaaattttcaatacaaacaatttgtggctgaacctaaatgcagtaaagaggcttgtggaagctgatgcactcaagatggagataattccaaacccaaaggaggtcgagggaaccaaagttcttcaactggaaactgcagctggtgcagcaattaggttctttgagcatgctattggtatcaacgtacctcgatcgcgattccttccagtgaaggcaacttcagatttgcttcttgtccagtctgatctttacaccttagttgatggctttgttagccggaatagtgctagagaaaatcctgaaaacccatccattgaattggggcctgaattcaagaaggttagcaacttcttaagtcggttcaagacaatcccaagcatcattaatctcgatagccttaccgtgactggtgatgtttggtttggtgctggtattgttctcaagggaaaagtgaaaattgctgcaaaaccaggagaaaagttggagattccggacggaattgtaatcgaaaacaaggaaatcaatggccccggagacttatccagctaaaggttcaatggttaagatttgacatatctgatttttggtccatttttagatcggaaaataaaagcatgttacgttgtaggatctgctttgtggtcttgcggaagtcaaacttgagtcattgagtatatttatatataaaaaaatttgatattattgaaaaacattaattttgatattgtgtactttctgaattagtaaataatttctccgtggttctaatgatgcct

SEQ ID NO: 1633 - protein, 467 aa, Gossypium hirsutum
  misc_feature (21)..(433): Pfam Name: UDPGP Pfam Description: UTP--glucose-1-phosphate uridylyltransfera
  misc_feature (1)..(467): Ceres Clone ID no. 1926174
  misc_feature (1)..(467): Bit score of 1239.3 for HMM based on sequences of Figure 17
  misc_feature (1)..(467): Functional Homolog Of SEQ ID NO. 1599
MEKLDHIKSHLAALSQIGENEKNGFINLVSRYLSGEAQHIEWSKIQTPTDEVVVPYDTLAPLSDDPAETKKLLDKLVVLKLNGGLGTTMGCTGPKSVIEVRNGFTFLDLIVQQIENLNKKYGCNVPLVLMNSFNTHDDTLKIVDKYANSNIQIHTFNQSQYPRLVAEDFTPFPCKGQPGKDGWYPPGHGDVFPALMNSGKLATFLSQDKEYAFVANSDNLGAIVDLKILNHLVKNKNEYCMEVTPKTLADVKGGTLISYEGKVQLLEIAQVPDAHVNEFKSIEKFKIFNTNNLWLNLNAVKRLVEADALKMEIIPNPKEVEGTKVLQLETAAGAAIRFFEHAIGINVPRSRFLPVKATSDLLLVQSDLYTLVDGFVSRNSARENPENPSIELGPEFKKVSNFLSRFKTIPSIINLDSLTVTGDVWFGAGIVLKGKVKIAAKPGEKLEIPDGIVIENKEINGPGDLSS

SEQ ID NO: 1634 - protein, 471 aa, Astragalus membranaceus
  misc_feature (27)..(439): Pfam Name: UDPGP Pfam Description: UTP--glucose-1-phosphate uridylyltransfera
  misc_feature (1)..(471): Public GI ID no. 12585472
  misc_feature (1)..(471): Bit score of 1249.6 for HMM based on sequences of Figure 17
  misc_feature (1)..(471): Functional Homolog Of SEQ ID NO. 1599
MATATATDRLSNLKSSVAGLNQISENEKSGFINLVARYLSGEAQHVEWSKIQTPTDEVVVPYDTLAPTPDGSLEIKNLLDKLVVLKLNGGLGTTMGCTGPKSVIEVRDGLTFLDLIVIQIENLNSKYGSNVPLLLMNSFNTHDDTQTIVEKYQNSNIEIHTFNQSQYPRLVVDDFLPLPSKGRTDKDGWYPPGHGSMFPSLSNSGKLDALISQGKEYVFVANSDNLGAIVDLKILNHLVAHKNEYCMEVTPKTLADVKGGTLISYEGRVQLLEIAQVPDEHVGEFKSIEKFKIFNTNNLWVNLKAIKRLVEADALKMEIIPNPKEVDGVKVLQLETAAGAAIRFFDKAIGINVPRSRFLPVKATSDLLLVQSDLYTVENGSVIRNKARTNPENPSIELGPEFKKVSNFLGRFKSIPSIVELDSLKVVGDVWFGTGVILKGKVSIVAKSGVKVEIPDGAVIANKEINGPKDL

SEQ ID NO: 1635 - DNA, 1404 bp, Populus balsamifera subsp. trichocarpa
  misc_feature (1)..(1404): Ceres Annot ID no. 1487348
  misc_feature (1)..(1404): Encodes the peptide sequence at SEQ ID NO. 1636
atggctactgatacggccaagatctctcagctcaaatcagctgttgctaatctcaatcaaatcagcgagagtgagaaaactggattcgtcaacctcgtttctcgctatctcagtggggaagcgcagcaagttgagtggagtaagattcagacacctactgatgaagtagtggttccttatgataccttggcgccaactccggaggatccggaggaaacaaagaagcttttggacaagcttgtcgttttgaagcttaatggaggtttggggactacaatgggatgcactggtcctaagtctgtcattgaagttcgtaatggattgacatttcttgaccttattgtcatccagatcgagaatcttaataagaaatatgggtgcagtgttcccttgcttctaatgaactcattcaacactcatgatgatacacagaagattgttgagaagtactcgaactcaaatattgagattcacacttttaatcagagccaataccctcgtctggttgttgatgattttgttccattgccttccaaaggacatactgacaaggacggatggtatcctcctggacatggtgatgtgttcccatccctaaagaacagtggcaaacttgatgctttattgtcgaagggtaaagagtatgtgtttgtcgccaactcagacaacctcggcgctgttgttgatttgagtatcctgattttggttcccattgtaacctttgacttcagggtgacacccaaaaccctggctgatgtgaagggtggtactctcatctcttatgatgggaaggttcagctcctggaaattgctcaggtccctgatcagcatgttaatgagttcaagtcaatcgagaagttcaaaattttcaatacaaacaacttgtgggtgaacttgaaagcaattaaaaggcttgtggaagcagatgcacttgagatggagatcattccaaacccaaaggaagtagatggagtcaaagtacttcagctagaaactgcagctggagcagcaattaagtttttcgatcatgcaattggtataaatgtacctcgttctcgattccttccagtgaaggcaacttcagatctgcttcttgttcagtctgatctttacactttagttgatggttttgtcatccgaaatccagctcgaacaattcctgcaaatccttctattgatctgggaccagagtataagaaggttgccaacttcttgagccgatttaaatcgatccctagcattattgagcttgatagtctaaaggtggtcggtgatgtatggtttggtgctggtattactctcaaggggaaagtgagtatcgtggcaaaatctggtgtgaaattggaaataccagatggagctgttcttcaaaacaaggaaatcaatggcccggaggacctctaa

SEQ ID NO: 1636 - protein, 467 aa, Populus balsamifera subsp. trichocarpa
  misc_feature (25)..(435): Pfam Name: UDPGP Pfam Description: UTP--glucose-1-phosphate uridylyltransfera
  misc_feature (1)..(467): Ceres Annot ID no. 1487348
  misc_feature (1)..(467): Bit score of 1252.9 for HMM based on sequences of Figure 17
  misc_feature (1)..(467): Functional Homolog Of SEQ ID NO. 1599
MATDTAKISQLKSAVANLNQISESEKTGFVNLVSRYLSGEAQQVEWSKIQTPTDEVVVPYDTLAPTPEDPEETKKLLDKLVVLKLNGGLGTTMGCTGPKSVIEVRNGLTFLDLIVIQIENLNKKYGCSVPLLLMNSFNTHDDTQKIVEKYSNSNIEIHTFNQSQYPRLVVDDFVPLPSKGHTDKDGWYPPGHGDVFPSLKNSGKLDALLSKGKEYVFVANSDNLGAVVDLSILILVPIVTFDFRVTPKTLADVKGGTLISYDGKVQLLEIAQVPDQHVNEFKSIEKFKIFNTNNLWVNLKAIKRLVEADALEMEIIPNPKEVDGVKVLQLETAAGAAIKFFDHAIGINVPRSRFLPVKATSDLLLVQSDLYTLVDGFVIRNPARTIPANPSIDLGPEYKKVANFLSRFKSIPSIIELDSLKVVGDVWFGAGITLKGKVSIVAKSGVKLEIPDGAVLQNKEINGPEDL

SEQ ID NO: 1637 - protein, 469 aa, Arabidopsis thaliana
  misc_feature (25)..(437): Pfam Name: UDPGP Pfam Description: UTP--glucose-1-phosphate uridylyltransfera
  misc_feature (1)..(469): Public GI ID no. 15228498
  misc_feature (1)..(469): Bit score of 1243.8 for HMM based on sequences of Figure 17
  misc_feature (1)..(469): Functional Homolog Of SEQ ID NO. 1599
MAATTENLPQLKSAVDGLTEMSESEKSGFISLVSRYLSGEAQHIEWSKIQTPTDEIVVPYEKMTPVSQDVAETKNLLDKLVVLKLNGGLGTTMGCTGPKSVIEVRDGLTFLDLIVIQIENLNNKYGCKVPLVLMNSFNTHDDTHKIVEKYTNSNVDIHTFNQSKYPRVVADEFVPWPSKGKTDKEGWYPPGHGDVFPALMNSGKLDTFLSQGKEYVFVANSDNLGAIVDLTILKHLIQNKNEYCMEVTPKTLADVKGGTLISYEGKVQLLEIAQVPDEHVNEFKSIEKFKIFNTNNLWVNLKAIKKLVEADALKMEIIPNPKEVDGVKVLQLETAAGAAIRFFDNAIGVNVPRSRFLPVKASSDLLLVQSDLYTLVDGFVTRNKARTNPSNPSIELGPEFKKVATFLSRFKSIPSIVELDSLKVSGDVWFGSSIVLKGKVTVAAKSGVKLEIPDRAVVENKNINGPEDL

SEQ ID NO: 1638 - DNA, 1756 bp, Arabidopsis thaliana
  misc_feature (1)..(1756): Ceres Clone ID no. 256780
  misc_feature (1)..(1756): Encodes the peptide sequence at SEQ ID NO. 1639
gctctgattcattcacaaataacaatcctctcttcgtttttgtttttcttttggatccaaagctctcttaaatctgtaaatcaacaatggccgccaccactgagaatctccctcaactcaaatccgccgtcgatggccttactgagatgagtgagagtgagaagagcggattcatcagcctggtttcacgttacctgagcggtgaggcacaacacattgagtggagtaagatccagactcctaccgatgaaatcgttgttccctacgagaaaatgacccctgtctcccaagatgttgccgagaccaagaatctgttggacaaacttgttgtgttgaagcttaatggaggtcttggaacaacaatgggatgcactggcccgaagtccgttatcgaagttcgtgatggtttgacatttcttgatctgattgttatccagattgagaatctcaacaacaagtatggctgcaaggttccgttagttctcatgaactcgtttaatacacatgatgacagacataagattgtggaaaagtacaccaactcaaatgttgacattcacacttttaaccagagcaaatatccccgtgttgtggcagatgagtttgtgccatggcccagcaagggaaagaccgacaaggagggctggtatcctcccggtcatggtgatgtattcccagccctcatgaacagtggaaagctcgatactttcttatcacagggtaaggaatatgtgtttgttgccaattcagacaacttgggtgccatcgttgacttaacaatcctgaagcatttgatccagaacaagaacgaatactgcatggaggttacacccaaaaccttagctgatgtaaaggggggaactctcatttcttatgaaggcaaagtccagcttctggagattgctcagtttcctgatgaacatgtcaatgagttcaaatcaattgagaagttcaagatattcaacacaaacaacctatgggttaacttgaaggccatcaaaaagcttgtggaagctgatgcacttaaaatggagatcattccaaacccaaaggaagttgatggagtcaaagttcttcaactggaaactgcagccggtgctgcgataaggttctttgacaacgctatcggtgttaatgtacctcgctcacggttcttgccagtgaaggcaagttcagacttgctgctcgtccagtctgatctctacaccttagttgatggctttgtcactcgaaacaaagctagaactaacccctcgaacccgtcaattgaattgggacccgagttcaagaaggtggctactttcttgagccggtttaagtccattcctagtatagtcgagctcgacagccttaaggtgtctggtgatgtctggtttggctcttccattgttctcaagggcaaggtgactgtggcggcaaaatccggtgtgaagcttgaaattccggacagggccgtggtcgagaacaagaacatcaatggtccagaagacctctgaataaaacaaattcaagtcttcttccctctctcatggaagacacatcttgatactcctttaattggtgtgaaaagatcacaagtggcacagcaaagcaagtttatgaagaaagaataaataatgtttctttttctttttgcagcttagcaaagtcttttcctctttggactttattttaattttgctctttgaattttcccaaaacatcacatttatatgttcgattatatttgggttctatccacaatcatttttctttt

SEQ ID NO: 1639 - protein, 469 aa, Arabidopsis thaliana
  misc_feature (25)..(437): Pfam Name: UDPGP Pfam Description: UTP--glucose-1-phosphate uridylyltransfera
  misc_feature (1)..(469): Ceres Clone ID no. 256780
  misc_feature (1)..(469): Bit score of 1236.4 for HMM based on sequences of Figure 17
  misc_feature (1)..(469): Functional Homolog Of SEQ ID NO. 1599
MAATTENLPQLKSAVDGLTEMSESEKSGFISLVSRYLSGEAQHIEWSKIQTPTDEIVVPYEKMTPVSQDVAETKNLLDKLVVLKLNGGLGTTMGCTGPKSVIEVRDGLTFLDLIVIQIENLNNKYGCKVPLVLMNSFNTHDDRHKIVEKYTNSNVDIHTFNQSKYPRVVADEFVPWPSKGKTDKEGWYPPGHGDVFPALMNSGKLDTFLSQGKEYVFVANSDNLGAIVDLTILKHLIQNKNEYCMEVTPKTLADVKGGTLISYEGKVQLLEIAQFPDEHVNEFKSIEKFKIFNTNNLWVNLKAIKKLVEADALKMEIIPNPKEVDGVKVLQLETAAGAAIRFFDNAIGVNVPRSRFLPVKASSDLLLVQSDLYTLVDGFVTRNKARTNPSNPSIELGPEFKKVATFLSRFKSIPSIVELDSLKVSGDVWFGSSIVLKGKVTVAAKSGVKLEIPDRAVVENKNINGPEDL

SEQ ID NO: 1640 - protein, 469 aa, Arabidopsis thaliana
  misc_feature (25)..(437): Pfam Name: UDPGP Pfam Description: UTP--glucose-1-phosphate uridylyltransfera
  misc_feature (1)..(469): Public GI ID no. 13605559
  misc_feature (1)..(469): Bit score of 1236.2 for HMM based on sequences of Figure 17
  misc_feature (1)..(469): Functional Homolog Of SEQ ID NO. 1599
MAATTENLPQLKSAVDGLTEMSESEKSGFISLVSRYLSGEAQHIEWSKIQTPTDEIVVPYEKMTPVSQDVAETKNLLDKLVVLKLNGGLGTTMGCTGPKSVIEVRDGLTFLDLIVIQIENLNNKYGCKVPLVLMNSFNTHDDTHKIVEKYTNSNVDIHTFNQSKYPRVVADEFVPWPSKGKTDKEGRYPPGHGDVFPALMNSGKLDTFLSQGKEYVFVANSDNLGAIVDLTILKHLIQNKNEYCMEVTPKTLADVKGGTLISYEGKVQLLEIAQVPDEHVNEFKSIEKFKIFNTNNLWVNLKAIKKLVEADALKMEIIPNPKEVDGVKVLQLETAAGAAIRFFDNAIGVNVPRSRFLPVKASSDLLLVQSDLYTLVDGFVTRNKARTNPSNPSIELGPEFKKVATFLSRFKSIPSIVELDSLKVSGDVWFGSSIVLKGKVTVAAKSGVKLEIPDRAVVENKNINGPEDL

SEQ ID NO: 1641 - protein, 471 aa, Solanum tuberosum
  misc_feature (32)..(439): Pfam Name: UDPGP Pfam Description: UTP--glucose-1-phosphate uridylyltransfera
  misc_feature (1)..(471): Public GI ID no. 76160958
  misc_feature (1)..(471): Bit score of 1216.5 for HMM based on sequences of Figure 17
  misc_feature (1)..(471): Functional Homolog Of SEQ ID NO. 1599
  misc_feature (155)..(155): Xaa is any aa, unknown, or other
MATATTLSLADAEKLNNLKSAVAGLNQISVNEKAGFINLVGRYLSGEAQHIDWSKIQTPTDEVVVPYDKLAPLSEDPAETKKLLDKLVVLKLNGGLGTTMGCTGPKSVIEVRNGLTFLDLIVKQIEALNAKFGCSVPLLLMNSFNTHDDTLKIVXKYVNSNIDIHTFNQSQYPRLVTEDFAPLPCKGNSGKDGWYPPGHGDVFPSLMNSGKLDALLATGKGICLCCKLRYLEILNHLILNKNEYCMEVTPKTLADVKGGTLISYEGKVQLLEIAQVPDEHVNEFKSIEKFKIFNTNNLWVNLSAIKRLVEADALKMEIIPNPKEVDGVKVLQLETAAGAAIKFFDRAIGANVPRSRFLPVKATSDLLLVQSDLYTLTDEGYVIRNPARSNPSNPSIELGPEFKKVANFLGRFKSIPSIIDLDSLKVTGDVWFGSGVTLKGKVTVAAKSGVKLEIPDGAVIANKDINGPEDI

SEQ ID NO: 1642 - protein, 480 aa, Pinus taeda
  misc_feature (34)..(446): Pfam Name: UDPGP Pfam Description: UTP--glucose-1-phosphate uridylyltransfera
  misc_feature (1)..(480): Public GI ID no. 148887793
  misc_feature (1)..(480): Bit score of 1183.9 for HMM based on sequences of Figure 17
  misc_feature (1)..(480): Functional Homolog Of SEQ ID NO. 1599
MAAAPAVAPPAAETDRIPKLQAEVTKLNQISDNEKEGFVRLVSRYLSGEEEKIEWEKIKTPTDEIVVPYDTLAALGEDPSETKELLDKLVVLKLNGGLGTTMGCTGPKSVIEVRNGLTFLDLIVKQIESLNNKYDSKVPLVLMNSFNTHDDTIKIVEKYSGSNIDIHIFNQSQYPRMVAEDLTPWPTKGRTDKEAWYPPGHGDVFPALLNSGKLDELLSQGKEYVFIANSDNLGAIVDLKILNHLVKNKNEYCMEVTPKTLADVKGGTLISYEGRVQLLEIAQVPEEHVGEFKSIEKFKIFNTNNLWVNLKAIKRLVEADALKMEIIPNPKEVDGVKVLQLETAAGAAIRFFDRAIGVNVPRSRFLPVKATSDLLLVQSDLYTVEEGFVIRNPARVNPTNPTIELGPEFKKVGNFLKRFKSIPSIIDLDSLKVSGDVWFGSGVILKGKVIIEAKQGATLEVPDESVIENKVVSSPDDIVN

SEQ ID NO: 1643 - protein, 480 aa, Picea sitchensis
  misc_feature (34)..(446): Pfam Name: UDPGP Pfam Description: UTP--glucose-1-phosphate uridylyltransfera
  misc_feature (1)..(480): Public GI ID no. 116787113
  misc_feature (1)..(480): Bit score of 1171.3 for HMM based on sequences of Figure 17
  misc_feature (1)..(480): Functional Homolog Of SEQ ID NO. 1599
MAAAAAVASPAVETDQISKLQAEVTKLNQISDNEKIGFVRLVSRHLSGEEERIEWEKIKTPTDEVVVPYDTMAAVGEDPLETKQLLDKLVVLKLNGGLGTTMGCTGPKSVIEVRNGLTFLDLIVKQIESLNNKYDSRVPLVLMNSFNTHDDTIKIVEKYSRSNIDIHIFNQSQYPRLVEEDLTPWPTKGRTDKEGWYPPGHGDVFPALLNSGKLGELLSQGKEYVFIANSDNLGAIVDLKILNHMVKNKNEYCMEVTPKTLADVKGGTLISYEGRVQLLEIAQVPKEHVGEFKSIEKFKIFNTNNLWVNLKAIKRLVEADALKMEIIPNPKEVDGVKVLQLETAAGAAIRFFYRAIGVNVPRSRFLPVKATSDLLLVQSDLYTVEEGFVIRNPARVNPANPSIELGPEFKKVGNFLKRFKSIPSIIDLDSLKVSGDVWFGSEIILKGKVTVEAKQGGKLEIPDESVIENKVVSNLEDIAN

SEQ ID NO: 1644 - DNA, 1407 bp, Sorghum bicolor
  misc_feature (1)..(1407): Ceres Annot ID no. 8671040
  misc_feature (1)..(1407): Encodes the peptide sequence at SEQ ID NO. 1645
atggcggacgagaagcttgccaagctgcgcgaagccaccgccggcctcacgcagatcagcgataatgagaagtccggcttcctcagcctcgtcggccgctacctcagcggcgacgaggagctcatcgagtgggccaagatccacacgcccaccgacgaggtggtggtgccgtacgacaccctggaatcccctcctgaagacattgaggccaccaagaagctgctcgacaagctcgccgtgctcaagctcaacggcggcctggggacgaccatgggatgcaccggacccaaatcggtcatcgaagtgcgcaacggatttactttccttgacctgattgtgatccagatcgagtcactcaacaagaagtatggcagcaatgtgccgctgcttctgatgaactccttcaacacccatgaagacaccttgaaaattgttgagaaatacgcgaattcaagcattgaaatccacacattcaatcagagccagtaccctcgtgtggtagctgacgagttcttgccatggccgtccaagggaaagactgacaagaatggctggtaccctcctggccatggtgatatcttcccatcactgatgaacagtggaaagctcgatttactactctcacagggaaaagagtatgtgttcattgcaaactcggataatttgggcgctattgtcaccccgaaaactttggctgatgtaaaaggtggcacactgatctcatacgaaggaagagttcagcttctggagattgcacaagtgcctgatgcacatgtgaatgagttcaaatcaattgagaaattcaagatattcaacaccaacaatctgtgggtgaacttgaaggccatcaaacgccttgttgaagctgatgcactcaagatggagatcattccgaatcctaaggaagtcgatggtgtgaaagttcttcagctggaaacagcagctggtgcagcaattaggttctttgaccacgccattggtatcaacgttccaaggtcccggttcctaccagttaaggcaacatcagatttacagctagtacagtctgatctatataccttggttgatggcttcgttacacgtaattcagctagagcaaatccatcaaatccctcaattgaacttggtcctgagttcaagaaggttgggtgcttccttagtcgcttcaagtcaatccctagcattgttgagcttgacagcttgaaggtttctggtgatgtttggtttggttctggcattgtactgaaggggaaagtgaccatcacagcaaaatctggcgtcaagctagaaatcccagacggagcagtgcttgagaacaagttagaactcctagagaagtcaacaaattttagcattcctcttatggatatgataaggaatgatatcaatggccctgaggacctttag

SEQ ID NO: 1645 - protein, 468 aa, Sorghum bicolor
  misc_feature (23)..(416): Pfam Name: UDPGP Pfam Description: UTP--glucose-1-phosphate uridylyltransfera
  misc_feature (1)..(468): Ceres Annot ID no. 8671040
  misc_feature (1)..(468): Bit score of 1131.0 for HMM based on sequences of Figure 17
  misc_feature (1)..(468): Functional Homolog Of SEQ ID NO. 1599
MADEKLAKLREATAGLTQISDNEKSGFLSLVGRYLSGDEELIEWAKIHTPTDEVVVPYDTLESPPEDIEATKKLLDKLAVLKLNGGLGTTMGCTGPKSVIEVRNGFTFLDLIVIQIESLNKKYGSNVPLLLMNSFNTHEDTLKIVEKYANSSIEIHTFNQSQYPRVVADEFLPWPSKGKTDKNGWYPPGHGDIFPSLMNSGKLDLLLSQGKEYVFIANSDNLGAIVTPKTLADVKGGTLISYEGRVQLLEIAQVPDAHVNEFKSIEKFKIFNTNNLWVNLKAIKRLVEADALKMEIIPNPKEVDGVKVLQLETAAGAAIRFFDHAIGINVPRSRFLPVKATSDLQLVQSDLYTLVDGFVTRNSARANPSNPSIELGPEFKKVGCFLSRFKSIPSIVELDSLKVSGDVWFGSGIVLKGKVTITAKSGVKLEIPDGAVLENKLELLEKSTNFSIPLMDMIRNDINGPEDL

SEQ ID NO: 1646 - protein, 516 aa, Physcomitrella patens subsp. patens
  misc_feature (76)..(488): Pfam Name: UDPGP Pfam Description: UTP--glucose-1-phosphate uridylyltransfera
  misc_feature (1)..(516): Public GI ID no. 168057301
  misc_feature (1)..(516): Bit score of 1073.8 for HMM based on sequences of Figure 17
  misc_feature (1)..(516): Functional Homolog Of SEQ ID NO. 1599
MLHVGAISELQHNEALPVRVRVTKQLCDTRKILMRDLAYIRKSAVPAVESPASTEVDQLTRIRLELATLDQISDNEKQGFLKLIGRYLGGKSEAIQWEKIKPPTDEVVVPYDKMSEFSDDPVKIKSLLDKLAVLKLNGGLGTTMGCTGPKSVIEVRNGLTFLDLIVKQIESLNQTYDSNVPLVLMNSFNTHDDTLKIVERYKDSKLEVITFNQSQYPRVVAADMIPWPAKGKTDNAGWYPPGHGDVFPSLDNSGKLDELLAQGKEYVFIANSDNLGAIVDLKILNHLVENQNEYCMEVTPKTLADVKGGTLISYEGRVQLLEIAQVPDEHVNEFKSIDKFKIFNTNNMWVNLKAIKRLVEADALQMEIIPNPKEVDGVKVLQLETAAGAAIRFFDRAIGVNVPRSRFLPVKATSDLLLVQSDLYTVQDGAVVRNPARTNPENPSIDLSSEFKKVGDFLKRFKSIPSILELESLKVSGNVWFGKDIVLKGKVVVEAAKGEKVEVPDEAVLDNTVVKN

SEQ ID NO: 1647 - protein, 458 aa, Pyrus pyrifolia
  misc_feature (23)..(435): Pfam Name: UDPGP Pfam Description: UTP--glucose-1-phosphate uridylyltransfera
  misc_feature (1)..(458): Public GI ID no. 19911799
  misc_feature (1)..(458): Bit score of 1086.5 for HMM based on sequences of Figure 17
  misc_feature (1)..(458): Functional Homolog Of SEQ ID NO. 1599
MATGVIDKLKSHVATLSQISENEKNGFINLVARSVSGEAQHVDWSKIETPTDEVVVPHAGLEPAPKDTAEIKALLDKLVVLKLNGGLGTTMGCTGPKSVIEVRDGLTFLDLIVMQIEHLNDKFGSSVPLLLMNSFNTHDDTQKIVEKYSKANVQIHTFNQSQYPRLVVDDFTPLPSKGQTGKDGWYPPGHGDVFPSLKNSGKLDLLLSQGREYVFISNSDNLGAIVDLKILHHLIKNKNEYIMEVTPKTLADVKGGTLISYEGKVQLLEIAQVPEEHVDEFKSIEKFKIFNTNNLWVNLNAIKRLVDADALKMEIIPNPKEVDGVKVLQLETAAGAAIKFFDNAIGINVPRARFLPVKATSDLLLVKSDLYNVRDGFVIRNKLRRDPQNPIIQLGPEFKKVDDFLSRFKSIPSLLECDGLRVDGDIWFGSGIKLKGNVHCSVSSEEMLNIPDNITLRE

SEQ ID NO: 1648 - protein, 474 aa, Physcomitrella patens subsp. patens
  misc_feature (34)..(446): Pfam Name: UDPGP Pfam Description: UTP--glucose-1-phosphate uridylyltransfera
  misc_feature (1)..(474): Public GI ID no. 168014649
  misc_feature (1)..(474): Bit score of 1066.0 for HMM based on sequences of Figure 17
  misc_feature (1)..(474): Functional Homolog Of SEQ ID NO. 1599
MASAVLDAPATTKVDQLDRIRLELATLNQISDNEKQGFLKLIGRYLSGKSEAIQWENIKAPTDEVVVPYDKLADFSDDPVKIKSLLDKLAVLKLNGGLGTTMGCTGPKSVIEVRNGLTFLDLIVKQIENLNHTYNANVPLVLMNSFNTHEDTLQIVERYADSKLEVITFNQSQYPRVVAEDMVPWPAKGKTDNAGWYPPGHGDVFPSLANTGKLDELIAQGKEYVFIANSDNLGAIVDLKILNHLVENQNEYCMEVTPKTLADVKGGTLISYEDRVQLLEIAQVPDEHVNEFKSIDKFKIFNTNNMWVNLKAIKRLVEADALQMEIIPNPKEVDGVKVLQLETAAGAAIRFFDRAIGVNVPRSRFLPVKATSDLLLVQSDLYTVQNGAVVRNRARTIPQNPSIELSGEFKKVGDFLKRFKSIPSIIELDSLKVSGDVWFGENIVLKGKVIVEAAKGEKLVLPDDATIEDKVVKE

SEQ ID NO: 1649 - protein, 1342 aa, Pyrus pyrifolia
  misc_feature (23)..(435): Pfam Name: UDPGP Pfam Description: UTP--glucose-1-phosphate uridylyltransfera
  misc_feature (1)..(1342): Public GI ID no. 19911797
  misc_feature (1)..(1342): Bit score of 1751.1 for HMM based on sequences of Figure 17
  misc_feature (1)..(1342): Functional Homolog Of SEQ ID NO. 1599
MATGVIDKLKSHVATLSQISENEKNGFINLVARSVSGEAQHVDWSKIETPTDEVVVPHAGLEPAPKDTAEIKALLDKLVVLKLNGGLGTTMGCTGPKSVIEVRDGLTFLDLIVMQIEHLNDKFGSSVPLLLMNSFNTHDDTQKIVEKYSKANVQIHTFNQSQYPRLVVDDFTPLPSKGQTGKDGWYPPGHGDVFPSLKNSGKLDLLLSQGREYVFISNSDNLGAIVDLKILHHLIKNKNEYIMEVTPKTLADVKGGTLISYEGKVQLLEIAQVPEEHVDEFKSIEKFKIFNTNNLWVNLNAIKRLVDADALKMEIIPNPKEVNGVKVLQLETAAGAAIKFFDHAIGINVPRARFLPVKATSDLLLVKSDLYNVRDGFVIRNKLRRDPQNPVIQLGPEFKKVDDFLSRFKSIPSLLECDGLRVDGDIWFGSGIKLKGNVHCSVSSEEMLNIPDNITLREMAFSSEAWKSSATAGHGDGDGDGDRTPPPTPPLPTPLLPPTLAPLQRSLVFGRVEGEAMSSEARESSATAVDRTPPPTPPSPPPPPPPPPTNGTLTPPPSSAPSGGRATSSEARESPHATSVDDGGRAPPPPPLPRPTSARATPATTPSADGSSSSSSSTSGGDEDKDSFMHLVSRYLIREEKEMIDWNKVERPTPEMVVPYDSLVQAPRDIPEIRNLLNKLAVLKLNGGLGTTMECVAPKCTIEVRSGLTFLDLAIMQTEFLNKKYGCSVPILLMNSFNTSLVNKIVEKYTNIEIHTFNQNKYPRIITEKFLPLSSEGSTGSHCWYPPGHGDVFFSLCKSGILDTMLSQRTWALQSILVSKYEYNILINVSWLASEIESLTSTEILNHLIHNKNEYCMEVTPKTSADVKGGSLICYEGLRRVNLKAIKRLVKAEALKMEIIPNLKEVDGVKVLQLEKEAGSAIQCFEKAIGVTVPRSRFLAVKNTSDLFLILSDLYIVMDGTVTRNPARDNSTNPLIDLGPEFRKVDSFLDRFKSIPSIVALDSLKISGDVWFGSRITLKGEVTIAAQLGLKLDILDGSVFDNKHSTHSSGAIKYTMKLDEGADCASIDSALNRLNPGSTLILKKDDFYRYIDPIQARNRAMFHSESSKPSSSNNELLQDNGTPFTPNDNSDRIQPLPLAPFSSSLGSSSLLPLYHSRARRAPYWYTRFIFVNPRGALHSQFRWLWGRIKFSSAKDLAIFYGIYHIVLYGIDCIITATLKDNWFAKLVQGKLWLIILVFHQFKLLSRRRLRWGERRRRTLRSIHQDIQSYLDNYSDSDMWHLIVHSVARVISNVLEDVNRKYMKNHYLGFLAIHSTVFAIEVIGSYAVELNYDIEHYAEPPEL

SEQ ID NO: 1650 - protein, 476 aa, Saccharum officinarum
  misc_feature (32)..(444): Pfam Name: UDPGP Pfam Description: UTP--glucose-1-phosphate uridylyltransfera
  misc_feature (1)..(476): Public GI ID no. 220682974
  misc_feature (1)..(476): Bit score of 1333.5 for HMM based on sequences of Figure 17
  misc_feature (1)..(476): Functional Homolog Of SEQ ID NO. 1599
MAAAAAAEVSVDEKLDKLRAEVAKLDQISENEKAGFISLVSRYLSGEAEQIEWSKIQTPTDEVVVPYDTLASPPEDLEETKKLLDKLVVLKLNGGLGTTMGCTGPKSVIEVRNGFTFLDLIVIQIESLNKKYGCSVPLLLMNSFNTHDDTQKIVEKYSNSNIEIHTFNQSQYPRIVTEDFLPLPSKGKSGKDGWYPPGHGDVFPSLNNSGKLDILLAQGKEYVFIANSDNLGAIVDIKILNHLINNQNEYCMEVTPKTLADVKGGTLISYEGRVQLLEIAQVPDEHVNEFKSIEKFKIFNTNNLWVNLKAIKRLVEAEALKMEIIPNPKEVDGVKVLQLETAAGAAIRFFDKAIGINVPRSRFLPVKATSDLLLVQSDLYTLVDGFVIRNPARANPANPSIELGPEFKKVANFLARFKSIPSIVELDSLKVSGDVWFGSGITLKGKVTITAKSGVKLEIPDGAVLENKDVNGPEDL

SEQ ID NO: 1651 - protein, 470 aa, Bambusa oldhamii
  misc_feature (26)..(438): Pfam Name: UDPGP Pfam Description: UTP--glucose-1-phosphate uridylyltransfera
  misc_feature (1)..(470): Public GI ID no. 224814363
  misc_feature (1)..(470): Bit score of 1332.3 for HMM based on sequences of Figure 17
  misc_feature (1)..(470): Functional Homolog Of SEQ ID NO. 1599
MAAAVDEKLEKLRSAVAQLDQISENEKAGFISLVSRYLSGEAEQIEWSKIQTPTDEVVVPYDTLAPAPEDLDAAKKLLDKLVVLKLNGGLGTTMGCTGPKSVIEVRNGFTFLDLIVIQIESLNKKYGCNVPLLLMNSFNTHDDTQKIVEKYNNSNIEIHTFNQSQYPRIVTEDFLPLPSKGKTGKDGWYPPGHGDVFPSLNNSGKLDILLSQGKEYVFVANSDNLGAIVDIKILNHLIHNQNEYCMEVTPKTLADVKGGTLISYEGRVQLLEIAQVPDEHVNEFKSIEKFKIFNTNNLWVNLKAIKRLVEAEALKMEIIPNPKEVDGVKVLQLETAAGAAIRFFEKAIGINVPRSRFLPVKATSDLLLVQSDLYTLVDGFVIRNPARANPSNPSIELGPEFKKVSNFLARFKSIPSIVELDSLKVSGDVWFGSGVALKGKVTITAKSGVKLEIPDGAVLENKDINGPEDL

SEQ ID NO: 1652 - protein, 495 aa, Gracilaria gracilis
  misc_feature (45)..(460): Pfam Name: UDPGP Pfam Description: UTP--glucose-1-phosphate uridylyltransfera
  misc_feature (1)..(495): Public GI ID no. 4140688
  misc_feature (1)..(495): Bit score of 710.0 for HMM based on sequences of Figure 17
  misc_feature (1)..(495): Functional Homolog Of SEQ ID NO. 1599
MNRDSRSLQDFKGVMDKSAASTVAEKLTVMNQMAANELEKMTDSETTGFVELYGRYMSERSKKAEIKWDLIEQPSENMLQKYDTLPKPATDEELASLLSKLAVLKLNGGLGTSMGCKGPKSVIEVRDDTTFLDLIVQQIGQLNKNHPTANVPLLLMNSFNTDSETAKIIRKYQDTSVTLTTFQQSRYPRIVKESLEPMPLTHDHYAHEDWYPPGHGDFFQSIYNSGLVDTLLAQGKEYIFVSNVDNLGATVDLNILKNVVDREVEYCMELTDKTRADIKGGTIISYDGKVSLLEVAQVPAKYVEEFKSISKFKVFNTNNIWVSLRAIKRVMQSGEMKLDIIVNNKEVKGTKVIQLESAIGAAIGYFNNACGVNVPRSRFLPVKSTSDLMLIQSNMYNLKSGSLVMNPARQFTTTPVIKLGKEFKKVAQYLERLGSIPDILELDHLTVSGDVYFGANTTLKGTVIVVANPGNTIMIPEGSVLENKVVLGSLHVIPH

SEQ ID NO: 1653 - protein, 509 aa, Ustilago maydis 521
  misc_feature (64)..(474): Pfam Name: UDPGP Pfam Description: UTP--glucose-1-phosphate uridylyltransfera
  misc_feature (1)..(509): Public GI ID no. 71023003
  misc_feature (1)..(509): Bit score of 704.7 for HMM based on sequences of Figure 17
  misc_feature (1)..(509): Functional Homolog Of SEQ ID NO. 1599
MSSNATLSTPNSGAQIKASRTRGASHIDFKSATTGVAAKAMRNEINALVSGIDDPAVRKAFDAEMSNFFTLFNRYLSEKAKGEKLVWDKIQPPSPKQITPYSELRNATDPSILNKLAVLKLNGGLGTTMGCTGPKSVIEVREGMTFLDLSVRQIEHLNSSHNVNVPFILMNSFNTDDDTARVIQKYANHNVEILTFNQSRYPRVNKESLLPCPRSATDNKNLWYPPGHGDLFDAMNNSGLLDRLISAGKEYLFVSNVDNLGADVDLNIYQHMIDTQAEFISEVTDKTKADVKGGTLIDYEGTIRLLEIAQVPSEHVEDFKSVKKFKIFNTNNLWLNLRAVKRVLENEELDLEIIVNNKALDSGEAVIQLETAVGAAIKHFRGAKGVNVPRSRFLPVKSCSDLLLITSDLYSLEHGKLVMNPGRMFSQTPVVKLGDTFKKVAQFQKRFKSIPEMIELDHLTVQGDVVFGRNITLRGTVIIVANEGNKIEIPEGSVLENKLISGNLAIIDH

SEQ ID NO: 1654 - protein, 492 aa, Danio rerio
  misc_feature (38)..(457): Pfam Name: UDPGP Pfam Description: UTP--glucose-1-phosphate uridylyltransfera
  misc_feature (1)..(492): Public GI ID no. 47086583
  misc_feature (1)..(492): Bit score of 692.1 for HMM based on sequences of Figure 17
  misc_feature (1)..(492): Functional Homolog Of SEQ ID NO. 1599
MAQFQEVMRQQLESSMHVELEKLLSTAKGAGAEVSKKDFEGFRKLFHRFLQVKGPSVEWPKINRPPEDSIQPYDKIKAKGLPDNIADSLNKLVVVKLNGGLGTSMGCKGPKSLISVRNENTFLDLTVQQIEHLNKTYNADVPLVLMNSFNTDEDTKKILQKYTHHRVKIHTFNQSRYPRINKESLLPVAKDMGMTGENGDVWYPPGHGDIYASFYNSGLLEQLIAEGKEYIFVSNIDNLGATVDLYILNHLVSQPNGKRCEFIMEVTDKTRADVKGGTLIQYDGKLRLLEIAQVPKAHVDEFKSVTKFKIFNTNNLWISLSAIKRLQEQNAMDMEIIVNPKTIDGGLNVIQLETAVGAAIKCFDNALGINVPRSRFLPVKTTSDLLLVMSNLYSLDAGSLTMSEKREFPTTPHVKLGSSFTKVQEYITRFESIPDMLELDHLTVSGDVTFGKHVSLKGTVIIIANHGDRIDIPAGSMLENKIVSGNLRILDH

SEQ ID NO: 1655 - protein, 503 aa, Cryptococcus neoformans var. neoformans JEC21
  misc_feature (59)..(468): Pfam Name: UDPGP Pfam Description: UTP--glucose-1-phosphate uridylyltransfera
  misc_feature (1)..(503): Public GI ID no. 58264886
  misc_feature (1)..(503): Bit score of 696.7 for HMM based on sequences of Figure 17
  misc_feature (1)..(503): Functional Homolog Of SEQ ID NO. 1599
MATLEPKQDPQASARQRGHSAMDFKSATTGVAAKTMRNELNRMVANEQDPAKKKMFEAEMQSFFILFNRFLTERAKGEKLDWDKINPPKPEQVRPYEVLPNVDPSILNKLAVLKLNGGLGTTMGCVGPKSIIEVRDNMTFLDLSVRQIEHLNEKYNVNVPFILMNSFNTDEDTARIIQKYQNHNINILTFNQSRYPRVDKESLLPCPRESSSDKSNWYPPGHGDIFDALTNSGLLDKLIAAGKEYIFISNVDNLGAVVDLNIFQTMIDAQAEYVMEVTDKTKADVKGGTIIDYDGKPRLLEVAQVPKDHLDEFCSTRKFKIFNTNNIWCNLRAIKRIMDEDALNLEIIVNNKVTDDGLAVIQLETAIGAAIKHFDSAIGINVPRSRFLPVKSCSDLLLIKSKLYNLEHGVLTMDRSREFGGTPVVKLGGEFKKVANFEKRFKSIPNITELDHLTVSGDVWFGKSVRLAGTCIIVATEGNKIMIPDGTNLENKLITGNLSIIDH

SEQ ID NO: 1656 - protein, 492 aa, Salmo salar
  misc_feature (38)..(457): Pfam Name: UDPGP Pfam Description: UTP--glucose-1-phosphate uridylyltransfera
  misc_feature (1)..(492): Public GI ID no. 213513005
  misc_feature (1)..(492): Bit score of 694.7 for HMM based on sequences of Figure 17
  misc_feature (1)..(492): Functional Homolog Of SEQ ID NO. 1599
MAEFQEKLRLQHETSMHKELEKLLATAKGAEQEISKKDFEGFKNLFHRFLQVKGPSVKWDKIHKPPEDLIHPYDKIKAQVLPDSVAASLNKLVVVKLNGGLGTSMGCKGPKSVISVRNENTFLDLTVHQIEHLNKTFNVDVPLVLMNSFNTDEDTKKILQKYTHHRVHIHTFNQSRYPRINKESLLPVAKDLGVHGDHGDAWYPPGHGDIYASFYNSGLLDQLIAAGKEYIFVSNIDNLGATVDLFILNHLMTQPKDKRCEFIMEVTDKTRADVKGGTLIQYDDKLRLLEIAQVPKAHVDEFKSVTKFKIFNTNNLWISLAAIKRLHEQNAMDMEIIVNPKTLDGGLNVIQLETAVGAAIKAFDNALGVNVPRSRFLPVKTSSDLLLVMSNLYSLDAGSLTMSKKREFPSTPHVKLGSSFTKVHDFLMRFESIPDMLELDHLTVSGDVTFGKNVSLKGTVIIIANHGDRIDIPAGAVLENKIVSGNLRILDH

SEQ ID NO: 1657 - protein, 508 aa, Xenopus laevis
  misc_feature (54)..(473): Pfam Name: UDPGP Pfam Description: UTP--glucose-1-phosphate uridylyltransfera
  misc_feature (1)..(508): Public GI ID no. 148235435
  misc_feature (1)..(508): Bit score of 681.7 for HMM based on sequences of Figure 17
  misc_feature (1)..(508): Functional Homolog Of SEQ ID NO. 1599
MTSFPGGLRKAMAGGGLLQFQEAIREELEEAMKADLEKILSTAPESEIEHTKKDLAGFQKLFHRFLQEKGPSVDWGKIQRPPEDSIQPYEKIKAKGLPDNITSVLNKLVVVKLNGGLGTSMGCKGPKSLIGVRNENTFLDLTVKQIEHLNTTYNTDVPLVLMNSFNTDEDTKKILQKYSHCRVKIHTFNQSRYPRISKESLLPVAKDLSYSVENAESWYPPGHGDIYSSFYNSGLLDRLIGEGKEYIFVSNIDNLGATVDLYILNHLMNPPNGKRCEFVMEVTDKTRADVKGGTLTQYEGKLRLVEIAQVPKAHVDEFKSVSKFKIFNTNNLWVSLSAIKRLQEANAIDMEIIVNPKTLDGGLNVIQLETAVGAAIKSFENSLGINVPRSRFLPVKTTSDLLLVMSNLYSLQAGSLTMSDKREFPTVPLTKLGSSFTKVQDYLKRFESIPDMLELDHLTVSGDVTFGKNVSLKGTVIIIANHGDRIDIPPGAVLENKIVSGNLRILDH

SEQ ID NO: 1658 - protein, 520 aa, Monodelphis domestica
  misc_feature (66)..(485): Pfam Name: UDPGP Pfam Description: UTP--glucose-1-phosphate uridylyltransfera
  misc_feature (1)..(520): Public GI ID no. 126304392
  misc_feature (1)..(520): Bit score of 668.5 for HMM based on sequences of Figure 17
  misc_feature (1)..(520): Functional Homolog Of SEQ ID NO. 1599
MEVLSTEIVMFGGEAGAGDLRKAMSQGGTSQFQEVIRQELELSVKKELEKILSTAPQNESEHTKKDLEGFRKLFHRFLQEKGPSVDWGKIQRPPEDSIQPYEKIKARGLPDNISSVLNKLVVVKLNGGLGTSMGCKGPKSLIGVRNENTFLDLTVQQIEHLNKTYNTDVPLVLMNSFNTDEDTKKILQKYNHCRVKIYTFNQSRYPRINKESLLPVAKDVSYSGENTEAWYPPGHGDIYASFYNSGLLDTLIGEGKEYIFVSNIDNLGATVDLYILNHLMNPPNGKRCEFVMEVTNKTRADVKGGTLTQYEGKLRLVEIAQVPKAHVDEFKSVSKFKIFNTNNLWISLAAVKRLQEQNAIDMEIIVNPKTLDGGLNVIQLETAVGAAIKSFENSLGINVPRSRFLPVKTTSDLLLVMSNLYSLNAGSLTMSEKREFPTVPLVKLGSSFTKVQDYLRRFESIPDMLELDHLTVSGDVTFGKNVSLKGTVIIIANHGDRIDIPPGAVLENKIVSGNLRILDH

SEQ ID NO: 1659 - protein, 497 aa, Mus musculus
  misc_feature (43)..(462): Pfam Name: UDPGP Pfam Description: UTP--glucose-1-phosphate uridylyltransfera
  misc_feature (1)..(497): Public GI ID no. 19343890
  misc_feature (1)..(497): Bit score of 665.8 for HMM based on sequences of Figure 17
  misc_feature (1)..(497): Functional Homolog Of SEQ ID NO. 1599
MSQDGASQFQEVILQELELSVKKELEKILTTAASHEFEHTKKDLDGFRKLFHRFLQEKGPSVDWGKIQRPPEDSIQPYEKIKARGLPDNISSVLNKLVVVKLNGGLGTSMGCKGPKSLIGVRNENTFLDLTVQQIEHLNKTYNTDVPLVLMNSFNTDEDTKKILQKYNHCRVKIYTFNQSRYPRINKESLLPIAKDVSYSGENTEAWYPPGHGDIYASFYNSGLLDTFIEEGKEYIFVSNIDNLGATVDLYILNHLMNPPNGKRCEFVMEVTNKTRADVKGGTLTQYEGKLRLVEIAQVPKAHVDEFKSVSKFKIFNTNNLWISLGAVKRLQEQNAIDMEIIVNPKTLDGGLNVIQLETAVGAAIKSFENSLGINVPRSRFLPVKTTSDLLLVMSNLYSLNAGSLTMSEKREFPTVPLVKLGSSFTKVQDYLRRFESIPDMLELDHLTVSGDVTFGKNVSLKGTVIIIANHGDRIDIPPGAVLENKIVSGNLRILDH

SEQ ID NO: 1660 - protein, 508 aa, Canis familiaris
  misc_feature (54)..(473): Pfam Name: UDPGP Pfam Description: UTP--glucose-1-phosphate uridylyltransfera
  misc_feature (1)..(508): Public GI ID no. 73969769
  misc_feature (1)..(508): Bit score of 666.1 for HMM based on sequences of Figure 17
  misc_feature (1)..(508): Functional Homolog Of SEQ ID NO. 1599
MSRYVQDLSKAMSQDGASQFQEVIRQELELSVKKELEKILTTAPSHEFEHTKKDLDGFRKLFHRFLQEKGPSVDWGKIQRPPEDSIQPYEKIKARGLPDNISSVLNKLVVVKLNGGLGTSMGCKGPKSLIGVRNENTFLDLTVQQIEHLNKTYNTDVPLVLMNSFNTDEDTKKILQKYNHCRVKIYTFNQSRYPRINKESLLPVAKDVSYSGENTEAWYPPGHGDIYASFYNSGLLDTLIGEGKEYIFVSNIDNLGATVDLYILNHLMNPPNGKPCEFVMEVTNKTRADVKGGTLTQYEGKLRLVEIAQVPKAHVDEFKSVSKFKIFNTNNLWISLAAVKRLQEQNAIDMEIIVNPKTLDGGLNVIQLETAVGAAIKSFENSLGINVPRSRFLPVKTTSDLLLVMSNLYSLNAGSLTMSEKREFPTVPLVKLGSSFTKVQDYLRRFESIPDMLELDHLTVSGDVTFGKNVSLKGTVIIIANHGDRIDIPPGAVLENKIVSGNLRILDH

SEQ ID NO: 1661 - protein, 508 aa, Gallus gallus
  misc_feature (54)..(473): Pfam Name: UDPGP Pfam Description: UTP--glucose-1-phosphate uridylyltransfera
  misc_feature (1)..(508): Public GI ID no. 53130600
  misc_feature (1)..(508): Bit score of 668.6 for HMM based on sequences of Figure 17
  misc_feature (1)..(508): Functional Homolog Of SEQ ID NO. 1599
MSSFAKDFSKAMSQAGPSQFQEVIRQELEYSMKVELDKILATAPSNELEHTKKDLEGFKKLFHRFLQEKGPSVDWGKIQRPPEDSIQPYEKIKARGLPDNIASVLNKLVVVKLNGGLGTSMGCKGPKSLIGVRNENTFLDLTVQQIEHLNKTYNTDVPLVLMNSFNTDEDTKKILQKYSLSRVKIYTFNQSRYPRINKETLLPIAKDVSYSGENTECWYPPGHGDIYGSFYNSGLLDNLIAEGKEYIFVSNIDNLGATVDLYILNHLMNPPNGKRCEFVMEVTNKTRADVKGGTLTQYENKLRLVEIAQVPKAHVDEFKSVSKFKIFNTNNLWIALSAIKRLQEKNAIDMEIIVNPKTLDGGLNVIQLETAVGAAIKSFENSLGINVPRSRFLPVKTTSDLLLVMSNLYSLNAGSLTMSEKREFPAVPLVKLGSSFTKVQDYLRRFESIPDMLELDHLTVSGDVTFGKNVSLKGTVIIIANHGDRIDIPAGAVLENKIVSGNLRILDH

SEQ ID NO: 1662 - protein, 508 aa, Cricetulus griseus
  misc_feature (54)..(473): Pfam Name: UDPGP Pfam Description: UTP--glucose-1-phosphate uridylyltransfera
  misc_feature (1)..(508): Public GI ID no. 6136108
  misc_feature (1)..(508): Bit score of 670.1 for HMM based on sequences of Figure 17
  misc_feature (1)..(508): Functional Homolog Of SEQ ID NO. 1599
MSRFVQDLSKAMSQDGASQFQEVILQELELSVKKELEKILTTATSHEYEHTKKDLDGFRKLYHRFLQEKGPSVDWGKIQRPPEDSIQPYEKIKARGLPDNISSVLNKLVVVKLNGGLGTSMGCKGPKSLIGVRNENTFLDLTVQQIEHLNKSYNTDVPLVLMNSFNTDEDTKKILQKYNHCRVKIYTFNQSRYPRINKESLLPVAKDVSSSGESTEAWYPPGHGDIYASFYNSGLLDTFLEEGKEYIFVSNIDNLGATVDLYILNHLMNPPNGKRCEFVMEVTNKTRADVKGGTLTQYEGKLRLVEIAQVPKAHVDEFKSVSKFKIFNTNNLWISLAAVKRLQEQNAIDMEIIVNPKTLDGGLNVIQLETAVGAAIKSFENSLGINVPRSRFLPVKTTSDLLLVMSNLYSLNAGSLTMSEKREFPTVPLVKLGSSFTKVQDYLRRFESIPDMLELDHLTVSGDVTFGKNVSLKGTVIIIANHGDRIDIPPGAVLENKIVSGNLRILDH

SEQ ID NO: 1663 - protein, 497 aa, Macaca mulatta
  misc_feature (43)..(462): Pfam Name: UDPGP Pfam Description: UTP--glucose-1-phosphate uridylyltransfera
  misc_feature (1)..(497): Public GI ID no. 109103119
  misc_feature (1)..(497): Bit score of 666.0 for HMM based on sequences of Figure 17
  misc_feature (1)..(497): Functional Homolog Of SEQ ID NO. 1599
MSQDGASQFQEVIRQELELSVKKELEKILTTASSHEFEHTKKDLDGFRKLFHRFLQEKGPSVDWGKIQRPPEDSIQPYEKIKARGLPDNISSVLNKLVVVKLNGGLGTSMGCKGPKSLIGVRNENTFLDLTVQQIEHLNKTYNTDVPLVLMNSFNTDEDTKKILQKYNHCRVKIYTFNQSRYPRINKESLLPVAKDVSYSGENTEAWYPPGHGDIYASFYNSGLLDTFIGEGKEYIFVSNIDNLGATVDLYILNHLMNPPNGKRCEFVMEVTNKTRADVKGGTLTQYEGKLRLVEIAQVPKAHVDEFKSVSKFKIFNTNNLWISLAAVKRLQEQNAIDMEIIVNPKTLDGGLNVIQLETAVGAAIKSFENSLGINVPRSRFLPVKTTSDLLLVMSNLYSLNAGSLTMSEKREFPTVPLVKLGSSFTKVQDYLRRFESIPDMLELDHLTVSGDVTFGKNVSLKGTVIIIANHGDRIDIPPGAVLENKIVSGNLRILDH

SEQ ID NO: 1664 - protein, 504 aa, Coprinopsis cinerea okayama7#130
  misc_feature (59)..(469): Pfam Name: UDPGP Pfam Description: UTP--glucose-1-phosphate uridylyltransfera
  misc_feature (1)..(504): Public GI ID no. 169846774
  misc_feature (1)..(504): Bit score of 693.4 for HMM based on sequences of Figure 17
  misc_feature (1)..(504): Functional Homolog Of SEQ ID NO. 1599
MSASLMPRSDSFNARVRGTSHIDFKTATTGVAAKSMRNEISRLVSTVEDPATKKAFDTEMQSFFYLFTRYLSERAKSVELDWDRIKSPAADQIIPYSDLPSPSDTKNLDKLAVLKVNGGLGTSMGMTGAKSALEVKDDMTFLDLTVRQIEHLNTTNRVDVPLILMTSFNTHEDTLRIIKKYANQQLRITTFNQSRYPRIYKESLLPCPKRADDDKSHWYPPGHGDLYNALLHSGVLDQLLAEGKEYLFVSNSDNLGAVVDEKILQHMIDTKAEFLMEVTDKTKADVKGGTLIDYEGSIRLLEIAQVPSEHVEDFKSVRKFKIFNTNNLWINLKALKRVMENEGLELDIIVNPKITDEGHAVIQLETAAGAAIKHFKNAHGVNVPRSRFLPVKSCSDLLLIKSDIYSLQHGQLVINPQRMFETTPVIKLGDHFKKIQQFQKRFKKIPKILELDHLTVTGDVYFGRNVTLRGTVIVVANEGQRIDIPDGCVLENRLLSGNLNMIEL

SEQ ID NO: 1665 - protein, 508 aa, Rattus norvegicus
  misc_feature (54)..(473): Pfam Name: UDPGP Pfam Description: UTP--glucose-1-phosphate uridylyltransfera
  misc_feature (1)..(508): Public GI ID no. 67078526
  misc_feature (1)..(508): Bit score of 667.2 for HMM based on sequences of Figure 17
  misc_feature (1)..(508): Functional Homolog Of SEQ ID NO. 1599
MSRFVQDLSKAMSQDGASQFQEVILQELELSVKKELEKILTTATSHEFEHTKKDLDGFRKLFHRFLQEKGPSVDWGKIQRPPEDSIQPYEKIKARGLPDNISSVLNKLVVVKLNGGLGTSMGCKGPKSLIGVRNENTFLDLTVQQIEHLNKTYNTDVPLVLMNSFNTDEDTKKILQKYNHCRVKIYTFNQSRYPRINKESLLPIAKDVSYSGENTEAWYPPGHGDIYASFYNSGLLDTFIEEGKEYIFVSNIDNLGATVDLYILNHLMNPPNGKRCEFVMEVTNKTRADVKGGTLTQYEGKLRLVEIAQVPKAHVDEFKSVSKFKIFNTNNLWISLAAVKRLQEQNAIDMEIIVNPKTLDGGLNVIQLETAVGAAIKSFENSLGINVPRSRFLPVKTTSDLLLVMSNLYSLNAGSLTMSEKREFPTVPLVKLGSSFTKVQDYLRRFESIPDMLELDHLTVSGDVTFGKNVSLKGTVIIIANHGDRIDIPPGAVLENKIVSGNLRILDH

SEQ ID NO: 1666 - protein, 508 aa, Homo sapiens [sequence omitted]

SEQ ID NO: 1667 - protein, 502 aa, Candida glabrata CBS138
  misc_feature (54)..(467): Pfam Name: UDPGP Pfam Description: UTP--glucose-1-phosphate uridylyltransfera
  misc_feature (1)..(502): Public GI ID no. 50292841
  misc_feature (1)..(502): Bit score of 682.6 for HMM based on sequences of Figure 17
  misc_feature (1)..(502): Functional Homolog Of SEQ ID NO. 1599
MSTAKKHTKTHSTYAFESNTNSVAASQMRNALNKLADSIGSEHGDDARTRFENELDSFFTLFRRYLVEKSSSNTLEWDKIKSPNPEEVVRYDTINSQAENVSSLSKLAVLKLNGGLGTSMGCVGPKSVIEVREGNSFLDLSVRQIEHLNRQYDSDVPLLLMNSFNTDKDTEHLIKKYSANRIRIRSFNQSRFPRVYKDSMLPVPETYNDPKDAWYPPGHGDLFESLHASGELDALIAQGREILFVSNGDNLGATVDLKILNHMIETGAEYIMELTDKTRADVKGGTLISYDGQVRLLEVAQVPKEHIDEFKNIRKFTNFNTNNLWINLKAVKRLVESSALEMEIIPNQKTITRGGQEINVLQLETACGAAIRHFSGAHGVVVPRSRFLPVKTCSDLLLVKSDLFYLQHGALKLDPSRFGPNPLIKLGSHFKKVSDFSARIPHIPKLVELDHLTITGNVFLGKGVTLRGTVIIVCSDGQKIDIPNGSVLENVVITGNLQILEH

SEQ ID NO: 1668 - protein, 497 aa, Equus caballus
  misc_feature (43)..(462): Pfam Name: UDPGP Pfam Description: UTP--glucose-1-phosphate uridylyltransfera
  misc_feature (1)..(497): Public GI ID no. 149727538
  misc_feature (1)..(497): Bit score of 664.2 for HMM based on sequences of Figure 17
  misc_feature (1)..(497): Functional Homolog Of SEQ ID NO. 1599
MSQDGASQFQEVIRQELEFSVKKELEKILTTAPSHEFEHTKKDLDGFRKLFHRFLQEKGPSVDWGKIQRPPEDSIQPYEKIKARGLPDNISSVLNKLVVVKLNGGLGTSMGCKGPKSLIGVRNENTFLDLTVQQIEHLNKSYNTDVPLVLMNSFNTDEDTKKILQKYNHCRVKIYTFNQSRYPRINKESLLPVAKDVSYSGENTEAWYPPGHGDIYASFYNSGLLDTFIGEGKEYIFVSNIDNLGATVDLYILNHLMNPPNGKPCEFVMEVTNKTRADVKGGTLTQYEGKLRLVEIAQVPKAHVDEFKSVSKFKIFNTNNLWISLAAVKRLQEQNAIDMEIIVNPKTLDGGLNVIQLETAVGAAIKSFENSLGINVPRSRFLPVKTTSDLLLVMSNLYSLNAGSLTMSEKREFPTVPLVKLGSSFTKVQDYLRRFESIPDMLELDHLTVSGDVTFGKNVSLKGTVIIIANHGDRIDIPPGAVLENKIVSGNLRILDH

SEQ ID NO: 1669 - protein, 497 aa, Xenopus laevis
  misc_feature (43)..(462): Pfam Name: UDPGP Pfam Description: UTP--glucose-1-phosphate uridylyltransfera
  misc_feature (1)..(497): Public GI ID no. 148234947
  misc_feature (1)..(497): Bit score of 674.8 for HMM based on sequences of Figure 17
  misc_feature (1)..(497): Functional Homolog Of SEQ ID NO. 1599
MASGGMSHFQEAIREELEGAMKADLERILSTAPESELEHTKKDLAGFQKLFHRFLQEKGPAVDWGKIQRPPEDSIQPYEKIKAKGLPDNIASVLNKLVVLKLNGGLGTSMGCKGPKSLIGVRNENTFLDLTVKQIEHLNTTYNTDVSLVLMNSFNTDEDTKKILQKYSHCRVKIHTFNQSRYPRINKESLLPIAKDLSYSVENAESWYPPGHGDIYASFYNSGLLDRLIGEGKEYIFVSNIDNLGATVDLYILNHLLNPPNGKKCEFVMEVTDKTRADVKGGTLTQYEGKLRLVEIAQVPKAHVDEFKSVSKFKIFNTNNLWISLSAIKRLQEANAIDMEIIVNPKTLDGGLNVIQLETAVGAAVKSFENSLGINVPRSRFLPVKTTSDLLLVMSNLYSLQAGSLTMSEKREFPTVPLTKLGSSFTKVQDYLKRFESIPDMLELDHLTVSGDVTFGKNVALKGTVIIIANHGDRIDIPPGAVLENKIVSGNLRILDH

SEQ ID NO: 1670 - protein, 508 aa, Bos taurus
  misc_feature (54)..(473): Pfam Name: UDPGP Pfam Description: UTP--glucose-1-phosphate uridylyltransfera
  misc_feature (1)..(508): Public GI ID no. 41386780
  misc_feature (1)..(508): Bit score of 665.0 for HMM based on sequences of Figure 17
  misc_feature (1)..(508): Functional Homolog Of SEQ ID NO. 1599
MSRFVQDLSKAMSQDGASQFQEVIRQELELSVKKELEKILTTAPSHEFEHTKKDLDGFRKLFHRFLQEKGPSVDWGKIQRPPEDSIQPYEKIKARGLPDNVSSVLNKLVVVKLNGGLGTSMGCKGPKSLIGVRNENTFLDLTVQQIEHLNKTYDTDVPLVLMNSFNTDEDTKKILQKYNHCRVKIYTFNQSRYPRINKESLLPVAKNVSYSGENTEAWYPPGHGDIYASFYNSGLLDTFIGEGKEYIFVSNIDNLGATVDLYILNHLMNPPNGKPCEFVMEVTNKTRADVKGGTLTQYEGKLRLVEIAQVPKAHVDEFKSVSKFKIFNTNNLWISLAAVKRLQEQNAIDMEIIVNPKTLDGGLNVIQLETAVGAAIKSFENSLGINVPRSRFLPVKTTSDLLLVMSNLYSLNAGSLTMSEKREFPTVPLVKLGSSFTKVQDYLRRFESIPDMLELDHLTVSGDVTFGKNVSLKGTVIIIANHGDRIDIPPGAVLENKIVSGNLRILDH

SEQ ID NO: 1671 - protein, 517 aa, Homo sapiens [sequence omitted]

SEQ ID NO: 1672 - protein, 499 aa, Saccharomyces cerevisiae
  misc_feature (51)..(464): Pfam Name: UDPGP Pfam Description: UTP--glucose-1-phosphate uridylyltransfera
  misc_feature (1)..(499): Public GI ID no. 6322815
  misc_feature (1)..(499): Bit score of 673.2 for HMM based on sequences of Figure 17
  misc_feature (1)..(499): Functional Homolog Of SEQ ID NO. 1599
MSTKKHTKTHSTYAFESNTNSVAASQMRNALNKLADSSKLDDAARAKFENELDSFFTLFRRYLVEKSSRTTLEWDKIKSPNPDEVVKYEIISQQPENVSNLSKLAVLKLNGGLGTSMGCVGPKSVIEVREGNTFLDLSVRQIEYLNRQYDSDVPLLLMNSFNTDKDTEHLIKKYSANRIRIRSFNQSRFPRVYKDSLLPVPTEYDSPLDAWYPPGHGDLFESLHVSGELDALIAQGREILFVSNGDNLGATVDLKILNHMIETGAEYIMELTDKTRADVKGGTLISYDGQVRLLEVAQVPKEHIDEFKNIRKFTNFNTNNLWINLKAVKRLIESSNLEMEIIPNQKTITRDGHEINVLQLETACGAAIRHFDGAHGVVVPRSRFLPVKTCSDLLLVKSDLFRLEHGSLKLDPSRFGPNPLIKLGSHFKKVSGFNARIPHIPKIVELDHLTITGNVFLGKDVTLRGTVIIVCSDGHKIDIPNGSILENVVVTGNLQILEH

SEQ ID NO: 1673 - protein, 508 aa, Gallus gallus
  misc_feature (54)..(473): Pfam Name: UDPGP Pfam Description: UTP--glucose-1-phosphate uridylyltransfera
  misc_feature (1)..(508): Public GI ID no. 45383884
  misc_feature (1)..(508): Bit score of 666.5 for HMM based on sequences of Figure 17
  misc_feature (1)..(508): Functional Homolog Of SEQ ID NO. 1599
MSSFAKDFSKAMSQAGPSQFQEVIRQELEYSMKVELDKILATAPSNELEHTKKDLEGFKKLFHRFLQEKGPSVDWGKIQRPPEDSIHPYEKIKARGLPDNIASVLNKLVVVKLNGGLGTSMGCKGPKSLIGVRNENTFLDLPVQQIEHLNKTYNTDVPLVLMNSFNTDEDTKKILQKYSLSRVKIYTFNQSRYPRINKETLLPIAKDVSYSGENTECWYPPGHGDIYGSFYNSGLLDNLIAEGKEYIFVSNIDNLGATVDLYILNHLMNPPNGKRCEFVMEVTNKTRADVKGGTLTQYENKLRLVEIAQVPKAHVDEFKSVSKFKIFNTNNLWIALSAIKRLQEKNAIDMEIIVNPKTLDGGLNVIQLETAVGAAIKSFENSLGINVPRSRFLPVKTTSDLLLVMSNLYSLNAGSLTMSEKREFPTVPLVKLGSSFTKVQDYLRRFESIPDMLELDHLTVSGDVTFGKNVSLKGTVIIIANHGDRIDIPAGAVLENKIVSGNLRILDH

SEQ ID NO: 1674 - protein, 502 aa, Candida glabrata
  misc_feature (54)..(467): Pfam Name: UDPGP Pfam Description: UTP--glucose-1-phosphate uridylyltransfera
  misc_feature (1)..(502): Public GI ID no. 7415873
  misc_feature (1)..(502): Bit score of 678.7 for HMM based on sequences of Figure 17
  misc_feature (1)..(502): Functional Homolog Of SEQ ID NO. 1599
MSTAKKHTKTHSTYAFESNTNSVAASQMRNALNKLADSIGSEHGDDARTRFENELDSFFTLFRRYLVEKSSSNTLEWDKIKSPNPEEVVRYDTINSQAENVSSLSKLAVLKLNGGLGTSMGCVGPKSVIEVREGNSFLDLSVRQIEHLNRQYDSDVPLLLMNSFNTDKDTEHLIKKYSANRIRIRSFNQSRFPRVYKDSMLPVPETYNDPKDAWYPPGHGDLFESLHASGELDALIAQGREILFVSNGDNLGATVDLKILNHMIETGAEYIMELTDKTRADVKGGTLISYDGQVRLLEVAQVPKEHIDEFKNIRKFTNFNTNNLWINLKAVKRLVESSALEMEIIPNQKTITRGGQEINVLQLETACGAAIRHLSGAHGVVVPRSRFLPVKTCSDLLLVKSDLFYLQHGALKLDPSRFGPNPLIKLGSHFKKVSDFSARIPHIPKLVELDHLTITGNVFLGKGVTLRGTVIIVCSDGQKIDIPNGSVLENVVITGNLQILEH

SEQ ID NO: 1675 - protein, 497 aa, Homo sapiens
  misc_feature (43)..(462): Pfam Name: UDPGP Pfam Description: UTP--glucose-1-phosphate uridylyltransfera
  misc_feature (1)..(497): Public GI ID no. 48255968
  misc_feature (1)..(497): Bit score of 661.4 for HMM based on sequences of Figure 17
  misc_feature (1)..(497): Functional Homolog Of SEQ ID NO. 1599
MSQDGASQFQEVIRQELELSVKKELEKILTTASSHEFEHTKKDLDGFRKLFHRFLQEKGPSVDWGKIQRPPEDSIQPYEKIKARGLPDNISSVLNKLVVVKLNGGLGTSMGCKGPKSLIGVRNENTFLDLTVQQIEHLNKTYNTDVPLVLMNSFNTDEDTKKILQKYNHCRVKIYTFNQSRYPRINKESLLPVAKDVSYSGENTEAWYPPGHGDIYASFYNSGLLDTFIGEGKEYIFVSNIDNLGATVDLYILNHLMNPPNGKRCEFVMEVTNKTRADVKGGTLTQYEGKLRLVEIAQVPKAHVDEFKSVSKFKIFNTNNLWISLAAVKRLQEQNAIDMEIIVNAKTLDGGLNVIQLETAVGAAIKSFENSLGINVPRSRFLPVKTTSDLLLVMSNLYSLNAGSLTMSEKREFPTVPLVKLGSSFTKVQDYLRRFESIPDMLELDHLTVSGDVTFGKNVSLKGTVIIIANHGDRIDIPPGAVLENKIVSGNLRILDH

SEQ ID NO: 1676 - protein, 510 aa, Nasonia vitripennis
  misc_feature (57)..(475): Pfam Name: UDPGP Pfam Description: UTP--glucose-1-phosphate uridylyltransfera
  misc_feature (1)..(510): Public GI ID no. 156543768
  misc_feature (1)..(510): Bit score of 650.0 for HMM based on sequences of Figure 17
  misc_feature (1)..(510): Functional Homolog Of SEQ ID NO. 1599
MLSVDDRKTRGHQRSPSDTQAFKERTKRDALIDLETELSKISASATNPLEKEAIEQQNDGFKRLFERFLEEDGPSLNWDQIQRLPEGAIKNYDNLQDPGTEEIKQLLSKLVVVKLNGGLGTSMGCHGPKSVISVRNGLTFLDLTVQQLENLNKTYGSNVPLVLMNSFNTDDDTQKIIRKYKGIDVEIHTFNQSCYPRINKESLLPIAKHCKIHDDMESWYPPGHGDFYESFRNSGLLKLFLAQGRQYCFISNIDNLGATVDLRVLRLLLGPENTAQIEFLMEVTDKTRADVKGGTLIQYEDKLRLLEIAQVPKEHVEDFKSVKTFKYFNTNNLWIKLAAIERILGSDGLQLEIIVNNKTFENGLNVIQLETAVGAAMKNFNGACGIHVPRSRFLPVKKTSDLLLVMSNLYILRNGFLSMSPQRMFPTTPLVKLGDNHFSKVKEFLNRFPTIPDILELDHLTVSGDVTFGRKVTLKGTVIIIANQGERIDLPSGTILENKIVSGNLRILDH

SEQ ID NO: 1677 - protein, 493 aa, Lodderomyces elongisporus NRRL YB-4239
  misc_feature (50)..(458): Pfam Name: UDPGP Pfam Description: UTP--glucose-1-phosphate uridylyltransfera
  misc_feature (1)..(493): Public GI ID no. 149238918
  misc_feature (1)..(493): Bit score of 677.6 for HMM based on sequences of Figure 17
  misc_feature (1)..(493): Functional Homolog Of SEQ ID NO. 1599
MSTKRHTKSQSAYAFDNTATNVAASQMRNALNNLADTVKDPEEKHRFENEMDNFFSLFRRYLTEKASGTTLEWDKIRSPSADEVVGYKDLDDATPDLTKLAVLKLNGGLGTSMGCVGPKSVIEVRDGNTFLDLSVRQIEHLNRKYDADVPLLLMNSFNTDADTAKIIRKYQGHRIRVKTFNQSKFPRIYKDSLLPVPESSDDPLEGWYPPGHGDLFEALVQSGELDALLAQGREILFVSNGDNLGATVDTKILAHMLETGAEYIMELTDKTRADVKGGTLINYQGEVRLLEIAQVPKEHVEEFKSIKKFKYFNTNNLWINLRAIKRLVEANAIEAEIIPNQKTIGNDINVLQLETAVGAAIRHFKGAHGVVVPRSRFLPVKTCSDLLLVKSDLFFLEHGALKLDPTREGFANPLIKLGSHFKKVSGFQARIPHMPKILELDHLTITGNVSIGKGVQLKGTVIIVCNDGDKIDIPNGSILENVVVTGNLTLLEH

SEQ ID NO: 1678 - protein, 497 aa, Pongo pygmaeus abelii
  misc_feature (43)..(462): Pfam Name: UDPGP Pfam Description: UTP--glucose-1-phosphate uridylyltransfera
  misc_feature (1)..(497): Public GI ID no. 197098334
  misc_feature (1)..(497): Bit score of 657.6 for HMM based on sequences of Figure 17
  misc_feature (1)..(497): Functional Homolog Of SEQ ID NO. 1599
MSQDGASQFQEVIRQELELSVKKELEKILTTASSHEFEHTKKDLDGFRKLFHRFLQEKGPSVDWGKIQRPPEDSIQPYEKIKARGLPDNISSVLNKLVVVKLNGGLGTSMGCKGPKSLIGVRDENTFLDLTVQQIEHLNKTYNTDVPLVLMNSFNTDEDTKKILQKYNHCRVKIYTFNQSRYPRINKESLLPVAKDVSYSGENTEAWYPPGHGDIYASFYNSGLLDTFIGEGKEYIFVSNIDNLGATVDLYILNHLMNPPNGKRCEFVMEVTNKTRADVKGGTLTQYEGKLRLVEIAQVPKAHVDEFKSVSKFKIFNTNNLWISLAAVKRLQEQNAIDMEIIVNAKTLDGGLNVIQLETAVGAAIKSFENSLGINVPRSRFLPVKTTSDLLLVMSNLYSLNAGSLTMSEKREFPTVPLVKLGGSFTKVQDYLRRFESIPDMLELDHLTVSGDVTFGKNVSLKGTVIIIANHGDRIDIPPGAVLENKIVSGNLRILDH

SEQ ID NO: 1679 - protein, 516 aa, Strongylocentrotus purpuratus
  misc_feature (64)..(481): Pfam Name: UDPGP Pfam Description: UTP--glucose-1-phosphate uridylyltransfera
  misc_feature (1)..(516): Public GI ID no. 72006253
  misc_feature (1)..(516): Bit score of 659.3 for HMM based on sequences of Figure 17
  misc_feature (1)..(516): Functional Homolog Of SEQ ID NO. 1599
MPFGQDGDAYASLLMNQGSGLKRSPSQKEFQSQARRDAERHLALEMDKLLDTCPEESRPAIGKQFEGYKQLFAQFLEEAGTAAAVDWDDILPPPADAVIPYNQLPNYDPALAREYLDKLVVIKLNGGLGTSMGCQGPKSVISVRNELTFLDLTVRQIEHLNKTYGCDVPLVLMNSFNTDEDTSKVLRKYGNINIKIHTFQQSRYPRINKESLLPIAKTAVVNGDNIENWYPPGHGDIYESFSNSGLLDTFIKQGKEYLFLANIDNQGATVDLRILTLLMNEKNREMVMELTDKTRADVKGGTLIQYHDKLRLLEIAQVPKWHVDDFKSVSKFKIFNTNNLWIKLDAIKRVVENKSLSMEIIVNNKTLDNGLNVIQLERAVGAAMQNFDNPLGVNVPRSRFLPVKKTQDLLLIMSNLYLLKSGTLGMSPLRQFPSTPIIKLGTHFDKVRDFLKRFASIPNLLELDHLTVSGDVTFGKGVVLKGTVIIIANHGERIDIPPGAILENKIVSGNLRILDH

SEQ ID NO: 1680 - protein, 508 aa, Sus scrofa
  misc_feature (54)..(473): Pfam Name: UDPGP Pfam Description: UTP--glucose-1-phosphate uridylyltransfera
  misc_feature (1)..(508): Public GI ID no. 47522786
  misc_feature (1)..(508): Bit score of 654.1 for HMM based on sequences of Figure 17
  misc_feature (1)..(508): Functional Homolog Of SEQ ID NO. 1599
  misc_feature (480)..(480): Xaa is any aa, unknown, or other
MSRFVQDLSKAMSQDGASQFQEVIRQELELSVKKELEKILTTAPSHEFEHTKKDLDGFRKLFHRFLQEKGPSVDWGKIQRPPEDSIQPYEKIKARGLPDNISSVLNKLVVVKLNGGLGTSMGCKGPKSLIGVRNENTFLDLTVQQIEHLNKTYNTDVPLVLMNSFNTDEDTKKILQKYNHCRVKIYTFNQSRYPRINKESLLPVAKDVSYSGENTEAWYPPGHGDIYASFYNSGLLDTFIGEGKEYIFVSNIDNLGATVDLYILNHLMNPPNGRPCEFVMEATNKARADVKGGTLTQYEGKLRLVEIAQVPKPHVDEFKSVSKFKIFNTNNLWISLAAVKRLQEQNAIDMEIIVNPKTLDGGLNVIQLETAVGAAIKSFENSLGINVPRSRFLPVKTTSDLLLVMSNLYSLNAGSLTMSEKREFPTVPLVKLGSSFTKVQDYLRRFESIPDMLELDHLTVSGDVTFGKNVSLKGTVIIIXNHGDRIDIPPGAVLENKIVSGNLRILDH

SEQ ID NO: 1681 - protein, 509 aa, Caenorhabditis briggsae AF16
  misc_feature (57)..(474): Pfam Name: UDPGP Pfam Description: UTP--glucose-1-phosphate uridylyltransfera
  misc_feature (1)..(509): Public GI ID no. 157775599
  misc_feature (1)..(509): Bit score of 636.1 for HMM based on sequences of Figure 17
  misc_feature (1)..(509): Functional Homolog Of SEQ ID NO. 1599
MPPQPVHRLHSLDHKPDESSEEWKTSTKSEALSIMEGELASLLNTSPDAKLDHYKMELSGFRNLFARFLRAKPTVDWSKIEPLPEGAIRPYKSLGTVSAKDIIAAQLRKLVVVKLNGGLGTSMGCKGPKSVISVRNDLTFLDLTMQQIQTLNKTYGVDVPLVLMNSFNTNEDTSKVLKKYSNVKVSVHTFSQSQYPRINRETLLPIVKSLDGDDNECWYPPGHGNFYEAFHNSGLLDKFIADGKEYCFLSNIDNMGATVDLSILNFVLNPQAEQEAPEFLMEVTDKTRADVKGGTLIQYEGRLMLLEIAQVPKDYVDEFKSISKFRIFNTNNLWAKLSAMKRVVTENKLEMEVIVNPKHLDRGLDVIQLETAAGAAIKSFRGAVGVNVPRSRFLPVKKTSDLLLLMSNLYDIDNGSLTLSHQRSFPTTPLVKLGSSFDKVKDYLGRFNGIPDLLELDHLTVSGDVWFGKDVSLKGTVIIIANHGDRIDIPPGSILENKIVSGNLRILEH

SEQ ID NO: 1682 - protein, 472 aa, Candida albicans SC5314
  misc_feature (24)..(437): Pfam Name: UDPGP Pfam Description: UTP--glucose-1-phosphate uridylyltransfera
  misc_feature (1)..(472): Public GI ID no. 68491920
  misc_feature (1)..(472): Bit score of 680.0 for HMM based on sequences of Figure 17
  misc_feature (1)..(472): Functional Homolog Of SEQ ID NO. 1599
MRNALNNLADTVENPEQTTRFENEMDNFFTLFRRYLTEKASGSTLDWDKIRSPSSDEVVEYGDLNSANNSANLSKLAVLKLNGGLGTSMGCVGPKSVIEVRDGNNFLDLAVRQIEHLNRKYDADVPLLLMNSFNTDADTEKIIKKYQSHRIRVKTFNQSRFPRIYKDSLLPVPESFDDSLEAWYPPGHGDLFEALVQSGELDALLAQGREILFVSNGDNLGATVDSKILDHMIETGAEYIMELTPKTRADVKGGTLINYQGEVRLLEIAQVPKEHVEEFKSIKKFKYFNTNNLWINLRAIKKLVEANAIEVEIIPNQKTISHGKSDINVLQLETAVGAAIRHFKGAHGVVVPRSRFLPVKTCSDLLLVKSDLFYLEHGALVLDPTRDGFSNPLIKLGSHFKKVSGFQSRIPYIPKILELDHLTITGNVTIGKGVQLKGTVIIVCNDGDKIDIPNGAILENVVVTGNLTILEH

SEQ ID NO: 1683 - protein, 502 aa, Vanderwaltozyma polyspora DSM 70294
  misc_feature (54)..(467): Pfam Name: UDPGP Pfam Description: UTP--glucose-1-phosphate uridylyltransfera
  misc_feature (1)..(502): Public GI ID no. 156848676
  misc_feature (1)..(502): Bit score of 669.5 for HMM based on sequences of Figure 17
  misc_feature (1)..(502): Functional Homolog Of SEQ ID NO. 1599
MATTAPKKHIKTHSTYAFESNTSNVAASQMRNVLNKLADKVDVSDPSHVRFENELDSFFSLFRRYLVEKSSGNTLDWDKIKSPNPEEVVDYKVIEQQPENVSNLSKLAVLKLNGGLGTSMGCVGPKSVIEVRDGNTFLDLSVRQIEYLNRQYDSDVPLLLMNSFNTDKDTEHLIKKYSANRIRIRSFNQSRFPRVYKDSLLPVPTDYNDSLDSWYPPGHGDLFESLYASGELDALISQGREILFVSNGDNLGATVDLKILNHMIETDAEYIMELTDKTRADVKGGTLISYDGQVRLLEVAQVPKEHIDDFKNIRKFKNFNTNNLWINLKAVKRLVESSALAMEIIPNEKTISRKGMDVTVLQLETACGAAIRHFGGAHGVVVPRSRFLPVKTCSDLLMVKSDLFYLQHGALKLDPTRFGPNPLIKLGSHFKKVSGFNARISHIPKLLELDHLTITGNVFLGKNVTLKGTVIIVCSDGQKIDIPNGSVLENVVITGNLQILEH

SEQ ID NO: 1684 - protein, 500 aa, Canis familiaris
  misc_feature (43)..(465): Pfam Name: UDPGP Pfam Description: UTP--glucose-1-phosphate uridylyltransfera
  misc_feature (1)..(500): Public GI ID no. 73969767
  misc_feature (1)..(500): Bit score of 653.6 for HMM based on sequences of Figure 17
  misc_feature (1)..(500): Functional Homolog Of SEQ ID NO. 1599
MSQDGASQFQEVIRQELELSVKKELEKILTTAPSHEFEHTKKDLDGFRKLFHRFLQEKGPSVDWGKIQRPPEDSIQPYEKIKARGLPDNISSVLNKLVVVKLNGGLGTSMGCKGPKSLIGVRNENTFLDLTVQQIEHLNKTYNTDVPLVLMNSFNTDEDTKKILQKYNHCRVKIYTFNQSRYPRINKESLLPVAKDVSYSGENTEAWYPPGHGDIYASFYNSGLLDTLIGEGKEYIFVSNIDNLGATVDLYILNHLMNPPNGKPCEFVMEVTNKTRADVKGGTLTQYEGKLRLVEIAQVPKAHVDEFKSVSKFKIFNTNNLWISLAAVKRLQEQNAIDMEIIVNPKVSLRCSSCLNVIQLETAVGAAIKSFENSLGINVPRSRFLPVKTTSDLLLVMSNLYSLNAGSLTMSEKREFPTVPLVKLGSSFTKVQDYLRRFESIPDMLELDHLTVSGDVTFGKNVSLKGTVIIIANHGDRIDIPPGAVLENKIVSGNLRILDH

SEQ ID NO: 1685 - protein, 509 aa, Caenorhabditis elegans
  misc_feature (57)..(474): Pfam Name: UDPGP Pfam Description: UTP--glucose-1-phosphate uridylyltransfera
  misc_feature (1)..(509): Public GI ID no. 17554108
  misc_feature (1)..(509): Bit score of 634.2 for HMM based on sequences of Figure 17
  misc_feature (1)..(509): Functional Homolog Of SEQ ID NO. 1599
MGPQPVHRLHSLDHKPDESSEEWKTSTKLEALGSMEGELAHLLSTCKPETLNHNKTELSGFRNLFARFLRAKPTVDWSKIEPLPEGAIRPYKSLGHVVDKELIASQLRKLVVVKLNGGLGTSMGCKGPKSVISVRNDLTFLDLTMQQIQTLNKTYGVDVPLVLMNSFNTNEDTQKVLKKYANVKVSVHTFSQSQYPRINRETLLPIVKSLEADDNECWYPPGHGNFYEAFHNSGLLDKFLADGKEYCFLSNIDNMGATVDLSILNFVLNPSPDQTAPEFLMEVTDKTRADVKGGTLIQYEGRLMLLEIAQVPKDYVDEFKSISKFRIFNTNNLWAKLDAMRKIVVENKLEMEVIVNPKHLDRGLDVIQLETAAGAAIKSFSGAVGVNVPRSRFLPVKKTSDLLLLMSNLYDIDNGSLTLSHQRSFPTTPLVKLGSSFDKVKDYLGRFNGIPDLLELDHLTVSGDVWFGKDVSLKGTVIIIANHGDRIDIPPGSILENKIVSGNLRILEH

SEQ ID NO: 1686 - protein, 492 aa, Pyrenophora tritici-repentis Pt-1C-BFP
  misc_feature (42)..(457): Pfam Name: UDPGP Pfam Description: UTP--glucose-1-phosphate uridylyltransfera
  misc_feature (1)..(492): Public GI ID no. 189208247
  misc_feature (1)..(492): Bit score of 685.4 for HMM based on sequences of Figure 17
  misc_feature (1)..(492): Functional Homolog Of SEQ ID NO. 1599
MDSLQAFENTSTNVAASQMRNALNKLADTVTDPAEKKYFETEMDNFFALFRRYLNDKAKGTAIDWNRIAPPKAEQVVNYDDLANSEGVEYLNKLAVVKLNGGLGTSMGCVGPKSVIEVRDGMSFLDLSVRQIEYLNRTYDVNVPFVLMNSFNTDTDTASIIKKYEGHNIDILTFNQSRYPRILKDSLLPAPKENKSDIANWYPPGHGDVFESLYNTGMIDKLMDRGIEYIFLSNADNLGAVVDLRILQHMVDSKAEYIMELTDKTKADVKGGTIIDYEGSVRLLEIAQVPKEHVNEFKSIKKFKYFNTNNIWMNLAAIKRVVEANELAMEIIPNGKSIPADKKGEADISVLQLETAVGAAIKHFKNAHGVNVPRRRFLPVKTCSDLMLVKSDLYTLQHGQLVIDPNRFGPAPLIKLGSDFKKVSSFQARIPSIPKIVELDHLTITGPVNLGRGVTLKGTVIIVATEGSTIDIPPGSILENVVVQGSLRLLEH

SEQ ID NO: 1687 - protein, 515 aa, Chaetomium globosum CBS 148.51
  misc_feature (65)..(480): Pfam Name: UDPGP Pfam Description: UTP--glucose-1-phosphate uridylyltransfera
  misc_feature (1)..(515): Public GI ID no. 116181760
  misc_feature (1)..(515): Bit score of 678.5 for HMM based on sequences of Figure 17
  misc_feature (1)..(515): Functional Homolog Of SEQ ID NO. 1599
MAAQTIKSALPSHLKPGNGDEAEFAKRHHGKTRSHMAFENTSTNIAAAQMRNALTNLAETLFETEMDNFFSLFRRYLNDKAKGNEVSWDRIAPPAEGQVVDYDDLANSESVNFLNKLAVLKLNGGLGTSMGCVGPKSVIEVRDGMSFLDMSVRQVEYLNRTYGSNVPILLMNSFNTDEDTAAIIKKYEGHNVNVLTFNQSRYPRIYKDSLLPVPKSVDSAVHDWYPPGHGDVFESLYNSGILDKLLDRGIEIIFLSNADNLGAVVDLRILQHMVESEAEYIMELTNKTKADVKGGTIIDYEGSVRLLEIAQVPKEHVNEFKSIKKFKYFNTNNIWMNLKAIKRVVENDELEMEIIPNGKTIPGDKKGESDISILQLETAVGAAIKHFKNAHGVNVPRRRFLPVKTCSDLMLVKSDLYTVKHGQLQMSANRFGDAPLIKLGGDFKKVSDFQKRIPSIPKIIELDHLTITGAVNLGRGVTLKGTVIIVATEGQTIDIPPGSILENVVVQGSLRLLEH

SEQ ID NO: 1688 - protein, 495 aa, Trichoplax adhaerens
  misc_feature (44)..(460): Pfam Name: UDPGP Pfam Description: UTP--glucose-1-phosphate uridylyltransfera
  misc_feature (1)..(495): Public GI ID no. 196014839
  misc_feature (1)..(495): Bit score of 684.3 for HMM based on sequences of Figure 17
  misc_feature (1)..(495): Functional Homolog Of SEQ ID NO. 1599
MWNVAEFQAQAKRDSEIAMQHDLDAMLQTAPADQKEASTIMGKELNGFSKLFSRYIENKGSAIKWDKIRPLPEGAVRKYDDIKVRESEVSRALLDQLVVLKLNGGLGTSMGCTGPKSIITVHTNATFLDLTIQQIEFLNDKYNASVPLVLMNSFNTHEDTLKVLRKYKSARVDIHCFNQSRYPRIYSDNLHPVASQFDDHHDCWYPPGHGDTYAAFSNSGLLEKFLAMGKRYVFISNIDNLGAVVDMSILNYLASPTDGERCDFVMEVTDKTRSDVKGGTLISYEDKLRLLEIAQVPKDHVDEFKSIKKFQIFNTNNIWIDMKAIHELYSSNALDMEIIVNNKTMDTTGAHVIQLETAIGAAIKCFNGAHGINVPRSRFLPVKKTADLLLAMSNLYTLRCGTLEMNPARSFPTVPLIKLGDEFKKVRDFLRRFEDIPDILELDHLTVSGDVTFGKNVSLKGTVIIIANFGERIDIPSGAVLENKIVTGNLRILEH

SEQ ID NO: 1689 - protein, 500 aa, Kluyveromyces lactis NRRL Y-1140
  misc_feature (51)..(465): Pfam Name: UDPGP Pfam Description: UTP--glucose-1-phosphate uridylyltransfera
  misc_feature (1)..(500): Public GI ID no. 50312377
  misc_feature (1)..(500): Bit score of 673.5 for HMM based on sequences of Figure 17
  misc_feature (1)..(500): Functional Homolog Of SEQ ID NO. 1599
MSTVKKHTKTHSTYAFESNTNSVAASQMRNALNKLVDSVNDDTVRSKFENEMDSFFSLFRRYLAEKSSGNTLDWDKIKSPSADEVVDYKVVESSQAENVSNLDKLAVLKLNGGLGTSMGCVGPKSVIEVRDGNTFLDLSVRQIEYLNRQYDSDVPLLLMNSFNTDADTEHLIKKYSANRIRIRSFNQSKFPRVLRDSLLPVPQSFNDALDSWYPPGHGDLFESLHSSGELDALLAQGREILFVSNGDNLGATVDLKILNHMIETGAEYIMELTDKTRADVKGGTLISYDGQVRLLEVAQVPKEHVDEFKNIRKFKNFNTNNLWINLRAIKRLIESQALSMEIIPNQKTITRNGHEINVLQLETACGAAIRHFKGAHGVVVPRSRFLPVKTCSDLLMVKSDLFFLEHGALKIDPTRFGANPLIKLGSHFKKVSGFNCHIPHIPKIIELDHLTITGNVYLGKNVTLKGTVIIVCSEGQRIDIPNGSVLENVVITGNLQILEH

SEQ ID NO: 1690 - protein, 513 aa, Gibberella zeae PH-1
  misc_feature (63)..(478): Pfam Name: UDPGP Pfam Description: UTP--glucose-1-phosphate uridylyltransfera
  misc_feature (1)..(513): Public GI ID no. 46107282
  misc_feature (1)..(513): Bit score of 680.2 for HMM based on sequences of Figure 17
  misc_feature (1)..(513): Functional Homolog Of SEQ ID NO. 1599
MANIIKSALPTHLKPNTGDEQGNERRHGKTRSHMAFENTSTNVAAAQMRNALTNLAETLFETEMDNFFALFRRYLNDKAKGNAVDWDRIAPPAQGQVVDYDDLANTESVQFLNKLAVLKLNGGLGTSMGCVGPKSVIEVRDGMSFLDLSVRQIEYLNRTYDVNVPFILMNSFNTNDDTAAIIKKYEGHNVDILTFNQSRYPRVYKDSLLPVPKDNDSPINEWYPPGHGDVFESLYNSGILDKLLERGIEIVFLSNVDNLGAVVDLRILQHMMETDSEYIMELTNKTKADVKGGTIIDYEGSVRLLEIAQVPKEHVNEFKSIKKFKYFNTNNIWLNLKAIKRVVENDELEMEIIPNGKTIPGDKKGESDISIVQLETAVGAAIRHFNNAHGVNVPRRRFLPVKTCSDLMLVKSDLYTLKHGQLQMSAARFGDAPLIKLGGDFKKVSDFQKRIPSIPKVLELDHLTITGAVNLGRGVTLKGTVIIVATEGSTIDVPPGSILENVVVQGSLRLLEH

SEQ ID NO: 1691 - protein, 471 aa, Debaryomyces hansenii CBS767
  misc_feature (24)..(436): Pfam Name: UDPGP Pfam Description: UTP--glucose-1-phosphate uridylyltransfera
  misc_feature (1)..(471): Public GI ID no. 50427861
  misc_feature (1)..(471): Bit score of 668.4 for HMM based on sequences of Figure 17
  misc_feature (1)..(471): Functional Homolog Of SEQ ID NO. 1599
MRNALNNLADTVQDSEKQSRFENEMDSFFALFRRYLTDKAAGSTLDWEKVKSPSPDEVVQYKSLSENGANNLDKLAVLKLNGGLGTSMGCVGPKSVIEVRDGNTFLDLSVRQIEHLNRKYDADVPLLLMNSFNTDADTEKIIKKYQGHRIRVKTFNQSRFPRIFKDSLLPVPQSFDDDLDSWYPPGHGDLFESLISSGELDSLLEQGREVLFVSNGDNLGATVDSKILDHMIDTGAEYIMELTDKTRADVKGGTLINYEGQVRLLEIAQVAKEHVEDFKSIKKFKYFNTNNLWINLRAIKKLVEADGIQAEIIPNQKTISKGSSDINVLQLETAVGAAIKHFNKAHGVVVPRSRFLPVKTCSDLLLVKSDLFFLEHGALKLDPVRDGFANPLIKLGSHFKKVSGFQSRIGHMPRILELDHLTITGNVTLGKNVTLKGTVIIVCNDGDKIDIPNGSILENVVVTGNLTILEH

SEQ ID NO: 1692 - protein, 506 aa, Schizosaccharomyces pombe
  misc_feature (56)..(471): Pfam Name: UDPGP Pfam Description: UTP--glucose-1-phosphate uridylyltransfera
  misc_feature (1)..(506): Public GI ID no. 19075632
  misc_feature (1)..(506): Bit score of 684.6 for HMM based on sequences of Figure 17
  misc_feature (1)..(506): Functional Homolog Of SEQ ID NO. 1599
MDLAPRPLGRQHSKSQSAFAFDNTATSIAASTMKNELNHLASTVKDPLAKKAFQKEMDNFFSLFSRYLQEDARGSEINWDLVESPKPEQVVEYDTITEAGGLSRDYLNKLAVLKLNGGLGTTMGCVGPKSIIEVRDGNSFLDLSVRQIEHLNRKYNVNVPFVLMNSFNTDEATAKVIKKYEAHKIDILTFNQSRYPRVHKETLLPVPHTADSAIDEWYPPGHGDVFEALTNSGIIDTLIAQGKEYLFVSNIDNLGAVVDLNILNHMVETNAEYLMELTNKTKADVKGGTLIDYDGNVRLLEIAQVPPQHVEEFKSIKKFKYFNTNNLWFHLPSVKRVVNNHELSMEIIPNKKTIKHKGENINIIQLETAAGAAIRHFKNAHGVNVPRRRFLPVKTCSDLLLVKSDLYSINHGQVEMNPRRFGGTAPLVKLGAHFKKVADFSAHIPSIPKILELDHLTITGDVNIGRNVTLKGTVIIVASDANRIDIPNGSVLENCVITGNLNILEH

SEQ ID NO: 1693 - protein, 522 aa, Podospora anserina DSM 980
  misc_feature (72)..(487): Pfam Name: UDPGP Pfam Description: UTP--glucose-1-phosphate uridylyltransfera
  misc_feature (1)..(522): Public GI ID no. 171696094
  misc_feature (1)..(522): Bit score of 676.5 for HMM based on sequences of Figure 17
  misc_feature (1)..(522): Functional Homolog Of SEQ ID NO. 1599
MAQAIKSALPSHLKPGNGDEQEFAKRHHGKTRSHMAFENTSTNIAAAQMRNALTNLAETVKDPKEKKLFETEMDNFFSLFRRYLNDKAKGNEVSWDRIAPPAAGQVVDYEDLAHSESVGFLNKLAVLKLNGGLGTSMGCVGPKSVIEVRDGMSFLDMSVRQVEHLNRSYGSNVPILLMNSFNTHDDTAAIIKKYEGHNVDILTFNQSRYPRIFKDSLLPVPKSFDSALHDWYPPGHGDVFESLYNSGVLDQLIDRGIEIIFLSNADNLGAVVDLRILQHMVESEAEYIMELTNKTKADVKGGTIIDYEGSVRLLEIAQVPKEHVNEFKSIKKFKYFNTNNIWMNVKAIKRVVENNELEMEIIPNGKTIPGDKKGESDISILQLETAVGAAIKHFKNAHGVNVPRRRFLPVKTCSDLMLVKSDLYTVKHGQLQMSTARFGDAPLIKLGGDFKKVSDFQKRIPSIPKIIELDHLTITGAVNLGRGVVLKGTVIIVATEGQTIDIPPGSILENVVVQGSLRLLEH

SEQ ID NO: 1694 - protein, 471 aa, Pichia stipitis CBS 6054
  misc_feature (24)..(436): Pfam Name: UDPGP Pfam Description: UTP--glucose-1-phosphate uridylyltransfera
  misc_feature (1)..(471): Public GI ID no. 150863853
  misc_feature (1)..(471): Bit score of 675.5 for HMM based on sequences of Figure 17
  misc_feature (1)..(471): Functional Homolog Of SEQ ID NO. 1599
MRNALNNLADTVENPDHQQRFENEMDSFFALFRRYLADKASGSTLDWEKIKSPSPNEVVQYNSLNESAATNLSKLAVLKLNGGLGTSMGCVGPKSVIEVRDGNTFLDLSVRQIEHLNRKYDADVPLLLMNSFNTDNDTAKIIKKYQGHRIRVKTFNQSRFPRIYKDSLLPVPDSYDDELDSWYPPGHGDLFESLVQSGELDALLAQGREILFVSNGDNLGATVDTKILDHMIETGAEYIMELTNKTRADVKGGTLINYEGSVRLLEIAQVPKEHVEEFKSIKKFKYFNTNNLWINLRAIKKLVEHNAIEAEIIPNQKTISKGNVDINVLQLETAVGAAIRHFQGAHGVVVPRSRFLPVKTCSDLLLVKSDLFFLEHGALKLDPTRDGFANPLIKLGSHFKKVSGFQSRVPHMPKILELDHLTITGNVTLGRGVTLKGTVIIVCNDGDKIDIPNGSILENVVVTGNLTILEH

SEQ ID NO: 1695 - protein, 500 aa, Nematostella vectensis
  misc_feature (50)..(465): Pfam Name: UDPGP Pfam Description: UTP--glucose-1-phosphate uridylyltransfera
  misc_feature (1)..(500): Public GI ID no. 156405246
  misc_feature (1)..(500): Bit score of 682.4 for HMM based on sequences of Figure 17
  misc_feature (1)..(500): Functional Homolog Of SEQ ID NO. 1599
METKDKVVDHVNVQQFKSLSRKDAFERMETEINKLIEFAPAPQKDLASKEMNNFKGLFKRYLQETGPSVVWEKIHPPPKGLVVNYDEVSHAEPADIKAALDKLVVIKLNGGLGTTMGLVGPKSLISVTQELTFLDLNIQQIEHLNNKYGSNVPLVLMNSFNTHEETVKTLRKYGAVNVRIHCFNQSGHPRIATESLLPLASTYDKNPNSWYPPGHGDIYESFYNSGLLQKFIDEGKEYMFVANIDNLGATVDLHILNYLLSESRKAPCEFVMEVTDKTRADVKGGTLIEYDNRLRLLEIAQVPKQHVDEFKSVSKFRIFNTNNLWVNLKAVKRLVEKQAMDMEIIVNKKTLDDGVRIIQLETAVGAAMKNFEGAVGINVPRRRFLPVKKTSDLLLVKSNLYHMSHGVLIMSPLRQFPSVPLVQLGSFFKKVNDFRDRFETIPDLLELDHLTVSGDVTFGKGVILKGTVIIIANHGDRIDIPAGAILENKIVSGNLRILEH

SEQ ID NO: 1696 - protein, 513 aa, Aedes aegypti
  misc_feature (58)..(478): Pfam Name: UDPGP Pfam Description: UTP--glucose-1-phosphate uridylyltransfera
  misc_feature (1)..(513): Public GI ID no. 157110519
  misc_feature (1)..(513): Bit score of 642.8 for HMM based on sequences of Figure 17
  misc_feature (1)..(513): Functional Homolog Of SEQ ID NO. 1599
MTGAIDILLKVRGHQRVPSDTKEFHEATKRDALLRLRKDLDNLLQTADDAKKTILQKEMCGFEALFHRFLQEDGPSVEWDRIQKLPQDAVKDYSSLKTPQESEIREMLNKLVVIKLNGGLGTSMGCHGPKSVIPVRNDLTFLDLTVQQIEHLNKTYGATVPLVLMNSFNTDDDTEKVIRKYKGFQVQIYTFNQSCYPRISRDSLLPVAKDFTIENDIEAWYPPGHGDFYQSFQNSGLLKKFLAEGREYCFLSNIDNLGATVDINILNRLLGDDRQGDKPIEFVMEVTDKTRADVKGGTLIHYENKLRLLEIAQVPKEHVDDFKSVKTFKFFNTNNIWARLESIERVLDAHTMNMEIIVNNKTLDNGMRVIQLETAVGAAMKCFDGGIGINVPRSRFLPVKKTSDLLLVMSNLYSLKYGSLVMSPQRMFPTTPLVKLGDNHFSKVKEFLGRFANIPDLIELDHLTVSGDVTFGRGVSLRGTVIIIANHGDRIDIPAGAILENKIVSGNMRILDH

SEQ ID NO: 1697 - protein, 521 aa, Magnaporthe grisea 70-15
  misc_feature (71)..(486): Pfam Name: UDPGP Pfam Description: UTP--glucose-1-phosphate uridylyltransfera
  misc_feature (1)..(521): Public GI ID no. 145613451
  misc_feature (1)..(521): Bit score of 675.9 for HMM based on sequences of Figure 17
  misc_feature (1)..(521): Functional Homolog Of SEQ ID NO. 1599
MASNVAKAVKSALPSHLKPESAETKGDSEFAPRHHGKTQSHMAFENASTNIAAAQMRNALTALAETLFETEMDNFFALFRRFVNDKAKGSTVDWDRIAPPAQGQVVDYDELANSESVEFLSKLAVLKLNGGLGTSMGCVGPKSVIEVRDGMSFLDLSVRQVEHLNRTYGTNVPFILMNSFNTDEDTASIIKKYEGHNVDIMTFNQSRYPRILKDSLLPVPKSYDSNIDAWYPPGHGDVFESLYNSGVLDKLIERGIEYIFLSNVDNLGAVVDLRILQHMVETGAEYIMELTNKTKADVKGGTIIDYEGKVRLLEIAQVPKEHVNEFKSIKKFRYFNTNNIWMNVQAIKRVVENHELEMEIIPNGKTIPGDKKGESDISIIQLETAVGAAIRHFNNAHGVNVPRRRFLPVKTCSDLMLVKSDLYTVKHGQLQMSAARFGDAPLIKLGTDFKKVSDFQKRISSIPKMIELDHLTITGAVNLGRGVTFKGTVIIVATEGQTIDIPPGSILENVVVQGSLRLLEH

SEQ ID NO: 1698 - protein, 504 aa, Laccaria bicolor S238N-H82
  misc_feature (59)..(469): Pfam Name: UDPGP Pfam Description: UTP--glucose-1-phosphate uridylyltransfera
  misc_feature (1)..(504): Public GI ID no. 170097792
  misc_feature (1)..(504): Bit score of 671.4 for HMM based on sequences of Figure 17
  misc_feature (1)..(504): Functional Homolog Of SEQ ID NO. 1599
MSSSLMPRSDSFNARVRGTSHIDFKTATTGVAAKAMRNEISRLVATVDDPATKKAFDTEMQSFFYLFTRYLAERAKSVDLDWDRIKSPAADQIVPYADLPKPKDTKNLSKLAVLKVNGGLGTSMGMTGAKSALEVKDDMTFLDLTVRQIEHLNTTSRVDVPLILMTSFNTHDDTLRIIKKYANQQLRITTFNQSRYPRIFKETLLPSPKRADDDKKNWYPPGHGDLYNALLHSGVLDQLLAEGKEYLFVSNSDNLGAVVDESILQHMIDTKAEFLMEVTDKTKADIKGGTLIDYDGSIRLLEIAQVPSEHVEDFKSIRKFKIFNTNNLWINLKALKNVMENEGMELEIIINPKTTDDGHAVVQLETAAGAAIKHFKNAHGINVPRKRFLPVKSCSDLLLIKSDIYSLQHGQLVINEQRMFETTPVIKLGDHFKKIQQFQKRFKKIPKILELDHLTVTGDVYFGRNVTLRGTVIVVANEGQRIDIPDGCILENRLLSGNLNMIEL

SEQ ID NO: 1699 - protein, 561 aa, Phaeosphaeria nodorum SN15
  misc_feature (111)..(526): Pfam Name: UDPGP Pfam Description: UTP--glucose-1-phosphate uridylyltransfera
  misc_feature (1)..(561): Public GI ID no. 169613428
  misc_feature (1)..(561): Bit score of 671.1 for HMM based on sequences of Figure 17
  misc_feature (1)..(561): Functional Homolog Of SEQ ID NO. 1599
MASRAIPSHLKPSSAAGKDEGGFNSQRHHGKSQSHVAFENTSTNVAASQMRNALNKLADTVEDPAEKKVSLMPKHTPLYLMDSRRDSHELLAASDGYGKVHVRHANYFETEMDNFFALFRRYLNDKAKGTAIDWNRIAPPKAEQVVNYDDLANSEAVEYLNKLAVVKLNGGLGTSMGCVGPKSVIEVRDGMSFLDLSVRQIEYLNRTYDVNVPFVLMNSFNTDTDTASIIKKYEGHNIDILTFNQSRYPRILKDSLLPAPKNNASDIANWYPPGHGDVFESLYNTGMLDKLLERGIEIIFLSNADNLGAVVDLRILQHMVDSKAEYIMELTDKTKADVKGGTIIDYEGSVRLLEIAQVPKEHVNEFKSIKKFKYFNTNNIWMDVAAIKRVVEANELAMEIIPNGKSIPADKKGEADISVLQLETAVGAAIKHFKNAHGVNVPRRRFLPVKTCSDLMLVKSDLYTLQHGQLVIDPNRFGPAPLIKLGSDFKKVSSFQSRIPSIPKIVELDHLTITGPVNLGRGVTLKGTVIIVATEGSTIDIPPGSVLENVVVQGSLRLLEH

SEQ ID NO: 1700 - protein, 525 aa, Botryotinia fuckeliana B05.10
  misc_feature (75)..(490): Pfam Name: UDPGP Pfam Description: UTP--glucose-1-phosphate uridylyltransfera
  misc_feature (1)..(525): Public GI ID no. 154301169
  misc_feature (1)..(525): Bit score of 669.1 for HMM based on sequences of Figure 17
  misc_feature (1)..(525): Functional Homolog Of SEQ ID NO. 1599
MAQALKSALPSHLKPSSLSPNDNGEFARKHHGKTQSHMAFENTSTSVAASQMRNALNNLADTVEDPEEKKLFETEMDNFFALFRRYLNDKAKGNQLDWDRIAPPAQNQVVDYNALANSESVGFLNKLAVLKLNGGLGTSMGCVGPKSVIEVRDGMSFLDLSVRQIEYLNRTYNVNVPFVLMNSFNTDDDTSNIIKKYEGHNIDILTFNQSRYPRILKDSLLPAPKTFDSQISDWYPPGHGDVFESLYNSGILDTLIKRGVEIVFLSNVDNLGAVVDLRILQHMVETKSEYIMELTDKTKADVKGGTIIDYEGSVRLLEIAQVPKEHTNEFKSIKKFKYFNTNNIWLNLQAVKRIVENNELEMEIIPNNKSIPADKKGESDVSIVQLETAVGAAIRHFHNAHGVNVPRRRFLPVKTCSDLMLVKSDLYSLKHGQLQIDPSRFGPAPLIKLGNDFKKVSDFQKRISSIPRILELDHLTITGAVNLGRGVTLKGTVIIVATEGQTIDIPPGSILENVVVQGSLRLLEH

SEQ ID NO: 1701 - protein, 521 aa, Neurospora crassa N150
  misc_feature (71)..(486): Pfam Name: UDPGP Pfam Description: UTP--glucose-1-phosphate uridylyltransfera
  misc_feature (1)..(521): Public GI ID no. 164427705
  misc_feature (1)..(521): Bit score of 661.7 for HMM based on sequences of Figure 17
  misc_feature (1)..(521): Functional Homolog Of SEQ ID NO. 1599
MAQAIRSALPDRLMPSNGDEEFAKRHHGKTRSHMAFENTSTSIAAAQMRNALTKLAETVKDPDQKKLFETEMDNFFSLFRRYLNDKAKGNEVNWDKIAPPAPHQIVDYESLANNNSVDFLNKLAVLKLNGGLGTSMGCVGPKSVIEVRDGMSFLDMSVRQVEHLNRTYGSNVPILLMNSFNTDDDTAAIIKKYEGHNVDILTFNQSRYPRIYKDSLLPVPKSFDSPLHDWYPPGHGDVFESLYNSGILDKLIERGIEIIFLSNADNLGAVVDLRILQHMVETDAEYIMELTNKTKADVKGGTIIDYEGSVRLLEIAQVPKEHVNEFKSIKKFKYFNTNNIWMNVQAVKRVVENNELELEIIPNEKTIPGDKKGESDISIVQLETAVGAAIKHFKGAHGVNVPRRRFLPVKTCSDLMLVKSDLYTVKHGQLQMSSARFGDAPLIKLGNDFKKVSDFQKRIPSIPKIIELDHLTITGAVNLGRGVTLKGTVIIVATEGQTIDIPPGSILENVVVQGSLRLLEH

SEQ ID NO: 1702 - protein, 502 aa, Dictyostelium discoideum AX4
  misc_feature (56)..(467): Pfam Name: UDPGP Pfam Description: UTP--glucose-1-phosphate uridylyltransfera
  misc_feature (1)..(502): Public GI ID no. 66816096
  misc_feature (1)..(502): Bit score of 660.4 for HMM based on sequences of Figure 17
  misc_feature (1)..(502): Functional Homolog Of SEQ ID NO. 1599
MMKPDLNSPLPQSPQLQAFGSRSSDLATEDLFLKKLEAISQTAPNETVKNEFLNKEIPSINKLFTRFLKNRKKVIDWDKINPPPADMVLNYKDLPAITEQRTSELASKLAVLKLNGGLGTTMGCTGPKSVIEVRSEKTFLDLSVQQIKEMNERYNIKVPLVLMNSFNTHQETGKIIQKYKYSDVKIHSFNQSRFPRILKDNLMPVPDKLFGSDSEWYPPGHGDVFFALQNSGLLETLINEGKEYLFISNVDNLGAVVDFNILEAMDKNKVEYIMEVTNKTRADVKGGTLIQYEGKAKLLEIAQVPSSKVEEFKSIKKFKIFNTNNIWVNLKAMDRILKQNLLDDMDIIINPKVADGKNIIQLEIAAGAAIEFFNNARGVNVPRSRFLPVKSTSDLFIVQSNLYSLEKGVLVMNKNRPFTTVPLVKLGDNFKKVSDYQARIKGIPDILELDQLTVSGDITFGPNMVLKGTVIIVANHGSRIDIPEGSEFENKVVSGNLHCGAL

SEQ ID NO: 1703 - protein, 525 aa, Sclerotinia sclerotiorum 1980
  misc_feature (75)..(490): Pfam Name: UDPGP Pfam Description: UTP--glucose-1-phosphate uridylyltransfera
  misc_feature (1)..(525): Public GI ID no. 156057023
  misc_feature (1)..(525): Bit score of 667.9 for HMM based on sequences of Figure 17
  misc_feature (1)..(525): Functional Homolog Of SEQ ID NO. 1599
MAQALKSALPSHLKPSSLSPNDNGEFARKHHGKTQSHMAFENTSTSVAASQMRNALNSLADTVSDPEEKKLFETEMDNFFALFRRYLNDKAKGNQLDWDRIAPPAQNQVVDYNELANSESVGFLNKLAVLKLNGGLGTSMGCVGPKSVIEVRDGMSFLDLSVRQIEYLNRTYNVNVPFVLMNSFNTDDDTSSIIKKYEGHNIDILTFNQSRYPRILKDSLLPAPKSFDSPISDWYPPGHGDVFESLYNSGILDTLIKRGVEIVFLSNVDNLGAVVDLRILQHMVETKAEYIMELTDKTKADVKGGTIIDYEGSVRLLEIAQVPKEHTNEFKSIKKFKYFNTNNIWLNLQAVKRIVENNELEMEIIPNNKSIPADKKGESDVSIVQLETAVGAAIRHFHNAHGVNVPRRRFLPVKTCSDLMLVKSDLYSLKHGQLQIDPSRFGPAPLIKLGNDFKKVSDFQKRISSIPRILELDHLTITGAVNLGRGVTLKGTVIIVATEGQTIDIPPGSILENVVVQGSLRLLEH

SEQ ID NO: 1704 - protein, 513 aa, Apis mellifera
  misc_feature (60)..(478): Pfam Name: UDPGP Pfam Description: UTP--glucose-1-phosphate uridylyltransfera
  misc_feature (1)..(513): Public GI ID no. 66536233
  misc_feature (1)..(513): Bit score of 643.2 for HMM based on sequences of Figure 17
  misc_feature (1)..(513): Functional Homolog Of SEQ ID NO. 1599
MHDFSKLDGDDGSLKRFMKRKDTQAFRERTKRDALNELQHELEKLEATATGDIKEEIHRQFDGFTHLFRRFLQEEGPSLEWDRIQKLPDDAIRDYNSLPTPEGEELKTLLSKLIVIKLNGGLGTSMGCHGPKSVIAVRNGLTFLDLTVQQIEYLNKTYNANVPLILMNSFNTDDDTQRIIRKYKGIDVNIQTFNQSCYPRINRDSLLPTAKHCDIADDIEAWYPPGHGDFYESFRNSGLLKKFIKEGREYCFISNIDNLGATVDFKILKLLLDKREASPLEFVMEVTDKTRADVKGGTLIKYEDKLRLLEIAQVPKDHVDDFKSVKTFKFFNTNNLWIKLSAIERVLEKNSLNMEIIVNNKTFSNGSNIIQLETAVGAAMKSFEGSIGINVPRSRFLPVKKTSDLMLVMSNLYTLRNGSLVMSPQRMFPTTPLIKLGDNHFAKVKEFLTRFPAIPDLLELDHLTVSGDVTFGKGVTLKGTVIIIANHGERIDLPSGTILENKIVSGNLRILNH

SEQ ID NO: 1705 - protein, 513 aa, Drosophila willistoni
  misc_feature (57)..(478): Pfam Name: UDPGP Pfam Description: UTP--glucose-1-phosphate uridylyltransfera
  misc_feature (1)..(513): Public GI ID no. 195442796
  misc_feature (1)..(513): Bit score of 648.3 for HMM based on sequences of Figure 17
  misc_feature (1)..(513): Functional Homolog Of SEQ ID NO. 1599
MLDIPQEAKVRGHQRAPSDSKEFHEVTKRDALRLLENDVERLLKTTEPARRPALQAEMGRFADLFGRFLQEEGPALDWNKIQKLPENAVMNYSNLKSPKNEQNEIRHMLDKLVVIKLNGGLGTSMGCHGPKSVIPVRSDLTFLDLTVQQIEHLNKTYDANVPLVLMNSFNTDEDTEKIIRKYKGFRVQIHTFNQSCFPRVSREHFLPVAKDFDVEKDKEAWYPPGHGDFYDTFRNSGLLKKFIEEGREYCFLSNIDNLGATVDLNILNKLVGEERASTPVEFVMEVTDKTRADVKGGTLIQFENKLRLLEIAQVPNEHVDDFKSVKTFKFFNTNNIWANLSAIDRVLRERTLNMEIIVNNKTLENGTRVVQLETAVGAAMKCFDGAIGVNVPRSRFLPVKKSADLLLVMSNLYTLKNGSLVMSPQRMFPTTPLVKLGDNHFSKVKEFLGRFANIPDIIDLDHLTVSGDVTFGRGVSLRGTVIIIANHGDRIDIPAGAILENKIVSGNMRILDH

SEQ ID NO: 1706 - protein, 523 aa, Coccidioides immitis RS
  misc_feature (73)..(488): Pfam Name: UDPGP Pfam Description: UTP--glucose-1-phosphate uridylyltransfera
  misc_feature (1)..(523): Public GI ID no. 119188835
  misc_feature (1)..(523): Bit score of 664.9 for HMM based on sequences of Figure 17
  misc_feature (1)..(523): Functional Homolog Of SEQ ID NO. 1599
MASRAIPSHLRAPNTESRSAEERSFVRHHGKSQSHMAFEHASTNVAASQMRNALNALSDTVKDPSEKKRFEAEMDNFFSLFRRFLNDKAKGNVLSWDRIAPPQPNQVVEYSELSNSASVDYLKKLAVIKLNGGLGTSMGCVGPKSVIEVREGMSFLDLSVRQIEYLNRTYNVNVPLVLMNSFNTDDDTQSIIKKYEGHNIDIITFNQSRYPRVLKDSLLPAPKDYSSPITDWYPPGHGDVFESLYNSGTLDKLIERGVEIVFLSNADNLGAVVDMRILEHMVTNNSEYIMELTDKTKADVKGGTIIDYEGKARLLEIAQVPKEHVNEFKSIKKFKYFNTNNIWLNLRAIKRVVEESALEMEIIPNEKSIPADKKGEADISIIQLETAVGAAIRFFKGAHGVNVPRRRFLPVKTCSDLMLVKSDLYTLQHGQLVIDPNRFGGAPLIKLGTDFKKVSDFQKRIPSIPRILELDHLTISGAVNLGRGVTLKGTVIIVATEGSTIDIPPGSILENVVVQGSLRILEH

SEQ ID NO: 1707 - protein, 529 aa, Drosophila virilis
  misc_feature (73)..(494): Pfam Name: UDPGP Pfam Description: UTP--glucose-1-phosphate uridylyltransfera
  misc_feature (1)..(529): Public GI ID no. 195377136
  misc_feature (1)..(529): Bit score of 656.5 for HMM based on sequences of Figure 17
  misc_feature (1)..(529): Functional Homolog Of SEQ ID NO. 1599
MLDVPQEAKMTSGIRPIDVLLQRAGMRGHQRAPSDSKEFHEVTKRDALRLLENDVDRLLQTTEPARRPALQAEMGRFADLFGRFLQEEGPALDWNKIQKLPENAVMNYSNLKSPKNEQNEIRNMLDKLVVIKLNGGLGTSMGCHGPKSVIPVRSDLTFLDLTVQQIEHLNKTYDANVPLVLMNSFNTDEDTEKIVRKYKGFRVQIHTFNQSCFPRISREHFLPVAKDFDVEKDMEAWYPPGHGDFYDTFRNSGLLKKFIGEGREYCFLSNIDNLGATVDLNILNKLVGEERASTPFEFVMEVTDKTRADVKGGTLIQMENKLRLLEIAQVPPEHVDDFKSVKTFKFFNTNNIWANLSAIDRVLRERTLNMEIIVNNKTLENGLRVIQLETAVGAAMKCFDGAIGINVPRSRFLPVKKSSDLLLVMSNLYTLKNGSLVMSPQRMFPTTPLVKLGENHFSKVKEFLGRFANIPDIIELDHLTVSGDVTFGRGVSLRGTVIIIANHGDRIDIPAGAILENKIVSGNMRILDH

SEQ ID NO: 1708 - protein, 513 aa, Anopheles gambiae str. PEST
  misc_feature (58)..(478): Pfam Name: UDPGP Pfam Description: UTP--glucose-1-phosphate uridylyltransfera
  misc_feature (1)..(513): Public GI ID no. 118795048
  misc_feature (1)..(513): Bit score of 641.0 for HMM based on sequences of Figure 17
  misc_feature (1)..(513): Functional Homolog Of SEQ ID NO. 1599
MTGAIDLLLSVRGHQRIPSDTKEFHEATKRDALMRLKKDLDHLLETVEESRKTGVQKEMCGFEALYHRFLQEDGPSVEWDRIEKLPEEAVKDYSTLKLPQEAHIRDMLDKLVVVKLNGGLGTSMGCHGPKSVIPVRNDLTFLDMTVQQIEFLNKKYNANVPLVLMNSFNTDVDTEKVIRKYKGFQVQIYTFNQSCYPRISRDSLLPIAKDFDIENDIEAWYPPGHGDFYQSFQNSGLLRKFLEEGREYCFLSNIDNLGATVDIKILNRLIGDDRQGDKPIEFVMEVTDKTRADVKGGTLIHYENKLRLLEIAQVPKEHVDDFKSVKTFKFFNTNNIWARLESIERVLNAKTMNMEIIVNNKTLDNGIRVIQLETAVGAAMKCFDGGIGINVPRSRFLPVKKTSDLLLVMSNLYSLKYGSLVMSPQRMFPTTPLVKLGDNHFSKVKEFLSRFANIPDLIELDHLTVSGDVTFGRGVSLRGTVIIIANHGDRIDIPAGAILENKIVSGNMRILDH

SEQ ID NO: 1709 - protein, 511 aa, Ajellomyces capsulatus NAm1
  misc_feature (61)..(476): Pfam Name: UDPGP Pfam Description: UTP--glucose-1-phosphate uridylyltransfera
  misc_feature (1)..(511): Public GI ID no. 154279628
  misc_feature (1)..(511): Bit score of 669.8 for HMM based on sequences of Figure 17
  misc_feature (1)..(511): Functional Homolog Of SEQ ID NO. 1599
MEIPVPSEEYSPLTDGDHGDRDVKAFENASTNVAASQMRNALNALADTVTDPKEKQRFEAEMDNFFSLFRRYLNDKAKGNVLSWDRIAPPQPSQVVEYSELGNSASVDFLKKLAVIKLNGGLGTSMGCVGPKSVIEVREGMSFLDLSVRQIEYLNRTYNVNVPFVLMNSFNTDEDTQSIIKKYEGHNIDILTFNQSRYPRILKDSLLPAPKSYQAPITDWYPPGHGDVFESLYNSGTLDKLLDRGVEIVFLSNADNLGAVVDMRILEHMVKNKAEYIMELTDKTKADVKGGTIIDYEGRARLLEIAQVPKEHVNEFKSIKKFKYFNTNNIWMNLRAIKRVVEHNELEMEIIPNDKSIPADRKGEADISIIQLETAVGAAIRHFKNAHGVNVPRRRFLPVKTCSDLMLVKSDLYTLQHGQLVMDPNRFGGAPLIKLGSDFKKVSDFQKRIPSIPRILELDHLTISGAVNLGRGVTMKGTVIIVATEGSTIDIPPGSVLENVVVQGSLRILEH

SEQ ID NO: 1710 - protein, 529 aa, Drosophila ananassae
  misc_feature (73)..(494): Pfam Name: UDPGP Pfam Description: UTP--glucose-1-phosphate uridylyltransfera
  misc_feature (1)..(529): Public GI ID no. 194751331
  misc_feature (1)..(529): Bit score of 652.0 for HMM based on sequences of Figure 17
  misc_feature (1)..(529): Functional Homolog Of SEQ ID NO. 1599
MLDVPHEAQMTSGIRPIDVLLQRAGVRGHQRVPSDSKEFHEVTKRDALRLLENDVDRLLKTTEPARQPALKAEMGRFADLFGRFLQEEGPALDWNKIQKLPENAVMNYSNLKSPKNEQNEIRNMLDKLVVIKLNGGLGTSMGCHGPKSVIPVRSDLTFLDLTVQQIEHLNKTYDANVPLVLMNSFNTDEDTEKIVRKYKGFRVQIHTFNQSCFPRISREHFLPVAKDFDVEKDMEAWYPPGHGDFYDTFRNSGLLKRFIDEGREYCFLSNIDNLGATVDLNILNKLVGEERATTPVEFVMEVTDKTRADVKGGTLIQMENKLRLLEIAQVPKEHVDDFKSVKTFKFFNTNNIWANLSAIDRVLRERTLNMEIIVNNKTLENGTRVIQLETAVGAAMKCFDGAIGINVPRSRFLPVKKSSDLLLVMSNLYTLKNGSLVMSPQRMFPTTPLVKLGENHFSKVKEFLGRFANIPDIIELDHLTVSGDVTFGRGVSLRGTVIIIANHGDRIDIPAGAILENKIVSGNMRILDH

SEQ ID NO: 1711 - protein, 520 aa, Drosophila mojavensis
  misc_feature (64)..(485): Pfam Name: UDPGP Pfam Description: UTP--glucose-1-phosphate uridylyltransfera
  misc_feature (1)..(520): Public GI ID no. 195126913
  misc_feature (1)..(520): Bit score of 657.0 for HMM based on sequences of Figure 17
  misc_feature (1)..(520): Functional Homolog Of SEQ ID NO. 1599
MTSGIRPIDVLLQRAGIRGHQRAPSDSKEFHEVTKRDALRLLENEVDRLLQTTEPARRPALQAEMGRFADLFGRFLQEEGPALDWNKIQKLPENAVMNYSNLKAPKNEQNEIRSMLDKLVVIKLNGGLGTSMGCHGPKSVIPVRSDLTFLDLTVQQIEHLNKTYDANVPLVLMNSFNTDEDTEKIVRKYKGFRVQIHTFNQSCFPRISREHFLPVAKDFDVEKDMEAWYPPGHGDFYDTFRNSGLLKKFIDEGREYCFLSNIDNLGATVDLNILNKLVGEERASTPFEFVMEVTDKTRADVKGGTLIQMENKLRLLEIAQVPKEHVDDFKSVKTFKFFNTNNIWANLAAIDRVLRERTLNMEIIVNNKTLENGLRVIQLETAVGAAMKCFDGAIGINVPRSRFLPVKKSSDLLLVMSNLYTLKNGSLVMSPQRMFPTTPLVKLGENHFSKVKEFLGRFANIPDIIELDHLTVSGDVTFGRGVSLRGTVIIIANHGDRIDIPAGAILENKIVSGNMRILDH

SEQ ID NO: 1712 - protein, 520 aa, Drosophila melanogaster
  misc_feature (64)..(485): Pfam Name: UDPGP Pfam Description: UTP--glucose-1-phosphate uridylyltransfera
  misc_feature (1)..(520): Public GI ID no. 62484278
  misc_feature (1)..(520): Bit score of 647.1 for HMM based on sequences of Figure 17
  misc_feature (1)..(520): Functional Homolog Of SEQ ID NO. 1599
MPSGIRPIDVLLERAGVRGHQRAPSDSKEFHEVTKRDALRLLEHDVDRLLETTEKARQPALKAEMGRFADLFGRFIQEEGPALDWNKIQKLPENAVMNYSNLKSPKNEQNEIRNMLDKLVVIKLNGGLGTSMGCHGPKSVIPVRSDLTFLDLTVQQIEHLNKTYDANVPLVLMNSFNTDEDTEKIVRKYKGFRVQIHTFNQSCFPRISREHYLPVAKDFDVEKDMEAWYPPGHGDFYDTFRNSGLLKKFIEEGREYCFLSNIDNLGATVDLNILNKLVGEERATTPVEFVMEVTDKTRADVKGGTLIQMENKLRLLEIAQVPPEHVDDFKSVKTFKFFNTNNIWANLAAIDRVLRERTLNMEIIVNNKTLENGTRVIQLETAVGAAMKCFDGAIGINVPRSRFLPVKKSSDLLLVMSNLYTLKNGSLVMSPQRMFPTTPLVKLGENHFSKVKEFLGRFANIPDIIELDHLTVSGDVTFGRGVSLRGTVIIIANHGDRIDIPAGAILENKIVSGNMRILDH

SEQ ID NO: 1713 - protein, 520 aa, Drosophila yakuba
  misc_feature (64)..(485): Pfam Name: UDPGP Pfam Description: UTP--glucose-1-phosphate uridylyltransfera
  misc_feature (1)..(520): Public GI ID no. 195490906
  misc_feature (1)..(520): Bit score of 647.5 for HMM based on sequences of Figure 17
  misc_feature (1)..(520): Functional Homolog Of SEQ ID NO. 1599
MPSGIRPIDVLLERAGVRGHQRAPSDSKEFHEVTKRDALRLLEHDVDRLLETTEKARQPALKAEMGRFADLFGRFIQEEGPALDWNKIQKLPENAVMNYSNLKSPQNEQNEIRNMLDKLVVIKLNGGLGTSMGCHGPKSVIPVRSDLTFLDLTVQQIEHLNKTYDANVPLVLMNSFNTDEDTEKIVRKYKGFRVQIHTFNQSCFPRISREHYLPVAKDFDVEKDMEAWYPPGHGDFYDTFRNSGLLKKFIEEGREYCFLSNIDNLGATVDLNILNKLVGEERATTPVEFVMEVTDKTRADVKGGTLIQMENKLRLLEIAQVPPEHVDDFKSVKTFKFFNTNNIWANLAAIDRVLRERTLNMEIIVNNKTLENGTRVIQLETAVGAAMKCFDGAIGINVPRSRFLPVKKSSDLLLVMSNLYTLKNGSLVMSPQRMFPTTPLVKLGENHFSKVKEFLGRFANIPDIIELDHLTVSGDVTFGRGVSLRGTVIIIANHGDRIDIPAGAILENKIVSGNMRILDH

SEQ ID NO: 1714 - protein, 496 aa, Yarrowia lipolytica CLIB99
  misc_feature (49)..(461): Pfam Name: UDPGP Pfam Description: UTP--glucose-1-phosphate uridylyltransfera
  misc_feature (1)..(496): Public GI ID no. 50543038
  misc_feature (1)..(496): Bit score of 654.2 for HMM based on sequences of Figure 17
  misc_feature (1)..(496): Functional Homolog Of SEQ ID NO. 1599
MSKHHLKTQSAVAFDNSATTVAASQMRNALNKLSDSVEDPAQKRRFENEMDNFFSLFRRYLVDKAKGNALDWDRIQPPKAEQVIDYKDIDQDVGAEFLNKLAVLKLNGGLGTSMGCVGPKSVIEVRDGKSFLDLSVRQIEHLNRQYNVDVPFILMNSFNTDEDTQTIIKKYQGHKINIKTFNQSRFPRVFKDSNLPVPKSFDDRIDAWYPPGHGDLFESLHNSGVLDELIAEGKEIIFVSNVDNLGAVVDLSILKHMSTTGSEYIMELTDKTRADVKGGTLIDYDGQVRLLEIAQVPKEHTEEFKSIKKFKYFNTNNLWINLKAIKRVVENNELDSEIIPNEKSITIGKNDIPVLQLETAVGAAIRHFKGCMGVNVPRRRFLPVKTCSDLLLVKSDLYTLHAGRLEMDPSRFGGSPLIKLGGHYKKVSDFQKRIPHMPKILELDHLTITGNVMLGKGVTLKGTVICVCEEGKKIDIPNGSVLENVVITGSLSILEH

SEQ ID NO: 1715 - protein, 511 aa, Drosophila grimshawi
  misc_feature (57)..(476): Pfam Name: UDPGP Pfam Description: UTP--glucose-1-phosphate uridylyltransfera
  misc_feature (1)..(511): Public GI ID no. 195015057
  misc_feature (1)..(511): Bit score of 645.9 for HMM based on sequences of Figure 17
  misc_feature (1)..(511): Functional Homolog Of SEQ ID NO. 1599
MLDVPQEAKVRGHQRAPSDSKEFHEVTKRDALRLLENEVDRLLQTTESARRPALQAEMGRFADLFGRFLQEEGPSLDWNKIQKLPENAVMDYTNLKSPKNEQIRLMLDKLVVIKLNGGLGTSMGCHGPKSVIPVRSDLTFLDLTVQQIEHLNKTYDANVPLVLMNSFNTDEDTEKIVRKYKGFRVQIHTFNQSCFPRISREHFLPVAKDFDVEKDMEAWYPPGHGDFYDTFRNSGLLKKFLCEGREYCFLSNIDNLGATVDLNILNKLVGEERATTPPEFVMEVTDKTRADVKGGTLIQMENKLRLLEIAQVPPEHVDDFKSVKTFKFFNTNNIWANLSAIDRVLRERTLNMEIIVNNKTLENGLRVIQLETAVGSAMKCFDGAIGINVPRSRFLPVKKSSDLLLVMSNLYTLKSGSLVMSPQRMFPTTPLVKLGENHFSKVKEFLGRFANIPDIIELDHLTVSGDVTFGRGVSLRGTVIIIANHGDRIDIPAGAILENKIVSGNMRILDH

SEQ ID NO: 1716 - protein, 513 aa, Drosophila persimilis
  misc_feature (57)..(478): Pfam Name: UDPGP Pfam Description: UTP--glucose-1-phosphate uridylyltransfera
  misc_feature (1)..(513): Public GI ID no. 195173943
  misc_feature (1)..(513): Bit score of 647.9 for HMM based on sequences of Figure 17
  misc_feature (1)..(513): Functional Homolog Of SEQ ID NO. 1599
MLDVPNEGKVRGHQRVPSDSKEFHEVTKRDALRLLENDVDRLLQTTEQVRRPALQAEMGRFADLFGRFLQEEGPALDWNKIQKLPENAVMNYSNLKLPKNEQNEIRNMLDKLVVIKLNGGLGTSMGCHGPKSVIPVRSDLTFLDLTVQQIEHLNKTYDANVPLVLMNSFNTDEDTEKIVRKYKGFRVQIHTFNQSCFPRISREHFLPVAKDFDVEKDMEAWYPPGHGDFYDTFRNSGLLKKFIEEGREYCFLSNIDNLGATVDLNILNKLVGEERASTPVEFVMEVTDKTRADVKGGTLIQFENKLRLLEIAQVPPEHVDDFKSVKTFKFFNTNNIWANLASIDRVLRERTLSMEIIVNNKTLETGLRVIQLETAVGSAMKCFDGAIGINVPRSRFLPVKKSSDLLLVMSNLYTLKNGSLVMSPQRMFPTTPLVKLGENHFSKVKEFLGRFANIPDIIELDHLTVSGDVTFGRGVSLRGTVIIIANHGDRIDIPAGAILENKIVSGNMRILDH

SEQ ID NO: 1717 - protein, 513 aa, Drosophila erecta
  misc_feature (57)..(478): Pfam Name: UDPGP Pfam Description: UTP--glucose-1-phosphate uridylyltransfera
  misc_feature (1)..(513): Public GI ID no. 194867745
  misc_feature (1)..(513): Bit score of 648.2 for HMM based on sequences of Figure 17
  misc_feature (1)..(513): Functional Homolog Of SEQ ID NO. 1599
MLDVPHEAKVRGHQRAPSDSKEFHEVTKRDALRLLEHDVDRLLETTEQARQPALKAEMDRFADLFGRFIQEEGPALDWNKIQKLPENAVMNYSNLKSPKNEQNEIRNMLDKLVVIKLNGGLGTSMGCHGPKSVIPVRSDLTFLDLTVQQIEHLNKTYDANVPLVLMNSFNTDEDTEKIVRKYKGFRVQIHTFNQSCFPRISREHYLPVAKDFEIEKDMEAWYPPGHGDFYDTFRNSGLLKKFIQEGREYCFLSNIDNLGATVDLNILNKLVGEERATTPVEFVMEVTDKTRADVKGGTLIQMENKLRLLEIAQVPPEHVDDFKSVKTFKFFNTNNIWANLAAIDRVLRERTLNMEIIVNNKTLENGTRVIQLETAVGAAMKCFDGAIGINVPRSRFLPVKKSSDLLLVMSNLYTLKNGSLVMSPQRMFPTTPLVKLGENHFSKVKEFLGRFANIPDIIELDHLTVSGDVTFGRGVSLRGTVIIIANHGDRIDIPAGAILENKIVSGNMRILDH

SEQ ID NO: 1718 - protein, 513 aa, Culex pipiens quinquefasciatus
  misc_feature (58)..(478): Pfam Name: UDPGP Pfam Description: UTP--glucose-1-phosphate uridylyltransfera
  misc_feature (1)..(513): Public GI ID no. 170039309
  misc_feature (1)..(513): Bit score of 632.2 for HMM based on sequences of Figure 17
  misc_feature (1)..(513): Functional Homolog Of SEQ ID NO. 1599
MTGAIDILLKVRGHQRVPSDTKEFHEATKRDALIRLRKDLDNLLHSADDDKKATVQKEMCGFEALFHRFLQEDGPSVEWDKIEKLPQDAVKDYSSLKTPQESEIRAMLDKLVVVKLNGGLGTSMGCHGPKSVIPVRNDLTFLDLTVQQIEHLNKKYSANVPLVLMNSFNTDEDTEKVIRKYKGFQVQIYTFNQSCYPRISRDSLLPVAKDFNIEADIEAWYPPGHGDFYQSFQNSGLLKKFIDEGRDYCFLSNIDNLGATVDINILNRLLGSDRQGDKPIEFVMEVTDKTRADVKGGTLIQYEHKLRLLEIAQVPKEHVDDFKSVKTFKFFNTNNIWARLESIERVLNARTMNMEIIVNNKTLDNGMRVIQLETAVGAAMKCFDDGIGINVPRSRFLPVKKTSDLLLVMSNLYSLKYGSLVMSPQRMFPTTPLVKLGDNHFSKVKEFLGRFANIPDLIELDHLTVSGDVTFGRGVSLRGTVIIIANHGDRIDIPAGAILENKIVSGNMRILDH

SEQ ID NO: 1719 - protein, 497 aa, Monosiga brevicollis MX1
  misc_feature (48)..(462): Pfam Name: UDPGP Pfam Description: UTP--glucose-1-phosphate uridylyltransfera
  misc_feature (1)..(497): Public GI ID no. 167536224
  misc_feature (1)..(497): Bit score of 657.9 for HMM based on sequences of Figure 17
  misc_feature (1)..(497): Functional Homolog Of SEQ ID NO. 1599
MALKRSESLNSVTSYSHEQGDAALTLSAELSKLIMTAPLNLRDEVERNCKGFQTLFDQYMGERGTKISWDKIRPPPAGSIVPHATVAAGEPKAASELSVPLSKLAVLKLNGGLGTSMGCVGPKSVISVRNDLTFLDLCVRQIEHLNDSYGTTVPLVLMNSFNTHDDTQKVLRKYKKTEVKVFNQSQYPRILKETLQPLPKNTDNSDEDWYPPGHGDLYRSFYDSGLLQELLDDGKEWVFISNIDNLGATVDEDILRYVTRPGNDCEFVMEVTDKTRADVKGGTLIEYEGRIRLLEVAQVPKDHEEDFKSVTKFRVFNTNNLWINLHAIKRLVEEESLHMEVIENKKTLDDGRVIIQLEQAVGSAIKNFNGAIGINVPRSRFLPVKKTSDLLLVMSNLYQLRHGTLSMNASRLFDSVPLIKLGDHFKKVKDFLRRFENIPDILELDHLTVSGDVKFGKNVILRGTVIIIAQENDSIDIPQGSVLENKIVTGNLRILDH

SEQ ID NO: 1720 - protein, 511 aa, Drosophila melanogaster
  misc_feature (57)..(476): Pfam Name: UDPGP Pfam Description: UTP--glucose-1-phosphate uridylyltransfera
  misc_feature (1)..(511): Public GI ID no. 111144847
  misc_feature (1)..(511): Bit score of 637.2 for HMM based on sequences of Figure 17
  misc_feature (1)..(511): Functional Homolog Of SEQ ID NO. 1599
MLDVPHEAKVRGHQRAPSDSKEFHEVTKRDALRLLEHDVDRLLETTEKARQPALKAEMGRFADLFGRFIQEEGPALDWNKIQKLPENAVMNYSNLKSPKNEQIRNMLDKLVVIKLNGGLGTSMGCHGPKSVIPVRSDLTFLDLTVQQIEHLNKTYDANVPLVLMNSFNTDEDTEKIVRKYKGFRVQIHTFNQSCFPRISREHYLPVAKDFDVEKDMEAWYPPGHGDFYDTFRNSGLLKKFIEEGREYCFLSNIDNLGATVDLNILNKLVGEERATTPVEFVMEVTDKTRADVKGGTLIQMENKLRLLEIAQVPPEHVDDFKSVKTFKFFNTNNIWANLAAIDRVLRERTLNMEIIVNNKTLENGTRVIQLETAVGAAMKCFDGAIGINVPRSRFLPVKKSSDLLLVMSNLYTLKNGSLVMSPQRMFPTTPLVKLGENHFSKVKEFLGRFANIPDIIELDHLTVSGDVTFGRGVSLRGTVIIIANHGDRIDIPAGAILENKIVSGNMRILDH

SEQ ID NO: 1721 - protein, 511 aa, Drosophila simulans
  misc_feature (57)..(476): Pfam Name: UDPGP Pfam Description: UTP--glucose-1-phosphate uridylyltransfera
  misc_feature (1)..(511): Public GI ID no. 111144907
  misc_feature (1)..(511): Bit score of 634.3 for HMM based on sequences of Figure 17
  misc_feature (1)..(511): Functional Homolog Of SEQ ID NO. 1599
MLDVPHEAKVRGHQRAPSDSKEFHEVTKRDALRLLEHDVDRLLETTEKARQPALKAEMGRFADLFGRFIQEEGPALDWNKIQKLPENAVMNYSNLKSPKNEQIRNMLDKLVVIKLNGGLGTSMGCHGPKSVIPVRSDLTFLDLTVQQIEHLNKTYDANVPLVLMNSFNTDEDTEKIVRKYKGFRVQIHTFNQSCFPRISREHYLPVAKDFDVEKDMEAWYPPGHGDFYDTFRNSGLRKKLIEEGREYCFLSNIDNLGATVDLNILNKLVGEERATTPVEFVMEVTDKTRADVKGGTLIQMENKLRLLEIAQVPPEHVDDFKSVKTFKFFNTNNIWANLAAIDRVLRERTLNMEIIVNNKTLENGTRVIQLETAVGAAMKCFDGAIGINVPRSRFLPVKKSSDLLLVMSNLYTLKNGSLVMSPQRMFPTTPLVKLGENHFSKVKEFLGRFANIPDIIELDHLTVSGDVTFGRGVSLRGTVIIIANHGDRIDIPAGAILENKIVSGNMRILDH

SEQ ID NO: 1722 - protein, 511 aa, Drosophila simulans
  misc_feature (57)..(476): Pfam Name: UDPGP Pfam Description: UTP--glucose-1-phosphate uridylyltransfera
  misc_feature (1)..(511): Public GI ID no. 111144899
  misc_feature (1)..(511): Bit score of 630.8 for HMM based on sequences of Figure 17
  misc_feature (1)..(511): Functional Homolog Of SEQ ID NO. 1599
MLDVPHEAKVRGHQRAPSDSKEFHEVTKRDALRLLEHDVDRLLETTEKARQPALKAEMGRFADLFGRFIQEEGPALDWNKIQKLPENAVMNYSNLKSPKNEQIRNMLDKLVVIKLNGGLGTSMGCHGPKSVIPVRSDLTFLDLTVQQIEHLNKTYDANVPLVLMNSFNTDEDTEKIVRKYKGFRVQIHTFNQSCFPRISREHYLPVAKDFDVEKDMEAWYPPGHGDFYDTFRNSGLLKKFIEEGREYCFLSNIDNLGATVDLNILNKLVGEERATTPVEFVMEVTDKTRADVKGGTLIQMENKLRLLEIAQVPPEHVDDFKSVKTFKFFNTNNIWANLAAIDRVLRERTLNMEIIVNNKTLENGTRVIQLETAVGAAMKCFDGAIGINVPRSRFLPVKKSSDLLLVMSNLDTLKNGSLVMSPQRMFPTTPLVKLGENHFSKVKEFLGRFANIPDIIELDHLTVSGDVTFGRGVSLRGTVIIIANHGDRIDIPAGAILENKIVSGNMRILDH

SEQ ID NO: 1723 - protein, 499 aa, Brugia malayi
  misc_feature (47)..(464): Pfam Name: UDPGP Pfam Description: UTP--glucose-1-phosphate uridylyltransfera
  misc_feature (1)..(499): Public GI ID no. 170589920
  misc_feature (1)..(499): Bit score of 624.6 for HMM based on sequences of Figure 17
  misc_feature (1)..(499): Functional Homolog Of SEQ ID NO. 1599
MMQKEIDKSSEEWKSSTKRETLLGMEQELRNLIETAPPDQKEAVQKELDCFRVLFSRFLRAKTTIEWKKIQPLPDNAIISYKELKLHDPSKDLVSDRLSKLVVVKLNGGLGTSMGCKGPKSMISVRNDLTFLDLTLQQIQNMNRTYDVNVPLVLMNSFNTDEDTKKLLRKYKNVQVDVHSFCQSKYPRILKESLMPIVKNVSDSDHDEWYPPGHGNFYEAFYNSGLLDKFLQDGKQFCFLSNIDNMGATVDMNVLNFIVQEVNGHQPEFVMEVTDKTRADIKGGTLIQYEDRLMLLEIAQVPKDYVDEFKSVSKFRIFNTNNLWAKLNAIKRVVEQKELEMEVIVNPKHLDRGVDVIQLETAAGAAIKSFKGACGINVPRSRFLPVKTTSDLLLLMSNLYEIENGNLTLSHLRSFPTTPLVKLGSFFDKVQEYLRRFQGIPDLLELDHLTVSGDVWFGRDVVLKGTVIIIANHGDRIDIPPGTILENKIVSGNLRILDH

SEQ ID NO: 1724 - protein, 477 aa, Macaca mulatta
  misc_feature (43)..(462): Pfam Name: UDPGP Pfam Description: UTP--glucose-1-phosphate uridylyltransfera
  misc_feature (1)..(477): Public GI ID no. 109103123
  misc_feature (1)..(477): Bit score of 594.4 for HMM based on sequences of Figure 17
  misc_feature (1)..(477): Functional Homolog Of SEQ ID NO. 1599
MSQDGASQFQEVIRQELELSVKKELEKILTTASSHEFEHTKKDLDGFRKLFHRFLQEKGPSVDWGKIQRPPEDSIQPYEKIKARGLPDNISSVLNKLVVVKLNGGLGTSMGCKGPKSLIGVRNENTFLDLTVQQIEHLNKTYNTDVPLVLMNSFNTDEDTKKILQKYNHCRVKIYTFNQSRYPRINKESLLPVAKDVSYSGENTEAWYPPGHGDIYASFYNSGLLDTFIGEGKEYIFVSNIDNLGATVDLYILNHLMNPPNGKRCEFVMEVTNKTRADVKGGTLTQYEGKLRLVEIAQVPKAHVDEFKSVSKFKIFNTNNLWISLAAVKRLQEQNAIDMEIIVNPKTLDGGLNVIQLETAVGAAIKSFENSLGINVPRSRFLPVKTTSDLLLVMSNLYSLNAGSLTMSEKREFPTVPLVKLGSSFTKVQDYLRRFESIPDMLELDHLTVSGDVTFGKNVSLKVCCYSENYISYSFTT

SEQ ID NO: 1725 - protein, 521 aa, Neosartorya fischeri NRRL 181
  misc_feature (71)..(486): Pfam Name: UDPGP Pfam Description: UTP--glucose-1-phosphate uridylyltransfera
  misc_feature (1)..(521): Public GI ID no. 119489040
  misc_feature (1)..(521): Bit score of 650.1 for HMM based on sequences of Figure 17
  misc_feature (1)..(521): Functional Homolog Of SEQ ID NO. 1599
MAAKALPTHLRAPANEASGDGSFGKHHAKSQSHMAFENASTSVAASQMRNALNALAETVPDPEEKKRFEAEMDNFFALFRRFLNDKAKGNVVNWDRINPPAPNQVVDYNDLGAEASVEFLNKLAVVKLNGGLGTSMGCVGPKSVIEVREGMSFLDLSVRQIEHLNRTYNVNVPFVLMNSFNTDQDTQSIIKKYQGHNVDIITFNQSRYPRIIKDSLLPAPKSFDAPLQDWYPPGHGDVFESLYNSGTLDKLLERGVEYIFLSNADNLGAVVDLRILQHMADTDAEYIMELTDKTKADVKGGTIIDYEGKARLLEIAQVPKEHVNEFKSIKKFKYFNTNNIWMNLRAIKRVVEENELEMEIIANEKSIPADKKGEADQAIYQLETAVGAAIRHFKNAHGVNVPRRRFLPVKTCSDLLLVKSDLYRLEHGQLVMDPNRFGGVPVIKLGSDFKKVSDFQKRIPSIPRIVELDHLTITGAVNLGRNVTLKGTVIIVATEGSTIDIPPGSVLENCVVQGSLRILEH

SEQ ID NO: 1726 - protein, 531 aa, Aspergillus oryzae RIB40
  misc_feature (81)..(496): Pfam Name: UDPGP Pfam Description: UTP--glucose-1-phosphate uridylyltransfera
  misc_feature (1)..(531): Public GI ID no. 169781996
  misc_feature (1)..(531): Bit score of 639.8 for HMM based on sequences of Figure 17
  misc_feature (1)..(531): Functional Homolog Of SEQ ID NO. 1599
MAAKALPTHLRAPATETSNAGSFGKHHGKSQSHMTCMLTGRFPQAFENASTSVAASQMRNALNALSETVPDPQERKRFEAEMDNFFALFRRFLNDKAKGNEVNWDRIAPPQPSQVVNYESLGSEASVEFLNKLAVVKLNGGLGTSMGCVGPKSVIEVREGMSFLDLSVRQIEHLNRTFNVNVPFVLMNSFNTDQDTQSIIKKYQGHNVDILTFNQSRYPRIIKDSLLPAPKSFDAPLQDWYPPGHGDVFESLYNSGTLDKLLERGVEYIFLSNADNLGAVVDLRILQHMVDTESEYIMELTDKTKADVKGGTIIDYEGKARLLEIAQVPKEHVNEFKSIKKFKYFNTNNIWMSLRAIKRVVEENELEMEIIANEKSIPADKKGDADQAIYQLETAVGAAIRHFKNGHGVNVPRRRFLPVKTCSDLLLVKSDLYRLEHGQLVMDPNRFGGVPVIKLGSDFKKVSDFQKHIPSIPRIVELDHLTITGAVNLGRNVTLKGTVIIVATEGSTIDVPPGSVLENCVVQGSLRILEH

SEQ ID NO: 1727 - protein, 521 aa, Aspergillus clavatus NRRL 1
  misc_feature (71)..(486): Pfam Name: UDPGP Pfam Description: UTP--glucose-1-phosphate uridylyltransfera
  misc_feature (1)..(521): Public GI ID no. 121709268
  misc_feature (1)..(521): Bit score of 648.9 for HMM based on sequences of Figure 17
  misc_feature (1)..(521): Functional Homolog Of SEQ ID NO. 1599
MASKALPTHLRAPANDAGNNGGFGKHHGKSQSHMAFENASTSVAASQMRNALNALSETVTDPNEKKRFEAEMDNFFALFRRFLNDKAKGNVVNWDRINPPQPSQVVDYNDLGTEASVEFLNKLAVVKLNGGLGTSMGCVGPKSVIEVREGMSFLDLSVRQIEHLNRTYNVNVPFVLMNSFNTDQDTQSIIKKYQGHNVDIITFNQSRYPRIIKDSLLPAPKSFDAPLQDWYPPGHGDVFESLYNSGTLDQLLERGVEYIFLSNADNLGAVVDLRILQHMVDTKAEYIMELTDKTKADVKGGTIIDYEGKVRLLEIAQVPKEHVNEFKSIKKFKYFNTNNIWMSLRAIKRVVEENELEMEIIANEKSIPADKKGEADQAIYQLETAVGAAIRHFKNAHGVNVPRRRFLPVKTCSDLLLVKSDLYRLEHGQLVMDPNRFGGVPVIKLGSDFKKVSDFQKRIPSIPRIVELDHLTITGAVNLGRNVTLKGTVIIVATETSTIDIPPGSVLENCVVQGSLRILEH

SEQ ID NO: 1728 - protein, 511 aa, Aspergillus fumigatus Af293
  misc_feature (61)..(476): Pfam Name: UDPGP Pfam Description: UTP--glucose-1-phosphate uridylyltransfera
  misc_feature (1)..(511): Public GI ID no. 70982442
  misc_feature (1)..(511): Bit score of 644.4 for HMM based on sequences of Figure 17
  misc_feature (1)..(511): Functional Homolog Of SEQ ID NO. 1599
MPLFSSSSSSSSSANKLTQFPRAQAFENASTSVAASQMRNALNALAETVPDPEEKKRFEAEMDNFFALFRRFLNDKAKGNVVNWDRINPPAPNQVVDYNDLGAEASVEFLNKLAVVKLNGGLGTSMGCVGPKSVIEVREGMSFLDLSVRQIEHLNRTYNVNVPFVLMNSFNTDQDTQSIIKKYQGHNVDIITFNQSRYPRIIKDSLLPAPKSFDAPLQDWYPPGHGDVFESLYNSGTLDKLLERGVEYIFLSNADNLGAVVDLRILQHMADTGAEYIMELTDKTKADVKGGTIIDYEGKARLLEIAQVPKEHVNEFKSIKKFKYFNTNNIWMSLRAIKRVVEENELEMEIIANEKSIPADKKGEADQAIYQLETAVGAAIRHFKNAHGVNVPRRRFLPVKTCSDLLLVKSDLYRLEHGQLVMDPNRFGGVPVIKLGSDFKKVSDFQKRIPSIPRIVELDHLTITGAVNLGRNVTLKGTVIIVATEGSTIDIPPGSVLENCVVQGSLRILEH

SEQ ID NO: 1729 - protein, 521 aa, Aspergillus niger CBS 513.88
  misc_feature (71)..(486): Pfam Name: UDPGP Pfam Description: UTP--glucose-1-phosphate uridylyltransfera
  misc_feature (1)..(521): Public GI ID no. 145245828
  misc_feature (1)..(521): Bit score of 639.1 for HMM based on sequences of Figure 17
  misc_feature (1)..(521): Functional Homolog Of SEQ ID NO. 1599
MASKALPSHLRAPASDSASAASFGKHHGKSQSHMAFENASTSVAASQMRNALNALAETVPDAAERKRFEAEMDNFFALFRRFLNDKAKGNEVNWDRIAPPQPSQVVNYNDLGSEASVEFLNKLAVVKLNGGLGTSMGCVGPKSVIEVREGMSFLDLSVRQIEHLNRTFNVNVPFVLMNSFNTDQDTQSIIKKYQGHNVDIITFNQSRYPRIIKDSLLPAPKSFDAPLQDWYPPGHGDVFESLYNSGTLDKLLERGVEYIFLSNADNLGAVVDLRILQHMVDTQAEYIMELTDKTKADVKGGTIIDYEGKARLLEIAQVPKEHVNEFKSIKKFKYFNTNNIWMSLRAIKRVVEENELEMEIIANEKSIPADKKGEADQAIYQLETAVGAAIRHFKNGHGVNVPRRRFLPVKTCSDLMLVKSDLYRLEHGQLVMDPNRFGGVPVIKLGSDFKKVSDFQKHIPSIPRIVELDHLTITGAVNLGRNVQLKGTVIIVATEGSTIDIPPGSVLENCVVQGSLRILEH

SEQ ID NO: 1730 - protein, 522 aa, Acyrthosiphon pisum
  misc_feature (70)..(487): Pfam Name: UDPGP Pfam Description: UTP--glucose-1-phosphate uridylyltransfera
  misc_feature (1)..(522): Public GI ID no. 193713936
  misc_feature (1)..(522): Bit score of 590.6 for HMM based on sequences of Figure 17
  misc_feature (1)..(522): Functional Homolog Of SEQ ID NO. 1599
MVEETNVGYSGINIFTNVVKPKGHSPVPSSADLKEFKEVTQRDSLVQLEKEIAALLTTTSDDKKDLAKSQFAAFSRLFQRFLEESGSSVDWERIEQLPIDSIRDYNTLLKPSPDDIHSKLEKLVVVKLNGGLGTSMGCRGPKSVIQVRNDLTFLDLTVQQIEHLNKKYNVNVPLVLMNSFNTDKDTEQIIRKYKGLQVEIYTFNQSCFPRVSKETLLPIAHDCDIEGNIEAWYPPGHGDFYDSFKNSGLLQKFINSGRDYCFISNIDNLGATVDLNILNMLLDRGTNPLEFVMEVTNKTKADVKGGTLIQYENKLRLLEIAQVPKEHLEEFKSVKKFKFFNTNNLWIKLDAIEKVLNEGSMNLEIIVNNKTLENNLNIIQLETAVGAAMKSFNGGLGINVPRSRFLPVKKTSDLLLVMSNLYHMKNGSLSMSPLRMFPTTPLVKLGDKDFAKVKDFLSRFATIPDILELDHLTVSGDVTFGRNVSLKGTVIIIANHGDRIDVPSNATLENKIVSGNLRILDH

SEQ ID NO: 1731 - protein, 500 aa, Laccaria bicolor S238N-H82
  misc_feature (54)..(465): Pfam Name: UDPGP Pfam Description: UTP--glucose-1-phosphate uridylyltransfera
  misc_feature (1)..(500): Public GI ID no. 170098292
  misc_feature (1)..(500): Bit score of 584.0 for HMM based on sequences of Figure 17
  misc_feature (1)..(500): Functional Homolog Of SEQ ID NO. 1599
MPFFNYPVRRFRRRERKNFPNTPGSVANASMRDELDRLVNTIPYPTSKKLFISEMQSFLHLYSRYLAQKPTAENIDWQKVSTPRPEQIVSYETLPEAGDNVLLKKLAVLRVNGGLGSTMGMVGAKSALEVKDNMTFLDLAVQQIKHLNSTEHVDVPLLLMTSFNTQEDTIRIVKKYANQHQVRITTFNQSRYPKIYNDTLLLVPKSVDDDRKAWYPPGHGDLYLALHRSGVLDQLLTEGKEYLFVSNSDNLGAVVDSKILRHMVETEAEFLVEVTNRTKADVKGGTLIDYDGTLQFLEIAQVPLGCLEEFESVKKFKSFSTNNVWVNLKALKRVMETQGMELNVFAKQKVTEDGRSALQLETAVGSAIKHFKNSHGINVPRSRFLPVKNCSDLLLVKSDLYSPQNGRLVLSEQRMFGTTPVIKLGDHFKKIQQFQKRLRYIPRMLELDHLTVTGDVYFGRNVTLRGTVIIVAGEGQRLDIPDGCVLENRLISGGLMMTEL

SEQ ID NO: 1732 - protein, 473 aa, Zea mays
  misc_feature (29)..(441): Pfam Name: UDPGP Pfam Description: UTP--glucose-1-phosphate uridylyltransfera
  misc_feature (1)..(473): Bit score of 1329.3 for HMM based on sequences of Figure 17
  misc_feature (1)..(473): Functional Homolog Of SEQ ID NO. 1599
MATAAVSVDEKLDKLRAEVAKLDQISENEKSGFISLVSRYLSGEAEQIEWSKIQTPTDEVVVPYDTVASPPEDLEETKKLLDKLVVLKLNGGLGTTMGCTGPKSVIEVRNGFTFLDLIVIQIESLNKKYGCNVPLLLMNSFNTHDDTQKIVEKYSNSNIEIHTFNQSQYPRIVTEDFLPLPSKGKSGKDGWYPPGHGDVFPSLNNSGKLDILLAQGKEYVFVANSDNLGAIVDIKILNHLINNQNEYCMEVTPKTLADVKGGTLISYEGRVQLLEIAQVPDEHVNEFKSIEKFKIFNTNNLWVNLKAIKRLVEAEALKMEIIPNPKEVDGVKVLQLETAAGAAIRFFDKAIGINVPRSRFLPVKATSDLLLVQSDLYTLVDGFVIRNPSRANPANPSIELGPEFKKVANFLARFKSIPSIVELDSLKVSGDVWFGSGITLKGKVTIIAKPGVKLEIPDGDVLENKDVNGPEDL

SEQ ID NO: 1733 - protein, 476 aa, Sorghum bicolor
  misc_feature (32)..(444): Pfam Name: UDPGP Pfam Description: UTP--glucose-1-phosphate uridylyltransfera
  misc_feature (1)..(476): Bit score of 1330.5 for HMM based on sequences of Figure 17
  misc_feature (1)..(476): Functional Homolog Of SEQ ID NO. 1599
MAAAAAAAVSVDEKLDKLRAEVAKLDQISENEKSGFLSLVSRYLSGEAEQIEWSKIQTPTDEVVVPYDTLASPPEDLEETKKLLDKLVVLKLNGGLGTTMGCTGPKSVIEVRNGFTFLDLIVIQIESLNKKYGCSVPLLLMNSFNTHDDTQKIVEKYSNSNIEIHTFNQSQYPRIVTEDFLPLPSKGNSGKDGWYPPGHGDVFPSLNNSGKLDILLAQGKEYVFVANSDNLGAIVDIKILNHLINNQNEYCMEVTPKTLADVKGGTLISYEGRVQLLEIAQVPDEHVNEFKSIEKFKIFNTNNLWVNLKAIKRLVEAEALKMEIIPNPKEVDGVKVLQLETAAGAAIRFFDKAIGINVPRSRFLPVKATSDLLLVQSDLYTLVDGFVIRNPARANPANPSIELGPEFKKVANFLARFKSIPSIVELDNLKVSGDVWFGSGITLKGKVTITAKSGVKLEIPDGAVLENKDVNGPEDL

SEQ ID NO: 1734 - protein, 473 aa, Zea mays
  misc_feature (29)..(441): Pfam Name: UDPGP Pfam Description: UTP--glucose-1-phosphate uridylyltransfera
  misc_feature (1)..(473): Bit score of 1323.0 for HMM based on sequences of Figure 17
  misc_feature (1)..(473): Functional Homolog Of SEQ ID NO. 1599
MATAAVSVDEKLDKLRAEVAKLDQISENEKSGFISLVSRYLSGEAEQIEWSKIQTPTDEVVVPYDTVASPPEDLEETKKLLDKLVVLKLNGGLGTTMGCTGPKSVIEVRNGFTFLDLIVIQIESLNKKYGCNVPLLLMNSFNTHDDTQKIVEKYSNSNIEIHTFNQSQYPRIVTEDFLPLPSKGKSGKDGWYPPGHGDVFPSLNNSGKLDILLAQGKEYVFVANSDNLGAIVDIKILNHLINNQNEYCMEVTPKTLADVKGGTLISYEGRVQLLEIAQVSDEHVNEFKSIEKFKIFNTNNLWVNLKAIKRLVEAEALKMEIIPNPKEVDGVKVLQLETAAGAAIRFFDKAIGINVPRSRFLPVKATSDLLLVQSDLYTLVDGFVIRNPSRANPANPSIELGPEFKKVANFLGRFKSIPSIVELDSLKVSGDVWFGSGITLKGKVTIIAKPGVKLEIPDGDVLENKDVNGPEDL

SEQ ID NO: 1735 - protein, 473 aa, Zea mays
  misc_feature (29)..(441): Pfam Name: UDPGP Pfam Description: UTP--glucose-1-phosphate uridylyltransfera
  misc_feature (1)..(473): Bit score of 1318.2 for HMM based on sequences of Figure 17
  misc_feature (1)..(473): Functional Homolog Of SEQ ID NO. 1599
MATAAVSVDEKLDKLRAEVAKLDQISENEKSGFISLVSRYLSGEAEQIEWSKIQTPTDEVVVPYDTVASPPEDLEETKKLLDKLVVLKLNGGLGTTMGCTGPKSVIEVRNGFTFLDLIVIQIESLNKKYGCNVPLLLMNSFNTHDDTQKIVEKYSNSNIEIHTFNQSQYPRIVTEDFLPLSSKGKSGKDGWYPPGHGDVFPSLNNSGKLDILLAQGKEYVFVANSDNLGAIVDIKILNHLINNQNEYCMEVTPKTLADVKGGTLISYEGRVQLLEIAQVSDEHVNEFKSIEKFKIFNTNNLWVNLKAIKRLVEAEALKMEIIPNPKEVDGVKVLQLETAAGAAIRFFDKAIGINVPRSRFLPVKATSDLLLVQSDLYTLVDGFVIRNPSRANPANPSIELGPEFKKVANFLGRFKSIPSIVELDSLKVSGDVWFGSGITLKGKVTIIAKPGVKLEIPDGDVLENKDVNGPEDL

SEQ ID NO: 1736 - protein, 473 aa, Zea mays
  misc_feature (29)..(441): Pfam Name: UDPGP Pfam Description: UTP--glucose-1-phosphate uridylyltransfera
  misc_feature (1)..(473): Bit score of 1322.2 for HMM based on sequences of Figure 17
  misc_feature (1)..(473): Functional Homolog Of SEQ ID NO. 1599
MAATAVSVDEKLDKLRAEVAKLSQISENEKAGFISLVSRYLSGEAEQIEWSKIQTPTDEVVVPYDILASPPEDLEETKKLLDKLVVLKLNGGLGTTMGCTGPKSVIEVRNGFTFLDLIVIQIESLNKKYGCNVPLLLMNSFNTHDDTQKIVEKYSNSNIEIHTFNQSQYPRIVTEDFLPLPSKGKSGKDGWYPPGHGDVFPSLNNSGKLDILLAQGKEYVFVANSDNLGAIVDIKILNHLINNQNEYCMEVTPKTLADVKGGTLISYEGRVQLLEIAQVPDEHVNEFKSIEKFKIFNTNNLWVNLKAVKRLVEAEALKMEIIPNPKEVDGVKVLQLETAAGAAIRFFDKAIGINVPRSRFLPVKATSDLLLVQSDLYTLVDGFVIRNPSRANPANPSIELGPEFKKVANFLARFKSIPSIVELDSLKVSGDVWFGSGITLKGKVTITAKSGVKLEVPDGAVFENKDVNGPEDL

SEQ ID NO: 1737 - protein, 473 aa, Zea mays
  misc_feature (29)..(441): Pfam Name: UDPGP Pfam Description: UTP--glucose-1-phosphate uridylyltransfera
  misc_feature (1)..(473): Bit score of 1322.1 for HMM based on sequences of Figure 17
  misc_feature (1)..(473): Functional Homolog Of SEQ ID NO. 1599
MAATAVSVDEKLDKLRAEVAKLSQISENEKAGFISLVSRYLSGEAEQIEWSKIQTPTDEVVVPYDTLTSPPEDLEETKKLLDKLVVLKLNGGLGTTMGCTGPKSVIEVRNGFTFLDLIVIQIESLNKKYGCNVPLLLMNSFNTHDDTQKIVEKYSNSNIEIHTFNQSQYPRIVTEDFLPLPSKGKSGKDGWYPPGHGDVFPSLNNSGKLDILLAQGKEYVFVANSDNLGAIVDIKILNHLINNQNEYCMEVTPKTLADVKGGTLISYEGRVQLLEIAQVPDEHVNEFKSIEKFKIFNTNNLWVNLKAVKRLVEAEALKMEIIPNPKEVDGVKVLQLETAAGAAIRFFDKAIGINVPRSRFLPVKATSDLLLVQSDLYTLVDGFVIRNPSRANPANPSIELGPEFKKVANFLGRFKSIPSIVELDSLKVSGDVWFGSGITLKGKVTIIAKPGVKLEIPDGDVLENKDVNGPEDL

SEQ ID NO: 1738 - protein, 473 aa, Zea mays
  misc_feature (29)..(441): Pfam Name: UDPGP Pfam Description: UTP--glucose-1-phosphate uridylyltransfera
  misc_feature (1)..(473): Bit score of 1309.2 for HMM based on sequences of Figure 17
  misc_feature (1)..(473): Functional Homolog Of SEQ ID NO. 1599
MATTAVSVDEKLDKLRAEVAKLDQISENEKSGFISLVSRGLSGDFFQIEWSKIQTPTDEVVVPYDTVASPPEDLEETKKLLDKLVVLKLNGGLGTTMGCTGPKSVIEVRNGFTFLDLIVIQIESLNKKYGCNVPLLLMNSFNTHDDTQKIVEKYSNSNIEIHTFNQSQYPRIVTEDFLPLPSKGKSGKDGWYPPGHGDVFPSLNNSGKLDILLAQGKEYVFVANSDNLGAIVDIKILNHLINNQNEYCMEVTPKTLADVKGGTLISYEGRVQLLEIAQVPDEHVNEFKSIEKFKIFNTNNLWVNLKAIKRLVEAEALKMEIIPNPKEVDGVKVLQLETAAGAAIRFFDKAIGINVPRSRFLPVKATSDLLLVQSDLYTLVDGFVIRNPSRANPANPSIELGPEFKKVANFLGRFKSIPSIVELDSLKVSGDVWFGSGITLKGKVTIIAKPGVKLEIPDGDVLENKDVNGPEDL

SEQ ID NO: 1739 - protein, 473 aa, Zea mays
  misc_feature (29)..(441): Pfam Name: UDPGP Pfam Description: UTP--glucose-1-phosphate uridylyltransfera
  misc_feature (1)..(473): Bit score of 1312.9 for HMM based on sequences of Figure 17
  misc_feature (1)..(473): Functional Homolog Of SEQ ID NO. 1599
MATTAVSVDEKLDKLRAEVAKLSQISENEKAGFISLVSRYLSGEAEQIEWGKIQTPTDEVVVPYDILASPPEDLEETKKLLDKLVVLKLNGGLGTTMGCTGPKSVIEVRNGFTFLDLIVIQIESLNKKYGCSVPLLLMNSFNTHDDTQKIVEKYSNSNIEIHTFNQSQYPRIVTEDFLPLPSKGKSGKDGWYPPGHGDVFPSLNNSGKLDILLAQGKEYVFVANSDNLVAIVDIKILNHLINNQNEYCMEVTPKTLADVKGGTLISYEGRVQLLEIAQVPDEHVNEFKSIEKFKIFNTNNLWVNLKAVKRLVEAEALKMEIIPNPKEVDGVKVLQLETAAGAAIRFFDKAIGINVPRSRFLPVKATSDLLLVQSDLYTLVDGFVIRNPSRANPANPSIELGPEFKKVANFLARFKSIPSIVELDSLKVSGDVWFGSGITLKGKVTITAKSGVKLEVPDGAVFENKDVNGPEDL

SEQ ID NO: 1740 - DNA, 1377 bp, Arabidopsis thaliana
  misc_feature (1)..(1377): Ceres Clone ID no. 6639
  misc_feature (1)..(1377): Ceres SEED LINE ID no. CW00676
  misc_feature (1)..(1377): Encodes the peptide sequence at SEQ ID NO. 1741
aaaaaacttcaaagagagagagagagagagttttgtgaactcaagaaaataaaaaaagttatagttaatgggattcggcttagagagtatcaaatcaatctccggcggatggggcgcggcggcgcgttcctgtgacgcttgtaaatcagttaccgccgccgtgttctgtcgagttgactcagctttcttatgcatagcatgtgacacaagaatccattccttcactcgccacgagcgcgtgtgggtttgtgaagtttgtgaacaagctcccgccgccgtcacttgcaaagccgacgccgccgctctttgcgtcacttgtgatgccgatattcactctgctaatcctctcgctagccgtcacgaacgtgtccccgtcgaaactttcttcgactcagccgaaaccgccgtcgccaaaatctcagcttcttcgacttttggtatccttggctcatccaccaccgttgatttaaccgctgttccggttatggctgatgatctcggtttatgtccgtggttacttcctaatgatttcaacgaaccggctaaaatcgaaatcggaactgaaaacatgaaaggttcttctgactttatgttttctgatttcgatcggcttattgatttcgagtttccgaattcgttcaatcatcatcaaaacaacgccggaggagatagtcttgttccggttcagacgaaaacagagcctctcccgttaactaacaatgatcattgcttcgatattgatttctgcagatcaaagctctctgctttcacttacccttctcaatcagtcagccacagtgtttcgacttcttctattgaatacggtgtagttcctgacggaaacacaaacaactctgttaaccggagcacgatcactagctcgacgactggtggtgatcatcaagcgagctctatggatagagaagctagggttttgaggtacagagagaagagaaagaacaggaaatttgagaagacgattcgttacgcttcgaggaaagcttatgcagagtcacggccaaggatcaaaggccggtttgcgaaaagaacagagacagaaaacgacgacattttccttagtcatgtttatgcttcagcagcacacgcacagtacggtgtcgtaccaacgttctgattcgaatctacggtggataaacaatcaacctgaagacttcatatcttccaccgttgatttacagtcggtgtataataagtatagtgagtcttaccgtagacaaacatcttatcctctttaccgttttaattactttttttttacgcgctctcactgccactgtaactcttttttttttcttcctatatatgtatgcttatttttatttagaaaatgttatgaaatcatataatttggtaatc

SEQ ID NO: 1741 - protein, 355 aa, Arabidopsis thaliana
  misc_feature (285)..(329): Pfam Name: CCT Pfam Description: CCT motif
  misc_feature (61)..(103): Pfam Name: zf-B_box Pfam Description: B-box zinc finger
  misc_feature (17)..(60): Pfam Name: zf-B_box Pfam Description: B-box zinc finger
  misc_feature (1)..(355): Ceres SEED LINE ID no. CW00676
  misc_feature (1)..(355): Ceres Clone ID no. 6639
  misc_feature (1)..(355): Bit score of 858.2 for HMM based on sequences of Figure 33
  misc_feature (1)..(355): in Figure 33
MGFGLESIKSISGGWGAAARSCDACKSVTAAVFCRVDSAFLCIACDTRIHSFTRHERVWVCEVCEQAPAAVTCKADAAALCVTCDADIHSANPLASRHERVPVETFFDSAETAVAKISASSTFGILGSSTTVDLTAVPVMADDLGLCPWLLPNDFNEPAKIEIGTENMKGSSDFMFSDFDRLIDFEFPNSFNHHQNNAGGDSLVPVQTKTEPLPLTNNDHCFDIDFCRSKLSAFTYPSQSVSHSVSTSSIEYGVVPDGNTNNSVNRSTITSSTTGGDHQASSMDREARVLRYREKRKNRKFEKTIRYASRKAYAESRPRIKGRFAKRTETENDDIFLSHVYASAAHAQYGVVPTF

SEQ ID NO: 1742 - DNA, 1155 bp, Populus balsamifera subsp. trichocarpa
  misc_feature (1)..(1155): Ceres Annot ID no. 1482536
  misc_feature (1)..(1155): Encodes the peptide sequence at SEQ ID NO. 1743
atgggaattgaagttgagagcttaaagaacttgaccggaggatggagtgttgcggctaaacgttgcgactcgtgcaaaacggcagctgcagctgcgttttgccgggcggactctgcttttttgtgtctgaattgtgacaccaagattcaccatagtggggtgaacagcaagatcatgtcaaggcacgagcgtgtgtggatgtgtgaggtttgcgagcaagcacccgctgcggttacctgtaaggctgatgcagctgctctttgtgttacttgtgatgctgacatccactctgctaaccctcttgctcgccgtcatgaacgagtccccgtggagcctttttatgactctgctgaatcaattgttaagacttcctcggcgtttaattttctagtgcctggtgatcaaaatggtgtgtctgcatatgatcataacgatgagatcgagggtgtttcgtggttgttgcacggtaatcacacaacacatgaccttaataccaagatcaacatcgagaatcctgttgtcaagactggagatatgtttttctgtgaaatggatccctttcttgattttgagtatcagaattcgatggatgggaggtacaagcagagtcatggtgggggtggtgctggagctgatagcgttgtgcctgtgcaaaacaaaccagctccgcttcccgtgatcgatcataaaaactgctttgatattgatttctgtagatcgaaactcacctctttcagcagctacccctctcagtcccttagccacagcgtttcttcgtcttccctcgatgttggtgttgttcctgatgggaattctatgtccgatatttcgtatcccttcggccgaagcatgaatacttataccgatccaagcatgcccatctcaggttccactacaaatcaagcagcagctcagttagctgggattgaccgcgaagctagagttttgaggtacagagagaaaagaaagaaccgtaaattcgaaaaaaccatacggtatgcttcacgtaaagcttacgcagaaaccaggccaagaatcaaaggccgattcgcgaagcgaaccgaaatggaatccgatatggacaccctatataactctccgagctctgtccctttcctggccgatactcattacggtgtcgttccctcgttttga

SEQ ID NO: 1743 - protein, 384 aa, Populus balsamifera subsp. trichocarpa
  misc_feature (311)..(355): Pfam Name: CCT Pfam Description: CCT motif
  misc_feature (63)..(110): Pfam Name: zf-B_box Pfam Description: B-box zinc finger
  misc_feature (17)..(56): Pfam Name: zf-B_box Pfam Description: B-box zinc finger
  misc_feature (1)..(384): Ceres Annot ID no. 1482536
  misc_feature (1)..(384): Bit score of 987.6 for HMM based on sequences of Figure 33
  misc_feature (1)..(384): Functional Homolog Of SEQ ID NO. 1741
  misc_feature (1)..(384): in Figure 33
MGIEVESLKNLTGGWSVAAKRCDSCKTAAAAAFCRADSAFLCLNCDTKIHHSGVNSKIMSRHERVWMCEVCEQAPAAVTCKADAAALCVTCDADIHSANPLARRHERVPVEPFYDSAESIVKTSSAFNFLVPGDQNGVSAYDHNDEIEGVSWLLHGNHTTHDLNTKINIENPVVKTGDMFFCEMDPFLDFEYQNSMDGRYKQSHGGGGAGADSVVPVQNKPAPLPVIDHKNCFDIDFCRSKLTSFSSYPSQSLSHSVSSSSLDVGVVPDGNSMSDISYPFGRSMNTYTDPSMPISGSTTNQAAAQLAGIDREARVLRYREKRKNRKFEKTIRYASRKAYAETRPRIKGRFAKRTEMESDMDTLYNSPSSVPFLADTHYGVVPSF

SEQ ID NO: 1744 - DNA, 1541 bp, Gossypium hirsutum
  misc_feature (1)..(1541): Ceres Clone ID no. 1842825
  misc_feature (1)..(1541): Encodes the peptide sequence at SEQ ID NO. 1745
aagagcaaactgtggcactactccatgtatactcccaaaatctctaaaaagggaaatactagtcctttcgagggcaactgaaagaggagaaaaaaaaatctattggttttgatttgtgaggatggtaatcgatacaaccaacgtcaagggacttacgggacgctggggcatggcagcaaagacatgcgacacatgtaaatcagcggcagcggctattttctgtcgttctgattccgcttttatgtgcctcagctgcgattccaggatccactctgctaatgacaagcttgtttcttgtcgtcacgagagggtgtggatgtgtgaggtgtgcgagcaggccccagctgccgtcacttgcaaggccgacgccgctgccctttgcgtcgcctgcgattccgacatccactctgctaatcctttggctcgtcgccacgagcgtgtccctgtccagcctttctttgactctgctgattccatcgtcaaatcttcttctttcagcttccttgtgccgactgatcctaatactggttctaattgtcaacaagaagatgtagagacaggttcttggctgttgcccaatcccaaactcaccatggaaactaaccaagtcaaaacaggggattttttcttctccgacatggatccgtttattgattttgagtaccaggattcgtttcaacagcatgacggagctatggacagcgtagttccagttcagaccaaaccagctacaatttcaatgatcaacaatgaaaattgtttcgatgttgatttctgtcgatccaagttccctactttcagctaccagacaaagtctcaaagccatagtgtttcatcatcgtcgctcgaggtaggagtagttccagatgggaactccgtgtcggatatctcatatactttgggacggaccatgggtgacccaagcgcaccaatctgggcagctacagccaataaccaagcaccacctcaggcccaagtcggtggaatggatcgagaagctagagttctaaggtacagagagaagagaaagaacagaaaatttgagaaaacaatccgctacgcttcgagaaaggcatacgccgagtcaaggccaaggatcaaaggccgtttcgccaaaagaaatgaaaccgacaacgaagttgaccacatgtataactcggcttcttccgctgctaccgcagcagctttcatgtacgataaccagtacggcatcgtcccatccttttgaggatgtcatgaatgaatctgattcagatggaaacaagaattgttggctgtaatattcaactgtgatatatatatccagcaagtagaatcaactaccctaaggaaaacaaatgatgtagcttttaattatggttattgatgtaaaaatagtgtatccatgagctattgatttgcagggattcattcaagttgattaactgcagaataagatggaaaagtcctgcaaaatctgaaacaaagcccttccactttttctctagagggcttcttctgtgattctgttatctagaagtaaaagtttttcttggtttttc

SEQ ID NO: 1745 - protein, 368 aa, Gossypium hirsutum
  misc_feature (291)..(335): Pfam Name: CCT Pfam Description: CCT motif
  misc_feature (65)..(109): Pfam Name: zf-B_box Pfam Description: B-box zinc finger
  misc_feature (17)..(64): Pfam Name: zf-B_box Pfam Description: B-box zinc finger
  misc_feature (1)..(368): Ceres Clone ID no. 1842825
  misc_feature (1)..(368): Bit score of 935.5 for HMM based on sequences of Figure 33
  misc_feature (1)..(368): Functional Homolog Of SEQ ID NO. 1741
  misc_feature (1)..(368): in Figure 33
MVIDTTNVKGLTGRWGMAAKTCDTCKSAAAAIFCRSDSAFMCLSCDSRIHSANDKLVSCRHERVWMCEVCEQAPAAVTCKADAAALCVACDSDIHSANPLARRHERVPVQPFFDSADSIVKSSSFSFLVPTDPNTGSNCQQEDVETGSWLLPNPKLTMETNQVKTGDFFFSDMDPFIDFEYQDSFQQHDGAMDSVVPVQTKPATISMINNENCFDVDFCRSKFPTFSYQTKSQSHSVSSSSLEVGVVPDGNSVSDISYTLGRTMGDPSAPIWAATANNQAPPQAQVGGMDREARVLRYREKRKNRKFEKTIRYASRKAYAESRPRIKGRFAKRNETDNEVDHMYNSASSAATAAAFMYDNQYGIVPSF

SEQ ID NO: 1746 - DNA, 1428 bp, Glycine max
  misc_feature (1)..(1428): Ceres Clone ID no. 463157
  misc_feature (1)..(1428): Encodes the peptide sequence at SEQ ID NO. 1747
aactcactcactcattcaagtcgctaatcctagttccttcaactcctcgctggcaacaacagcagtactaccattagccgcgtttttcaaaagtgattttcgagaattagcgatgggaattgaaagaggaggcttcaagggattcaggagcgcctggagcgtgccgcccaagccgtgcgattcctgcaagctggcctcggcggcgcttttctgccgccccgattccgcgtttctctgcatcgcctgcgattccaacattcactgctcgaacaaactcgcgtcgcgccacgagcgcgtgtggatgtgtgaggtgtgcgagcaggcacccgctgctgtcacgtgcaaggccgacgccgccgccctctgcgtcacgtgtgactccgacatccactccgcgaaccccctcgcgcaacgccacgagcgcgtccccgtggaacctttctttgactccgctgagtccatagtgaaagcctctgctgccgccaccttcgggttcattgtcccatccgacgacggcggcgcctccgacgctttcgcccccgatgactccgacgccgccgcgtggctcatcccgaaccctaatttcgggtccaagctcatggacgcccccgaaatcaagtccaaggagatattcttctctgaaatggaccccttcctcgattttgattactcaaactccttccaaaacaacaacagcgccggaaacgacagcgtcgttccagttcaaaaaccctctctcgcccctcccctaatcaataatcaccaccaccaccaatcagaaacttgcttcgacgtcgatttttgtcgctcgaagctctcctcctttaactacccttccaattctcttagccaaagcgtttcgtcgtcgtcgcttgatgttggagtggtgccggacgggaacacggtgtcagacatgtcgtattcttttggtcggaacagttcggattcgagtgggattgttgttgtgtcaggaaatagtgtggggcaaggtgcgacgcagttgtgtggaatggatcgggaagcgagggtactgcgatacagagagaaaaggaagaaccgaaaattcgagaagacaattcgatacgcatcgcgaaaagcatatgcggaaacccggcccaggataaaaggccgcttcgccaaacgaacagaaattgactcggatgtggagcgtctctatagccctggccctgcggtgctcatgctggacactccatacggcgtcgtaccatcgttttagttaatttcaaaatgaagaaacgatggagtgcatgaatcttagaataatgattagcgattctgtgggattgttaggggaaaaaggtgaagaatcgaatcggtacgaacgtgattcttagctggagcgcgatgggggaagattattgtgaagatttgtctcgatcgaccagaaaagcccgtttactttttatg

SEQ ID NO: 1747 - protein, 374 aa, Glycine max
  misc_feature (302)..(346): Pfam Name: CCT Pfam Description: CCT motif
  misc_feature (65)..(107): Pfam Name: zf-B_box Pfam Description: B-box zinc finger
  misc_feature (17)..(64): Pfam Name: zf-B_box Pfam Description: B-box zinc finger
  misc_feature (1)..(374): Ceres Clone ID no. 463157
  misc_feature (1)..(374): Bit score of 985.8 for HMM based on sequences of Figure 33
  misc_feature (1)..(374): Functional Homolog Of SEQ ID NO. 1741
  misc_feature (1)..(374): in Figure 33
MGIERGGFKGFRSAWSVPPKPCDSCKLASAALFCRPDSAFLCIACDSNIHCSNKLASRHERVWMCEVCEQAPAAVTCKADAAALCVTCDSDIHSANPLAQRHERVPVEPFFDSAESIVKASAAATFGFIVPSDDGGASDAFAPDDSDAAAWLIPNPNFGSKLMDAPEIKSKEIFFSEMDPFLDFDYSNSFQNNNSAGNDSVVPVQKPSLAPPLINNHHHHQSETCFDVDFCRSKLSSFNYPSNSLSQSVSSSSLDVGVVPDGNTVSDMSYSFGRNSSDSSGIVVVSGNSVGQGATQLCGMDREARVLRYREKRKNRKFEKTIRYASRKAYAETRPRIKGRFAKRTEIDSDVERLYSPGPAVLMLDTPYGVVPSF

SEQ ID NO: 1748 - protein, 386 aa, Solanum lycopersicum
  misc_feature (307)..(351): Pfam Name: CCT Pfam Description: CCT motif
  misc_feature (64)..(106): Pfam Name: zf-B_box Pfam Description: B-box zinc finger
  misc_feature (22)..(63): Pfam Name: zf-B_box Pfam Description: B-box zinc finger
  misc_feature (1)..(386): Public GI ID no. 186915025
  misc_feature (1)..(386): Bit score of 914.5 for HMM based on sequences of Figure 33
  misc_feature (1)..(386): Functional Homolog Of SEQ ID NO. 1741
  misc_feature (1)..(386): in Figure 33
MGIFREAPNCFPGGWNIGAAARMAKSCEYCHLAAALVFCRTDNTFVCLSCDTRLHARHERVWVCEVCEQAAASVTCRADAAALCVACDRDIHSANPLARRHERVPVVPFYDPVESVVKSTAATLLVSINGTTTTATTTATITPELGKVDTCIGHHENNNDPWIPPNTITSKLPLNTEMKGMDFIFTDSENFLDFDYPACVDTQSQPHYNSSNDSVVPVQANTPIKSLPFHHQEKHFEIDFTQSHIKSYNTPSLSVSSSSLDVGIVPDGSSISEISYPYIRTMNNSNSSIDLSNSANHQGEKLLGLDREARVLRYREKKKNRKFEKTIRYASRKAYAETRPRIKGRFAKRTDGSAGAGEFDDVDGIFSGTDFIAAESRYGVVPSFLT

SEQ ID NO: 1749 - protein, 343 aa, Prunus persica
  misc_feature (282)..(326): Pfam Name: CCT Pfam Description: CCT motif
  misc_feature (1)..(48): Pfam Name: zf-B_box Pfam Description: B-box zinc finger
  misc_feature (49)..(91): Pfam Name: zf-B_box Pfam Description: B-box zinc finger
  misc_feature (1)..(343): Public GI ID no. 197726026
  misc_feature (1)..(343): Bit score of 868.4 for HMM based on sequences of Figure 33
  misc_feature (1)..(343): Functional Homolog Of SEQ ID NO. 1741
  misc_feature (1)..(343): in Figure 33
MASKLCDSCKSATATLFCRADSAFLCVNCDSKIHAANKLASRHARVWLCEVCEQAPAHVTCKADDAALCVTCDRDIHSANPLSRRHERVPVTPFYDSGNSAANSAPVVKSVVNFLDDRYFSDVDGQDAETEVSREEAEAASWLLPNPKAMENPDLNSGEYFLPEMDPYLDLDYGHVDPKLEDAQEQNSCGTDGVVPVQSKSVQPQLVNDHSFEIDFSAASKPYVYGFHAQCLSQSVSSSSMDVSVVPDGNTTMTDVCDPYTKSMSAAVESTHQAVQISSADREARVLRYREKRKNRKFEKTIRYASRKAYAETRPRIKGRFAKRTEVEIEAERLCRYGVVPSF

SEQ ID NO: 1750 - protein, 329 aa, Malus x domestica
  misc_feature (268)..(312): Pfam Name: CCT Pfam Description: CCT motif
  misc_feature (1)..(48): Pfam Name: zf-B_box Pfam Description: B-box zinc finger
  misc_feature (49)..(91): Pfam Name: zf-B_box Pfam Description: B-box zinc finger
  misc_feature (1)..(329): Public GI ID no. 4091806
  misc_feature (1)..(329): Bit score of 829.1 for HMM based on sequences of Figure 33
  misc_feature (1)..(329): Functional Homolog Of SEQ ID NO. 1741
  misc_feature (1)..(329): in Figure 33
MASKLCDSCQSATATLFCRADSAFLCVNCDSKIHAANKLASRHPRVWLCEVCEQAPAHVTCKADDAALCVTCDRDIHSANPLSSRHDRVPVTPFYDSVNSAANSVPVVKSVVNFLDDRYLSDVDGETEVSREEAEAASWLLPNPKAMENPDLNSGQYLFQEMDPYLDLDYGHVDPKLEEAQEQNSCGADGVVPVQSKNMQPLLVNDQSFELDFSAGSKPFVYGYHHARCLSQSVSSSSMDISVVPDGNAVTAAVETSQPAVQLSSVDRVARVLRYREKRKNRKFEKTIRYASRKAYAETRPRIKGRFAKRTEVEIEAERMCRYGVVPSF

SEQ ID NO: 1751 - protein, 360 aa, Solanum tuberosum
  misc_feature (299)..(341): Pfam Name: CCT Pfam Description: CCT motif
  misc_feature (56)..(98): Pfam Name: zf-B_box Pfam Description: B-box zinc finger
  misc_feature (8)..(55): Pfam Name: zf-B_box Pfam Description: B-box zinc finger
  misc_feature (1)..(360): Public GI ID no. 111378451
  misc_feature (1)..(360): Bit score of 869.5 for HMM based on sequences of Figure 33
  misc_feature (1)..(360): Functional Homolog Of SEQ ID NO. 1741
  misc_feature (1)..(360): in Figure 33
MGTENWSLTAKLCDSCKTTPATVFCRADSAFLCLGCDCKIHAANKLASRHARVWVCEVCEQAPAVVTCKADAAALCVTCDRDIHSANPLARRHERFPVVPFYDSAVAKSDGGGDADADAADDEKYFDSTSENPSQPEEEAEAASWILPIPKEGTDQYKSADYLFNDMDSYLDIDLMSCEQKPHIIHHQQHQHGHYSSDGVVPVQNNNNETSTHLPGPVVDGFPTYEIDFTGSKPYMYNFTSQSISQSVSSSSLDVGVVPDHSAMTDVSNTFVMNSSAAAGTGTDTEAVPNAVSGLDAGARVMRYRKKRKNIKIEKTIPYASTKAYAETRPKIKGRFAKRTEIEIDLLIDADASYGVVPSF

SEQ ID NO: 1752 - protein, 384 aa, Picea abies
  misc_feature (320)..(364): Pfam Name: CCT Pfam Description: CCT motif
  misc_feature (23)..(70): Pfam Name: zf-B_box Pfam Description: B-box zinc finger
  misc_feature (71)..(113): Pfam Name: zf-B_box Pfam Description: B-box zinc finger
  misc_feature (1)..(384): Public GI ID no. 150014754
  misc_feature (1)..(384): Bit score of 887.9 for HMM based on sequences of Figure 33
  misc_feature (1)..(384): Functional Homolog Of SEQ ID NO. 1741
  misc_feature (1)..(384): in Figure 33
MVKEEDCKVPKEAGIVKEFQAWTMPKPCNVCRIASASLYCRADSAYLCSGCDVKVHGANKLASRHERVWLCEVCEQAPAAVTCKADAASLCVSCDADIHSANPLARRHDRVPIVPFYECASVAKTFLPPPPPPPTSSLQDSDVVGTLDYEDDDEDDEIYAAEAASWLLPNPKSSAEGAKNCDDGGSCFGVDAGPPVNKAAGGYFSVVDLFPDVDPYLDLDYASPLEATGGTDSVVPVQSNVSSQDGAVSTPSDCFDTEKATYSYTTTTSLSHSVSSSSLDVGVVPDATLSDMSRPLNRGVFELANPGVVNVGIQYVQLDREARVLRYKEKRKNRKFEKTIRYASRKAYAETRPRIKGRFAKRVDADVAQMYTSAELSYGLVPSF

SEQ ID NO: 1753 - protein, 362 aa, Chenopodium rubrum
  misc_feature (297)..(341): Pfam Name: CCT Pfam Description: CCT motif
  misc_feature (13)..(60): Pfam Name: zf-B_box Pfam Description: B-box zinc finger
  misc_feature (61)..(103): Pfam Name: zf-B_box Pfam Description: B-box zinc finger
  misc_feature (1)..(362): Public GI ID no. 170779036
  misc_feature (1)..(362): Bit score of 876.1 for HMM based on sequences of Figure 33
  misc_feature (1)..(362): Functional Homolog Of SEQ ID NO. 1741
  misc_feature (1)..(362): in Figure 33
MMKKEVPGGDNNSWARVCDTCRSAPCTVYCKEDSAFLCTSCDARIHAVNQMASRHERVWVCEACEREPAAFLCKADAASLCATCDADIHSANPLARRHHRVPIMPVGCVYGPSDGRMSEDGFLDLPDRDDQTTDHEGDEDEAASWLLLNPGKNSNNQTTNGFLTGGGEVDEYLDLFEYNSGADNQFCEQYNQQQEFSVPEKNCGGDSVVPVQCREVKDHQIQYQNFLFGMECETKSEYTYNTSISHSVSVSSLDVGVVPESTMSDMSVSHSRPPKGTIDLFSSTPMQVPTQLSPLDREARVMRYREKKKNRKFEKTIRYASRKAYAETRPRIKGRFAKRTDVEAERTNSLMSDGGYGIVPSF

SEQ ID NO: 1754 - protein, 312 aa, Pisum sativum
  misc_feature (245)..(289): Pfam Name: CCT Pfam Description: CCT motif
  misc_feature (1)..(48): Pfam Name: zf-B_box Pfam Description: B-box zinc finger
  misc_feature (49)..(91): Pfam Name: zf-B_box Pfam Description: B-box zinc finger
  misc_feature (1)..(312): Public GI ID no. 61611682
  misc_feature (1)..(312): Bit score of 735.0 for HMM based on sequences of Figure 33
  misc_feature (1)..(312): Functional Homolog Of SEQ ID NO. 1741
  misc_feature (1)..(312): in Figure 33
MATKLCDSCKSTKATLFCRSDSAFLCITCDSNIHAANKLASRHHRVTLCEVCEQAPAHVTCKADAAALCVSCDHDIHSANPLASRHERIPLNTFHHNSKQQFFSESDPDADVSTEEAEAASWLLQTPANPKGPDLNSSHYSFTEIDATDLNFVCVDAKTDSPEQHSPGTADGVVPVQSHSKTVTEHYSDINNDFSTSKPFTYNYNHSVSSPSLEVGVVPDGNVMSEMSYCGYGRTEAVQITAADREARVMRYREKRKNRRFEKTIRYASRKAYAETRPRIKGRFAKRTDLNMNVNLIGEDESYDGYGVVPSC

SEQ ID NO: 1755 - protein, 355 aa, Arabidopsis thaliana
  misc_feature (285)..(329): Pfam Name: CCT Pfam Description: CCT motif
  misc_feature (61)..(103): Pfam Name: zf-B_box Pfam Description: B-box zinc finger
  misc_feature (17)..(60): Pfam Name: zf-B_box Pfam Description: B-box zinc finger
  misc_feature (1)..(355): Public GI ID no. 18424009
  misc_feature (1)..(355): Bit score of 855.9 for HMM based on sequences of Figure 33
  misc_feature (1)..(355): Functional Homolog Of SEQ ID NO. 1741
MGFGLESIKSISGGWGAAARSCDACKSVTAAVFCRVDSAFLCIACDTRIHSFTRHERVWVCEVCEQAPAAVTCKADAAALCVSCDADIHSANPLASRHERVPVETFFDSAETAVAKISASSTFGILGSSTTVDLTAVPVMADDLGLCPWLLPNDFNEPAKIEIGTENMKGSSDFMFSDFDRLIDFEFPNSFNHHQNNAGGDSLVPVQTKTEPLPLTNNDHCFDIDFCRSKLSAFTYPSQSVSHSVSTSSIEYGVVPDGNTNNSVNRSTITSSTTGGDHQASSMDREARVLRYREKRKNRKFEKTIRYASRKAYAESRPRIKGRFAKRTETENDDIFLSHVYASAAHAQYGVVPTF

SEQ ID NO: 1756 - protein, 351 aa, Arabidopsis thaliana
  misc_feature (281)..(325): Pfam Name: CCT Pfam Description: CCT motif
  misc_feature (61)..(103): Pfam Name: zf-B_box Pfam Description: B-box zinc finger
  misc_feature (17)..(60): Pfam Name: zf-B_box Pfam Description: B-box zinc finger
  misc_feature (1)..(351): Public GI ID no. 9759262
  misc_feature (1)..(351): Bit score of 841.4 for HMM based on sequences of Figure 33
  misc_feature (1)..(351): Functional Homolog Of SEQ ID NO. 1741
MGFGLESIKSISGGWGAAARSCDACKSVTAAVFCRVDSAFLCIACDTRIHSFTRHERVWVCEVCEQAPAAVTCKADAAALCVSCDADIHSANPLASRHERVPVETFFDSAETAVAKISASSTFGILGSSTTVDLTAVPVMADDLGLCPWLLPNDFNEPAKIEIGTENMKGSSDFMFSDFDRLIDFEFPNSFNHHQNNAGGDSLVPVQTKTEPLPLTNNDHCFDIDFCRSKLSAFTYPSQSVSTSSIEYGVVPDGNTNNSVNRSTITSSTTGGDHQASSMDREARVLRYREKRKNRKFEKTIRYASRKAYAESRPRIKGRFAKRTETENDDIFLSHVYASAAHAQYGVVPTF

SEQ ID NO: 1757 - DNA, 1332 bp, Gossypium hirsutum
  misc_feature (1)..(1332): Ceres Clone ID no. 1834027
  misc_feature (1)..(1332): Encodes the peptide sequence at SEQ ID NO. 1758
ttaaaatcaataacaaacacttcaaaccctccacgtttgatccaaacataatatttttttatttccattgctttgatttgattcgcgattatgggaatcgaaataagcggcggcacgatcattccaggaggttggggggccgccgccatggctgtcgcggctaagacatgcgacgcatgtaaatcatcggcggcagctatcttttgtcgtactgattgggtctttttatgcttgaattgtgattccaatttccattccggtcacgaaagggtgtctatgtgtgaagtttgcgaacaagctccggcggctgtcacttgtaaagccgacgcggcggctctttgtgtcacttgcgacgccgatatccattcagcgaacccactggctcgccgtcacgaacgtgtacccatcgaacctttctacgactccgctgattccatcgtcaaatcttccccttttagcttccttgtgccgacgacggatcataatggtactaattgtaaacaagaaattgaatctaacaaaggggatttttttttcacagaaatggatcggtttatcgatttcgggtacccgaattcatctcaacatcttcatgatgccgccatggatagcgttgttccagttcaaactccaaaaccagtcattccactgatcaacgatggaagctgtttcgatactttcagctatcaaactcaatcatctctcagtcatagcgtttcatcatcgtcgcttgaagtagaaacagttccagatgggaattaccacgcaacacaagtgggtggttcaatcgatcgagaagctagggttttaaggtacaaagagaagagaaagaacaggaaattcgagaagacaatacgatacgcttcaagaaaggcttacgctgaatcaagaccaagaatcaaaggtcgatttgctaaaagaacagaaacccacaacgatgatgttgatcacatgttcaataactcttctttcgctgttggtcctgctggtttcatggcggaaacagactatggtgtcgttccatcgttttgaatgttgatgttttatgtttggtttaatctgtaatgtattaaattatttaatccaatttccagcaaagtagaaataaccttatggccattgaaaatcaaggaagaaagatgcttagttctttgattaatcattaaagtttctgatgtataaaaaacagtgtatcggtggagttcgtcgtatgttcgccatggttgatttgcaggattcctgcaagggagatatattagttttcataaaaatgtttatttcaatctctgaataaaaccagatatatggtaagtaaatgcttcaatttagttc

SEQ ID NO: 1758 - protein, 313 aa, Gossypium hirsutum
  misc_feature (235)..(279): Pfam Name: CCT Pfam Description: CCT motif
  misc_feature (64)..(106): Pfam Name: zf-B_box Pfam Description: B-box zinc finger
  misc_feature (22)..(63): Pfam Name: zf-B_box Pfam Description: B-box zinc finger
  misc_feature (1)..(313): Ceres Clone ID no. 1834027
  misc_feature (1)..(313): Bit score of 578.8 for HMM based on sequences of Figure 33
  misc_feature (1)..(313): Functional Homolog Of SEQ ID NO. 1741
MGIEISGGTIIPGGWGAAAMAVAAKTCDACKSSAAAIFCRTDWVFLCLNCDSNFHSGHERVSMCEVCEQAPAAVTCKADAAALCVTCDADIHSANPLARRHERVPIEPFYDSADSIVKSSPFSFLVPTTDHNGTNCKQEIESNKGDFFFTEMDRFIDFGYPNSSQHLHDAAMDSVVPVQTPKPVIPLINDGSCFDTFSYQTQSSLSHSVSSSSLEVETVPDGNYHATQVGGSIDREARVLRYKEKRKNRKFEKTIRYASRKAYAESRPRIKGRFAKRTETHNDDVDHMFNNSSFAVGPAGFMAETDYGVVPSF

SEQ ID NO: 1759 - DNA, 1077 bp, Solanum lycopersicum
  misc_feature (1)..(1077): Ceres Annot ID no. 8457547
  misc_feature (1)..(1077): Encodes the peptide sequence at SEQ ID NO. 1760
atgggaacggagaattggagtttaacggcgaagttatgtgactcatgcaaaacgtcgccggcgacggtgttctgccgggcagattcagcatttctctgcttaggatgtgactgcaaaatccacgcagcgaacaagttagcgtcacgtcacgcgcgtgtctgggtttgtgaagtgtgtgagcaagctccggcgagtgtcacgtgtaaagcggatgccgctgctctctgcgttacgtgtgaccgtgatattcattcagcaaatccgttagctcgtcgccatgagcgttttccggtagttccgttctatgatttcgccgtcgcgaaatctcacggcggtggtgataccgatgccgatgctgttgatgatgagaagtactttgatagtactaatgagaatccttctcaaccagaggaagaagctgaagcagcgtcgtggatacttccgacgccgaaagaaggaactgatcagtataaatctgctgattacttgtttaatgatatggattcatatttagatatagatctaatgtcatgtgagcaaaaaccacatattcttcatcatcaacagcatcaacacaaccattacagctccgacggagttgtaccagtacagaacaacaacgaaactactcatttacccggtccagtcgttgatggattccctacatacgaactcgatttcactggatctaaaccttatatgtacaatttcacctctcaatcgatcagccaaagtgtttcatcatcatctcttgacgtcggagttgtaccagaccacagcacaatgacggatgtatcaaacacttttgtgatgaactcatcttccggtgctattgccggcgccggcgccgacgttgtaccgaatgcagtttccggtttagacagagaagcaagggtaatgaggtacagagagaagaggaagaatagaaagttcgagaagacgattcgatatgcttctagaaaagcttatgctgagactcggcccagaatcaaagggagattcgctaaacgtactgaaactgaaatcgattcactcatcaccgtcgatgcatcatacggtgtcgttccatcgttttaa

SEQ ID NO: 1760 - protein, 358 aa, Solanum lycopersicum
  misc_feature (295)..(339): Pfam Name: CCT Pfam Description: CCT motif
  misc_feature (56)..(98): Pfam Name: zf-B_box Pfam Description: B-box zinc finger
  misc_feature (8)..(55): Pfam Name: zf-B_box Pfam Description: B-box zinc finger
  misc_feature (1)..(358): Ceres Annot ID no. 8457547
  misc_feature (1)..(358): Bit score of 852.4 for HMM based on sequences of Figure 33
  misc_feature (1)..(358): Functional Homolog Of SEQ ID NO. 1741
MGTENWSLTAKLCDSCKTSPATVFCRADSAFLCLGCDCKIHAANKLASRHARVWVCEVCEQAPASVTCKADAAALCVTCDRDIHSANPLARRHERFPVVPFYDFAVAKSHGGGDTDADAVDDEKYFDSTNENPSQPEEEAEAASWILPTPKEGTDQYKSADYLFNDMDSYLDIDLMSCEQKPHILHHQQHQHNHYSSDGVVPVQNNNETTHLPGPVVDGFPTYELDFTGSKPYMYNFTSQSISQSVSSSSLDVGVVPDHSTMTDVSNTFVMNSSSGAIAGAGADVVPNAVSGLDREARVMRYREKRKNRKFEKTIRYASRKAYAETRPRIKGRFAKRTETEIDSLITVDASYGVVPSF

SEQ ID NO: 1761 - DNA, 1047 bp, Populus balsamifera subsp. trichocarpa
  misc_feature (1)..(1047): Ceres Annot ID no. 1455741
  misc_feature (1)..(1047): Encodes the peptide sequence at SEQ ID NO. 1762
atggcatcaaagctttgtgactcatgcaaatcagcaacagcaacgttgttttgtcgagctgactcagctttcctctgcgtcagttgcgactccaaaatccacgcggccaacaagcttgcttctcgccacgcgcgtgtctgggtctgtgaagtctgtgaacaagccccagctcatgtcacctgcaaggctgacgctgccgctctatgtgtcacctgtgaccgtgacatccactcggcaaaccctcttgcccaacgccacgaacgtgtccctgtcactcccttctttgactcttcctccgctgcgcacggcggtggagctgccgttaacttcttggagtatcgttaccttgatgacgtgaatggtggggatgatgttagtagggaggaggcagaggcggagtcgtggctgttaccgaaccctggtggggggaatactaaaggggtggacagtttggatctgaatacgggtcaatatgtgtttggggcggaaatgcacccgtatttggatttggatcggtatgtggatcagaaagtggaagtggaagtgcaagagcagaacagttcaggtactactgatggggtggtgcctgtgcaaagtaacaaattagggtttcaagctcctgctttggtgaatgacaattgctgctttgagttggatttctctgctggatctaaaacttttgctggtggctatggctataactccttgagccacagtgtttcttcttcatctcttgatgttggagtcgtaccagatggcagtaccttgacagacatatcgaacccttacagtagatcagtgagcaatggaatggagtcggcaaaccagacagtgcaactatcagcagttgaccgcgaagcaagggtgttaaggtatagagagaagagaaagaatcgaaaattcgagaagacaattagatatgcatcgcgaaaagcctatgccgaaacaaggcctcgaatcaaaggaaggttcgctaaacgtactgattccggagtcgaggttgatcggagtagtatttatggattcggcgttgttccatcattctaa

SEQ ID NO: 1762 - protein, 348 aa, Populus balsamifera subsp. trichocarpa
  misc_feature (285)..(329): Pfam Name: CCT Pfam Description: CCT motif
  misc_feature (1)..(48): Pfam Name: zf-B_box Pfam Description: B-box zinc finger
  misc_feature (49)..(91): Pfam Name: zf-B_box Pfam Description: B-box zinc finger
  misc_feature (1)..(348): Ceres Annot ID no. 1455741
  misc_feature (1)..(348): Bit score of 720.3 for HMM based on sequences of Figure 33
  misc_feature (1)..(348): Functional Homolog Of SEQ ID NO. 1741
MASKLCDSCKSATATLFCRADSAFLCVSCDSKIHAANKLASRHARVWVCEVCEQAPAHVTCKADAAALCVTCDRDIHSANPLAQRHERVPVTPFFDSSSAAHGGGAAVNFLEYRYLDDVNGGDDVSREEAEAESWLLPNPGGGNTKGVDSLDLNTGQYVFGAEMHPYLDLDRYVDQKVEVEVQEQNSSGTTDGVVPVQSNKLGFQAPALVNDNCCFELDFSAGSKTFAGGYGYNSLSHSVSSSSLDVGVVPDGSTLTDISNPYSRSVSNGMESANQTVQLSAVDREARVLRYREKRKNRKFEKTIRYASRKAYAETRPRIKGRFAKRTDSGVEVDRSSIYGFGVVPSF

SEQ ID NO: 1763 - protein, 362 aa, Arabidopsis thaliana
  misc_feature (295)..(339): Pfam Name: CCT Pfam Description: CCT motif
  misc_feature (1)..(48): Pfam Name: zf-B_box Pfam Description: B-box zinc finger
  misc_feature (49)..(91): Pfam Name: zf-B_box Pfam Description: B-box zinc finger
  misc_feature (1)..(362): Public GI ID no. 52840166
  misc_feature (1)..(362): Bit score of 679.8 for HMM based on sequences of Figure 33
  misc_feature (1)..(362): Functional Homolog Of SEQ ID NO. 1741
MASKLCDSCKSATAALYCRPDAAFLCLSCDSKVHAANKLASRHARVWMCEVCEQAPAHVTCKADAAALCVTCDRDIHSANPLARRHERVPVTPFYDSVSSDGSVKHTAVNFLDDCYFSDIDGNGSREEEEEEAASWLLLPNPKTTTTATAGIVAVTSAEEVPGDSPEMNTGQQYLFSDPDPYLDLDYGNVDPKVESLEQNSSGTDGVVPVENRTVRIPTVNENCFEMDFTGGSKGFTYGGGYNCISHSVSSSSMEVGVVPDGGSVADVSYPYGGPATSGADPGTQRAVPLTSAEREARVMRYREKRKNRKFEKTIRYASRKAYAEMRPRIKGRFAKRTDTNESNDVVGHGGIFSGFGLVPTF

SEQ ID NO: 1764 - protein, 350 aa, Populus x generosa
  misc_feature (287)..(331): Pfam Name: CCT Pfam Description: CCT motif
  misc_feature (1)..(48): Pfam Name: zf-B_box Pfam Description: B-box zinc finger
  misc_feature (49)..(91): Pfam Name: zf-B_box Pfam Description: B-box zinc finger
  misc_feature (1)..(350): Public GI ID no. 118489345
  misc_feature (1)..(350): Bit score of 711.3 for HMM based on sequences of Figure 33
  misc_feature (1)..(350): Functional Homolog Of SEQ ID NO. 1741
MASKLCDSCKSATATLFCRADSAFLCISCDSKIHAANKLASRHARVSVCEVCEQAPAHFTCKADAAALCVTCDRDIHSANPLASRHERVPITPFFDSSSTVHGGGAAVNLLEDRYFDEVDGGRGDVSREEAEAESWLLPNPGGGTAKGVDSMDLNTGQYVFGSEMDPYLDLDPYVDPKVEVQEQNSSGTTDGVVPVQSNKLGFQAPALVNDNCCYELDFSTGSKSFGGGYGYNSLSHSVSSSSLDVGVVPDGSGSTLTDISNPYCSRSVSNGMESANQTVQLSAVDREARVLRYREKRKNRKFEKTIRYASRKAYAETRPRIKGRFAKRTDTEVEVDRSSLYGFGVVPSF

SEQ ID NO: 1765 - DNA, 1310 bp, Gossypium hirsutum
  misc_feature (1)..(1310): Ceres Clone ID no. 1937613
  misc_feature (1)..(1310): Encodes the peptide sequence at SEQ ID NO. 1766
agacacagagaaagaaaaggagaaagacggtagatttgtttaaccccagcaactcgttgaaatggcgtccaagttgtgtgactcatgcaaatcagcgacggccactctgttctgccgtcctgactcggcttttctttgccccaactgcgactccaaaatccatgccgccaacaagctagcctcccgtcacgctcgggtcttggtctgtgaagtttgcgaacaagcaccggctcacgtcacctgcaaggctgacgcagccgctctttgcgtcacttgtgaccgtgacatccactccgctaaccctctcgctcgccggcacgagcgggttcctttggctcccttttacgattccgtcaagcccaacacagcgtttaacttcctggacgaccgttacttatccgacgttgatggagacgctgacagcagcagggaagaagcggaggcagcttcgtggttgcttcctaaccctaaccacaaagcacatgaaagcccggacgtgaacacggggcagtacgtgtttcccgagatggatccgtatctagatctggattacggtcatgtggatccgaaaatggaaacccaggaccaggagcagaacagttctggaactgatggagtggtccctgtccaaagcaacaccgtccaagctccgatggtcaacgatcactgtttcgacatggagttcactacaccaaaagccttcccttatggctacaactacaactgtaactacaaccttcactgtcttagccacagtgtatcatcttcttctctggatgttggggtagttccagatggcggtagtacgattacggacatatcagtcccgtgcgcgaaagtgacggagacgactcatcaggcggtgcaactctcatcggcggagagagaagcgagggtgctgaggtacagagagaagaggaagaacagaaaattcgagaaaacgatacgttacgcttctaggaaagcttacgcggaggtgcggccgaggattaaaggaagatttgcaaagcgcagtgatgttgaagtcgaagtcgacggcggtaacatgtttggatttggcgtcgttccgtcgttttgaaattaactaaggtagccgtgtagtaatattctacgttaaattttggaactgtaattttctaagtgtttttttttcttcttttctttcctttttacttcattgctcactaaattaataggtaaagaagatgaaggtagggtgatttgtataatccaaataactatggaatctggaccattgattttgtacaagtctcatttttatgttattaatactctgttaatatttgtat

SEQ ID NO: 1766 - protein, 338 aa, Gossypium hirsutum
  misc_feature (275)..(319): Pfam Name: CCT Pfam Description: CCT motif
  misc_feature (1)..(48): Pfam Name: zf-B_box Pfam Description: B-box zinc finger
  misc_feature (49)..(91): Pfam Name: zf-B_box Pfam Description: B-box zinc finger
  misc_feature (1)..(338): Ceres Clone ID no. 1937613
  misc_feature (1)..(338): Bit score of 723.2 for HMM based on sequences of Figure 33
  misc_feature (1)..(338): Functional Homolog Of SEQ ID NO. 1741
MASKLCDSCKSATATLFCRPDSAFLCPNCDSKIHAANKLASRHARVLVCEVCEQAPAHVTCKADAAALCVTCDRDIHSANPLARRHERVPLAPFYDSVKPNTAFNFLDDRYLSDVDGDADSSREEAEAASWLLPNPNHKAHESPDVNTGQYVFPEMDPYLDLDYGHVDPKMETQDQEQNSSGTDGVVPVQSNTVQAPMVNDHCFDMEFTTPKAFPYGYNYNCNYNLHCLSHSVSSSSLDVGVVPDGGSTITDISVPCAKVTETTHQAVQLSSAEREARVLRYREKRKNRKFEKTIRYASRKAYAEVRPRIKGRFAKRSDVEVEVDGGNMFGFGVVPSF

SEQ ID NO: 1767 - protein, 340 aa, Malus x domestica
  misc_feature (279)..(323): Pfam Name: CCT Pfam Description: CCT motif
  misc_feature (1)..(48): Pfam Name: zf-B_box Pfam Description: B-box zinc finger
  misc_feature (49)..(91): Pfam Name: zf-B_box Pfam Description: B-box zinc finger
  misc_feature (1)..(340): Public GI ID no. 189014382
  misc_feature (1)..(340): Bit score of 799.9 for HMM based on sequences of Figure 33
  misc_feature (1)..(340): Functional Homolog Of SEQ ID NO. 1741
MALKLCDSCKSATGTLFCRADSAFLCVNCDSKIHAANKLASRHARVWLCEVCEQAPAHVTCKADDAALCVTCDRDIHSANPLSRRHERVPVTPFYDSVNSATDSVPAVKSAVNFLNDRYFSDVDGEIEARREEAEAASWLLPNPKAMENPDLNSGQYLFPEMDPYMDLDYGHVDPKLEDAQEQNSCITDGVVPEQSKNMQPQLVNDHSFEIDFSAASKPFVYGYHHAQCLRQSVSSSSMDVSIVPDDNAMTDDSNPYNKSMTSAVESSHPAVQLSSADREARVLRYREKRKNRKFEKTIRYASRKAYAETRPRIKGRFAKRTEVEIEAEPMCRYGIVPSF

SEQ ID NO: 1768 - DNA, 1053 bp, Populus balsamifera subsp. trichocarpa
  misc_feature (1)..(1053): Ceres Annot ID no. 1477832
  misc_feature (1)..(1053): Encodes the peptide sequence at SEQ ID NO. 1769
atggcttcaaagctctgtgactcatgcaagtcagcaacagcaacgttgttttgtcgagctgactcagcttttctatgcatcagctgcgactccaaaatccacgcggcaaacaagcttgcctctcgccacgcgcgtgtctcggtctgcgaagtctgtgagcaagccccagcccatttcacctgcaaggcagacgcggctgctctctgtgttacctgtgaccgtgacatccactcagcaaaccctctagctagtcggcacgagcgtgtccctatcactccgtttttcgactcatcctccactgtgcacggcggtggggaagccgtgaacttgttggaggatcggtactttgatgaagtggatggtggtcgtggtgatgttagcagggaggaggcagaggcggagtcgtggctgttgcctaacccgggtggggggactactaagggggtggatagtatggatctgaataccggtcagtatgtgtttggttcggaaatggatccgtatttggatttggatccgtatgtggatccaaaagtggaagtgcaagagcagaacagttcagggactactgatggggtggtgcctgtgcaaagtaacaaactaggatttcaatctcctgctttggtcaatgatcattgctgctatgagttggatttctctactggatccaagtcttttggtggtggctatggctataactccttgagccagagtgtttcttcttcatctcttgatgttggagtggtaccagatggaagtggaagtaccttgacagacatatctaacccatactgtagtagatcagtgtgcaacggaatggagtcagcaaaccagacagtgcaactatcggcagttgaccgtgaagcaagggtgttgaggtacagagagaagaggaagaacagaaaattcgagaagacaattcgatacgcatcaagaaaagcctatgccgaaacaaggccacgaatcaaaggaaggttcgctaaacgtacagatactgaagtcgaggttgatcgaagcagtctttatggattcggtgtcgttccatcgttctaa

SEQ ID NO: 1769 - protein, 350 aa, Populus balsamifera subsp. trichocarpa
  misc_feature (287)..(331): Pfam Name: CCT Pfam Description: CCT motif
  misc_feature (1)..(48): Pfam Name: zf-B_box Pfam Description: B-box zinc finger
  misc_feature (49)..(91): Pfam Name: zf-B_box Pfam Description: B-box zinc finger
  misc_feature (1)..(350): Ceres Annot ID no. 1477832
  misc_feature (1)..(350): Bit score of 703.4 for HMM based on sequences of Figure 33
  misc_feature (1)..(350): Functional Homolog Of SEQ ID NO. 1741
MASKLCDSCKSATATLFCRADSAFLCISCDSKIHAANKLASRHARVSVCEVCEQAPAHFTCKADAAALCVTCDRDIHSANPLASRHERVPITPFFDSSSTVHGGGEAVNLLEDRYFDEVDGGRGDVSREEAEAESWLLPNPGGGTTKGVDSMDLNTGQYVFGSEMDPYLDLDPYVDPKVEVQEQNSSGTTDGVVPVQSNKLGFQSPALVNDHCCYELDFSTGSKSFGGGYGYNSLSQSVSSSSLDVGVVPDGSGSTLTDISNPYCSRSVCNGMESANQTVQLSAVDREARVLRYREKRKNRKFEKTIRYASRKAYAETRPRIKGRFAKRTDTEVEVDRSSLYGFGVVPSF

SEQ ID NO: 1770 - protein, 340 aa, Malus x domestica
  misc_feature (279)..(323): Pfam Name: CCT Pfam Description: CCT motif
  misc_feature (1)..(48): Pfam Name: zf-B_box Pfam Description: B-box zinc finger
  misc_feature (49)..(91): Pfam Name: zf-B_box Pfam Description: B-box zinc finger
  misc_feature (1)..(340): Public GI ID no. 4091804
  misc_feature (1)..(340): Bit score of 774.9 for HMM based on sequences of Figure 33
  misc_feature (1)..(340): Functional Homolog Of SEQ ID NO. 1741
MALKLCDSCKSATGTLFCRADSAFLCVNCDSKIHAANKLASRHARVWLCEVCEQAPAHVTCKADDAALCVTCDRDIHSANPLSHADERVPVTPFYDSVNSATDSVPAVKSAVNFLNDRYFSDVDGEIEARREEAEAASWLLPNPKAMENPDLNSGQYLFPEMDPYMDLDYGHVDPKLEDAQEQNSCITDGVVPEQSKNMQPQLVNDHSFEIDFSAASKPFVYGYHHAQCLRQSVSSSSMDVSIVPDDNAMTDDSNPYNKSMTSAVESSHPAVQLSSADREARVLRYREKRKNRKFEKTIRYASRKAYAETRPRIKGRFAKRTEVEIEAEPMCRYGIVPSF

SEQ ID NO: 1771 - DNA, 1141 bp, Glycine max
  misc_feature (1)..(1141): Ceres Clone ID no. 530984
  misc_feature (1)..(1141): Encodes the peptide sequence at SEQ ID NO. 1772
atcgcttccacaccacaccctattcccaaacaaaaacaacacatcacggagccaccaaccatggcttccaagctctgcgactcatgcaaatccgccactgctaccttgtactgccgccctgacgccgcgttcctctgcggcgcctgcgattctaaggtccacgccgccaacaagctcgcgtcgcgccacccgcgcgtggcgctctgcgaggtgtgcgagcaggccccggcgcacgtaacctgcaaggctgatgccgccgcgctctgccttgcctgcgaccgcgacatccactccgccaaccccctcgccagccgccacgagcgcatccccgtctcaccgttcttcgagtccgtacactccgtcaaggcctcctcgccgatcaacttcctagatgaccaccgcttcttctccgacgccgatgctgacgtcagcaccgaggaggccgaggccgcctcctggctgcttcctaatccgaagacagatctaaattcctctcagtacttgttctccgaaaccgagccggttccttacatagatctggattatgctgccgtggatcctaaggcggagcagaaaagctccgccaccgccgacggcgtcgttcccgtgcagagcaacttcgagccattcgcctacggttacaagtacaataccactctctcacagtctcagatgagccagagtgtatcgtcgtcgtcgatggaggttggagtcgtgccggacgggaacacaatgtcggagacatcgaactgcagctacagcaaggtgcctccggtgacggtgacggtgacggcgcagttctcggcggcggatagggaggcgagagtgttgaggtacagggagaagaggaagaaccgtaagttcgagaagacgattcgttacgcatcgagaaaagcatatgcggaggcgaggccaaggatcaaagggaggtttgcgaaacgcactgacccggaccctctggctggatacggcgtcgttccgtcgtgttgatttcgctatgatgttaatcatatatatcattatatgaatatgaatgatgctgttgtttttgctgtatatacactatgctcttttcttttttgtttgaattatgcaatgtaaagttgcaaaaacacatttgtgatagattttgtagtttgtt

SEQ ID NO: 1772 - protein, 309 aa, Glycine max
  misc_feature (252)..(296): Pfam Name: CCT Pfam Description: CCT motif
  misc_feature (1)..(48): Pfam Name: zf-B_box Pfam Description: B-box zinc finger
  misc_feature (49)..(91): Pfam Name: zf-B_box Pfam Description: B-box zinc finger
  misc_feature (1)..(309): Ceres Clone ID no. 530984
  misc_feature (1)..(309): Bit score of 609.7 for HMM based on sequences of Figure 33
  misc_feature (1)..(309): Functional Homolog Of SEQ ID NO. 1741
MASKLCDSCKSATATLYCRPDAAFLCGACDSKVHAANKLASRHPRVALCEVCEQAPAHVTCKADAAALCLACDRDIHSANPLASRHERIPVSPFFESVHSVKASSPINFLDDHRFFSDADADVSTEEAEAASWLLPNPKTDLNSSQYLFSETEPVPYIDLDYAAVDPKAEQKSSATADGVVPVQSNFEPFAYGYKYNTTLSQSQMSQSVSSSSMEVGVVPDGNTMSETSNCSYSKVPPVTVTVTAQFSAADREARVLRYREKRKNRKFEKTIRYASRKAYAEARPRIKGRFAKRTDPDPLAGYGVVPSC

SEQ ID NO: 1773 - protein, 384 aa, Picea sitchensis
  misc_feature (320)..(364): Pfam Name: CCT Pfam Description: CCT motif
  misc_feature (23)..(70): Pfam Name: zf-B_box Pfam Description: B-box zinc finger
  misc_feature (71)..(113): Pfam Name: zf-B_box Pfam Description: B-box zinc finger
  misc_feature (1)..(384): Public GI ID no. 116787635
  misc_feature (1)..(384): Bit score of 877.3 for HMM based on sequences of Figure 33
  misc_feature (1)..(384): Functional Homolog Of SEQ ID NO. 1741
MVKEEDCKVPKEAGIVKEFQAWTMPKPCNVCRIASASLYCRADSAYLCSGCDVKVHGANKLASRHERVWLCEVCEQAPAAVTCKADAASLCVSCDADIHSANPLARRHDRVPIVPFYECASVAKTFLPPPPPPPTSSLQDSDVVGTLDYEDHDDDDEIYAAEAASWLLPNPKSSAEGTKNCDDGGSCFGVDAGPPVNKAAGGYFSVVDLFPDVDPYLDLDYASPLEATGGTDSVVPVQSNVSSQDGAVSTPSDCFDTEKVTYSYTTTTSLSHSVSSSSLDVGVVPDATLSDMPRPLNRGVFELANPGVVNVGIQYVQLDREARVLRYKEKRKNRKFEKTIRYASRKAYAETRPRIKGRFAKRVDADVAQMYTSAELSYGLVPSF

SEQ ID NO: 1774 - protein, 307 aa, Raphanus sativus
  misc_feature (241)..(285): Pfam Name: CCT Pfam Description: CCT motif
  misc_feature (1)..(48): Pfam Name: zf-B_box Pfam Description: B-box zinc finger
  misc_feature (49)..(91): Pfam Name: zf-B_box Pfam Description: B-box zinc finger
  misc_feature (1)..(307): Public GI ID no. 3341723
  misc_feature (1)..(307): Bit score of 472.5 for HMM based on sequences of Figure 33
  misc_feature (1)..(307): Functional Homolog Of SEQ ID NO. 1741
MASRLCDSCRSAAATLYCRADAAFLCGECDGKIHTANKLASRHERVLLCQICEQAPAHVTCEADAAALCVTCDRDIHSANPLSRRHERVSVTPFYDAPAQGGSPATTKSAASSNLFGEDADVSMEAVSWLLPNPSVKEGVVVEIPNLFADLDYSAVDPKMEASENSSGNDGVVPVQTKALFLNEDYFNFDVSASKTTFPHGYSCINQTVSSTSLEVPLVPEGGAVTTTNATPAVQLSPAEREARVLRYREKRKNRKFEKTIRYASRKAYAEVRPRIKGRFAKRTDSRVNDGGGDVGVYGGFGVVPSF

SEQ ID NO: 1775 - DNA, 1310 bp, Arabidopsis thaliana
  misc_feature (1)..(1310): Ceres Clone ID no. 949
  misc_feature (1)..(1310): Encodes the peptide sequence at SEQ ID NO. 1776
aattacaatctctccttttgccaacaatcattgcttaaaaaacacataccttcttctttagttataaaaatgttgaaagaagagagtaatgagagtggtacttgggcacgagcatgtgacacttgtcgttcagccgcctgcactgtctactgtgaagccgactctgcctacttgtgcaccacctgtgatgctcgagttcacgcagccaaccgtgttgcttctcgccatgaacgtgttcgtgtctgtcagtcatgtgagtctgccccagctgcgtttttgtgtaaagcagacgctgcgtctctttgtacagcttgtgatgcagagattcattccgcaaacccactagctagacgtcatcagcgagttccgattcttccattatctgcaaactcttgcagctccatggccccaagtgagactgatgctgataacgatgaggatgatcgagaggttgcttcgtggttactccctaatccagggaaaaacatcggtaatcagaataatgggttcttgtttggtgttgagtaccttgatcttgtggattacagctccagcatggacaaccaattcgaagataatcagtacactcactaccagaggagctttggaggagatggagttgtgccgcttcaagttgaagaatcaacaagtcacctgcaacaaagccaacaaaactttcagttgggtatcaactatggattctcctcaggagctcactacaacaacaactccttaaaggacctaaaccatagcgcatccgtttcatcaatggacatcagtgttgtgccagagtcaactgcaagtgacataacagtccaacacccaagaactactaaagagacgatagaccaactatctggtcctcctactcaggtggtgcaacagcttactccaatggagagggaggctagggtcctgagatacagagagaagaagaagacaaggaaatttgacaagacaataagatatgcttcaagaaaggcatatgcagagataagaccacggatcaagggcagattcgcaaagaggatagaaactgaagctgaggctgaagaaatcttctcaacatcgctaatgtctgagactggatatggaattgttccttccttctaaactcctatggcgaagatggactagattgcatgctgtaaattacttctagtttggatttctacaagttattactgcatatgggtccttagttttgtgacttttgtctaactagtacgagtttaatcagatatgttcctatagctgcagttgtttaagcaacatctcgctacataattgaattggtgaaatcttatcac

SEQ ID NO: 1776 - protein, 347 aa, Arabidopsis thaliana
  misc_feature (278)..(322): Pfam Name: CCT Pfam Description: CCT motif
  misc_feature (59)..(101): Pfam Name: zf-B_box Pfam Description: B-box zinc finger
  misc_feature (11)..(58): Pfam Name: zf-B_box Pfam Description: B-box zinc finger
  misc_feature (1)..(347): Ceres Clone ID no. 949
  misc_feature (1)..(347): Bit score of 498.2 for HMM based on sequences of Figure 33
  misc_feature (1)..(347): Functional Homolog Of SEQ ID NO. 1741
MLKEESNESGTWARACDTCRSAACTVYCEADSAYLCTTCDARVHAANRVASRHERVRVCQSCESAPAAFLCKADAASLCTACDAEIHSANPLARRHQRVPILPLSANSCSSMAPSETDADNDEDDREVASWLLPNPGKNIGNQNNGFLFGVEYLDLVDYSSSMDNQFEDNQYTHYQRSFGGDGVVPLQVEESTSHLQQSQQNFQLGINYGFSSGAHYNNNSLKDLNHSASVSSMDISVVPESTASDITVQHPRTTKETIDQLSGPPTQVVQQLTPMEREARVLRYREKKKTRKFDKTIRYASRKAYAEIRPRIKGRFAKRIETEAEAEEIFSTSLMSETGYGIVPSF

SEQ ID NO: 1777 - DNA, 1125 bp, Arabidopsis thaliana
  misc_feature (1)..(1125): Ceres Clone ID no. 17434
  misc_feature (1)..(1125): Encodes the peptide sequence at SEQ ID NO. 1778
gactccattattatccctctctctacaaaaaaaaacagtagagagagatatagagagcatcaatggcgtcgtcgtcaagactttgcgattcgtgcaaatcgacggcagcaactctattctgccgcgcagacgccgcgtttctctgcggcaactgcgacggtaagatccacacagctaacaaactcgcatcacgtcacgaacgagtttggctatgtgaagtatgcgaacaagcaccagcacacgtcacgtgcaaagctgacgccgctgcgttatgcgtcacgtgcgaccgtgatatccactcagctaatccactctctcgccgccacgagcgcgtaccaatcactcctttctacgacgctgttggtccagcaaaatccgcttcctcctccgtcaatttcgtagatgaagatggcggtgacgtcactgcttcgtggcttttagctaaagaaggaatcgaaatcactaatttgttttccgatcttgattatccgaagattgaggtcacgtcggaggagaatagctccggtaacgacggagttgttcctgtgcagaataagttgtttctcaatgaagattacttcaatttcgatctctctgcttccaaaatttctcaacaaggattcaatttcatcaaccaaactgtttcgacgagaacgatagatgtaccgttggtgcctgaaagtggaggagtgacggcggagatgacgaacacggagacgccagctgtgcagttatcaccggcggagagggaagcaagggttttgaggtatagagagaagaggaagaatcggaaatttgagaagacgattaggtatgcgtcgcgtaaagcttacgctgagatgaggccgagaatcaaaggacgttttgctaagagaacagattcgagagagaatgatggtggagacgtcggagtttattgcggattcggtgttgttccgagtttctgatatttcccggttaaagaaacatggtagtagtatatcggttaatagcagattaaggataattaaaactaaaatgtttcctgatttaatcaggggctaagttattgttagaagattgttgttttttgaattaattctcacaattgtatcctaaattatatagtttacttaatgttgaact

SEQ ID NO: 1778 - protein, 294 aa, Arabidopsis thaliana
  misc_feature (229)..(273): Pfam Name: CCT Pfam Description: CCT motif
  misc_feature (3)..(50): Pfam Name: zf-B_box Pfam Description: B-box zinc finger
  misc_feature (51)..(93): Pfam Name: zf-B_box Pfam Description: B-box zinc finger
  misc_feature (1)..(294): Ceres Clone ID no. 17434
  misc_feature (1)..(294): Bit score of 491.3 for HMM based on sequences of Figure 33
  misc_feature (1)..(294): Functional Homolog Of SEQ ID NO. 1741
MASSSRLCDSCKSTAATLFCRADAAFLCGNCDGKIHTANKLASRHERVWLCEVCEQAPAHVTCKADAAALCVTCDRDIHSANPLSRRHERVPITPFYDAVGPAKSASSSVNFVDEDGGDVTASWLLAKEGIEITNLFSDLDYPKIEVTSEENSSGNDGVVPVQNKLFLNEDYFNFDLSASKISQQGFNFINQTVSTRTIDVPLVPESGGVTAEMTNTETPAVQLSPAEREARVLRYREKRKNRKFEKTIRYASRKAYAEMRPRIKGRFAKRTDSRENDGGDVGVYCGFGVVPSF

SEQ ID NO: 1779 - protein, 367 aa, Beta vulgaris subsp. vulgaris
  misc_feature (298)..(342): Pfam Name: CCT Pfam Description: CCT motif
  misc_feature (13)..(60): Pfam Name: zf-B_box Pfam Description: B-box zinc finger
  misc_feature (61)..(103): Pfam Name: zf-B_box Pfam Description: B-box zinc finger
  misc_feature (1)..(367): Public GI ID no. 186911828
  misc_feature (1)..(367): Bit score of 813.3 for HMM based on sequences of Figure 33
  misc_feature (1)..(367): Functional Homolog Of SEQ ID NO. 1741
MMKEEVSGSDTNSWARVCDTCRAAPCTVYCRADSAFLCTSCDARIHAANQVASRHERVWVCEACERAPAAFLCKADAASLCATCDAEIHSANPLARRHQRVPIMPVAGCVYGPQGGRMSEDRFLTLPEGDDHTTDHEGDEDEAASWLLLNPVKNSNNQNTNGFLTGGGEVDEYLDLLEYNSGADNQLCEQYNQQQEFKVPEKNCGGDSVVPVQCREAKDHQIQYQNFLFGMECETKSGYTYNTSISQSVSVSSMDVGVVPESAMSDISMSHPRPPKGTIDLFSSPPMQVPTQLSPLDREARVMRYREKKKNRKFEKTIRYASRKAYAETRPRIKGRFAKRTDVEAEMDQMFTNSLMADSGYGIVPSY

SEQ ID NO: 1780 - protein, 336 aa, Chenopodium rubrum
  misc_feature (267)..(311): Pfam Name: CCT Pfam Description: CCT motif
  misc_feature (13)..(60): Pfam Name: zf-B_box Pfam Description: B-box zinc finger
  misc_feature (61)..(103): Pfam Name: zf-B_box Pfam Description: B-box zinc finger
  misc_feature (1)..(336): Public GI ID no. 170779038
  misc_feature (1)..(336): Bit score of 762.0 for HMM based on sequences of Figure 33
  misc_feature (1)..(336): Functional Homolog Of SEQ ID NO. 1741
MMKKEVPGGDNNSWARVCDTCRSAPCTVYCKEDSAFLCTSCDARIHAVNQVASRHERVWVCEACEREPAAFLCKADAASLCATCDADIHSANPLARRHHRVPIMPVGCVYGPSDGRMSEEGFLDLPDGDDQTTDHEGDEDEAASWLLLNPGADNQFCEQYSQQQEFSVPEKNCGGDSVVPVQCREVKDHQIQYQKFLFGMECETKSEYNYNTSISHSVSVSSLDVGVVPESTMSDMSVSHSRPPKGTIDLFSSPPMQVPTQLSPLDREARVMRYREKKKNRKFEKTIRYASRKAYAETRPRIKGRFAKRTDVEAEMDQMFTNSLMSDGGYGIVPSF

SEQ ID NO: 1781 - protein, 312 aa, Pisum sativum
  misc_feature (245)..(289): Pfam Name: CCT Pfam Description: CCT motif
  misc_feature (1)..(48): Pfam Name: zf-B_box Pfam Description: B-box zinc finger
  misc_feature (49)..(91): Pfam Name: zf-B_box Pfam Description: B-box zinc finger
  misc_feature (1)..(312): Public GI ID no. 60459257
  misc_feature (1)..(312): Bit score of 718.1 for HMM based on sequences of Figure 33
  misc_feature (1)..(312): Functional Homolog Of SEQ ID NO. 1741
MATKLCDSCKSTKATLFCRSDSAFLCITCDSNIQAANKLASRHHRVTLCEVCEQAPAHVTCKADAAALCVSCDHDIHSANPPASRHERIPLNTFHHNSKQQFFSESDPDADVSTEEAEAASWLLQTPANPKGPDLNSSHYSFTEIDATDLNFVCVDAKTDSPEQHSPGTADGVVPVQSHSKTVTEHYSDINNDFSTSKPFTYNYNHSVSSSSLEVGVVPDGNVMSEMSYCGYGRTEAVQITAADREARVMRYREKRKNRRFEKTIRYASRKAYAETRPRIKGRFAKRTDLNMNVNLIGEDESYDGYGVVPSC

SEQ ID NO: 1782 - protein, 317 aa, Medicago sativa
  misc_feature (256)..(300): Pfam Name: CCT Pfam Description: CCT motif
  misc_feature (1)..(48): Pfam Name: zf-B_box Pfam Description: B-box zinc finger
  misc_feature (49)..(91): Pfam Name: zf-B_box Pfam Description: B-box zinc finger
  misc_feature (1)..(317): Public GI ID no. 110277457
  misc_feature (1)..(317): Bit score of 589.5 for HMM based on sequences of Figure 33
  misc_feature (1)..(317): Functional Homolog Of SEQ ID NO. 1741
MATKLCDSCKSSKATLFCRSDSAFLCLTCDSNIHAANKLASRHHRVTLCQVCEQAPAHVTCKADAAALCISCDHDIHSANPLARRHERVPLTTFHHHNNNSQQQSFFSENDHDATNEEAGAASWLLQTPSNPKFPDLNYSHYSYPEIDDFVTVNAKTDTPEQNSPGTTADGVVPVQSQSKTTTEHQHEHYSDINIDFSNSKPFTYNFNHTVSSPSMEVGVVPDGNVMTEISYCGYQTTATETAPMTVAVPMTAVEREARVSRYREKRKNRKFEKTIRYASRKAYAETRPRIKGRFAKRSDLNMNLIAEDEYGVVPSC

SEQ ID NO: 1783 - protein, 422 aa, Populus deltoides
  misc_feature (353)..(397): Pfam Name: CCT Pfam Description: CCT motif
  misc_feature (113)..(155): Pfam Name: zf-B_box Pfam Description: B-box zinc finger
  misc_feature (65)..(112): Pfam Name: zf-B_box Pfam Description: B-box zinc finger
  misc_feature (1)..(422): Public GI ID no. 41323976
  misc_feature (1)..(422): Bit score of 633.4 for HMM based on sequences of Figure 33
  misc_feature (1)..(422): Functional Homolog Of SEQ ID NO. 1741
MPRFTSLILSSPLVFFLQVSLILATNAHSLSYIAKDSIIEIGIGREREEVMLKEESGGSGGVVNNWARVCDTCRAAACTVYCRADSAYLCAGCDARVHAANRVASRHERVRVCEACERAPAALLCKADAASLCTACDADIHSANPLARRHQRVPILPISGYLYGTQVGPAAGETEDQFMTQEGEETIGEEDEDEAASWLLLNPAKNSNNQNNNGFLFGGEVDEYLDIVEYNSCAENQYSDQYNQQHYSVPPKSCGGDSVVPIQYGEGKDHQQQQQQQYHNFQLGLEYEPAKAAYSYDGSVSQGVSMSSMDVGVVPESAMSEISISHQSASRGTIDLFSSPPIQMPSQLSPMEREARVLRYREKKKARKFEKTIRYASRKAYAETRPRIKGRFAKRTDVDVEVDQMFSSTLMAETAYGIVPSF

SEQ ID NO: 1784 - DNA, 1350 bp, Panicum virgatum
  misc_feature (1)..(1350): Ceres Clone ID no. 1755065
  misc_feature (1)..(1350): Encodes the peptide sequence at SEQ ID NO. 1785
aaccatttccgacgcagaacccccgggggccggaatccgtgacacccacccggaggagagcagagcagaggcatcaggcatggccgccgcggtggagctggagcagaagccggcggtggggtactggggcgtggccggcgcgcggccctgcgacgcgtgcgccgcggagccggcgcggctgcactgccgcgcggacggcgcgttcctgtgccccgggtgcgacgcccgcgcgcacggcgccgggtcgcgccacgcgcgcgtctggctctgcgaggtctgtgagcacgctcccgccgccgtcacgtgccgcgccgacgccgccgcgctctgcgcggcctgcgacgccgacatccactcggccaacccgctcgcgcgccgccacgagcggctccccgtcgcgcccttcttcggcgcgctcgccgacgcgccgcagccgttcccgtccgcggccttcgccaccgcggggggccagtcccagggggacgcggcggcggcggcggcggcggacgacgacgggagcaacgaggccgaggccgcctcatggctcctccccgagcccgacaccagccacgaggacagcgcagccgccaccgacgccttcttcgcggactccgacaagtacctcggcgtcgacctcgacttcgcccggtccatggacggcatcaaggccatcggcgtcccggtcgcgccgccggagctggacatcgccgctggcgctttctactaccccgaacactccatgaaccatagcgtgtcgtcatcagaggtggcggtcgtgccggacgtgctggcgggcggcgtcccggcggtgccggtggcgagccgggggaaggagcgggaagcgcggctgatgcggtaccgcgagaagcgcaagaaccggcggttcgacaagaccatccggtacgcgtcccgcaaggcgtacgccgagacgcggccgcgcatcaagggccgcttcgccaagcgctgctccgccgaggccgaggacgaggacgaggcgctgctggagcacgaggaaggggcgtgcttctcgcccgcggtgtcggcccccgcggcctcggacggcgtcgtcccgtccttctgctaagggggacgacgggtggcggccgcgcctcctcctcctccccggctcccaggcggcaaccccttaattttgccgactctgaatcgacccccaacgcatgccaacatgcgaatgcgatgcgcgcgctccgtgtagcataataattgtacagcagctcgtccgacgcaacgagctcaatcgcggtcgcacggaacgcctgtaatcctcctcaccatccgtgtaatccagccttgtacattaccatctagaggtgtttgtgcttctcttgc

SEQ ID NO: 1785 - protein, 334 aa, Panicum virgatum
  misc_feature (253)..(297): Pfam Name: CCT Pfam Description: CCT motif
  misc_feature (64)..(106): Pfam Name: zf-B_box Pfam Description: B-box zinc finger
  misc_feature (19)..(63): Pfam Name: zf-B_box Pfam Description: B-box zinc finger
  misc_feature (1)..(334): Ceres Clone ID no. 1755065
  misc_feature (1)..(334): Bit score of 342.6 for HMM based on sequences of Figure 33
  misc_feature (1)..(334): Functional Homolog Of SEQ ID NO. 1741
MAAAVELEQKPAVGYWGVAGARPCDACAAEPARLHCRADGAFLCPGCDARAHGAGSRHARVWLCEVCEHAPAAVTCRADAAALCAACDADIHSANPLARRHERLPVAPFFGALADAPQPFPSAAFATAGGQSQGDAAAAAAADDDGSNEAEAASWLLPEPDTSHEDSAAATDAFFADSDKYLGVDLDFARSMDGIKAIGVPVAPPELDIAAGAFYYPEHSMNHSVSSSEVAVVPDVLAGGVPAVPVASRGKEREARLMRYREKRKNRRFDKTIRYASRKAYAETRPRIKGRFAKRCSAEAEDEDEALLEHEEGACFSPAVSAPAASDGVVPSFC

SEQ ID NO: 1786 - protein, 323 aa, Hordeum vulgare subsp. vulgare
  misc_feature (236)..(280): Pfam Name: CCT Pfam Description: CCT motif
  misc_feature (61)..(103): Pfam Name: zf-B_box Pfam Description: B-box zinc finger
  misc_feature (16)..(60): Pfam Name: zf-B_box Pfam Description: B-box zinc finger
  misc_feature (1)..(323): Public GI ID no. 21667485
  misc_feature (1)..(323): Bit score of 339.7 for HMM based on sequences of Figure 33
  misc_feature (1)..(323): Functional Homolog Of SEQ ID NO. 1741
MEGEEKPVVGGAYWGVGARACDSCATEAARLFCRADAAFLCAGCDARAHGSGSRHARVWLCEVCEHAPAAVTCKADAAVLCASCDADIHAANPLARRHERVPVAPFFGAAADAHKPFPSSGAQAGAAASAEDDGSNDAEAASWLLPEPDHKDGANGATADVFFADSDHYLDLDFARSMDDIKAISVQLNGQPEIDLNGGNKGFYSDHSMNHSLSSSEAAVVPDAAAAPVVSRGREREARLMRYREKRKSRRFEKTIRYASRKAYAETRPRVKGRFAKRTGTADADALEEHEEMYSSAAAAVAALMAPGPDHDYGVDGVVPTLV

SEQ ID NO: 1787 - protein, 381 aa, Cleome spinosa
  misc_feature (312)..(356): Pfam Name: CCT Pfam Description: CCT motif
  misc_feature (64)..(106): Pfam Name: zf-B_box Pfam Description: B-box zinc finger
  misc_feature (16)..(63): Pfam Name: zf-B_box Pfam Description: B-box zinc finger
  misc_feature (1)..(381): Public GI ID no. 90657642
  misc_feature (1)..(381): Bit score of 576.0 for HMM based on sequences of Figure 33
  misc_feature (1)..(381): Functional Homolog Of SEQ ID NO. 1741
MLKEERTSGGETGENNWARICDTCRSAACTVYCRADSAYLCTSCDARVHAANHVASRHERVWVCESCERAPAAFLCKADAASLCAACDAEIHSANPLARRHHRVPILPISGSMSGPMANHHPSETAMTDTENDMVVGREEAEDEDEDDEEAASWLLLNPGKNSGNNNNQNNGFFFDGEADEYLDLVEYNSSMENQFSDQYSQYHQDCGVPQKSFGGDGVVPLQVEESRGQLHHEQQSFQLAITYGSPGALYGSYNGSMNHSVSMSSMDIVVVPESTASDMAVVSQLRAPKGTTDLLIGPPIQMMPQLSPMDREARVLRYREKKKTRKFEKTIRYASRKAYAETRPRIKGRFAKRTDIEAEVDQAFSTTLMQESGYGIVPSF

SEQ ID NO: 1788 - protein, 372 aa, Populus deltoides
  misc_feature (303)..(347): Pfam Name: CCT Pfam Description: CCT motif
  misc_feature (14)..(61): Pfam Name: zf-B_box Pfam Description: B-box zinc finger
  misc_feature (62)..(104): Pfam Name: zf-B_box Pfam Description: B-box zinc finger
  misc_feature (1)..(372): Public GI ID no. 41323978
  misc_feature (1)..(372): Bit score of 605.8 for HMM based on sequences of Figure 33
  misc_feature (1)..(372): Functional Homolog Of SEQ ID NO. 1741
MLKQESSGSGGGDNRARLCDTCRAAACTVYCRADSAYLCAGCDARVHAANRVASRHERVWVCESCERAPAALLCKADAASLCTACDADIHSANPLARRHQRVPILPISGCLHGSQVGPAAGETEDRFTTQEGEETISEEEEEEEDEAASWLLLNPVKNSKNQNNNGFLFEGEVDEYLDLVEYNSCTENQCSDQYNQQHYCVPPKSYGGDRVVPIQYGEGKDHQQQRQYHNFQLGLEYEPSKAAYSYNGLISQSVSMSSMDVGVVPESTMSEISISQHRTPKRTIELFSSTAIQMPSQLSPMDREARVLRYREKKKTRKFEKTIRYASRKAYAETRPRVKGRFAKRKDVEVEDDRTFSSTLMAGTGCGIVPSF

SEQ ID NO: 1789 - protein, 358 aa, Physcomitrella patens subsp. patens
  misc_feature (295)..(339): Pfam Name: CCT Pfam Description: CCT motif
  misc_feature (48)..(90): Pfam Name: zf-B_box Pfam Description: B-box zinc finger
  misc_feature (1)..(47): Pfam Name: zf-B_box Pfam Description: B-box zinc finger
  misc_feature (1)..(358): Public GI ID no. 168063317
  misc_feature (1)..(358): Bit score of 444.5 for HMM based on sequences of Figure 33
  misc_feature (1)..(358): Functional Homolog Of SEQ ID NO. 1741
MPKPCDACHVSSAAVFCRADAAYLCVGCDGKVHGANKLASRHERVWMCEVCEVAPAVVTCKADAASLCVACDTDIHSANPLAQRHERVPVTPLFESASPLRGPDFCVLVSENGCHDLLKGCEDASVVEAVSWLLPHPKISTNSIIRGSAAADEMGSSPFHDRPFSPKPKKQKVELPADIFSDVDPFLDLDDATVTGIQPDSLVPVHMPECSEDTDSLAHSMDPSFTKFPLSAKSGYSYGTSTLTQSISCSSLDAAVVPDSSLSDISTPYLDSQSSQDMSARLPHQTGGPIDTVDREARVLRYKEKRQKRKFEKTIRYASRKAYAESRPRIKGRFAKRTDSDMEQFGSVDSSFGVVPSF

SEQ ID NO: 1790 - protein, 332 aa, Oryza sativa subsp. japonica
  misc_feature (261)..(305): Pfam Name: CCT Pfam Description: CCT motif
  misc_feature (27)..(71): Pfam Name: zf-B_box Pfam Description: B-box zinc finger
  misc_feature (72)..(114): Pfam Name: zf-B_box Pfam Description: B-box zinc finger
  misc_feature (1)..(332): Public GI ID no. 115447239
  misc_feature (1)..(332): Bit score of 340.4 for HMM based on sequences of Figure 33
  misc_feature (1)..(332): Functional Homolog Of SEQ ID NO. 1741
MEAVEDKAMVGVGGAVAAGYSSSSWGLGTRACDSCGGEAARLYCRADGAFLCARCDARAHGAGSRHARVWLCEVCEHAPAAVTCRADAAALCAACDADIHSANPLARRHERLPVAPFFGPLADAPQPFPFSQAAADAAAAREEDADDDRSNEAEAASWLLPEPDDNSHEDSAAAADAFFADTGAYLGVDLDFARSMDGIKAIGVPVAPPELDLTAGSLFYPEHSMAHSLSSSEVAIVPDALSAGSAAPPMVVVVASKGKEREARLMRYREKRKNRRFDKTIRYASRKAYAETRPRIKGRFAKRTADADDDDEAPCSPAFSALAASDGVVPSF

SEQ ID NO: 1791 - protein, 364 aa, Physcomitrella patens subsp. patens
  misc_feature (298)..(342): Pfam Name: CCT Pfam Description: CCT motif
  misc_feature (48)..(90): Pfam Name: zf-B_box Pfam Description: B-box zinc finger
  misc_feature (1)..(47): Pfam Name: zf-B_box Pfam Description: B-box zinc finger
  misc_feature (1)..(364): Public GI ID no. 168030717
  misc_feature (1)..(364): Bit score of 436.0 for HMM based on sequences of Figure 33
  misc_feature (1)..(364): Functional Homolog Of SEQ ID NO. 1741
MPKSCDACHISSAVVYCRADAAYLCAGCDGKVHGANKLASRHERVWMCEVCEVAVAVVTCKADAASLCVSCDTDIHSANPLAQRHERVPVQPLFDCASSAREAHISVPFPESECHETLKGVEDSCVAEAGSWLLPHPKIPTNAIIRGSAAADEAPDSPFRARPFSPKLKKQKVDLAADIFSDVDPFLELDDATVTGIQPDSLVPVHIPEGSEDSPSLAHSMEPSFTTDFHLSEKSGYSFGTSTLTHSISCSSVDAAVVPDSSLSDISTPYPLDSQGAQELSGTRMPQQVSGPIDTVDREARVMRYKEKRQKRKFEKTIRYASRKAYAESRPRIKGRFAKRTDSDVEQLFSSCSMDSSFGVVPSF

SEQ ID NO: 1792 - protein, 332 aa, Oryza sativa subsp. indica
  misc_feature (261)..(305): Pfam Name: CCT Pfam Description: CCT motif
  misc_feature (27)..(71): Pfam Name: zf-B_box Pfam Description: B-box zinc finger
  misc_feature (72)..(114): Pfam Name: zf-B_box Pfam Description: B-box zinc finger
  misc_feature (1)..(332): Public GI ID no. 125540249
  misc_feature (1)..(332): Bit score of 338.3 for HMM based on sequences of Figure 33
  misc_feature (1)..(332): Functional Homolog Of SEQ ID NO. 1741
MEAVEDKAMVGVGGAVAAGYSSSSWGLGTRACDSCGGEAARLYCRADGAFLCARCDARAHGAGSRHARVWLCEVCEHAPAAVTCRADAAALCAACDADIHSANPLARRHERLPVAPFFGPLADAPQPFTFSQAAADAAGAREEDADDDRSNEAEAASWLLPEPDDNSHEDSAAAADAFFADTGAYLGVDLDFARSMDGIKAIGVPVAPPELDLTAGSLFYPEHSMAHSLSSSEVAIVPDALSAGAAAPPMVVVVASKGKEREARLMRYREKRKNRRFDKTIRYASRKAYAETRPRIKGRFAKRTADADDDDEAPCSPAFSALAASDGVVPSF

SEQ ID NO: 1793 - DNA, 982 bp, Arabidopsis thaliana
  misc_feature (1)..(982): Ceres Clone ID no. 7088
  misc_feature (1)..(982): Encodes the peptide sequence at SEQ ID NO. 1794
atagagagaagaaaaagaagaggtttagagagagaaaaatggcgtcaaagctctgcgattcgtgcaaatcagcgacggcggcgttatactgccgaccagacgcagcgtttctatgcttaagctgcgattcaaaagtccacgcggcgaacaaactcgcgtcacgacacgcgcgcgtgtggatgtgtgaagtgtgcgagcaagcaccggcacacgtcacgtgcaaagcagacgcggccgcgttatgcgtcacgtgcgaccgtgatatccactcggctaatccgttagctcgccgtcacgaacgcgttcccgttactccgttttacgattccgtctctagtgacggttccgttaaacacaccgccgttaatttccttgacgactgttacttctccgatatagatggtaacggaagccgtgaagaagaggaggaagaagctgcttcgtggctgttacttcccaatccaaagactacaacgacggcgacggcggggatcgttgctgttacttcagctgaggaagttccgggagatagtccggagatgaacactggtcaacagtatttgttctcggatccggatccgtatctggatctggattatggaaatgttgatccgaaggtggaatcgttagagcagaatagctccggtactgatggtgttgttccggtggagaatcggacggttagaatcccgacggtgaacgagaattgctttgaaatggattttaccggaggatctaaaggctttgcttatggaggtggttacaattgcatcagtcacagcgtgtcatcatcgtcgatggaagtgggagtggtgccagatggtggttcggtggctgatgtatcgtatccttacggtggtcctgcaaccagtggagctgatccggggacacagcgggctgttccgctgacttcagctgagagagaagcgagggtaatgaggtacagagagaagaggaagaacaggaagtttgagaagactat

SEQ ID NO: 1794 - protein, 314 aa, Arabidopsis thaliana
  misc_feature (295)..(314): Pfam Name: CCT Pfam Description: CCT motif
  misc_feature (1)..(48): Pfam Name: zf-B_box Pfam Description: B-box zinc finger
  misc_feature (49)..(91): Pfam Name: zf-B_box Pfam Description: B-box zinc finger
  misc_feature (1)..(314): Ceres Clone ID no. 7088
  misc_feature (1)..(314): Bit score of 505.8 for HMM based on sequences of Figure 33
  misc_feature (1)..(314): Functional Homolog Of SEQ ID NO. 1741
MASKLCDSCKSATAALYCRPDAAFLCLSCDSKVHAANKLASRHARVWMCEVCEQAPAHVTCKADAAALCVTCDRDIHSANPLARRHERVPVTPFYDSVSSDGSVKHTAVNFLDDCYFSDIDGNGSREEEEEEAASWLLLPNPKTTTTATAGIVAVTSAEEVPGDSPEMNTGQQYLFSDPDPYLDLDYGNVDPKVESLEQNSSGTDGVVPVENRTVRIPTVNENCFEMDFTGGSKGFAYGGGYNCISHSVSSSSMEVGVVPDGGSVADVSYPYGGPATSGADPGTQRAVPLTSAEREARVMRYREKRKNRKFEKT

SEQ ID NO: 1795 - DNA, 1357 bp, Panicum virgatum
  misc_feature (1)..(1357): Ceres Clone ID no. 1996408
  misc_feature (1)..(1357): Encodes the peptide sequence at SEQ ID NO. 1796
aaaaacacccccgaggccaaccatttccgacgcaaaaccccccggaatccgtgacacccgcccggaggagagcagagcagaggcaccaggcatggacgccgcggtggagctggagctggagcagaagccggcggtggggtactggggcttggccggcgcgcggccctgcgacgcgtgcgccgcggaggcggcgcggctgcactgccgcgcggacggcgccttcctgtgccccgggtgcgacgcccgcgcgcacggcgccgggtcgcgccacgcgcgcgtctgtctctgcgaggtctgcgagcacgcccccgccgccgtcacgtgccgcgccgacgccgccgcgctctgcgcggcctgcgacgccgacatccactcggccaacccgctcgcgcgccgccacgagcggctccccgtcgcgcccttcttcggcgcgctcgccgacgcgccgcagccgttcccgtcctcagccttcgccgccgcgggggtccaggcccagggggacgcggctgcggacgacgacgggagcaacgaggccgaggccgcctcgtggctcctccccgagcccgacaactgccacgaggacagcgccgccgccaccgacgccttcttcgctgactccgacgcgtacctcggcgtcgacctcgacttcgcccggtccatggacggcatcaaggccatcggcgtgccggtcgcgccgcccgagctggacatggccaccggcggttactactaccccgaacactccatgaaccacagcgtgtcgtcgtcggaggtggcggttgtgccggacgcgctggcgggcggcgccccggccgcgccggcggtgccggcggcgagccgggggaaggagcgggaggcgcggctgatgcggtaccgcgagaagcgcaagaaccggcggttcgacaagaccatccggtacgcgtcccgcaaggcgtacgccgagacgcggccgcgcatcaagggccgcttcgccaagcgctgctcctccgcggaggccgaggccgaggacgaggcgctgctggagcacgaggaagcggcgtgcttctcgcccgcggcgtcggcgcccgcggcctcctcggacggcgtcgtcccgtcctgctgaggggacacgacgggcggcggccgcgcctcctcctcccaggctccccggcggcgaccccttaattttgccgactctgaatcgatcccaacgcatgcgaacatgcgatgcgatgcgcgctccgtgcagcacatgaataattgtacagtagttccacgaactcgatcgtggtcgcacggaatcgcatgtaatcctcctcaccgtccttgtaatccagccttgtacattaccgtctagaggtgtttgtgcttctctcgc

SEQ ID NO: 1796 - protein, 336 aa, Panicum virgatum
  misc_feature (254)..(298): Pfam Name: CCT Pfam Description: CCT motif
  misc_feature (66)..(108): Pfam Name: zf-B_box Pfam Description: B-box zinc finger
  misc_feature (21)..(65): Pfam Name: zf-B_box Pfam Description: B-box zinc finger
  misc_feature (1)..(336): Ceres Clone ID no. 1996408
  misc_feature (1)..(336): Bit score of 330.9 for HMM based on sequences of Figure 33
  misc_feature (1)..(336): Functional Homolog Of SEQ ID NO. 1741
MDAAVELELEQKPAVGYWGLAGARPCDACAAEAARLHCRADGAFLCPGCDARAHGAGSRHARVCLCEVCEHAPAAVTCRADAAALCAACDADIHSANPLARRHERLPVAPFFGALADAPQPFPSSAFAAAGVQAQGDAAADDDGSNEAEAASWLLPEPDNCHEDSAAATDAFFADSDAYLGVDLDFARSMDGIKAIGVPVAPPELDMATGGYYYPEHSMNHSVSSSEVAVVPDALAGGAPAAPAVPAASRGKEREARLMRYREKRKNRRFDKTIRYASRKAYAETRPRIKGRFAKRCSSAEAEAEDEALLEHEEAACFSPAASAPAASSDGVVPSC

SEQ ID NO: 1797 - DNA, 990 bp, Sorghum bicolor
  misc_feature (1)..(990): Ceres Annot ID no. 8701721
  misc_feature (1)..(990): Encodes the peptide sequence at SEQ ID NO. 1798
atggagggcgacgagaagtcggcgggcggggccccggcgtactggggcctgggcgcgcggccctgcgacgcgtgcggcgccgatgcggcgcgcctctactgccgcgcggactcggcgttcctgtgcgccgggtgcgacgcgcgggcgcacggggccgggtcgcccaacgcgcgggtctggctctgcgaggtctgcgagcacgcgccggcggcggtcacgtgccgcgccgacgccgccgcgctctgcgcctcctgcgacgccgacatccactcggccaacccgctggcgcgacgccacgagcgcctccccgtggcgcccttcttcggcgcgctggccgacgcgcccaagcccttcgcctcgtcggcggcggccgtgccgcccaaagcgacggccggggccgacgacgacgggagcagcgaggccgaggcggcgtcgtggctcctccccgagcccgaccacgggcacaaagaagaaggcgccaccacggaggtgttcttcgcggactccgacccgtacctcgacctcgacttcgcgcgttccatggacgacatcaagaccatcggcgtccagggcgggccaccagagctcgacctcaacggcgccaagctcttctactccgaccactccatgaaccacagtgtgtcatcgtcggaggcagcggtggtgcccgacgcggcggctggcgcggcgcccgtggtggcagtggtcagcaggggcctggagcgggaggcgcggctgatgcggtaccgggagaagcgcaagagcaggcggttcgagaagacgatccggtacgcgtcccgcaaggcgtacgcggagacgcggccgcgcatcaagggccggttcgccaagcgcacgccgggggctggggaggacccgctggaggagcacgaggagatgtactcctcggccgcggcggccgtggctgcgctcatggcccccggcggagccgacgcggactacggcgtcgacggcgtcgtgcccacatattga

SEQ ID NO: 1798 - protein, 329 aa, Sorghum bicolor
  misc_feature (242)..(286): Pfam Name: CCT Pfam Description: CCT motif
  misc_feature (57)..(104): Pfam Name: zf-B_box Pfam Description: B-box zinc finger
  misc_feature (17)..(55): Pfam Name: zf-B_box Pfam Description: B-box zinc finger
  misc_feature (1)..(329): Ceres Annot ID no. 8701721
  misc_feature (1)..(329): Bit score of 357.6 for HMM based on sequences of Figure 33
  misc_feature (1)..(329): Functional Homolog Of SEQ ID NO. 1741
MEGDEKSAGGAPAYWGLGARPCDACGADAARLYCRADSAFLCAGCDARAHGAGSPNARVWLCEVCEHAPAAVTCRADAAALCASCDADIHSANPLARRHERLPVAPFFGALADAPKPFASSAAAVPPKATAGADDDGSSEAEAASWLLPEPDHGHKEEGATTEVFFADSDPYLDLDFARSMDDIKTIGVQGGPPELDLNGAKLFYSDHSMNHSVSSSEAAVVPDAAAGAAPVVAVVSRGLEREARLMRYREKRKSRRFEKTIRYASRKAYAETRPRIKGRFAKRTPGAGEDPLEEHEEMYSSAAAAVAALMAPGGADADYGVDGVVPTY

SEQ ID NO: 1799 - protein, 368 aa, Physcomitrella patens
  misc_feature (301)..(345): Pfam Name: CCT Pfam Description: CCT motif
  misc_feature (48)..(90): Pfam Name: zf-B_box Pfam Description: B-box zinc finger
  misc_feature (1)..(47): Pfam Name: zf-B_box Pfam Description: B-box zinc finger
  misc_feature (1)..(368): Public GI ID no. 66841020
  misc_feature (1)..(368): Bit score of 400.3 for HMM based on sequences of Figure 33
  misc_feature (1)..(368): Functional Homolog Of SEQ ID NO. 1741
MPKSCDACQASSAVVYCRADAAYLCLGCDGKVHGANKLASRHERLWMCEVCEVAAAVVTCKADAASLCVSCDTDIHSANPLAQRHERVPVQPLFDCVSQFRGTHFSVLAPKNECNNNLLKGDEDPAVAEAVSWLLPHPKTLSSAILRGIAAADEAPAFPFRERPFSPKLKKLKVEQAADIYSDVDPFLVLDGGNGTGFQPDSLVPVHIPEGPDDSPSLANSTAPSSAINFRASQKSGCSYGTSTLTHSMSCSSVDAAVVPDSSLSDISTPYSKALDSQDSQDLSGALVPHQASKPIDTVDREARVMRCKEKRQKRKFEKTIRYASRKAYAESRPRIKGRFTKRTDSDVEQMFSSCTADSGFGVVPSSC

SEQ ID NO: 1800 - DNA, 1290 bp, Arabidopsis thaliana
  misc_feature (1)..(1290): Ceres Annot ID no. 882715
  misc_feature (1)..(1290): Encodes the peptide sequence at SEQ ID NO. 1801
ctcaccatcaaacaactacaacatctgcggttagtatgttgaaagtagagagtaactgggcacaagcctgtgatacatgccgatcagccgcctgcaccgtgtactgccgggctgattctgcctacttgtgctccagttgtgatgctcaagttcatgctgccaatcgtcttgcttcccgccatgaacgtgttcgagtctgtcaatcatgtgagcgagccccggctgcctttttctgcaaggcagatgctgcatctctatgcacaacctgtgattcagagattcattccgcaaacccacttgctagacgccatcaacgagttccaattctgcccatttctgagtactcttacagttccacggccactaaccattcatgtgagacaacagtgacagatccagagaacagacttgtgcttggtcaagaagaagaggatgaagatgaagcagaggcggcttcatggttgttgcctaattcagggaaaaacagtggtaacaacaatggcttctcgattggggatgagtttctgaaccttgttgattatagttcgagtgataagcaattcacagatcaatccaatcagtatcaactagactgcaacgtacctcagaggagctatggggaagatggagttgttccacttcaaattgaagtatcaaagggcatgtaccaagagcaacagaactttcagctgagtatcaactgtggctcctggggagctcttcgaagctccaatggttccctcagtcatatggtgaatgtttcatctatggacctgggagttgtgccggagtcaacaacgagtgacgcaacagtatcaaacccaagatcgcccaaagcggtaacagaccaaccaccttaccctccagctcagatgctcagtccaagggacagagaagctagagtcctgagatacagagagaagaagaagatgaggaaatttgagaagacgataagatatgcttcaaggaaagcgtatgcagagaaaagaccacggatcaagggccggtttgcaaagaagaaagatgtcgatgaagaggcaaaccaagctttctccacaatgataacatttgacaccggatatggaattgttccatcattctgatgctgctatggcaaaactagactgcatgcttgtaaattacttctggtttgaaattcctgcaagttattaccacggttttatgcatatagggtctgtagtttactagttttgcctaactagtacgagttaattagatatacactcatacttagctgctgtaagttaatacaaattttgcccacttggt

SEQ ID NO: 1801 - protein, 355 aa, Arabidopsis thaliana
  misc_feature (286)..(330): Pfam Name: CCT Pfam Description: CCT motif
  misc_feature (55)..(97): Pfam Name: zf-B_box Pfam Description: B-box zinc finger
  misc_feature (7)..(54): Pfam Name: zf-B_box Pfam Description: B-box zinc finger
  misc_feature (1)..(355): Ceres Annot ID no. 882715
  misc_feature (1)..(355): Bit score of 456.1 for HMM based on sequences of Figure 33
  misc_feature (1)..(355): Functional Homolog Of SEQ ID NO. 1741
MLKVESNWAQACDTCRSAACTVYCRADSAYLCSSCDAQVHAANRLASRHERVRVCQSCERAPAAFFCKADAASLCTTCDSEIHSANPLARRHQRVPILPISEYSYSSTATNHSCETTVTDPENRLVLGQEEEDEDEAEAASWLLPNSGKNSGNNNGFSIGDEFLNLVDYSSSDKQFTDQSNQYQLDCNVPQRSYGEDGVVPLQIEVSKGMYQEQQNFQLSINCGSWGALRSSNGSLSHMVNVSSMDLGVVPESTTSDATVSNPRSPKAVTDQPPYPPAQMLSPRDREARVLRYREKKKMRKFEKTIRYASRKAYAEKRPRIKGRFAKKKDVDEEANQAFSTMITFDTGYGIVPSF

SEQ ID NO: 1802 - protein, 325 aa, Hordeum vulgare subsp. vulgare
  misc_feature (250)..(294): Pfam Name: CCT Pfam Description: CCT motif
  misc_feature (70)..(112): Pfam Name: zf-B_box Pfam Description: B-box zinc finger
  misc_feature (25)..(69): Pfam Name: zf-B_box Pfam Description: B-box zinc finger
  misc_feature (1)..(325): Public GI ID no. 21655154
  misc_feature (1)..(325): Bit score of 356.4 for HMM based on sequences of Figure 33
  misc_feature (1)..(325): Functional Homolog Of SEQ ID NO. 1741
MKVEEQTVVGGGGGAGQGGAGFWGLAGRPCDTCAVDAARLYCRLDGAYLCAGCDARAHGAGSRHARVWLCEVCEHAPAAVTCRADAAALCATCDADIHSANPLASRHLLLPTPFFGALADPPQPVPSPSSAAATQEDAEDDGSNEAEAASWLLPEPGDSPEDSAATFFADSDAYLDLDFVRSMDGIKAIGVPVAPSELDLAGGTLFYPEHSMNHSMSTSEVAVVPDALSAGGAPAPAPSVAVVASKGKEREARLMRYREKRKNRRFQKTIRYASRKAYAETRPRIKGRFAKRTAEDDALEQDGPFSPASSAHLASDGDYGVVPSF

SEQ ID NO: 1803 - DNA, 1251 bp, Panicum virgatum
  misc_feature (1)..(1251): Ceres Clone ID no. 1770031
  misc_feature (1)..(1251): Encodes the peptide sequence at SEQ ID NO. 1804
agcgagctcccggcgcgcgataatggagggtgacgagaagtcggcaggcggggccccggccccggcctactggggcctgggcgcgcggccctgcgacgcgtgcggcgacgaggcggcgaggctctactgccgcgcggacgcggcgttcctctgcgccgggtgcgacgcgcgcgcgcacggcgccgggtcgcgccacgcccgcgtctggctctgcgaggtctgcgagcacgcgccggccgcggtcacgtgccgcgcggacgccgccgcgctctgcgcctcgtgcgacgccgacatccactccgccaacccgctcgcgcgccgccacgagcgccaggccgtggcgcccttctacggcgcgctggccgacgcgcccaagcccttcgcctcgtcggcggccgtgcccaaagcggccgacgacgacgggagcaacgaggccgaggcggcgtcgtggctcctccccgagcccgaccacgggctcaaggaaggcgccacgacggaggtgttcttcgcggactccgacccgtacctcgacctcgacttcgcgcgcaccatggacgacatcaaggccatcggcgtccagaacggccccgccgagctcgacctcaccggcgccaagctcttctactccgaccactccatgaaccacagcgtgtcgtcatcggaggcagcagtggtgcccgacgcggcggcgggcgcggcgcccgtggttccagtggtgagcaggggtctggagcgggaggcccggctgatgcggtaccgggagaagcgcaagagccggcggttcgagaagacgatccggtacgcgtcccgcaaggcgtacgcggagacgcggccgcgcatcaagggccggttcgccaagcgcacccccgggcccggcggcgcggacggggaggacccgctggaggagcacgaggaggagatgtactcctccgccgcggcagccgtggccgcgctcatggtccccggcggcgccgacgccgactacggcgtcgtgcccacgtattgatcggcgccggcctgttgtaacactagccagcctcgacctcgccgccggggctgtaatttttgctgcatgccctgcatgcaaagctgccgtgtagcattaattacctgtaatatgattccacggaagccatcaggccggacttccaagctattcttcctccctaatcattccgccatgtatgtatattattatgagtaaattgcactcatcatacaataaattgacagatagatacaaattgatcc

SEQ ID NO: 1804 - protein, 327 aa, Panicum virgatum
  misc_feature (238)..(282): Pfam Name: CCT Pfam Description: CCT motif
  misc_feature (19)..(63): Pfam Name: zf-B_box Pfam Description: B-box zinc finger
  misc_feature (64)..(106): Pfam Name: zf-B_box Pfam Description: B-box zinc finger
  misc_feature (1)..(327): Ceres Clone ID no. 1770031
  misc_feature (1)..(327): Bit score of 343.3 for HMM based on sequences of Figure 33
  misc_feature (1)..(327): Functional Homolog Of SEQ ID NO. 1741
MEGDEKSAGGAPAPAYWGLGARPCDACGDEAARLYCRADAAFLCAGCDARAHGAGSRHARVWLCEVCEHAPAAVTCRADAAALCASCDADIHSANPLARRHERQAVAPFYGALADAPKPFASSAAVPKAADDDGSNEAEAASWLLPEPDHGLKEGATTEVFFADSDPYLDLDFARTMDDIKAIGVQNGPAELDLTGAKLFYSDHSMNHSVSSSEAAVVPDAAAGAAPVVPVVSRGLEREARLMRYREKRKSRRFEKTIRYASRKAYAETRPRIKGRFAKRTPGPGGADGEDPLEEHEEEMYSSAAAAVAALMVPGGADADYGVVPTY

SEQ ID NO: 1805 - DNA, 1345 bp, Zea mays
  misc_feature (1)..(1345): Ceres Clone ID no. 1559496
  misc_feature (1)..(1345): Encodes the peptide sequence at SEQ ID NO. 1806
ctgacacccgtggcatccctctcgtgactcccggagcggaggcatggacaccgcggcggagctggagctggggctggagttggagcagaagccggcggcggggtactggagcgtggtgggcgcgcgcccttgcgacgcgtgcgccgcggagccggcgcggctgcactgccgcgcggacggcgcgttcctgtgccccggctgcgacgcccgggcgcacggcgccgggtcgcgccacgcgcgcgtctggctgtgcgaggtctgcgagcacgcccccgccgtcgtcacctgccgcgccgacgccgccgcgctctgcgccgcctgcgacgccgacatccactcggccaacccgctcgcgcgccgccacgagcgcctccccatcgcccctctcttcggcgcgctcgcggacgcgccgcagcccttcccgtccccggccctcgctgccgccgcgggggccgaggccccggccccgaccccggctcagggtgaagcggtggcggaagactacgggagcagcgaggccgaggcggcgtcgtggttgctccccgagcccgacaacagccacgaggacagcgccgccgacacgttcttcgcggagtcggacgcgtacctcggcgccgacctcgacttcgcccggtgcatggacggcgtcaaggccatcggcgtgccggtcgcgccgcccgagctggacatcggtgccggcagcttttgctaccccgaacactccatgaaccacattttgtcgtcatcctcggaggtggcggtggtaccggacgcgcaggcggccggtctgccggtggtggtggtggtgagcagaggggaggagcgggaggcgcggctgatgcggtaccgtgagaagcgcaagaaccgccggttcgacaagaccatccgctacgcgtcccgcaaggcgtacgccgagacgcggccgcgcatcaagggccgcttcgccaagcgccgttccgcggagggcgaggacgaggcgctggagcacgaggaaggggcgtgcttctcgcccgcggggtcggcgcccgccgcgtcggacggcgtcgtcccgtccttgtgttgaggggagaagacgacgacgaccccggcagacggctgcttaactttgccagctctgtcgaccctgaaccttttttttttccctcccccaccttctctcttttgatcgaggggttgccagctctggatctgaaactctgaacgcatgggacgcgagctgtgtgtagcatgaataactgcgtagtttgttggatggacgaactcaatcgcgctcgcatggaatggaactcttgtaatccaccctttgtacattaccatctagagttgctccttttttccatgagcc

SEQ ID NO: 1806 - protein, 339 aa, Zea mays
  misc_feature (261)..(305): Pfam Name: CCT Pfam Description: CCT motif
  misc_feature (70)..(112): Pfam Name: zf-B_box Pfam Description: B-box zinc finger
  misc_feature (25)..(69): Pfam Name: zf-B_box Pfam Description: B-box zinc finger
  misc_feature (1)..(339): Ceres Clone ID no. 1559496
  misc_feature (1)..(339): Bit score of 321.0 for HMM based on sequences of Figure 33
  misc_feature (1)..(339): Functional Homolog Of SEQ ID NO. 1741
MDTAAELELGLELEQKPAAGYWSVVGARPCDACAAEPARLHCRADGAFLCPGCDARAHGAGSRHARVWLCEVCEHAPAVVTCRADAAALCAACDADIHSANPLARRHERLPIAPLFGALADAPQPFPSPALAAAAGAEAPAPTPAQGEAVAEDYGSSEAEAASWLLPEPDNSHEDSAADTFFAESDAYLGADLDFARCMDGVKAIGVPVAPPELDIGAGSFCYPEHSMNHILSSSSEVAVVPDAQAAGLPVVVVVSRGEEREARLMRYREKRKNRRFDKTIRYASRKAYAETRPRIKGRFAKRRSAEGEDEALEHEEGACFSPAGSAPAASDGVVPSLC

SEQ ID NO: 1807 - DNA, 1011 bp, Sorghum bicolor
  misc_feature (1)..(1011): Ceres Annot ID no. 8680182
  misc_feature (1)..(1011): Encodes the peptide sequence at SEQ ID NO. 1808
atggacaccgcggtggagctggagctggagcagaagccggcggtgggttactggagcgtggtgggcgcccggccctgcgacgcgtgcgccgcggagccggcgcggctgcactgccgcgaggacggcgcgttcctgtgccccggctgcgacgcccgggcgcacggcgccgggtcccgccacgcgcgcgtctggctgtgcgaggtctgcgagcacgcccccgccgccgtcacctgccgcgccgacgccgccgcgctctgcgccgcctgcgacgccgacatccactcggccaacccgctcgcgcgccgccacgagcgcctccccgtcgcgcccttcttcggcgcgctcgctgacgcgccccagcccttcccgtccccggccttcgccgccgctgccgcagcggggggccaggctcagggggaagccgcggcggcggacaacgacgacgacgacgggagcaacgaggccgaggcggcgtcgtggctgctcgccgagcccgacaacagccacgaggacagcgccgccgccaccgccgccgacacgttgttcgcggaatcggacgcgtacctcggcgtcgacctggacttcgcccggtgcatggacggcgtcaaggccatcggcgtgccggtcgcgccgcccgagctggacatcgctgccggcagctttttctaccccgaacactccatgaaccacagtttgtcgtcgtcggaggtggcggtggtgccggacgcgcaggcggccggcgtgccggcggtggtgagcagggggaaggagcgggaggcgcggctgatgcggtaccgtgagaagcgcaagaaccgccggttcgacaagaccatccgctacgcgtcccgcaaggcgtacgccgagacgcggccgcgcatcaagggccgcttcgccaagcgctgctccgcggaggccgacgacgacgcgctggagcacgacgaaggcgcgtgcttctcgcccgcggggtcggcgcacgcggcgtcggacggcgtcgtcccgtccttctgttga

SEQ ID NO: 1808 - protein, 336 aa, Sorghum bicolor
  misc_feature (258)..(302): Pfam Name: CCT Pfam Description: CCT motif
  misc_feature (66)..(108): Pfam Name: zf-B_box Pfam Description: B-box zinc finger
  misc_feature (21)..(65): Pfam Name: zf-B_box Pfam Description: B-box zinc finger
  misc_feature (1)..(336): Ceres Annot ID no. 8680182
  misc_feature (1)..(336): Bit score of 337.2 for HMM based on sequences of Figure 33
  misc_feature (1)..(336): Functional Homolog Of SEQ ID NO. 1741
MDTAVELELEQKPAVGYWSVVGARPCDACAAEPARLHCREDGAFLCPGCDARAHGAGSRHARVWLCEVCEHAPAAVTCRADAAALCAACDADIHSANPLARRHERLPVAPFFGALADAPQPFPSPAFAAAAAAGGQAQGEAAAADNDDDDGSNEAEAASWLLAEPDNSHEDSAAATAADTLFAESDAYLGVDLDFARCMDGVKAIGVPVAPPELDIAAGSFFYPEHSMNHSLSSSEVAVVPDAQAAGVPAVVSRGKEREARLMRYREKRKNRRFDKTIRYASRKAYAETRPRIKGRFAKRCSAEADDDALEHDEGACFSPAGSAHAASDGVVPSFC

SEQ ID NO: 1809 - protein, 373 aa, Arabidopsis thaliana
  misc_feature (306)..(350): Pfam Name: CCT Pfam Description: CCT motif
  misc_feature (63)..(105): Pfam Name: zf-B_box Pfam Description: B-box zinc finger
  misc_feature (15)..(62): Pfam Name: zf-B_box Pfam Description: B-box zinc finger
  misc_feature (1)..(373): Public GI ID no. 15242402
  misc_feature (1)..(373): Bit score of 412.0 for HMM based on sequences of Figure 33
  misc_feature (1)..(373): Functional Homolog Of SEQ ID NO. 1741
MLKQESNDIGSGENNRARPCDTCRSNACTVYCHADSAYLCMSCDAQVHSANRVASRHKRVRVCESCERAPAAFLCEADDASLCTACDSEVHSANPLARRHQRVPILPISGNSFSSMTTTHHQSEKTMTDPEKRLVVDQEEGEEGDKDAKEVASWLFPNSDKNNNNQNNGLLFSDEYLNLVDYNSSMDYKFTGEYSQHQQNCSVPQTSYGGDRVVPLKLEESRGHQCHNQQNFQFNIKYGSSGTHYNDNGSINHNAYISSMETGVVPESTACVTTASHPRTPKGTVEQQPDPASQMITVTQLSPMDREARVLRYREKRKTRKFEKTIRYASRKAYAEIRPRVNGRFAKREIEAEEQGFNTMLMYNTGYGIVPSF

SEQ ID NO: 1810 - protein, 410 aa, Picea abies
  misc_feature (343)..(387): Pfam Name: CCT Pfam Description: CCT motif
  misc_feature (45)..(92): Pfam Name: zf-B_box Pfam Description: B-box zinc finger
  misc_feature (2)..(43): Pfam Name: zf-B_box Pfam Description: B-box zinc finger
  misc_feature (1)..(410): Public GI ID no. 108859363
  misc_feature (1)..(410): Bit score of 460.3 for HMM based on sequences of Figure 33
  misc_feature (1)..(410): Functional Homolog Of SEQ ID NO. 1741
MSMPKLCDVCQVSNSVLYCRAHTAQLCLVCDVKIHGGSKASLCHERVWVCEVCEQAPAVVTCKADAAALCVSCDTDIHSANPLASRHERAPVIPFYECPNMPNNNTATNANNDNLDCNVLLNEDGGGDDPLKHDYVDDDYDDYDDDENDHNNLLNHQEEDNDAEICCAEEAATASWLIPEANRNNLTNINGGNSEGEDKMVKDKLKFKAYMQSIDFLQDVENYVDLEYLGTTTTITTPTTPTAHMGADSMVPVHTPEVIEHSSTKVSVETARSLDVDAASKCNYVYRTTSLNHCVSSSSIDVGIVPDSNTTTDISTPYHDPRGVFEIPPRVVHPGGHVEVMGREARVLRYREKRKNRRFEKTIRYASRKAYAETRPRIKGRFAKRTEVEVEQIYSSSLLPDQGYGVVPSY

SEQ ID NO: 1811 - DNA, 1249 bp, Arabidopsis thaliana
  misc_feature (1)..(1249): Ceres Clone ID no. 32753
  misc_feature (1)..(1249): Ceres SEED LINE ID no. CW00219
  misc_feature (1)..(1249): Encodes the peptide sequence at SEQ ID NO. 1812
ctcttgcttctcttcactcacaatctcacagcaaagcctctcgttgctagaggaatcaaacaatggtgtttgtgaagtccaccaagtcgaatgcttacttcaagaggtaccaagtgaagttcaggagaagaagagatggaaagactgactacagggcaaggatccgtcttatcaaccaagacaagaacaagtacaatacacctaagtatcgttttgttgtccggtttaccaacaaagacatagtggcacagattgtatctgcaagcattgctggtgacattgttaaagcttctgcttacgcacatgaactgcctcagtatggtctcactgttggtcttacaaactatgctgcagcttactgtactggccttcttttggctcgccgtgttttaaagatgttggaaatggatgacgagtatgagggaaacgttgaggccactggagaggacttttccgttgagccaactgattcaaggagacctttccgtgctcttcttgatgttggacttatcaggaccacaacaggaaaccgtgtgttcggtgctcttaagggtgctttggatggtggtcttgatatccctcacagtgacaagagatttgctgggttccacaaggagaacaagcaacttgatgctgaaatccacaggaactacatctatggtggccatgtctcaaactacatgaagctgttgggagaagatgagccagagaagttacaaactcacttcagtgcttacatcaagaaaggagttgaagctgagagcattgaggagttgtacaagaaggttcacgcagctattcgtgctgaccccaacccaargaaaaccgtgaaacctgctcccaagcaacacaagaggtacaacttgaagaaacttacttacgaggagaggaagaacaagttgatcgagagagtcaggcattgaatggagcaggtggtgatgatgatgatgaggacgatgaasagtaaatcagtcaagccttctttatctcatgcctcttgtagttttttatcttttgagcttaatgcctcaaattttctgttttcagactaaaacactcagcttttgtgttcacattttaattgtgttcgaggattttgatattgaggatacattttctttgaagtatcattatcttattattacctccatcataattttcaagaatttgtatgacaatagtttgatgacttgattttatctgtagtttgctattgttaaatgtaagaactgttagacttcatctatat

SEQ ID NO: 1812 - protein, 286 aa, Arabidopsis thaliana
  misc_feature (26)..(172): Pfam Name: Ribosomal_L18p Pfam Description: Ribosomal L18p/L5e family
  misc_feature (1)..(286): Ceres SEED LINE ID no. CW00219
  misc_feature (1)..(286): Ceres Clone ID no. 32753
  misc_feature (1)..(286): Bit score of 733.0 for HMM based on sequences of Figure 35
  misc_feature (1)..(286): in Figure 35
  misc_feature (253)..(253): Xaa is any aa, unknown, or other
MVFVKSTKSNAYFKRYQVKFRRRRDGKTDYRARIRLINQDKNKYNTPKYRFVVRFTNKDIVAQIVSASIAGDIVKASAYAHELPQYGLTVGLTNYAAAYCTGLLLARRVLKMLEMDDEYEGNVEATGEDFSVEPTDSRRPFRALLDVGLIRTTTGNRVFGALKGALDGGLDIPHSDKRFAGFHKENKQLDAEIHRNYIYGGHVSNYMKLLGEDEPEKLQTHFSAYIKKGVEAESIEELYKKVHAAIRADPNPXKTVKPAPKQHKRYNLKKLTYEERKNKLIERVRH

SEQ ID NO: 1813 - DNA, 1092 bp, Brassica napus
  misc_feature (1)..(1092): Ceres Clone ID no. 1073884
  misc_feature (1)..(1092): Encodes the peptide sequence at SEQ ID NO. 1814
ctcttgtcttctcgacactctcatctcacacccaaagcttccgcttagcttccgcttagcttcaaacaatggtgtttgtgaagccatccaagtcgaacgcttacttcaagaggtaccaagtcaagttcaggagaaggagagatgggaagactgattacagagcaaggatccgtctcatcaaccaagacaagaacaagtacaacacaccaaagtaccgttttgttgtcaggttcaccaacaaagacatagtcgcacaaatcgtgtctgcaagcatagccggtgacattgtcaaggcttctgcttacgctcatgagttgcctcagtatggtctcaccgttggacttaccaactacgctgcagcttactgcaccgggcttctattggctcgccgtgttctgaagatgttggaaatggatgaagagtacgagggcaaccttgaggctaccggagaggacttttccgtcgagccaaccgagtccaggagaccattccgtgctctacttgatgttggtcttatcaggaccactacaggaaaccgtgtctttggtgcactcaagggtgccttggacggaggacttgatatcccccacagtgacaagagatttgctggtttcaacaaggagaacaagcaactcgatgctgagatccacaggaactacatctatggtggtcacgtctcaaactacatgaagatgttgaatgaggatgagccagagaagtttcagactcacttcagtcagtacttgaagaaaggagttgatgctgagagcatggaggagttgtacaagaaggttcatgctgccatccgtgcagaccccaaccctaagaagaccgagaaacctgctcctaagacacacaataggtacaacttgaagaagttgacctatgaagagaggaagaacaagttgattgagagagtcaaggcattgaatggagctgctggtggcgacgatgatgacgaggacgacgaagagtaaagcgtggtctcatgatgtctcttttagtttgttactttttttttgccagactttaaacttatgttttcacattttaattgcgtttgaggattttgagtatgagaatgctaagttt

SEQ ID NO: 1814 - protein, 302 aa, Brassica napus
  misc_feature (26)..(172): Pfam Name: Ribosomal_L18p Pfam Description: Ribosomal L18p/L5e family
  misc_feature (1)..(302): Ceres Clone ID no. 1073884
  misc_feature (1)..(302): Bit score of 791.6 for HMM based on sequences of Figure 35
  misc_feature (1)..(302): Functional Homolog Of SEQ ID NO. 1812
  misc_feature (1)..(302): in Figure 35
MVFVKPSKSNAYFKRYQVKFRRRRDGKTDYRARIRLINQDKNKYNTPKYRFVVRFTNKDIVAQIVSASIAGDIVKASAYAHELPQYGLTVGLTNYAAAYCTGLLLARRVLKMLEMDEEYEGNLEATGEDFSVEPTESRRPFRALLDVGLIRTTTGNRVFGALKGALDGGLDIPHSDKRFAGFNKENKQLDAEIHRNYIYGGHVSNYMKMLNEDEPEKFQTHFSQYLKKGVDAESMEELYKKVHAAIRADPNPKKTEKPAPKTHNRYNLKKLTYEERKNKLIERVKALNGAAGGDDDDEDDEE

SEQ ID NO: 1815 - protein, 297 aa, Populus balsamifera subsp. trichocarpa
  misc_feature (26)..(172): Pfam Name: Ribosomal_L18p Pfam Description: Ribosomal L18p/L5e family
  misc_feature (1)..(297): Public GI ID no. 224127226
  misc_feature (1)..(297): Bit score of 792.1 for HMM based on sequences of Figure 35
  misc_feature (1)..(297): Functional Homolog Of SEQ ID NO. 1812
  misc_feature (1)..(297): in Figure 35
MAFAKAQKSRAYFKRYQVKFKRRRAGKTDYRARIRLINQDKNKYNTPKYRFVVRFTNKDIIAQIASASIAGDIVLASAYAHELPRYGLEAGLTNYAAAYCTGLLLARRVLKMLEMDDEYEGNVEATGEDFSVEPADSRRPFRALLDVGLLRTTTGNRVFGALKGALDGGLDIPHSDKRFAGFAKDNKQLDAEVHRKYIYGGHVAAYMRTLMEDEPEKYQSHFSEYLKRGIDADGMEALYKKVHAAIRADPTAKKSEKQPPKEHKRYNLKKLTYEERKAKLVERLNALNSAADDEDDE

SEQ ID NO: 1816 - DNA, 1202 bp, Glycine max
  misc_feature (1)..(1202): Ceres Clone ID no. 544072
  misc_feature (1)..(1202): Encodes the peptide sequence at SEQ ID NO. 1817
gactccttctggtcactctgggagaaagaggtcgagtttcacagcagcaatggtgtacgtcaaggctcagaaatcaaaagcctacttcaagagatatcaagtcaagttcaagagaagaagagagggaaaaaccgattaccgtgccaggattcggttgattaatcaggacaagaacaaatataacactccgaaataccgatttgttgttcgctttagcaacaaggacattgttgcacaaataatatctgctagcattgctggcgatattgttcttgctgcagcatatgcacatgagctgccacgatatggtcttgaagtagggcttacaaattatgctgcagcttattgcactggtctcctgttggcccgaagagtcctcaaaacacttgaaatggatgaggagtatgaaggaaatgttgaggctactggagaggattattccgtggaacctgctgagagcaggaggccattccgtgctctccttgatgttggtcttattaggactacaaccggtaaccgtgtgtttggtgcccttaagggagctctggatggggggttggatattcctcacagtgacaagaggtttgctgggtttgataaggagaagaaggagcttgatgcagaggttcatcggaaatatgtttttggtggacatgttgctgcctatatgaagatcttggcggaagatgaaccagagaaataccagtcacacttcagtgaatacatcaagcgtgggatagaagctgatggtattgaggcactgtataaaaatgttcatgctgccatccgggctgatcctactctcaagaaatctgataagcagaccccgaaggagcacaagaggtacaacttaaagaagctgacatatgaggagaggaaggctaagttgatttcacgtgtggcagctctcaactctgctgctgataatgatgaagatgatgagtgaaagttcattgcagatgccttctcatggctacactagtagaaactatcttatttggtatctacagaatcattttcttgaaaatttatttgcctgcctgtttatttctaggcccaaaatttggatactttttttggagttgagtaagccttaattttggtcaatttcgggttagtttgaatttgaagttttaccttgtttttatggttcactactttcactcgagcaatgttcgtataaaatcagtttttgttaacgt

SEQ ID NO: 1817 - protein, 298 aa, Glycine max
  misc_feature (26)..(172): Pfam Name: Ribosomal_L18p Pfam Description: Ribosomal L18p/L5e family
  misc_feature (1)..(298): Ceres Clone ID no. 544072
  misc_feature (1)..(298): Bit score of 785.3 for HMM based on sequences of Figure 35
  misc_feature (1)..(298): Functional Homolog Of SEQ ID NO. 1812
  misc_feature (1)..(298): in Figure 35
MVYVKAQKSKAYFKRYQVKFKRRREGKTDYRARIRLINQDKNKYNTPKYRFVVRFSNKDIVAQIISASIAGDIVLAAAYAHELPRYGLEVGLTNYAAAYCTGLLLARRVLKTLEMDEEYEGNVEATGEDYSVEPAESRRPFRALLDVGLIRTTTGNRVFGALKGALDGGLDIPHSDKRFAGFDKEKKELDAEVHRKYVFGGHVAAYMKILAEDEPEKYQSHFSEYIKRGIEADGIEALYKNVHAAIRADPTLKKSDKQTPKEHKRYNLKKLTYEERKAKLISRVAALNSAADNDEDDE

SEQ ID NO: 1818 - DNA, 1279 bp, Gossypium hirsutum
  misc_feature (1)..(1279): Ceres Clone ID no. 1974604
  misc_feature (1)..(1279): Encodes the peptide sequence at SEQ ID NO. 1819
atataatctatctcctcctccttcccctttagccgtctttccctccctccctctcagatcaaagcttcaaaatggcatttgtcaaggctcagaaaaccaaagcttactttaagcggtttcaggttccatacaaaagaaggagagagggaaagactgactaccgggctaggattcgcctaatcaatcaagacaagaataagtacaacactccgaagtaccgattcgttgtccgatttagcaacaaagatgtcaccgcacaaatagtttctgctaatattgctggtgatatggttcttgcttctgcttactcacatgagcttccacgatatgggcttgaagtgggtcttacaaactatgccgcagcttattgcactggtttgctgttggggcgccgtgtgcttaagatgcttgaaatggatgaagagtatcagggcaatgtagaggctactggagaggacttctcagttgagccaactgacacaaggaggcctttccgtgctctccttgatgtagggctgatcaggacaaccactggcaatcgtgtttttggtgctctaaagggagccttggatgctggtttggatattcctcatagcgacaagaggtttgctgggttctccaaggacaacaagcagctcgatgctgaggttcacagcaagtacatatatggtggccatgttgctgcatatatgaggactttgatggaagatgaacccgagaagtatcaatctcacttcagcgagtatattaagaggggaattgaggctgataacattgagtccttgtacaagaaagttcatgctgctatccgagctgatccaactgcaaagaagactgaaaaggagcctcctaagcagcacaaaaggttcaacttgaagaagctaacatacgaggaaaggaaagctaagttgattgaacggttacacacccttaatgccgctgctggtgattcagaggaagaggattgaatgtaggaatgctcatttcaaagcactaaaattattacatgcttttcttattatacattgctgttgactgcagttttgtccagaactgagttgcattttgtaaggggttgaacttatttcacattttgtttcaattttgtttagagtttttgttattttttgcaattggagtgtaattgaattattaggtttttggttatttagttgcttgtgaaatgcaattttagccagtcacaggctagctttgcaaaacttcatcactaacacttaaaaaggtttatgaaggtctcagtaaaaatttagttccattt

SEQ ID NO: 1819 - protein, 298 aa, Gossypium hirsutum
  misc_feature (26)..(172): Pfam Name: Ribosomal_L18p Pfam Description: Ribosomal L18p/L5e family
  misc_feature (1)..(298): Ceres Clone ID no. 1974604
  misc_feature (1)..(298): Bit score of 787.3 for HMM based on sequences of Figure 35
  misc_feature (1)..(298): Functional Homolog Of SEQ ID NO. 1812
  misc_feature (1)..(298): in Figure 35
MAFVKAQKTKAYFKRFQVPYKRRREGKTDYRARIRLINQDKNKYNTPKYRFVVRFSNKDVTAQIVSANIAGDMVLASAYSHELPRYGLEVGLTNYAAAYCTGLLLGRRVLKMLEMDEEYQGNVEATGEDFSVEPTDTRRPFRALLDVGLIRTTTGNRVFGALKGALDAGLDIPHSDKRFAGFSKDNKQLDAEVHSKYIYGGHVAAYMRTLMEDEPEKYQSHFSEYIKRGIEADNIESLYKKVHAAIRADPTAKKTEKEPPKQHKRFNLKKLTYEERKAKLIERLHTLNAAAGDSEEED

SEQ ID NO: 1820 - DNA, 1167 bp, Zea mays
  misc_feature (1)..(1167): Ceres Clone ID no. 339870
  misc_feature (1)..(1167): Encodes the peptide sequence at SEQ ID NO. 1821
aaaaaaacccttccattcacccgcagctcccatcctctcgctcgccaggagaagcagccgccgttgctgctgccgcgtccacagaatggggggtttcgtgaagactcataagaccaatgcgtatttcaaacgtttccaagtgaaattcaagagaaggcgggctggcaagacagactacagggccaggataaggctgattaaccaagacaaaaacaagtacaacacacccaaatacagatttgttgtgcgatttaccaacaaggacatcactgcacaaatcatatctgctagtatagcgggtgatatggttcttgcttctgcctactctcatgagttgccacgatatggtcttgaagttggtctgaccaactatgcagctgcctactgcactggacttctgttggctcgccgtgtgctaaagatccgtggtttggataaggagtatgagggcaatgttgaggccactggtgaggacttctctgttgagccagctgatgagaggaggccattccgtgctctcttggatgttggccttatcaggactacaacagggaaccgtgtctttggtgccctcaagggagctttggatgggggcctggatattcctcacagcgagaagaggtttgctggattcaagaaggatgacaagcagttggatgctgatacccaccgcaggtacatctatggtggccatgttgctgactacatgaagaaccttgctgaagaggagccagaaaagtaccagagccacttcagtgcgtacattaagaagggagttgaggctgaggaaattgaagccctgtacaagaaggttcatgctgccatccgtgctgatccttcggttgttaagtcaaccaagcagccaccaaaggagcataagaggtacaaccccaagaagctgacatatgagcagaggaaggccagcctcattgaaaggctcaaccaactcaactcctccggtggtgctgatgacgacgatgaggacgacgagtaaagtttagtgccatcgaagtggtgctatctcaatccagcgatcagcaattgtgtactgtcttatgcggggacctgtagtactgcaataggcatttttgtttaagttttgcgaggtgaacaaaactgtttctgttagtttcgagcttgagctctcaatgtttactctttacattg

SEQ ID NO: 1821 - protein, 302 aa, Zea mays
  misc_feature (27)..(173): Pfam Name: Ribosomal_L18p Pfam Description: Ribosomal L18p/L5e family
  misc_feature (1)..(302): Ceres Clone ID no. 339870
  misc_feature (1)..(302): Bit score of 787.5 for HMM based on sequences of Figure 35
  misc_feature (1)..(302): Functional Homolog Of SEQ ID NO. 1812
  misc_feature (1)..(302): in Figure 35
MGGFVKTHKTNAYFKRFQVKFKRRRAGKTDYRARIRLINQDKNKYNTPKYRFVVRFTNKDITAQIISASIAGDMVLASAYSHELPRYGLEVGLTNYAAAYCTGLLLARRVLKIRGLDKEYEGNVEATGEDFSVEPADERRPFRALLDVGLIRTTTGNRVFGALKGALDGGLDIPHSEKRFAGFKKDDKQLDADTHRRYIYGGHVADYMKNLAEEEPEKYQSHFSAYIKKGVEAEEIEALYKKVHAAIRADPSVVKSTKQPPKEHKRYNPKKLTYEQRKASLIERLNQLNSSGGADDDDEDDE

SEQ ID NO: 1822 - protein, 302 aa, Cucumis sativus
  misc_feature (26)..(172): Pfam Name: Ribosomal_L18p Pfam Description: Ribosomal L18p/L5e family
  misc_feature (1)..(302): Public GI ID no. 55976189
  misc_feature (1)..(302): Bit score of 794.3 for HMM based on sequences of Figure 35
  misc_feature (1)..(302): Functional Homolog Of SEQ ID NO. 1812
  misc_feature (1)..(302): in Figure 35
MAFAKAQKTKAYFKRYQVKFKRRREGKTDYRARIRLINQDKNKYNTPKYRFVVRTSNKDITAQIISASIAGDLVLASAYSHELPQYGLEVGLTNYAAAYCTGLLLARRVLKMLEMDAEYEGNVEATGEDYSVEPADTRRPFRALLDVGLIRTTTGNRVFGALKGALDGGLDIPHSDKRFAGYAKNGQQLDVEVHRKYIFGGHVAAYMRTLMEDEPEKYQSHFSEYIKKGIEADELEGLYKKVHAAIRANPIAKKSDKPQPKAHKRYNLKKLTYDERKARLVERLNALNSAADGDDDDDEDDE

SEQ ID NO: 1823 - DNA, 1179 bp, Panicum virgatum
  misc_feature (1)..(1179): Ceres Clone ID no. 1724322
  misc_feature (1)..(1179): Encodes the peptide sequence at SEQ ID NO. 1824
ctctcgcccgccagcagaagcagccgccgccgccgcttcgacagccaccgcagggtaccgagatgggtggttttgtcaagacccagaagaccagtgcgtactccaagcgtttccaagtgaagttcaagagaaggcgtgctggcaagacggactacagggcaaggatcaggttgatcaaccaagacaagaacaagtacaatacgcccaaatacagatttgttgtgcgatttaccaacaaggacatcactgcacaaatcgtatctgcaagtattgcgggtgatatggtacttgctgctgcctactcccatgagcttccacgatatggtcttgaagttggtctgaccaactatgctgcagcctactgcactgggcttcttttggcccgtcgtgtgctcaagcttcgtgatttggatcaggagtatgagggcaacgttgaggccactggtgaggacttctctgttgagccagatgatgagaggaggcctttccgtgctcttttggatgttggccttgttaggactaccactggaaaccgtgtctttggtgccctgaagggagctttggatggtggtctagatattcctcatagtgacaagaggtttgctggtttcaagaaggatgaaaagcagctggatgctgaggtccaccgcaagtacatctatggtggccatgttgcagagtacatgaggactctggctgaggaggagccggagaagtaccaggctcacttcagtgactacatcaagaaggggattgaggctgatgacatggaagctttgtacaagaaggtccatgctgccatccgtgctgatcctaccatggccaagtcaaccaagcagccaccgaaggagcacaagaggtacaaccccaagaagctgacctatgagcagaggaaggccagccttgtcgaaaggcttaacgccctcaactcgtctggtggtgctgatgatgatgacgatgaggacgacgagtgaagtgtagtcccttcgtagtagtgctatcttatggggcgatcagaacttctgccatggcacttatcgttacctgtagtcctgcaacaggcatttttgtttaagtttgtcgtcgtgaacaaagctgttctattagttttgagctggagttatagatatttactcttatctaaaattaagatgctgccgtttgaacgtggttcttccg

SEQ ID NO: 1824 - protein, 303 aa, Panicum virgatum
  misc_feature (27)..(173): Pfam Name: Ribosomal_L18p Pfam Description: Ribosomal L18p/L5e family
  misc_feature (1)..(303): Ceres Clone ID no. 1724322
  misc_feature (1)..(303): Bit score of 800.7 for HMM based on sequences of Figure 35
  misc_feature (1)..(303): Functional Homolog Of SEQ ID NO. 1812
  misc_feature (1)..(303): in Figure 35
MGGFVKTQKTSAYSKRFQVKFKRRRAGKTDYRARIRLINQDKNKYNTPKYRFVVRFTNKDITAQIVSASIAGDMVLAAAYSHELPRYGLEVGLTNYAAAYCTGLLLARRVLKLRDLDQEYEGNVEATGEDFSVEPDDERRPFRALLDVGLVRTTTGNRVFGALKGALDGGLDIPHSDKRFAGFKKDEKQLDAEVHRKYIYGGHVAEYMRTLAEEEPEKYQAHFSDYIKKGIEADDMEALYKKVHAAIRADPTMAKSTKQPPKEHKRYNPKKLTYEQRKASLVERLNALNSSGGADDDDDEDDE

SEQ ID NO: 1825 - DNA, 1193 bp, Triticum aestivum
  misc_feature (1)..(1193): Ceres Clone ID no. 1072407
  misc_feature (1)..(1193): Encodes the peptide sequence at SEQ ID NO. 1826
gccgttctaaaccctcccttctcccacttctccacccctctccctcggcaagaaaagccgccgccgccgcatccgcagcagccgcatccgcagcaggcgagcgagatggtgtttgtgaagaaccagaagaccagggcctactccaagcggttccaagtgaagttcaagagaaggagacaggggaagaccgattacagggccaggctcaggctcaccaaccaagacaagaacaagtacaacacgcccaagtaccggtttgttgtacgatttaccaacaaagatgtcactgcccaaattgtgtacgctaccattgctggtgatatcgtgatggctgctgcctattcccatgagcttcctcggtatggtcttgaagttggcctcaccaactatgctgcagcgtactgcactggtctgcttttggcccgccgtgtgctcaagtgccgtgatttggatcaggaatatgagggcaatgttgaggccactggggaggacttctctgttgagccggctgatgagaggaggcctttccgcgcgctcttggatgttggccttattaggaccactactggaaaccgtgtgtttggtgcccttaagggagctttggatggtggtcttgatattccgcacagtgacaagagatttgctggcttcaagaaggatgagaagcagctggacgctgagattcaccgcaaatacatctatggagggcatgttgctgactacatgaagtcactggctgatgaggaacctgagaagtaccaatctcacttcagtgagtacatcaagaaggggattgaggctgataacatggaagcactgtacaagaaggttcatgctgccattcgtgctgatcctaccatggcaaagtcaaccaaggaacctccaaagacgcacaagaggtacaaccccaagaagctgacctacgagcagaggaaggccagtctcgtggagcggctcaacgccctcaactcatctgctggtgctgatgtcgatgaggacgacgacgaatgagtgtaatcgaccctaggcccctatagtgctgtcttcatgcttccaaatgaacttgctccatgcattaaagagtagtatcgcgagagagacatatatgcacattgtacctgcccttggttttgagtaccatgctggagttctggatcatcttacattatacaaggtgctggcattttgacgtc

SEQ ID NO: 1826 - protein, 301 aa, Triticum aestivum
  misc_feature (26)..(172): Pfam Name: Ribosomal_L18p Pfam Description: Ribosomal L18p/L5e family
  misc_feature (1)..(301): Ceres Clone ID no. 1072407
  misc_feature (1)..(301): Bit score of 794.6 for HMM based on sequences of Figure 35
  misc_feature (1)..(301): Functional Homolog Of SEQ ID NO. 1812
  misc_feature (1)..(301): in Figure 35
MVFVKNQKTRAYSKRFQVKFKRRRQGKTDYRARLRLTNQDKNKYNTPKYRFVVRFTNKDVTAQIVYATIAGDIVMAAAYSHELPRYGLEVGLTNYAAAYCTGLLLARRVLKCRDLDQEYEGNVEATGEDFSVEPADERRPFRALLDVGLIRTTTGNRVFGALKGALDGGLDIPHSDKRFAGFKKDEKQLDAEIHRKYIYGGHVADYMKSLADEEPEKYQSHFSEYIKKGIEADNMEALYKKVHAAIRADPTMAKSTKEPPKTHKRYNPKKLTYEQRKASLVERLNALNSSAGADVDEDDDE

SEQ ID NO: 1827 - protein, 302 aa, Solanum tuberosum
  misc_feature (26)..(172): Pfam Name: Ribosomal_L18p Pfam Description: Ribosomal L18p/L5e family
  misc_feature (1)..(302): Public GI ID no. 77999273
  misc_feature (1)..(302): Bit score of 785.1 for HMM based on sequences of Figure 35
  misc_feature (1)..(302): Functional Homolog Of SEQ ID NO. 1812
  misc_feature (1)..(302): in Figure 35
MAFIKVQKTRAYFKRFQVKFKRRREGKTDYRARNRLINQDKNKYNTPKYRFVVRFTNRDIIAQIVSASIAGDMILASAYASELPHFGLKVGLTNYAAAYCTGLLLARRVLKKLEMDEEYQGNLDVNGEDYSVEPAESRRPFRALLDVGLLRTTTGNRVFGALKGALDGGIDIPHSEKRFAGYSKDSKQLDAEVHRKFIYGGHVTAYMNTLMEDEPEKYQTHFSLYIKAGLEADNLEEMYKKVHAAIRADPCPKKSGKQPPKTHKRYNLKKLTYEERKAKLIERLNALNAAGGNDDDDEEDDD

SEQ ID NO: 1828 - protein, 304 aa, Oryza sativa subsp. indica
  misc_feature (27)..(173): Pfam Name: Ribosomal_L18p Pfam Description: Ribosomal L18p/L5e family
  misc_feature (1)..(304): Public GI ID no. 158513203
  misc_feature (1)..(304): Bit score of 784.7 for HMM based on sequences of Figure 35
  misc_feature (1)..(304): Functional Homolog Of SEQ ID NO. 1812
  misc_feature (1)..(304): in Figure 35
MGGFVKTQKTNAYYKRFQVKFKRRRQGKTDYRARIRLTNQDKNKYNTPKYRFVVRFTNKDITAQIVYATIAGDIVMAAAYSHELPRYGLEVGLTNYAAAYCTGLLLARRVLKLRGLDQEYEGNIEATGEDYYVEPADERRPFRALLDVGLIRTTTGNRVFGALKGALDGGLDIPHSDKRFAGFKKDEKQLDSDIHRKYIYGGHVADYMRSMAEEEPEKFQAHFSEYLKKGIDADGMEALYKKVHAAIRADPTMAKSTKKEPATHKRYNLKKLTYEQRKASLVERLNALNSSAGADDDDEEEDDE

SEQ ID NO: 1829 - protein, 297 aa, Picea sitchensis
  misc_feature (26)..(172): Pfam Name: Ribosomal_L18p Pfam Description: Ribosomal L18p/L5e family
  misc_feature (1)..(297): Public GI ID no. 116778980
  misc_feature (1)..(297): Bit score of 756.7 for HMM based on sequences of Figure 35
  misc_feature (1)..(297): Functional Homolog Of SEQ ID NO. 1812
  misc_feature (1)..(297): in Figure 35
MVFVKAQKTRAYFKRFQVKFKRRREGKTDYRARIRLINQDKNKYNTPKYRLVVRFSNKDVVAQIIYATLAGDVVMAAAYSRELPRYGLEVGLTNYAAAYCTGLLLARRVLKQLEMDEEYVGNEEASGEDYSVEPNDARRPFRALLDVGLVRTTTGNRVFGALKGALDGGLDIPHSDKRFAGYNKESKSLDADLHRKYILGGHVAAYMKTLREDEPEKYQSQFSEYHKKGIEPENIEELYKKVHAAIRADPTIKYSEKHVPKVQKHYLTRKLTYEERKNKLIARLNALNAGADEEDDE

SEQ ID NO: 1830 - protein, 301 aa, Arabidopsis thaliana [sequence omitted]

SEQ ID NO: 1831 - DNA, 1227 bp, Arabidopsis thaliana
  misc_feature (1)..(1227): Ceres Clone ID no. 21756
  misc_feature (1)..(1227): Encodes the peptide sequence at SEQ ID NO. 1832
gcgcctcttgccatcttttgtcactcatcttcacaggaaacaatggtgtttgtgaagtcctccaaatcgaatgcttacttcaagaggtaccaagtgaagttcaggagaaggagagatgggaagactgattacagggcaaggatccgtcttatcaatcaagacaagaacaagtacaacacccctaagtaccgttttgttgttcgatttaccaacaaagacattgtggcacagattgtatctgcaagcatagctggtgacattgttaaagcttcggcttacgcacatgagcttcctcagtatggactcactgttggtcttaccaactatgctgcagcttactgtactggccttcttttggctcgtcgtgttctgaaaatgctggaaatggatgatgagtacgagggaaacgtagaggccactggagaggacttttctgtggaaccaactgattccagaagacctttccgtgctcttcttgatgttggacttatcaggactaccactggaaaccgtgtgtttggtgcactcaagggagctttggacggaggtcttgatatccctcacagtgacaagagatttgctggtttccacaaagagaacaagcaacttgatgctgaaatccacaggaactacatctacggtggccatgtctcaaactacatgaagctgttgggggaagatgagccggagaagttgcaaactcacttcagtgcttacattaagaaaggagttgaagctgagagcatcgaggagatgtacaagaaggttcacgcagctatccgagcagaacccaaccataagaaaaccgagaaatctgctcccaaggaacacaagaggtacaacttgaagaaactgacttacgaagagaggaagaataagttgatcgagagagtgaaggcattaaacggagcaggtggtgatgatgatgatgaggatgatgaagagtaaatcaccaatcaagccttctttgtctcatgcctctagtagctttttacttatttattttcagactaaaacactcagtttttgttttcacattttagttgcgtttgaagattttgaattcgaggatatgttttgtttgaagaatttattatcatctcttattacaccatcgtcattttcaggaatttgcctgtcaatagttagattttatgcgtagtgtggttttattgcttgtggaaaatggggattcttgaagtaatgaaagtgatcattagtgatgcc

SEQ ID NO: 1832 - protein, 301 aa, Arabidopsis thaliana
  misc_feature (26)..(172): Pfam Name: Ribosomal_L18p Pfam Description: Ribosomal L18p/L5e family
  misc_feature (1)..(301): Ceres Clone ID no. 21756
  misc_feature (1)..(301): Bit score of 781.9 for HMM based on sequences of Figure 35
  misc_feature (1)..(301): Functional Homolog Of SEQ ID NO. 1812
MVFVKSSKSNAYFKRYQVKFRRRRDGKTDYRARIRLINQDKNKYNTPKYRFVVRFTNKDIVAQIVSASIAGDIVKASAYAHELPQYGLTVGLTNYAAAYCTGLLLARRVLKMLEMDDEYEGNVEATGEDFSVEPTDSRRPFRALLDVGLIRTTTGNRVFGALKGALDGGLDIPHSDKRFAGFHKENKQLDAEIHRNYIYGGHVSNYMKLLGEDEPEKLQTHFSAYIKKGVEAESIEEMYKKVHAAIRAEPNHKKTEKSAPKEHKRYNLKKLTYEERKNKLIERVKALNGAGGDDDDEDDEE

SEQ ID NO: 1833 - DNA, 1168 bp, Gossypium hirsutum
  misc_feature (1)..(1168): Ceres Clone ID no. 1894842
  misc_feature (1)..(1168): Encodes the peptide sequence at SEQ ID NO. 1834
agccgtctcttcctccttcactttcagatcatcaaaaccttcaacaatggcctttgttaaggctcaaaaaaccaaagcttactttaagcgttttcaggttccattcaagagaaggagagagggaaagactgattacagggctaggattcgcttaaccaatcaagacaagaacaaatacaacacgcctaaataccgattcgttgttcgatttagcaacaaagatatcactgcacaaataatttctgctaatattactggtgatatgattcttgcctcggcttactcgcatgagcttcctcgttatggacttgaagtcggtcttacaaactatgccgctgcttattgcactggattacttttggggcgccgtgtccttaagttgcttgaaatggacgatgaatatcaaggaaatgtggaggctaccggagaggatttctcagttgagccaactgacacaaggaggcctttccgagctctccttgatgtaggactgatcaggacaaccactggaaacaatgtttttggtgcactaaagggagctttggatgccggtttggatattcctcatagtgataagagatttgccgggttctccaaggatagtaagcagctcgatgctgaagttcaccgcaactacatttacggtggtcacgtagccgcatatatgaggattttgatggaagacgagccagaaaagtatcagtctcacttcagcgagtatattaagagaggaatcgaagcagataacattgagtccttgtacaagaaggttcacgctgctatccgtgcagatccctctgcaaagaagtctgaaaaggctcctcctaagcaacacaagaggttcaacttgaagaagctgacgtacgaggaaaggaaagctaagttgattgatcgattacacacccttaatgccgctgctggtgcggattccgaagatgaggattgaacgtagtatgctgatttcgaaaaatactgaacttgtttacctgcttttgtttttactgttctataaagaactatttgaagttaatttcttttttgtttaggttagcttatttacttctcaatttcaattttgttattaggagttctgtactttttttttaaacagtttctgaaggcgactgaatgatcagattcttgtgaaatgcgaattcggttttgagtc

SEQ ID NO: 1834 - protein, 299 aa, Gossypium hirsutum
  misc_feature (26)..(172): Pfam Name: Ribosomal_L18p Pfam Description: Ribosomal L18p/L5e family
  misc_feature (1)..(299): Ceres Clone ID no. 1894842
  misc_feature (1)..(299): Bit score of 776.0 for HMM based on sequences of Figure 35
  misc_feature (1)..(299): Functional Homolog Of SEQ ID NO. 1812
MAFVKAQKTKAYFKRFQVPFKRRREGKTDYRARIRLTNQDKNKYNTPKYRFVVRFSNKDITAQIISANITGDMILASAYSHELPRYGLEVGLTNYAAAYCTGLLLGRRVLKLLEMDDEYQGNVEATGEDFSVEPTDTRRPFRALLDVGLIRTTTGNNVFGALKGALDAGLDIPHSDKRFAGFSKDSKQLDAEVHRNYIYGGHVAAYMRILMEDEPEKYQSHFSEYIKRGIEADNIESLYKKVHAAIRADPSAKKSEKAPPKQHKRFNLKKLTYEERKAKLIDRLHTLNAAAGADSEDED

SEQ ID NO: 1835 - protein, 298 aa, Populus balsamifera subsp. trichocarpa
  misc_feature (26)..(172): Pfam Name: Ribosomal_L18p Pfam Description: Ribosomal L18p/L5e family
  misc_feature (1)..(298): Public GI ID no. 118483391
  misc_feature (1)..(298): Bit score of 784.1 for HMM based on sequences of Figure 35
  misc_feature (1)..(298): Functional Homolog Of SEQ ID NO. 1812
MAFAKAQKSRAYCKRFQVKFKRRREGKTDYRARIRLINQDKNKYNTPKYRFVMRFTNKDITAQIIHASMAGDIVVAAAYSHELPHYGLEVGLTNYAAAYCTGLLLARRVLKKLEMDEEYEGNVEATGEDYSVEPADSRRPFRALLDVGLVRTTTGNRVFGALKGALDGGLDIPHSDKRFAGFNKDGKQLDAEVHRKYIYGGHVAAYMRNLMEDEPEKYQSHFSEYIKRGIEPDNMEELYKKVHAAIRADPTAKKSEKQLPKEHKRYNLKKLTYEERKAKLVERLKALNSAADDDEDDE

SEQ ID NO: 1836 - DNA, 1134 bp, Solanum lycopersicum
  misc_feature (1)..(1134): Ceres Annot ID no. 8460689
  misc_feature (1)..(1134): Encodes the peptide sequence at SEQ ID NO. 1837
atggccttcatcaaagtccagaagacaagggcttattttaagcgtttccaggttaaattcaagagaaggagagaggggaaaacagattacagagccaggaatcgcttgatcaatcaggacaaaaataagtacaacactcctaaatatcgtttggttgtccgatttactaacaaggacataattgcacaaattgtgtctgctagtattgctggtgacatgattcttgcctctgcttatgctaacgagctgcctcgttatggcctagaagttggactgactaattatgctgctgcctactgcactggacttcttttggcaaggagagttcttaaaaagcttgaaatggatgaggagtatgaagggaaccttgaggtcaatggggaggactactctgttgaacctgctgaaagcagaaggcctttccgagctctcttggatgttggccttctaagaactactacaggaaatcgtgtttttggtgctctcaagggtgcattggatggtggacttgatattcctcacagtgagaagaggttcgctggattcagcaaggattccaagcaacttgatgctgatgttcaccgcaagtacatatatggtggccacgttgctacatatatgcagactctaattgaagatgaaccagagaaatatcagacacactttagtcagtacatcaaaaagggttttgaggctgatggccttgaggagatgtacaagaaggttcatgctgccattcgtgctgatccaagcccaaagaaatctgagaagcaacctcctaaacagcacaagaggtataatctgaagaagctaacatacgaggaaaggaaggctaagttgattgagagactgaatgctttgaattcagctgctggaaatgacgatgatgatgaggatgacgactggaacacccgccaaagcatgattttaaaagttgatggcatgtatttcgtgctgtttcatcaacagttggatataaatggatggaacatcgccctggacgatttacaacacttgcagcagcagcaaaccaaatgcacccaaacaactacaggagaactttttcccatatataccaagaatgtgcgaaacattgcactcagcaaccaggcaggcaagctcatgctcggatga

SEQ ID NO: 1837 - protein, 377 aa, Solanum lycopersicum
  misc_feature (26)..(172): Pfam Name: Ribosomal_L18p Pfam Description: Ribosomal L18p/L5e family
  misc_feature (1)..(377): Ceres Annot ID no. 8460689
  misc_feature (1)..(377): Bit score of 788.6 for HMM based on sequences of Figure 35
  misc_feature (1)..(377): Functional Homolog Of SEQ ID NO. 1812
MAFIKVQKTRAYFKRFQVKFKRRREGKTDYRARNRLINQDKNKYNTPKYRLVVRFTNKDIIAQIVSASIAGDMILASAYANELPRYGLEVGLTNYAAAYCTGLLLARRVLKKLEMDEEYEGNLEVNGEDYSVEPAESRRPFRALLDVGLLRTTTGNRVFGALKGALDGGLDIPHSEKRFAGFSKDSKQLDADVHRKYIYGGHVATYMQTLIEDEPEKYQTHFSQYIKKGFEADGLEEMYKKVHAAIRADPSPKKSEKQPPKQHKRYNLKKLTYEERKAKLIERLNALNSAAGNDDDDEDDDWNTRQSMILKVDGMYFVLFHQQLDINGWNIALDDLQHLQQQQTKCTQTTTGELFPIYTKNVRNIALSNQAGKLMLG

SEQ ID NO: 1838 - DNA, 1247 bp, Zea mays
  misc_feature (1)..(1247): Ceres Clone ID no. 278897
  misc_feature (1)..(1247): Encodes the peptide sequence at SEQ ID NO. 1839
cccgtccaccggctagggtttccccagagttaaaaggcccggaggaggcgcccctataaacccttcccttctgtcgctgctcccacctctagcccgacaggtgaagccgccgccgctgcagtgtccatagccaccgcaggagactgagatggggggttttgtcaagacccacaagagcaatgcgtacttcaagcgtttccaggtgaagttcaagagaaggcgcgctggcaagacagactacagggccaggataaggctgattaaccaagacaaaaacaagtacaatacacccaaatacagatttgttgtgcgatttaccaacaaggacatcacagcacaaatcatctctgctagtatagcaggtgatatggttcttgcttctgcttactcgcatgagttgccacgatatggtcttgaagttggtctgaccaactatgcagctgcctactgcactggccttctgttggctcgccgtgtgctcaagacccgtggtttagataaggaatatgagggcaatgttgaggccactggtgaggatttctctgttgagccagctgatgagaggaggcctttccgtgctctcttggatgttggccttattaggactacgactgggaaccgtgtctttggtgccctcaagggagctttggatggtggcctggatattcctcacagcgagaagaggtttgctggtttcaagaaggatgacaagcagctggatgctgatatccatcgcaagtacatctatggtggccatgttgctgactacatgaggaacctcgctgaagaggagccagagaagtaccagtctcacttcagtgagtacattaagaagggaattgaggctgacgacatggaagctctgtacaagaaggtccatgctgccatccgtgctgatccttctgtggtcaagtcaaccaagcagccaccaaaggagcacaagaggtacaaccccaagaaactgacatacgagcagaggaaggccagtctcattgaaaggctcaaccaactcaactcctcgggcggcgcagatgacgacgacgaggatgacgagtaaagtttcgtcccatcgaagtagtgctatcttatgcggcgatcagtatttgtgctatggcatttatcgctacctgtagtcgtgcaacatgcatttttgtttaagtttgtcgatgcgaacaaagttgtttctgttagtttggagctggagttctgaatatttacttttataatattaaaattggaccgagtcg

SEQ ID NO: 1839 - protein, 302 aa, Zea mays
  misc_feature (27)..(173): Pfam Name: Ribosomal_L18p Pfam Description: Ribosomal L18p/L5e family
  misc_feature (1)..(302): Ceres Clone ID no. 278897
  misc_feature (1)..(302): Bit score of 793.0 for HMM based on sequences of Figure 35
  misc_feature (1)..(302): Functional Homolog Of SEQ ID NO. 1812
MGGFVKTHKSNAYFKRFQVKFKRRRAGKTDYRARIRLINQDKNKYNTPKYRFVVRFTNKDITAQIISASIAGDMVLASAYSHELPRYGLEVGLTNYAAAYCTGLLLARRVLKTRGLDKEYEGNVEATGEDFSVEPADERRPFRALLDVGLIRTTTGNRVFGALKGALDGGLDIPHSEKRFAGFKKDDKQLDADIHRKYIYGGHVADYMRNLAEEEPEKYQSHFSEYIKKGIEADDMEALYKKVHAAIRADPSVVKSTKQPPKEHKRYNPKKLTYEQRKASLIERLNQLNSSGGADDDDEDDE

SEQ ID NO: 1840 - protein, 297 aa, Populus balsamifera subsp. trichocarpa
  misc_feature (26)..(172): Pfam Name: Ribosomal_L18p Pfam Description: Ribosomal L18p/L5e family
  misc_feature (1)..(297): Public GI ID no. 224121940
  misc_feature (1)..(297): Bit score of 761.5 for HMM based on sequences of Figure 35
  misc_feature (1)..(297): Functional Homolog Of SEQ ID NO. 1812
MAYAKAQKSKAYSKRFQVKFKRRREGKTDYRARIRLINQDKNKYNTPKYRFVVRFSNKDIVAQITSASITGDTVLASAYAHELPRYGLEVGLTNYAAAYCTGLLLARRLLKMLEMDEEYEGNVEATGEDFSVEPADTRRPFRALLDVGLVRTTTGNRVFGALKGALDGGLDIPHSEKRFAGFGKDNKQLDAEVHRKYIYGGHVAAYMRTLMEDEPEKYQSHFSEYLKREIDADCMEALYKKVHAAIRADPTTKKSEKEPLKEHKRYNLKKLTYEERKEKLVERLNTFNSAADDEDDE

SEQ ID NO: 1841 - protein, 297 aa, Populus balsamifera subsp. trichocarpa
  misc_feature (26)..(172): Pfam Name: Ribosomal_L18p Pfam Description: Ribosomal L18p/L5e family
  misc_feature (1)..(297): Public GI ID no. 118484032
  misc_feature (1)..(297): Bit score of 759.8 for HMM based on sequences of Figure 35
  misc_feature (1)..(297): Functional Homolog Of SEQ ID NO. 1812
MAYAKAQKSKAYSKRFQVKFKRRREGKTDYRARIRLINQDKNKYNTPKYRFVVRFSNKDIVAQITSASITGDTVLASAYAHELPRYGLEVGLTNYAAAYCTGLLLARRLLKMLEMDEEYEGNVEATGEDFSVEPADTRRPFRALLDVGLVRTTTGNRVFGALKGALDGGLDIPHSEKRFAGFGKDNKQLDAEVHRKYIYGGHVAAYMRTLMEDEPEKYQSHFSEYLKREIDADCMEALYKKVHAAIRADPTTKKSEKEPLKEHKKYNLKKLTYEERKEKLVERLNTFNSAADDEDDE

SEQ ID NO: 1842 - DNA, 1214 bp, Panicum virgatum
  misc_feature (1)..(1214): Ceres Clone ID no. 1726573
  misc_feature (1)..(1214): Encodes the peptide sequence at SEQ ID NO. 1843
ctacccttctccatccgctcccaccctctcggctgccaggagaagcagccgctgccgccgcttcgacagccaccgcagggtaccaagatgggtggttttgtcaagacccaaaagaccagtgcgtactccaagcgtttccaagtgaagttcaagagaaggcgcgctggcaagacagactacagggcaaggatcaggttgattaaccaagacaagaacaagtacaacacgcccaaatacagatttgttgtgcgatttaccaacaaggacatcactgcacaaatcgtatctgcaagtattgcgggtgatatggtacttgctgctgcctactcccatgagctgccacgatatggtcttgaagttggtctgaccaactatgctgcagcctactgcactgggcttcttttggcccgtcgtgtgctcaagcttcgtgatttggataaggagtatgagggcaacgttgaggccactggtgaagacttctctgttgagccagatgatgagaggaggcctttccgtgctcttttggatgttggccttgttaggactaccactggaaaccgtgtctttggtgccctgaagggagctttggatggtggtctagatattcctcacagtgagaagaggtttgctggtttcaagaaggatgaaaagcagctggatgctgaggtccaccgcaagtacatctatggtggtcatgttgctgagtacatgaggactctagctgaggaggagccggagaagtaccagtctcacttcagtgagtacatcaagaagggtattgaggctgatgacatggaagctctgtacaagaaggtccatgctgccatccgagctgatcctaccatggccaagtcaaccaagcagccaccgaaggagcacaagaggtacaaccccaagaaactgacctatgagcagaggaaggccagcctagttgaaaggctcaacgccctcaactcgtctggtggtgctgatgatgatgacgatgaggacgacgagtgaagtgtcccttcgtagtagtgctatcttatgtggcgatcagaacttgtgccatggcacctatcgttacctgtagtcctgcaacaggcatttttgtttaagtttgtcgatgtgaacaaagctgttctgctagttttgagctggagttatggatattaaaattaagatgcttccgattgaacgtggttcttctgaatccccagttgtggtttgaaacc

SEQ ID NO: 1843 - protein, 303 aa, Panicum virgatum
  misc_feature (27)..(173): Pfam Name: Ribosomal_L18p Pfam Description: Ribosomal L18p/L5e family
  misc_feature (1)..(303): Ceres Clone ID no. 1726573
  misc_feature (1)..(303): Bit score of 801.2 for HMM based on sequences of Figure 35
  misc_feature (1)..(303): Functional Homolog Of SEQ ID NO. 1812
MGGFVKTQKTSAYSKRFQVKFKRRRAGKTDYRARIRLINQDKNKYNTPKYRFVVRFTNKDITAQIVSASIAGDMVLAAAYSHELPRYGLEVGLTNYAAAYCTGLLLARRVLKLRDLDKEYEGNVEATGEDFSVEPDDERRPFRALLDVGLVRTTTGNRVFGALKGALDGGLDIPHSEKRFAGFKKDEKQLDAEVHRKYIYGGHVAEYMRTLAEEEPEKYQSHFSEYIKKGIEADDMEALYKKVHAAIRADPTMAKSTKQPPKEHKRYNPKKLTYEQRKASLVERLNALNSSGGADDDDDEDDE

SEQ ID NO: 1844 - protein, 304 aa, Oryza sativa subsp. japonica
  misc_feature (27)..(173): Pfam Name: Ribosomal_L18p Pfam Description: Ribosomal L18p/L5e family
  misc_feature (1)..(304): Public GI ID no. 115441607
  misc_feature (1)..(304): Bit score of 783.4 for HMM based on sequences of Figure 35
  misc_feature (1)..(304): Functional Homolog Of SEQ ID NO. 1812
MGGFVKTQKTNAYHKRFQVKFKRRRQGKTDYRARIRLTNQDKNKYNTPKYRFVVRFTNKDITAQIVYATIAGDIVMAAAYSHELPRYGLEVGLTNYAAAYCTGLLLARRVLKLRGLDQEYEGNIEATGEDYYVEPADERRPFRALLDVGLIRTTTGNRVFGALKGALDGGLDIPHSDKRFAGFKKDEKQLDSDIHRKYIYGGHVADYMRSMAEEEPEKFQAHFSEYLKKGIDADGMEALYKKVHAAIRADPTMAKSTKKEPATHKRYNLKKLTYEQRKASLVERLNALNSSAGADDDDEEEDDE

SEQ ID NO: 1845 - DNA, 1204 bp, Gossypium hirsutum
  misc_feature (1)..(1204): Ceres Clone ID no. 1833880
  misc_feature (1)..(1204): Encodes the peptide sequence at SEQ ID NO. 1846
ctctattctctttactctctctcaaagctcggctgctaacccctgtgctcaaagctatgccttacgtgaaagctcaaaagtcaaaggcatacttcaaaagatatcaagttaagttcaagagaagacgagagggcaagactgactaccgggccaggaaccgtcttatcaatcaggataaaagcaagtacaataccccaaaatatcgtttcgttgcaagatttaccaataaggatatagttgcacaaattatacatgctagtatttctggtgatatagttcttgcagcagcttatgctcatgaacttccccgctatggacttgaagtgggccttaccaattatgctgcagcttattgtgttggactcctcttggctcgccgaacactgaagcaactggagatggatgctgagtatgagggaaatgttgaggcaactggggaggacttcactgttgaaccagcagagaccaggaggcctttccgtgcgctccttgatgttggtcttatcagaactactactggtaaccgtttttttggtgttctcaagggtgctctggatgggggaattgatattcctcacggtgacaagaggtttgctggatttaacaaggacagtaagcaacttgatcctgaagttcaccgcaaatacatttacggtggccatgttgctgcatacatgaggactttaatggaagatgagccagagaagtaccagtctcacttcagtgagtacattaagagaagcattgagcctgacaccatagagggaatgtacaagaaggttcataccgccattcgtgcaagtccagaagcaaagaaatccaagaaggctcctcccaaggaacacaaaaggtacaacctgaagaagctgtcttacgaggaaaggaaggcgaagttgattgataggttgaaggctttgaattcagctgccggagttgataatgattctgatgaggatgattgatcaagccgctgaagttgatgctacggttgaggaaaacactgggtgaattcagcatcggaatttttgtttttgttctttttttttccttctaaaacttcatccttttgctgctagaatttaagaaaaaaaaaagactgaaggctttgcttctttattaggtatacgaggaactggcatttttgcctgctgcttccgttatttgatagtttaattttataagtactattctattcgtggcttcc

SEQ ID NO: 1846 - protein, 301 aa, Gossypium hirsutum
  misc_feature (26)..(172): Pfam Name: Ribosomal_L18p Pfam Description: Ribosomal L18p/L5e family
  misc_feature (1)..(301): Ceres Clone ID no. 1833880
  misc_feature (1)..(301): Bit score of 735.4 for HMM based on sequences of Figure 35
  misc_feature (1)..(301): Functional Homolog Of SEQ ID NO. 1812
MPYVKAQKSKAYFKRYQVKFKRRREGKTDYRARNRLINQDKSKYNTPKYRFVARFTNKDIVAQIIHASISGDIVLAAAYAHELPRYGLEVGLTNYAAAYCVGLLLARRTLKQLEMDAEYEGNVEATGEDFTVEPAETRRPFRALLDVGLIRTTTGNRFFGVLKGALDGGIDIPHGDKRFAGFNKDSKQLDPEVHRKYIYGGHVAAYMRTLMEDEPEKYQSHFSEYIKRSIEPDTIEGMYKKVHTAIRASPEAKKSKKAPPKEHKRYNLKKLSYEERKAKLIDRLKALNSAAGVDNDSDEDD

SEQ ID NO: 1847 - protein, 301 aa, Oryza sativa subsp. japonica
  misc_feature (27)..(170): Pfam Name: Ribosomal_L18p Pfam Description: Ribosomal L18p/L5e family
  misc_feature (1)..(301): Public GI ID no. 21952858
  misc_feature (1)..(301): Bit score of 763.5 for HMM based on sequences of Figure 35
  misc_feature (1)..(301): Functional Homolog Of SEQ ID NO. 1812
MGGFVKTQKTNAYHKRFQVKFKRRRQGKTDYRARIRLTNQDKNKYNTPKYRFVTNKDITAQIVYATIAGDIVMAAAYSHELPRYGLEVGLTNYAAAYCTGLLLARRVLKLRGLDQEYEGNIEATGEDYYVEPADERRPFRALLDVGLIRTTTGNRVFGALKGALDGGLDIPHSDKRFAGFKKDEKQLDSDIHRKYIYGGHVADYMRSMAEEEPEKFQAHFSEYLKKGIDADGMEALYKKVHAAIRADPTMAKSTKKEPATHKRYNLKKLTYEQRKASLVERLNALNSSAGADDDDEEEDDE

SEQ ID NO: 1848 - DNA, 1029 bp, Populus balsamifera subsp. trichocarpa
  misc_feature (1)..(1029): Ceres Annot ID no. 1480607
  misc_feature (1)..(1029): Encodes the peptide sequence at SEQ ID NO. 1849
atggcctatgcgaaggctcagaaatctaaggcctactccaagaggtttcaagtcaagtttaagagaagaagagaggggaagactgactacagggctaggattcgactgattaatcaggacaagaacaagtacaatacgcccaagtatcgatttgttgtccgatttgtatccttcagcaacaaggacattgttgcacaaataacatcagctagcattactggagatactgtccttgcttctgcttatgctcatgaacttcctcgatatgggcttgaagttggtcttacaaactatgcagcagcttactgtaccggacttctcttggctcgccgcttgttgaaaatgcttgagatggatgaggaatatgagggcaatgttgaggccactggcgaggatttctcagttgaaccagctgacaccaggaggccatttcgtgccctacttgatgttgggttagtcagaactacaactggaaatcgtgtctttggtgctctcaaggatagtcatttagtctctttgaatttcaatgttatacatggagctcttgatggtggtttggatattcctcacagtgaaaagaggtttgctggctttggaaaggacaataagcagctcgatgctgaagttcaccggaaatatatttatggtggacatgttgcagcatacatgaggcatcataaaactgcgtcaatcagaaattgtgcttgtatattttgtattatggttcttgaatgtttagtttgcgtttcttcaccccagactttgatggaggatgaacctgagaaataccagtctcactttagtgagtacctcaagagagaaattgatgctgattgtatggaggcattgtacaagaaggttcatgctgctattcgtgcagatccaacaaccaagaaatcagagaaggagccactcaaggagcacaagaggtataacttgaagaagctaacctacgaggaaaggaaagagaagttggttgagcgattgaataccttcaactcagctgctgatgatgaagatgacgagtga

SEQ ID NO: 1849 - protein, 342 aa, Populus balsamifera subsp. trichocarpa
  misc_feature (26)..(188): Pfam Name: Ribosomal_L18p Pfam Description: Ribosomal L18p/L5e family
  misc_feature (1)..(342): Ceres Annot ID no. 1480607
  misc_feature (1)..(342): Bit score of 696.2 for HMM based on sequences of Figure 35
  misc_feature (1)..(342): Functional Homolog Of SEQ ID NO. 1812
MAYAKAQKSKAYSKRFQVKFKRRREGKTDYRARIRLINQDKNKYNTPKYRFVVRFVSFSNKDIVAQITSASITGDTVLASAYAHELPRYGLEVGLTNYAAAYCTGLLLARRLLKMLEMDEEYEGNVEATGEDFSVEPADTRRPFRALLDVGLVRTTTGNRVFGALKDSHLVSLNFNVIHGALDGGLDIPHSEKRFAGFGKDNKQLDAEVHRKYIYGGHVAAYMRHHKTASIRNCACIFCIMVLECLVCVSSPQTLMEDEPEKYQSHFSEYLKREIDADCMEALYKKVHAAIRADPTTKKSEKEPLKEHKRYNLKKLTYEERKEKLVERLNTFNSAADDEDDE

SEQ ID NO: 1850 - DNA, 774 bp, Glycine max
  misc_feature (1)..(774): Ceres Clone ID no. 1614435
  misc_feature (1)..(774): Encodes the peptide sequence at SEQ ID NO. 1851
aaaaaaaaccccaaagagactcaggcgctgctgcccttcagtccttcagcaatggtttacgtgaagtcacagaaatcaaaagcctacttcaagaggtatcaagtcaagttcaagagaagaagagagggaaaaaccgattaccgtgccaggattcggttgattaatcaggacaagaacaaatataacaccccgaaatatcgctttgttgttcgtttcagcaacaaagacattgttgcacaaataatatctgctagcattgctggcgatattgttcttgctgcagcatatgcacatgagctgccacgatatggtcttgaagtagggcttacaaattatgctgcagcttattgtactggtctcctgttggcccgaagagtcctcaaaacacttgaaatggatgaggagtacgaaggaaatgttgaggctactggagaggactattcagtggaacctgctgagagcaggaggccattccgtgctctccttgatgttggtcttattaggactacaactggcaaccgtgtctttggtgcccttaagggagctctggatgggggtttggatattcctcatagtgacaagaggtttgctgggtttgataaggagaagaaggagcttgatgctgaggtgcatcgcaaatatgtttttggtggacatgttgctgcctatatgaagatcttggcggaagatgaacctgagaaatatcagtcacacttcagtgaatacatcaagcgtggaatagaagctgatggtattgaggcactgtacaagagg

SEQ ID NO: 1851 - protein, 241 aa, Glycine max
  misc_feature (26)..(172): Pfam Name: Ribosomal_L18p Pfam Description: Ribosomal L18p/L5e family
  misc_feature (1)..(241): Ceres Clone ID no. 1614435
  misc_feature (1)..(241): Bit score of 572.9 for HMM based on sequences of Figure 35
  misc_feature (1)..(241): Functional Homolog Of SEQ ID NO. 1812
MVYVKSQKSKAYFKRYQVKFKRRREGKTDYRARIRLINQDKNKYNTPKYRFVVRFSNKDIVAQIISASIAGDIVLAAAYAHELPRYGLEVGLTNYAAAYCTGLLLARRVLKTLEMDEEYEGNVEATGEDYSVEPAESRRPFRALLDVGLIRTTTGNRVFGALKGALDGGLDIPHSDKRFAGFDKEKKELDAEVHRKYVFGGHVAAYMKILAEDEPEKYQSHFSEYIKRGIEADGIEALYKR

SEQ ID NO: 1852 - protein, 293 aa, Physcomitrella patens subsp. patens
  misc_feature (26)..(172): Pfam Name: Ribosomal_L18p Pfam Description: Ribosomal L18p/L5e family
  misc_feature (1)..(293): Public GI ID no. 168062894
  misc_feature (1)..(293): Bit score of 652.2 for HMM based on sequences of Figure 35
  misc_feature (1)..(293): Functional Homolog Of SEQ ID NO. 1812
MAFIKPNKTKAYFKRFQVKYKRRRAGKTDYRARIRLTTQDKNKYNTPKYRFVVRFTNKDIVAQITYATLAGDIVLTSAYAHELPRYGLKGGLTNYAAAYCTGLLLARRHLKNYDLDDEYVGNEQATGEDYNVEEGEGKRPFRALLDVGLVRTTTGNRVFGALKGALDGGLDVPHSEKRFAGYNKEDKSLNAEIHRKYILGGHVADYMKLLKEDEPEKYQSHFSGFIKAGVEAENLAEMYTSVHAAIRADPTQQKTEKKAPAEKRKWKIQKLTYDERQAALVKRLNAINGEDEE

SEQ ID NO: 1853 - DNA, 751 bp, Musa acuminata
  misc_feature (1)..(751): Ceres Clone ID no. 1729334
  misc_feature (1)..(751): Encodes the peptide sequence at SEQ ID NO. 1854
ctttgctcctcgtctccattgccgcgacgctctttgagatcggagcagacaaggaggcgcaatggtttttgttaaagctcataagtctaaggcttactttaagcgttttcaagtcaagtacaagagaaggagagagggaaagacggactatcgggcaaggattcggctaataaatcaagacaagaacaaatataatacacctaaatatcgttttgttgttcgctttaccaacaaggatattgtcgcacaaataatatcttcaagtattgctggagatttggtccttgcttcagcctttgcccatgaattacctcgttatgggcttgaagtaggccttaccaattatgcagcagcttattgcactggacttcttttggcccgtcgtgttttgaagacgcttgaaatggatgaggaatatcagggtaatgttgaggctactggggaagatttctctgttgaacctgcagagagtaggaggcctttccgtgctcttcttgatgttggccttgtgaggacaacaactggcaatcgtgtttttggtgttctcaagggagcattggatggtggccttgatgttccacatagtgataagaggtttgcaggttttaagaaggatgagaagcagcttgatgcagattttcataggaattacatttttggcggccatgttgcttcttacatgaggacactgatggaagatgagccagagaagtaccagacacattttagtgattacattaaacgaaatgtt

SEQ ID NO: 1854 - protein, 230 aa, Musa acuminata
  misc_feature (26)..(172): Pfam Name: Ribosomal_L18p Pfam Description: Ribosomal L18p/L5e family
  misc_feature (1)..(230): Ceres Clone ID no. 1729334
  misc_feature (1)..(230): Bit score of 517.7 for HMM based on sequences of Figure 35
  misc_feature (1)..(230): Functional Homolog Of SEQ ID NO. 1812
MVFVKAHKSKAYFKRFQVKYKRRREGKTDYRARIRLINQDKNKYNTPKYRFVVRFTNKDIVAQIISSSIAGDLVLASAFAHELPRYGLEVGLTNYAAAYCTGLLLARRVLKTLEMDEEYQGNVEATGEDFSVEPAESRRPFRALLDVGLVRTTTGNRVFGVLKGALDGGLDVPHSDKRFAGFKKDEKQLDADFHRNYIFGGHVASYMRTLMEDEPEKYQTHFSDYIKRNV

SEQ ID NO: 1855 - DNA, 723 bp, Gossypium hirsutum
  misc_feature (1)..(723): Ceres Clone ID no. 1921953
  misc_feature (1)..(723): Encodes the peptide sequence at SEQ ID NO. 1856
atctcctcctccttcccctttagccgtctttccctccctccctctcagatcaaagcttcaaaatggcatttgtcaaggctcagaaaaccaaagcttactttaagcggtttcaggttccatacaaaagaaggagagagggaaagactgactaccgggctaggattcgcctaatcaatcaagacaagaataagtacaacactccgaagtaccgattcgttgtccgatttagcaacaaagatgtcaccgcacaaatagtttctgctaatattgctggtgatatggttcttgcttctgcttactcacatgagcttccacgatatgggcttgaagtgggtcttacaaactatgccgcagcttattgcactggtttgctgttggggcgccgtgtgcttaagatgcttgaaatggatgaagagtatcagggcaatgtagaggctactggagaggacttctcagttgagccaactgacacaaggaggcctttccgtgctctccttgatgtagggctgatcaggacaaccactggcaatcatgtttttggtgctctaaagggagccttggatgctggtttggatattcctcatagcgacaagaggtttgctgggttctccaaggacaacaagcagctcgatgctgaggttcacagcaagtacatatatggtggccatgttgctgcatatatgaggactttgatgggagatgaaccccgagaatatcaatctc

SEQ ID NO: 1856 - protein, 220 aa, Gossypium hirsutum
  misc_feature (26)..(172): Pfam Name: Ribosomal_L18p Pfam Description: Ribosomal L18p/L5e family
  misc_feature (1)..(220): Ceres Clone ID no. 1921953
  misc_feature (1)..(220): Bit score of 482.1 for HMM based on sequences of Figure 35
  misc_feature (1)..(220): Functional Homolog Of SEQ ID NO. 1812
MAFVKAQKTKAYFKRFQVPYKRRREGKTDYRARIRLINQDKNKYNTPKYRFVVRFSNKDVTAQIVSANIAGDMVLASAYSHELPRYGLEVGLTNYAAAYCTGLLLGRRVLKMLEMDEEYQGNVEATGEDFSVEPTDTRRPFRALLDVGLIRTTTGNHVFGALKGALDAGLDIPHSDKRFAGFSKDNKQLDAEVHSKYIYGGHVAAYMRTLMGDEPREYQS

SEQ ID NO: 1857 - DNA, 672 bp, Gossypium hirsutum
  misc_feature (1)..(672): Ceres Clone ID no. 1849983
  misc_feature (1)..(672): Encodes the peptide sequence at SEQ ID NO. 1858
ttttattctctttacactctctcaaagctcggctgctaacccctgtgctcaaagctatgccttacgtgaaagctcaaaagtcaaaggcatacttcaaaagatatcaagttaagttcaagagaagacgagagggcaagactgactaccgggctaggaaccgtcttatcaatcaggataagaacaagtacaataccccaaaatatcgtttggttgcaagatttaccaataaggatatagttgcacaaattatacatgctagtatttctggtgatatagttcttgcagcagcttatgctcatgaacttccccgctatggacttgaagtgggccttaccaattatgctgcagcttattgtgttggactcctcttggctcgccgaacactgaagcaactggagatggatgctgagtatgagggaaatgttgaggcaactggggaggacttcactgttgaaccagcagagacaaggaggccatttcgtgcgcttcttgatgttggtcttatcagaactactactggtaaccgtgtttttggtgttctcaagggggctctggatgggggaattgatattcctcacagtgacaagaggtttgctggatttaacaaggacagtaagcaacttgatcctgaagttcaccgcaaatacatttacggtggccatgttgctgcat

SEQ ID NO: 1858 - protein, 205 aa, Gossypium hirsutum
  misc_feature (26)..(172): Pfam Name: Ribosomal_L18p Pfam Description: Ribosomal L18p/L5e family
  misc_feature (1)..(205): Ceres Clone ID no. 1849983
  misc_feature (1)..(205): Bit score of 404.8 for HMM based on sequences of Figure 35
  misc_feature (1)..(205): Functional Homolog Of SEQ ID NO. 1812
MPYVKAQKSKAYFKRYQVKFKRRREGKTDYRARNRLINQDKNKYNTPKYRLVARFTNKDIVAQIIHASISGDIVLAAAYAHELPRYGLEVGLTNYAAAYCVGLLLARRTLKQLEMDAEYEGNVEATGEDFTVEPAETRRPFRALLDVGLIRTTTGNRVFGVLKGALDGGIDIPHSDKRFAGFNKDSKQLDPEVHRKYIYGGHVAA

SEQ ID NO: 1859 - DNA, 699 bp, Populus balsamifera subsp. trichocarpa
  misc_feature (1)..(699): Ceres Annot ID no. 1534090
  misc_feature (1)..(699): Encodes the peptide sequence at SEQ ID NO. 1860
atggcctatgcgaaggctcagaaatctaaggcctactccaagaggtttcaagtcaagtttaagagaagaagagaggggaagactgactacagggctaggattcgactgattaatcaggacaagaacaagtacaatacgcccaagtatcgatttgttgtccgatttgtatccttcagcaacaaggacattgttgcacaaataacatcagctagcattactggagatactgtccttgcttctgcttatgctcatgaacttcctcgatatgggcttgaagttggtcttacaaactatgcagcagcttactgtaccggacttctcttggctcgccgcttgttgaaaatgcttgagatggatgaggaatatgagggcaatgttgaggccactggcgaggatttctcagttgaaccagctgacaccaggaggccatttcgtgccctacttgatgttgggttagtcagaactacaactggaaatcgtgtctttggtgctctcaaggatagtcatttagtctctttgaatttcaatgttatacatggagctcttgatggtggtttggatattcctcacagtgaaaagaggtttgctggctttggaaaggacaataagcagctcgatgctgaagttcaccggaaatatatttatggtggacatgttgcagcatacatgaggtttgcgtttcttcaccccagactttga

SEQ ID NO: 1860 - protein, 232 aa, Populus balsamifera subsp. trichocarpa
  misc_feature (26)..(188): Pfam Name: Ribosomal_L18p Pfam Description: Ribosomal L18p/L5e family
  misc_feature (1)..(232): Ceres Annot ID no. 1534090
  misc_feature (1)..(232): Bit score of 415.6 for HMM based on sequences of Figure 35
  misc_feature (1)..(232): Functional Homolog Of SEQ ID NO. 1812
MAYAKAQKSKAYSKRFQVKFKRRREGKTDYRARIRLINQDKNKYNTPKYRFVVRFVSFSNKDIVAQITSASITGDTVLASAYAHELPRYGLEVGLTNYAAAYCTGLLLARRLLKMLEMDEEYEGNVEATGEDFSVEPADTRRPFRALLDVGLVRTTTGNRVFGALKDSHLVSLNFNVIHGALDGGLDIPHSEKRFAGFGKDNKQLDAEVHRKYIYGGHVAAYMRFAFLHPRL

SEQ ID NO: 1861 - protein, 293 aa, Chlamydomonas reinhardtii
  misc_feature (26)..(173): Pfam Name: Ribosomal_L18p Pfam Description: Ribosomal L18p/L5e family
  misc_feature (1)..(293): Public GI ID no. 159463258
  misc_feature (1)..(293): Bit score of 493.3 for HMM based on sequences of Figure 35
  misc_feature (1)..(293): Functional Homolog Of SEQ ID NO. 1812
MGYVKVIKTSPYFSRFQVKYRRRREGKTDYRARLRLVKQDKNKYNTPKYRLVVRFTNRDITCQIVRSTIKGDIVEAAAYAHELPDYGLECGLTNYAACYCVGLLVARRILTKFGLDKHYPGQTEPDGEDYNIEPVEEGPRPFFCLLDTGLKRTSTGSKVFGCLKGALDGGLDIPHNEKRLVGYDRSGKKMDAEVLKKYIFGGHVAEYMEEMEEEEPEKYMKHFAKYVEADLSGGDLEDKYAEVHAAIREKPVKEKAARTKPAAAKRWHTPKLTLEQRRENLKQKLAALQDDEE

SEQ ID NO: 1862 - protein, 297 aa, Helianthus annuus
  misc_feature (26)..(173): Pfam Name: Ribosomal_L18p Pfam Description: Ribosomal L18p/L5e family
  misc_feature (1)..(297): Public GI ID no. 6094086
  misc_feature (1)..(297): Bit score of 476.1 for HMM based on sequences of Figure 35
  misc_feature (1)..(297): Functional Homolog Of SEQ ID NO. 1812
MGFVKVVKNKQYFKRYQVKFKRRREGKTDYFARKRLIAQDKNKYNTPKYRLVVRFSNRDITCQVAYSRIEGDKILCAAYAHELPQYGVKVGLTNYAAAYCTGLLLARKLLSQLGLDKLYIGSTEVTGEEFNVKPVEDGPGAFRCYLDVGLMRTTTGARVFGAMKGAVDGGLNILHSTKRFPGFDSESKEFNADVHRQHIFGQHVAEYMRQLAEEDDEAYKRQFSQYIKLGLNADAIEGLYKKAHEAIRANPARKTVAKKAHPKKRWTEKKLTREQRQGKVAAAKAEWLKKIEAGEVE

SEQ ID NO: 1863 - protein, 271 aa, Dunaliella salina
  misc_feature (26)..(173): Pfam Name: Ribosomal_L18p Pfam Description: Ribosomal L18p/L5e family
  misc_feature (1)..(271): Public GI ID no. 6094085
  misc_feature (1)..(271): Bit score of 446.4 for HMM based on sequences of Figure 35
  misc_feature (1)..(271): Functional Homolog Of SEQ ID NO. 1812
MGYVKVVKTSPYFSRYQVKYRRRRQGKTDYRARLRLVRQDKNKYNTHKYRLVVRFSNKNVTCQIVYSTIQGDVVMAAAYSKELPNYGLKVGLTNYSAAYCVGLLVARRILTKLNLADTYKGQEEPDGEDYNVEPVEDGPKPFYCLLDTGLKRTSTGSKVFAAMKGALDGGLDIPHNEKRFVGYADKKLDTEVLQKYIYGGHVAEYQETMQEEEPEKYQAHFSSYVENEIEPDGIEDMYKEVHAKIRENPCPPKKERTKPADAKRWSPQAHL

SEQ ID NO: 1864 - DNA, 962 bp, Panicum virgatum
  misc_feature (1)..(962): Ceres Clone ID no. 2023733
  misc_feature (1)..(962): Encodes the peptide sequence at SEQ ID NO. 1865
ctttacatagcaacgtcgaacaatgcctttcgtcaagcaacaaaagaacaaggcttatttcaagcgttatcaagtcaagtatcgtagaagaagagagggtaagaccgattactatgctcgtaagagactcgtcgttcaagccaagaacaagtacaactctcctaagtacagattggttgtccgtttcaccaacaaggacatcatctgtcaaatcatctacgctaagctccaaggtgatttcgtcctctctgctgcctatgctcatgaacttccccgttatggtgttaagggtggtttgaccaactgggcctctgcttacgctactggtctcctccttgctcgtcgtaccctcgccaagctcggtcttgctgacaagtacgaaggtttcgctgagcccgatggtaccgttcaattgattgaagctgctgaggatgctccccgtcctttcaaggctttcctcgatgtcggtctcgctcgtacctccactggtgcccgtgtctttggtgccatgaagggtgcctccgatggtggtatctttgttccccacaacggtaaccgtttccctggtttcgatatcgagaccaagaccaacgatgatgaacttctccgtaactacatttatggtgttcacgttgctgagtacatggaatacctcgaagaagaagatgaggaacgttacaagaagcaattctctaccttcatcaaggccggtattacctctgataaggtcgaggatatgtacactgaagctcatgaagctatccgtgagaaccctgctgctcaacccaccgagaagaagggtaagcccgccaagccttaccgcagactcgttgccctcaacaagaagcaacgtctcaacaagatcaaggatgccaaggctgctttcgaagcttctcaataaattggtttatcccaatctattagtttaataataaaaaaatcgacttgactttttgttgtat

SEQ ID NO: 1865 - protein, 292 aa, Panicum virgatum
  misc_feature (26)..(173): Pfam Name: Ribosomal_L18p Pfam Description: Ribosomal L18p/L5e family
  misc_feature (1)..(292): Ceres Clone ID no. 2023733
  misc_feature (1)..(292): Bit score of 405.3 for HMM based on sequences of Figure 35
  misc_feature (1)..(292): Functional Homolog Of SEQ ID NO. 1812
MPFVKQQKNKAYFKRYQVKYRRRREGKTDYYARKRLVVQAKNKYNSPKYRLVVRFTNKDIICQIIYAKLQGDFVLSAAYAHELPRYGVKGGLTNWASAYATGLLLARRTLAKLGLADKYEGFAEPDGTVQLIEAAEDAPRPFKAFLDVGLARTSTGARVFGAMKGASDGGIFVPHNGNRFPGFDIETKTNDDELLRNYIYGVHVAEYMEYLEEEDEERYKKQFSTFIKAGITSDKVEDMYTEAHEAIRENPAAQPTEKKGKPAKPYRRLVALNKKQRLNKIKDAKAAFEASQ

SEQ ID NO: 1866 - protein, 300 aa, Ostreococcus lucimarinus CCE9901
  misc_feature (33)..(180): Pfam Name: Ribosomal_L18p Pfam Description: Ribosomal L18p/L5e family
  misc_feature (1)..(300): Public GI ID no. 145354281
  misc_feature (1)..(300): Bit score of 432.0 for HMM based on sequences of Figure 35
  misc_feature (1)..(300): Functional Homolog Of SEQ ID NO. 1812
MGRRKVKRKSQSVAKTNAYFSRFQVKFARRRAGKTDYYARQRLITQDKNKYNSPKYRFVVRFTNRDVICQVVYATLAGDVCIASAYSHELPKYGMKAGLTNYAATYATGLLCARRLLTKYGLADAYEGKTEDLGEDYHVEQGDEEARPFKCFLDTGLVRTSTGARVFAALKGAVDGGLDIPHNEKRFAGYDLQDKSHDPDTLERYIKGGVVAEYAEELQEEEPEKFEQQFAKYLAADFDPTELEDAMEDVLDAIREDPVHEKKERVKPADAGRLFKLPKLTYEEKKANLKAKLEALRAAA

SEQ ID NO: 1867 - protein, 331 aa, Ostreococcus tauri
  misc_feature (35)..(182): Pfam Name: Ribosomal_L18p Pfam Description: Ribosomal L18p/L5e family
  misc_feature (1)..(331): Public GI ID no. 116055139
  misc_feature (1)..(331): Bit score of 377.4 for HMM based on sequences of Figure 35
  misc_feature (1)..(331): Functional Homolog Of SEQ ID NO. 1812
MGKRRQKRKSQSVAKTTAYQSRYQVKFARRRLGACKTDYQARQRLITQDKNKYNSPKYRFVVRFTNRDVVCQVVYATLSGDVTICAAYSHELPKYGMKAGLTNYAATYATGLLCARRLLTKYGLADAYEGKTEDLGEDYHVEQGDEEARPFKCFLDTGLVRTSTGARVFAALKGAVDGGLDIPHNEKRFAGYDLQDKSHDPDTLERYIKGGVVAEYAEEMQEEEPEKFEQHFAKYLAEDFDPTELEDAMEEVFEAIREDPTHEKKERVKPADAGQEGQPQGEARSSSCGGVNDAGVVFCIARCAFGSTSSKSRRPNSLRFASRGDCNDHAT

SEQ ID NO: 1868 - protein, 295 aa, Styela clava
  misc_feature (26)..(173): Pfam Name: Ribosomal_L18p Pfam Description: Ribosomal L18p/L5e family
  misc_feature (1)..(295): Public GI ID no. 2500286
  misc_feature (1)..(295): Bit score of 488.1 for HMM based on sequences of Figure 35
  misc_feature (1)..(295): Functional Homolog Of SEQ ID NO. 1812
MGFVKVVKNKAYFKRYQVKYKRRRQGKTDYFARKRLVVQDKNKYNTPKYRMIVRFTNKDIVCQIAYARIEGDVVICAAYAHELPRYGVKVGLTNYAAAYCTGLLLSRRLLNKFGLDEIYEGQTEIDGDEFYVEDVDGKPGAFRAFLDVGLARTTTGAKVFGAMKGAADGGLDIPHSTKRFPGYDDESGDFSAEVHRSHIFGGHVSNYMKELEEEDEEAFKRQFSQYIKHGVTADTVEEMYTKAHAAIREDPTPKKKTDFAGKTKRWNRKKMTFSQRRDRVKQKKASFLRAKQQEG

SEQ ID NO: 1869 - protein, 293 aa, Suberites domuncula
  misc_feature (26)..(173): Pfam Name: Ribosomal_L18p Pfam Description: Ribosomal L18p/L5e family
  misc_feature (1)..(293): Public GI ID no. 122050162
  misc_feature (1)..(293): Bit score of 488.0 for HMM based on sequences of Figure 35
  misc_feature (1)..(293): Functional Homolog Of SEQ ID NO. 1812
MPFVKVIKNKAYFKRYQVKFRRRREGKTDYRARKRLVVQDKNKYNTPKYRIVIRFTNTDIICQIIYAKIEGDKVLVSAYAHELPRYGVKVGLTNYAAAYCTGLLLARRLLTNLGLADKYAGQTDIDGEDFNVEHMGDGPRPFRAFLDVGLTRTTTGNRVFAAMKGAVDGGIDIPHSPSRFVGYDEESSQLEADKLRQYIFGGHVSDYMKYLQEEDEEKYKAHFSRFIKEGITADSMEQMYRDAHAKIRANPAHEKKQPRDGLVKKRWNRAKMSLKQKRDRVKQKKAAYLKTLE

SEQ ID NO: 1870 - protein, 296 aa, Lepeophtheirus salmonis
  misc_feature (26)..(173): Pfam Name: Ribosomal_L18p Pfam Description: Ribosomal L18p/L5e family
  misc_feature (1)..(296): Public GI ID no. 155966157
  misc_feature (1)..(296): Bit score of 475.6 for HMM based on sequences of Figure 35
  misc_feature (1)..(296): Functional Homolog Of SEQ ID NO. 1812
  misc_feature (241)..(241): Xaa is any aa, unknown, or other
MVFVKVVKCKAYFKRYQVKFRRRREGRTDYYARKRLVVQDKNKYNTPKYRMIVRFTNKDICCQIAYARIDGDRIVEAAYAHELPRYGVKVGLTNYAAAYCTGLLLARRVLNKFKLDSIYEGQTKVDGEHFMVEDEEGKPGAFRACLDTGLARTSTGAKVFGAMKGAADGGLDVPHSVKRFPGYDNEENQFDAKTHRSHIFGKHVADYMELLQQGEPEAYKRQFSQYIKHGVTPSSMEDMYXKAHAAIRKDPTRPKKPVKKVQKKRFNAKKLTGEERKAKVKAAKAEFLAQIEAQKE

SEQ ID NO: 1871 - protein, 296 aa, Nematostella vectensis
  misc_feature (26)..(173): Pfam Name: Ribosomal_L18p Pfam Description: Ribosomal L18p/L5e family
  misc_feature (1)..(296): Public GI ID no. 156388083
  misc_feature (1)..(296): Bit score of 496.9 for HMM based on sequences of Figure 35
  misc_feature (1)..(296): Functional Homolog Of SEQ ID NO. 1812
MGFVKVVKNKAYFKRFQVKFKRRREGKTDYYARKRLITQDKNKYNTPKYRFVVRFTNKDITCQIAYAKLEGDVIICAAYAHELPRYGVKVGLTNYAAAYCTGLLLARRLLTKLNLHEIYTGTEEVNGDEYNVESIDGSPGAFRCFLDVGLARTSTGARVFGALKGAVDGGLEIPHSMKRFPGYDSESKDFSAEVHRNHIFGQHVANYMRQLAEDDEEAFKRQFSLYIKHGIEADGIEAMYKKAHAAIRESPEAKPAAKREVTVKRFHRKKMSRQQRVDRVKQKKAAFLRAQGEDDD

SEQ ID NO: 1872 - protein, 296 aa, Ciona intestinalis
  misc_feature (26)..(173): Pfam Name: Ribosomal_L18p Pfam Description: Ribosomal L18p/L5e family
  misc_feature (1)..(296): Public GI ID no. 198420685
  misc_feature (1)..(296): Bit score of 472.8 for HMM based on sequences of Figure 35
  misc_feature (1)..(296): Functional Homolog Of SEQ ID NO. 1812
MGFVKVVKNKAYFKRYQVKYRRRREGVTDYFARKRLVVQDRNKYNTPKYRMIVRFTNKDIITQIAYARIEGDVVICAAYAHELPRYGVKVGLTNYSAAYCTGLLLARRLLTKFGLDKIYEGQTEIDGDEYNVEDIDGQPGAFRAFLDIGLARTTTGARIFGAMKGAADGGLDIPHSVKRFPGYDAESKEFNAEVHRNHIFGQHVSEYMTSLEESDEDAFKRQFSQYIKNGITADGVEEMYKKAHASIREDPTPKAKVEKQVPKKRWNRAKLTKSQREDRVRQKKASYLRAIGAGDN

SEQ ID NO: 1873 - protein, 296 aa, Ictalurus punctatus
  misc_feature (26)..(173): Pfam Name: Ribosomal_L18p Pfam Description: Ribosomal L18p/L5e family
  misc_feature (1)..(296): Public GI ID no. 15293871
  misc_feature (1)..(296): Bit score of 479.6 for HMM based on sequences of Figure 35
  misc_feature (1)..(296): Functional Homolog Of SEQ ID NO. 1812
MGFVKVVKNKAYFKRYQVKFRRRREGKTDYFARKRLVIQDKNKYNTPKYRMIVRFSNRDIVCQIAYAKIEGDMIVCAAYSHELPKYGVTVGLTNYAAAYCTGLLLARQLLNKFGLDKVYEGQVEITGDEFNVESIDDKPSAFTCYLDAGLARTTTGNKVFGALKGAVDGGLSIPHSTKRFPGYDSESKEFNAEVHRKHILGLNVAEYMRLLIEEDEEAYKKQFSRFIKNGVTPDSIEEMYKKAHAAIRENPVHEKKPKREVKKKRWNRAKLTLAQRKDPVAQKKASFLRAQAAEED

SEQ ID NO: 1874 - protein, 297 aa, Trichoplax adhaerens
  misc_feature (26)..(173): Pfam Name: Ribosomal_L18p Pfam Description: Ribosomal L18p/L5e family
  misc_feature (1)..(297): Public GI ID no. 195999960
  misc_feature (1)..(297): Bit score of 491.4 for HMM based on sequences of Figure 35
  misc_feature (1)..(297): Functional Homolog Of SEQ ID NO. 1812
MTFVKVVKNKAYFKRFQVKYKRRREGKTDYFARKRLCTQDKNKYNSPKYRMVVRLTNKDVICQIACAKLEGDEIFCAAYSHELPRYGIKVGLTNYAACYCTGLLLARRVLTKLNLADKYVGVEEPDGEDFEVEEPDEGARAFRCFLDVGLARTTTGARIFGTLKGAVDGGLNIPHQHKRFPGYDNESKSYDAGVHRDRIFGCHVADYMRQLQGEDEEAYRSQFSRFIKNGITADSVEEMYKSAHSAIRANPAPLAKKEKKVAHKRFNEKKLTLEQRKERVAQKKAAFLQSLGAGDES

SEQ ID NO: 1875 - protein, 299 aa, Drosophila melanogaster
  misc_feature (26)..(173): Pfam Name: Ribosomal_L18p Pfam Description: Ribosomal L18p/L5e family
  misc_feature (1)..(299): Public GI ID no. 116007382
  misc_feature (1)..(299): Bit score of 497.0 for HMM based on sequences of Figure 35
  misc_feature (1)..(299): Functional Homolog Of SEQ ID NO. 1812
MGFVKVVKNKQYFKRYQVKFRRRREGKTDYYARKRLTFQDKNKYNTPKYRLIVRLSNKDITVQIAYARIEGDRVVCAAYSHELPKYGIQVGLTNYAAAYCTGLLVARRVLNKLGLDSLYAGCTEVTGEEFNVEPVDDGPGAFRCFLDVGLARTTTGARVFGAMKGAVDGGLNIPHSVKRFPGYSAETKSFNADVHRAHIFGQHVADYMRSLEEEDEESFKRQFSRYIKLGIRADDLEDIYKKAHQAIRNDPTHKVTAKKSSAVTKKRWNAKKLTNEQRKTKIAAHKAAYVAKLQSETEA

SEQ ID NO: 1876 - protein, 297 aa, Lysiphlebus testaceipes
  misc_feature (26)..(173): Pfam Name: Ribosomal_L18p Pfam Description: Ribosomal L18p/L5e family
  misc_feature (1)..(297): Public GI ID no. 74829222
  misc_feature (1)..(297): Bit score of 489.2 for HMM based on sequences of Figure 35
  misc_feature (1)..(297): Functional Homolog Of SEQ ID NO. 1812
MGFVKVVKNKQYFKRFQVKYKRRREGKTDYYARKRLTVQDKSKYNTPKYRLIVRLSNKDITCQIAYSRIEGDRIVCAAYSHELPKYGIKVGLTNYAAAYCTGLLLARRLLKQLKLDTLYTGTTEVDGDEYNVEEHDDGPGAFRCYLDTGLMRTTTGARIFGAMKGAVDGGLNIPHSTKRFPGYDNESKSFNADVHRQHIFAHHIANYMKTLEENEPENFQRQFSQYIKNGITADGIEEMYKKAHEAIRADPDRAEIVKTKEPVKKRWNRAKLTLSERKDRVKQIKASFQKKLEETEA

SEQ ID NO: 1877 - protein, 296 aa, Danio rerio
  misc_feature (26)..(173): Pfam Name: Ribosomal_L18p Pfam Description: Ribosomal L18p/L5e family
  misc_feature (1)..(296): Public GI ID no. 50344868
  misc_feature (1)..(296): Bit score of 480.1 for HMM based on sequences of Figure 35
  misc_feature (1)..(296): Functional Homolog Of SEQ ID NO. 1812
MGFVKVVKNKSYFKRYQVKFRRRREGKTDYFARKRLVIQDKNKYNTPKYRMIVRFSNRDIVCQIAYAKIEGDMIVCAAYSHELPKYGISVGLTNYAAAYCTGLLLARRLLNKFGLDKVYDGQVEITGDEFNVESIDGQPGAFTCYLDAGLARTTTGNKVFGALKGAVDGGLSIPHSTKRFPGYDVESKEFNAEVHRKHILGLNIAEYMRLLMEEDEECYKKQFSRFIKNGVTADSMEEMYKKAHAAIRENPVHEKKPKREVKKKRWNRAKLTLAQRKDRVAQKKASFLRAQAAEED

SEQ ID NO: 1878 - protein, 308 aa, Drosophila ananassae
  misc_feature (35)..(182): Pfam Name: Ribosomal_L18p Pfam Description: Ribosomal L18p/L5e family
  misc_feature (1)..(308): Public GI ID no. 194769639
  misc_feature (1)..(308): Bit score of 489.3 for HMM based on sequences of Figure 35
  misc_feature (1)..(308): Functional Homolog Of SEQ ID NO. 1812
MSAGQNRTLAGFVKVVKNKQYFKRYQVKFRRRREGKTDYYARKRLTFQDKNKYNTPKYRLIVRLSNKDITVQIAYARIEGDRVVCAAYSHELPKYGIQVGLTNYAAAYCTGLLVARRVLNKLGLDSLYAGCTEVTGEEFNVEPVDDGPGAFRCFLDVGLARTTTGARVFGAMKGAVDGGLNIPHSVKRFPGYSAETKSFNADVHRAHIFGQHVADYMRTLEEEDEESFKRQFSRYIRLGIRADDLEDIYKKAHQAIRNDPTHKVTAKKAAGVTKKRWNAKKLTNEQRKTKIAAHKAAYVAKLQSETEA

SEQ ID NO: 1879 - protein, 318 aa, Drosophila sechellia
  misc_feature (45)..(192): Pfam Name: Ribosomal_L18p Pfam Description: Ribosomal L18p/L5e family
  misc_feature (1)..(318): Public GI ID no. 195355748
  misc_feature (1)..(318): Bit score of 490.8 for HMM based on sequences of Figure 35
  misc_feature (1)..(318): Functional Homolog Of SEQ ID NO. 1812
MVGSNKAALFSFFLLAISGEGFVKVVKNKQYFKRYQVKFRRRREGKTDYYARKRLTFQDKNKYNTPKYRLIVRLSNKDITVQIAYARIEGDRVVCAAYSHELPKYGIQVGLTNYAAAYCTGLLVARRVLNKLGLDSLYAGCTEVTGEEFNVEPVDDGPGAFRCFLDVGLARTTTGARVFGAMKGAVDGGLNIPHSVKRFPGYSAETKSFNADVHRAHIFGQHVADYMRSLEEEDEESFKRQFSRYIKLGIRADDLEDIYKKAHQAIRNDPTHKVTAKKSSAVTKKRWNAKKLTNEQRKTKIAAHKAAYVAKLQSETEA

SEQ ID NO: 1880 - protein, 299 aa, Drosophila willistoni
  misc_feature (26)..(173): Pfam Name: Ribosomal_L18p Pfam Description: Ribosomal L18p/L5e family
  misc_feature (1)..(299): Public GI ID no. 195437688
  misc_feature (1)..(299): Bit score of 496.4 for HMM based on sequences of Figure 35
  misc_feature (1)..(299): Functional Homolog Of SEQ ID NO. 1812
MGFVKVVKNKQYFKRYQVKFRRRREGKTDYYARKRLTFQDKNKYNTPKYRLIVRLSNKDITVQIAYARIEGDRVVCAAYSHELPKYGVQVGLTNYAAAYCTGLLVARRVLNKLGLDSLYAGCTEVTGEEFNVEPVDDGPGAFRCYLDVGLARTTTGARVFGAMKGAVDGGLNIPHSVKRFPGYSAESKSFNADVHRAHIFGQHVADYMRTLEEEDEESFKRQFSRYIKLGIRADDLEDIYKKAHQAIRNDPTHKVAAKKAAGVTKKRWNAKKLTNEQRKTKIAAHKAAYVAKLQSETDA

SEQ ID NO: 1881 - protein, 296 aa, Xenopus laevis
  misc_feature (26)..(173): Pfam Name: Ribosomal_L18p Pfam Description: Ribosomal L18p/L5e family
  misc_feature (1)..(296): Public GI ID no. 148230833
  misc_feature (1)..(296): Bit score of 472.2 for HMM based on sequences of Figure 35
  misc_feature (1)..(296): Functional Homolog Of SEQ ID NO. 1812
MGFVKVVKNKAYFKRYQVKFRRRREGKTDYYARKRLVIQDKNKYNTPKYRMIVRVTNRDIICQIAYARIEGDMIVCAAYAHELPKYGVKVGLTNYAAAYCTGLLLARRLLNKFGLDKVYEGQVEVTGDEYNVESVDGEPGAFTCYLDAGLTRTTTGNKVFGALKGAVDGGLSIPHSTKRFPGYDSESKEFNAEVHRKHIFGLNIAEYMRLLIEEDEDAYKKQFSQYIKNGVAADQLEDIYKKAHAGIRENPVHEKKPKKEVKKKRWNRAKLSLEQKKDRVAQKKASFLRAQQKADS

SEQ ID NO: 1882 - protein, 299 aa, Drosophila persimilis
  misc_feature (26)..(173): Pfam Name: Ribosomal_L18p Pfam Description: Ribosomal L18p/L5e family
  misc_feature (1)..(299): Public GI ID no. 195164533
  misc_feature (1)..(299): Bit score of 496.5 for HMM based on sequences of Figure 35
  misc_feature (1)..(299): Functional Homolog Of SEQ ID NO. 1812
MGFVKVVKNKQYFKRYQVKFRRRREGKTDYYARKRLTFQDKNKYNTPKYRLIVRLSNKDITVQIAYARIEGDRVVCAAYSHELPKYGIKVGLTNYAAAYCTGLLVARRVLNKLGLDSLYAGCTEVTGEEFNVEPVDDGPGAFRCFLDVGLARTTTGARVFGAMKGAVDGGLNIPHSVKRFPGYSAETKSFNADVHRAHIFGQHVADYMRTLEEEDEESFKRQFSRYIKLGIRADDLEDIYKKAHQAIRNDPTHKVAAKKTSGVTKKRWNAKKLTNEQRKTKIAAHKAAYVAKLQSETEA

SEQ ID NO: 1883 - protein, 267 aa, Crassostrea gigas
  misc_feature (26)..(173): Pfam Name: Ribosomal_L18p Pfam Description: Ribosomal L18p/L5e family
  misc_feature (1)..(267): Public GI ID no. 40642990
  misc_feature (1)..(267): Bit score of 439.1 for HMM based on sequences of Figure 35
  misc_feature (1)..(267): Functional Homolog Of SEQ ID NO. 1812
MGFVKVVKNKAYFKRFQVKFRRRREGKTDFFARKRLVIQEKNKYNTPKYRMIVRFTNKDIICQIAYARIEGDIIICAAYSHELPRYGVKVGLTNYAAAYCTGLLLARRLLQKLKLDDIYEGQKEVDGEQFNVEDVDEKPGAFRCYLDVGLVRTTTGARVFGAMKGAADGGLDIPHSTKRFPGYDSENGEFSAEVHRNHIFGQHVANYMRSLQDEDEDAFKKQFSQFIKNKITADNLEAMYKKCHAAIRADPSPKAKKDKKDVKVKRW

SEQ ID NO: 1884 - protein, 297 aa, Caenorhabditis briggsae
  misc_feature (29)..(175): Pfam Name: Ribosomal_L18p Pfam Description: Ribosomal L18p/L5e family
  misc_feature (1)..(297): Public GI ID no. 268530064
  misc_feature (1)..(297): Bit score of 455.6 for HMM based on sequences of Figure 35
  misc_feature (1)..(297): Functional Homolog Of SEQ ID NO. 1812
MNNMGLVKVIKNKAYFKRYQVKLKRRREGKTDYYARKRLTVQDKNKYNTPKYRLIVRLTNKDIVAQLAYSKIEGDVVVASAYAHELPRYGLKAGLTNYAAAYATGLLLARRHLKAIGLDSTYKGHEELTGEDYNVEEEGDRAPFKAVLDIGLARTTTGSKIFAVMKGVADGGINVPHSESRFFGFDQESKDYNAEAHRDRILGKHVADYMSLLKEEDEDRYKRQFSKFLSNGMNADNLVATYQKAHANIRADPSPSAKKAAKPSKRHTAKRLTYDERKQRVADKKALLLQLKEQQQE

SEQ ID NO: 1885 - protein, 302 aa, Tetraodon nigroviridis
  misc_feature (32)..(179): Pfam Name: Ribosomal_L18p Pfam Description: Ribosomal L18p/L5e family
  misc_feature (1)..(302): Public GI ID no. 47215976
  misc_feature (1)..(302): Bit score of 465.6 for HMM based on sequences of Figure 35
  misc_feature (1)..(302): Functional Homolog Of SEQ ID NO. 1812
MAFLSFQGFVKVVKNKAYFKRYEVKFRRRREGKTDYFARKRLVVQDKNKYNTPKYRMIVRLSNRDICCQIAYAKIEGDHIVCAAYSHELPKYGITVGLTNYAAAYCTGLLLARRLLHKFGMDQVYEGQVEVTGEEFNVESVDGQPGAFTCYLDAGLARTTTGNKVFGALKGAVDGGLSIPHSLKRFPGYDTESKEFDAEVHRKHIMGMNVADYMSYLMEEDEDAYKKQFSRFIKNGVTPDTVEEMYKKAHASIRANPAHEKKPKKDVKKKRWNRAKLSLAQRKDRVAQKKASFLRAQEQEAG

SEQ ID NO: 1886 - protein, 299 aa, Bombyx mori
  misc_feature (26)..(173): Pfam Name: Ribosomal_L18p Pfam Description: Ribosomal L18p/L5e family
  misc_feature (1)..(299): Public GI ID no. 112983276
  misc_feature (1)..(299): Bit score of 467.8 for HMM based on sequences of Figure 35
  misc_feature (1)..(299): Functional Homolog Of SEQ ID NO. 1812
MGFVKVVKNKQYFKRYQVKFKRRREGKTDYYARKRLVVQDKNKYNTPKYRLIVRLSNKDVTCQVAYSRIEGDHIVCAAYSHELPRYGVKVGLTNYAAAYSTGLLLARRLLQRLGLDTLYTGTTDVTGDEYNVEPVDNGPGAFRCYLDVGLARTTTGRRVFGAMKGAVDGGLNVPHSIKRFPGYDAESKKFNAEVHRAHIFGLHVAEYMRSLEQDDEDSFKRQFSKYIKLGVTADAIEAIYKKAHEAIRADPSHKKKELKKDSVKQKRWNKRKLTLAERKNRIKQKKASFIKRLQAQAEA

SEQ ID NO: 1887 - protein, 297 aa, Solea senegalensis
  misc_feature (26)..(173): Pfam Name: Ribosomal_L18p Pfam Description: Ribosomal L18p/L5e family
  misc_feature (1)..(297): Public GI ID no. 164690935
  misc_feature (1)..(297): Bit score of 473.2 for HMM based on sequences of Figure 35
  misc_feature (1)..(297): Functional Homolog Of SEQ ID NO. 1812
MGFVKVVKNKAYFKRYQVKFRRRREGKTDFFARKRLVVQDKNKYNTPKYRMIVRFSNRDIVCQIAYAKIEGDMIVCAAYSHELPKYGITVGLTNYAAAYCTGLLVARRLLNKFGLDKVYEGQVEVTGDEFNVESIDGQPGAFSCYLDAGLARTTTGNKVFGALKGAVDGGLSIPHSTKRFPGYDTESKEFNAEVHRKHILGINISEYMSYLMEEDEDAYKKQFSRFIKNGVAPDAIEEMYKKAHATIRENPVHEKKPPKEVKKKRWNRAKLSLTQRKDRVAQKKASFLRAQEQENDE

SEQ ID NO: 1888 - protein, 293 aa, Caenorhabditis elegans
  misc_feature (26)..(172): Pfam Name: Ribosomal_L18p Pfam Description: Ribosomal L18p/L5e family
  misc_feature (1)..(293): Public GI ID no. 17534333
  misc_feature (1)..(293): Bit score of 452.9 for HMM based on sequences of Figure 35
  misc_feature (1)..(293): Functional Homolog Of SEQ ID NO. 1812
MGLVKVIKNKAYFKRYQVKLRRRREGKTDYYARKRLTVQDKNKYNTPKYRLIVRITNKDVVAQLAYSKIEGDVVVASAYSHELPRYGLKVGLTNYAAAYATGLLLARRHLKTIGLDSTYKGHEELTGEDYNVEEEGDRAPFKAVLDIGLARTTTGSKIFAVMKGVADGGINVPHSESRFFGFDQESKEYNAEAHRDRILGKHVADYMTYLKEEDEDRYKRQFSKFLAAGLNADNLVATYQKVHSAIRADASPAAKKAAKPSKRHTAKRLTYDERKQRVADKKALLLQLKEQQE

SEQ ID NO: 1889 - protein, 296 aa, Silurana tropicalis
  misc_feature (26)..(173): Pfam Name: Ribosomal_L18p Pfam Description: Ribosomal L18p/L5e family
  misc_feature (1)..(296): Public GI ID no. 45360909
  misc_feature (1)..(296): Bit score of 466.5 for HMM based on sequences of Figure 35
  misc_feature (1)..(296): Functional Homolog Of SEQ ID NO. 1812
MGFVKVVKNKAYFKRYQVKFRRRREGKTDYYARKRLVIQDKNKYNTPKYRMIVRVTNRDIICQIAYARIEGDMIVCAAYAHELTKYGVKVGLTNYAAAYCTGLLLARRLLNKFGLDKVYEGQVEVTGDEYNVESIDGEPGAFTCYLDAGLTRTTTGNKVFGALKGAVDGGLSIPHSTKRFPGYDSESKEFNAEVHRKHIFGQNIAEYMRLLTEEDEDAFKKQFSQYIKNGVTADQMEDIYKKAHAGIRENPVHEKKPKKEVKKKRWNRAKLSLAQKKDRVAQKKASFLRAQEKADS

SEQ ID NO: 1890 - protein, 298 aa, Salmo salar
  misc_feature (26)..(173): Pfam Name: Ribosomal_L18p Pfam Description: Ribosomal L18p/L5e family
  misc_feature (1)..(298): Public GI ID no. 197632317
  misc_feature (1)..(298): Bit score of 467.0 for HMM based on sequences of Figure 35
  misc_feature (1)..(298): Functional Homolog Of SEQ ID NO. 1812
MGFVKVVKSKAYFKRYQVKFRRRREGKTDYFARKRLVIQDKNKYNTPKYRMIVRFSNRDICCQIAYAKIEGDQIVAAAYSHELPKYGITVGLTNYAAAYCTGLLLARRLLNKFGLDQVYEGQVEVTGDEFNVESIDGQPGAFTCFLDAGLARTSTGNKVFGALKGAVDGGLSIPHSTKRFPGYDMESKEFNAEMHRKHIMGMNVSDYMSYLMEEDEDAYKKQFSRFIKNGVTPDTVEEMYKKAHTAIRENPVHEKKPQKDVKKKRWNRAKLSLAQRKDRVAQKKASFLRAQEAEAADG

SEQ ID NO: 1891 - protein, 296 aa, Strongylocentrotus purpuratus
  misc_feature (27)..(174): Pfam Name: Ribosomal_L18p Pfam Description: Ribosomal L18p/L5e family
  misc_feature (1)..(296): Public GI ID no. 115723047
  misc_feature (1)..(296): Bit score of 466.1 for HMM based on sequences of Figure 35
  misc_feature (1)..(296): Functional Homolog Of SEQ ID NO. 1812
MNGFVKVVKNKAYFKRYQVKFRRRREGRTDYQARRFLVVQDKNKYNTPKYRMIVRFTNKNITCQVAYAKLEGDVIVCAAYSHELPRYGVKVGLTNYAAAYCTGLLLARRILKKFNLDGIYEGQTEPDGDDYMVESEEGKAGAFRCFLDVGLARTTTGAKVFGALKGAVDGGLEIPHSNKRFPGYDSESSEFSAEVHRKYIFGGHVSDYMKELQGEDDDAYKRQFSQFIKNDITPDTLEAMYKKAHETIRAEPDAKPKKEFAGKTKRWNRAKLTLLQRKDRVKQKKKSFLYANQSHD

SEQ ID NO: 1892 - protein, 297 aa, Homo sapiens [sequence omitted]

SEQ ID NO: 1893 - protein, 297 aa, Dicentrarchus labrax
  misc_feature (26)..(173): Pfam Name: Ribosomal_L18p Pfam Description: Ribosomal L18p/L5e family
  misc_feature (1)..(297): Public GI ID no. 112907480
  misc_feature (1)..(297): Bit score of 464.8 for HMM based on sequences of Figure 35
  misc_feature (1)..(297): Functional Homolog Of SEQ ID NO. 1812
MGFVKVVKNKAYFKRYQVKFRRRREGKTDFFARKRLVVQDKNKYNTPKYRMIVRFSNRDIICQIAYAKIEGDMIVCAAYSHELPKYGISVGLTNYAAAYCTGLLLARRLLNKFGLDKVYEGQVEVTGDEFNVESIDGQPGAFTCYLDAGLARTTTGNKVFGALKGAVDGGLSIPHSTKRFPGYDPESKEFNAEVHRKHIMGTNVSEYMSYLLEEDEDAYKKQFSRFIKNGVTPDSIEEMYKNAHATIRENPVHEKKPPKEVKKKRGNRAKLSLAQRKDRVAQKKASFLRAQEQEASD

SEQ ID NO: 1894 - protein, 297 aa, Culex pipiens quinquefasciatus
  misc_feature (26)..(173): Pfam Name: Ribosomal_L18p Pfam Description: Ribosomal L18p/L5e family
  misc_feature (1)..(297): Public GI ID no. 170049217
  misc_feature (1)..(297): Bit score of 473.5 for HMM based on sequences of Figure 35
  misc_feature (1)..(297): Functional Homolog Of SEQ ID NO. 1812
MGFVKVVKNKQYFKRYQVRFRRRREGKTDYYARKRLIFQDKNKYNTPKYRLIVRLSNRDITCQIAYARIEGDRIVCAAYSHELPKYGVKVGLTNYAAAYCTGLLVARRILQKLRLDTLYTGCTDVTGEEYLVEQADDGPGAFRCYLDVGLARTTTGARVFGAMKGAVDGGLNIPHSVKRFPGYSAENKSFNAEVHRAHIFGQHVADYMRTLEEEDEEAYKRQFSKYVGLGIKADDIETIYKNAHAAIRKDPSFTKKPEKKVTKKRHNLAKLTLEARKAKIAKHKADYLAKIQADVEA

SEQ ID NO: 1895 - protein, 297 aa, Aedes aegypti
  misc_feature (26)..(173): Pfam Name: Ribosomal_L18p Pfam Description: Ribosomal L18p/L5e family
  misc_feature (1)..(297): Public GI ID no. 157105498
  misc_feature (1)..(297): Bit score of 475.2 for HMM based on sequences of Figure 35
  misc_feature (1)..(297): Functional Homolog Of SEQ ID NO. 1812
MGFVKVVKNKQYFKRYQVRFRRRREGKTDYYARKRLIFQDKNKYNTPKYRLIVRLSNRDITCQIAYARIEGDRIVCAAYSHELPRYGVKVGLTNYAAAYCTGLLVARRILQKLRLDTLYTGCTDVTGEEYLVEPVDDGPGAFRCYLDVGLARTTTGARIFGAMKGAVDGGLNIPHSVKRFPGYSAENKSFNAEVHRAHIFGQHVADYMRTLEEEDEDAYKRQFSKYIALGIKADDIETIYKNAHAGIRKDPAFHKKPEKKVTKKRFNLAKLTLEARKAKIAKHKADFLAKIQADVEA

SEQ ID NO: 1896 - protein, 297 aa, Sus scrofa
  misc_feature (26)..(173): Pfam Name: Ribosomal_L18p Pfam Description: Ribosomal L18p/L5e family
  misc_feature (1)..(297): Public GI ID no. 166796061
  misc_feature (1)..(297): Bit score of 466.0 for HMM based on sequences of Figure 35
  misc_feature (1)..(297): Functional Homolog Of SEQ ID NO. 1812
MGFVKVVKNKAYFKRYQVKFRRRREGKTDYYARKRLVIQDKNKYNTPKYRMIVRVTNRDIICQIAYARIEGDMIVCAAYAHELPKYGVKVGLTNYAAAYCTGLLLARRLLNRFGMDKIYEGQVEVTGDEYNVESIDGQPGAFTCYLDAGLTRTTTGNKVFGALKGAVDGGLSIPHSTKRFPGYDSESKEFNAEVHRKHILGQNVADYMRYLIEEDEDAYKKQFSQYIKNNVTPDMMEEMYKKAHAAIRENPVYEKKPKKEVKKKRWNRPKMSLAQKKDRVAQKKASFLRAQERAAES

SEQ ID NO: 1897 - protein, 297 aa, Bos taurus
  misc_feature (26)..(173): Pfam Name: Ribosomal_L18p Pfam Description: Ribosomal L18p/L5e family
  misc_feature (1)..(297): Public GI ID no. 108862056
  misc_feature (1)..(297): Bit score of 464.6 for HMM based on sequences of Figure 35
  misc_feature (1)..(297): Functional Homolog Of SEQ ID NO. 1812
MGFVKVVKNKAYFKRYQVKFRRRREGKTDYYARKRLVIQDKNKYNTPKYRMIVRVTNRDIICQIAYARIEGDMIVCAAYAHELPKYGVKVGLTNYAAAYCTGLLLARRLLNRFGMDKIYEGQVEVTGDEYNVESIDGQPGAFTCYLDAGLARTTTGNKVFGALKGAVDGGLSIPHSTKRFPGYDSESKEFSAEVHRKHIMGQNVADYMRYLIEEDEDAYKKQFSQYIKNNVTPDMMEEMYKKAHAAIRENPVYEKKPKKEVKKKRWNRPKMSLAQKKDRVAQKKASFLRAQERAAES

SEQ ID NO: 1898 - protein, 406 aa, Pan troglodytes
  misc_feature (135)..(282): Pfam Name: Ribosomal_L18p Pfam Description: Ribosomal L18p/L5e family
  misc_feature (1)..(406): Public GI ID no. 114557920
  misc_feature (1)..(406): Bit score of 461.9 for HMM based on sequences of Figure 35
  misc_feature (1)..(406): Functional Homolog Of SEQ ID NO. 1812
MPTLLALEPEQQKRGRNVKRLVADALSLPHVTGVTVRATYCACARAVALFPPPSAAGPAGLCRAADASLCSAGWCSSQRGLKWLPPGARTLGEGLAKKGCVSLDGGLGRRGFVKVVKNKAYFKRYQVKFRRRREGKTDYYARKRLVIQDKNKYNTPKYRMIVRVTNRDIICQIAYARIEGDMIVCAAYAHELPKYGVKVGLTNYAAAYCTGLLLARRLLNRFGMDKIYEGQVEVTGDEYNVESIDGQPGAFTCYLDAGLARTTTGNKVFGALKGAVDGGLSIPHSTKRFPGYDSESKEFNAEVHRKHIMGQNVADYMRYLMEEDEDAYKKQFSQYIKNSVTPDMMEEMYKKAHAAIRENPVYEKKPKKEVKKKRWNRPKMSLAQKKDRVAQKKASFLRAQERAAES

SEQ ID NO: 1899 - protein, 297 aa, Macaca fascicularis
  misc_feature (26)..(173): Pfam Name: Ribosomal_L18p Pfam Description: Ribosomal L18p/L5e family
  misc_feature (1)..(297): Public GI ID no. 75076080
  misc_feature (1)..(297): Bit score of 464.3 for HMM based on sequences of Figure 35
  misc_feature (1)..(297): Functional Homolog Of SEQ ID NO. 1812
MGFVKVVKNKAYFKRYQVKFRRRREGKTDYYARKRLVIQDKNKYNTPKYRMIVRVTNRDIICQIAYARIEGDMIVCAAYAHKLPKYGVKVGLTNYAAAYCTGLLLARRLLNRFGMDKIYEGQVEVTGDEYNVESIDGQPGAFTCYLDAGLARTTTGNKVFGALKGAVDGGLSIPHSTKRFPGYDSESKEFNAEVHRKHIMGQNVADYMRYLMEEDEDAYKKQFSQYIKNSVTPDMMEEMYKKAHAAIRENPVYEKKPKKEVKKKRWNRPKMSLAQKKDRVAQKKASFLRAQERAAES

SEQ ID NO: 1900 - protein, 297 aa, Gallus gallus
  misc_feature (26)..(173): Pfam Name: Ribosomal_L18p Pfam Description: Ribosomal L18p/L5e family
  misc_feature (1)..(297): Public GI ID no. 45383023
  misc_feature (1)..(297): Bit score of 468.3 for HMM based on sequences of Figure 35
  misc_feature (1)..(297): Functional Homolog Of SEQ ID NO. 1812
MGFVKVVKNKAYFKRYQVKFRRRREGKTDYYARKRLVIQDKNKYNTPKYRMIVRVTNRDIICQIAYARIEGDMIVCAAYAHELPKYGVKVGLTNYAAAYCTGLLLARRLLNKFGLDKIYEGQVEVTGDEYNVESVDGKPGAFTCYLDAGLARTTTGNKVFGALKGAVDGGLSIPHSTKRFPGYDSESKEFNAEVHRKHIMGQNVADYMRYLMEEDEDAYKKQFSQYIKNNITPDGMEEMYKKAHAAIRDNPVHEKKPKREVKKKRVNSTKMSLAQKKDRVAQKKASFLRAQERAADS

SEQ ID NO: 1901 - protein, 297 aa, Canis familiaris [sequence omitted]

SEQ ID NO: 1902 - protein, 357 aa, Ornithorhynchus anatinus
  misc_feature (86)..(233): Pfam Name: Ribosomal_L18p Pfam Description: Ribosomal L18p/L5e family
  misc_feature (1)..(357): Public GI ID no. 149626807
  misc_feature (1)..(357): Bit score of 460.4 for HMM based on sequences of Figure 35
  misc_feature (1)..(357): Functional Homolog Of SEQ ID NO. 1812
MVSDPPPRPLPDGRATPRPPRHGVRRPAGGSSGTDGAGLRERRAGGHRRGLMAAGGGDRPRGFVKVVKNKAYFKRYQVKFRRRREGKTDYYARKRLVIQDKNKYNTPKYRMIVRVTNRDIICQIAYARIEGDMIVCAAYAHELPKYGVKVGLTNYAAAYCTGLLLARRLLNRFGMDKIYEGQVEVTGDEYNVESIDGKPGAFTCYLDAGLARTTTGNKVFGALKGAVDGGLSIPHSTKRFPGYDSESKEFNAEVHRKHIMGQNVAEYMRYLMEEDEDAYKKQFSQYIKNNVNPDMMEEMYKKAHAGIRENPVYEKKPKKEVKKKRWNRPKMSLAQKKDRVAQKKASFLRAQERAADS

SEQ ID NO: 1903 - protein, 269 aa, Argopecten irradians
  misc_feature (26)..(173): Pfam Name: Ribosomal_L18p Pfam Description: Ribosomal L18p/L5e family
  misc_feature (1)..(269): Public GI ID no. 22758888
  misc_feature (1)..(269): Bit score of 429.5 for HMM based on sequences of Figure 35
  misc_feature (1)..(269): Functional Homolog Of SEQ ID NO. 1812
MGFVKVVKNKAYFKRFQVKFRRRREGKTDFYARKRLVIQEKNKYNTPKYRLIVRFTNKDIICQIAYARIEGDHIICSAYAHELPRYGVKVGLTNYSAAYCTGLLLARRLLKQFKLDSVYAGQEEVDGDEYYVEDVDGEAGAFRCYLDAGLVRTSTGARVFGALKGAVDGGLDIPHSTKRFPGYDGESNEFNAEVHRNHIFGKHVAGYMAHLQEEDEEAYKRQFSRFIKNGLNSENLEEMYKKGHAAIRANPERATKTKKAPAGKVKRWN

SEQ ID NO: 1904 - protein, 307 aa, Monodelphis domestica
  misc_feature (36)..(183): Pfam Name: Ribosomal_L18p Pfam Description: Ribosomal L18p/L5e family
  misc_feature (1)..(307): Public GI ID no. 126305867
  misc_feature (1)..(307): Bit score of 460.3 for HMM based on sequences of Figure 35
  misc_feature (1)..(307): Functional Homolog Of SEQ ID NO. 1812
MEKPGIAVAVQGFVKVVKNKAYFKRYQVKFRRRREGKTDYYARKRLVIQDKNKYNTPKYRMIVRVTNRDIICQIAYARIEGDMIVCAAYAHELPKYGVKVGLTNYAAAYCTGLLLARRLLNRFGMDKIYEGQVEVTGDEYNVESIDGQPGAFTCYLDAGLARTTTGNKVFGALKGAVDGGLSIPHSTKRFPGYDSESKEFNAEVHRKHIMGQNVADYMRYLMEEDEDAYKKQFSQYIKNNITPDMMEEMYKKAHAGIRENPVYEKKPKREVKKKRWNRPKMSLAQKKDRVAQKKASFLRAQERAADS

SEQ ID NO: 1905 - protein, 297 aa, Rattus norvegicus
  misc_feature (26)..(173): Pfam Name: Ribosomal_L18p Pfam Description: Ribosomal L18p/L5e family
  misc_feature (1)..(297): Public GI ID no. 13592051
  misc_feature (1)..(297): Bit score of 462.9 for HMM based on sequences of Figure 35
  misc_feature (1)..(297): Functional Homolog Of SEQ ID NO. 1812
MGFVKVVKNKAYFKRYQVRFRRRREGKTDYYARKRLVIQDKNKYNTPKYRMIVRVTNRDIICQIAYARIEGDMIVCAAYAHELPKYGVKVGLTNYAAAYCTGLLLARRLLNRFGMDKIYEGQVEVNGDEYNVESIDGQPGAFTCYLDAGLARTTTGNKVFGALKGAVDGGLSIPHSTKRFPGYDSESKEFNAEVHRKHIMGQNVADYMRYLMEEDEDAYKKQFSQYIKNNVTPDMMEEMYKKAHAAIRENPVYEKKPKREVKKKRWNRPKMSLAQKKDRVAQKKASFLRAQERAAES

SEQ ID NO: 1906 - protein, 300 aa, Toxoptera citricida
  misc_feature (26)..(173): Pfam Name: Ribosomal_L18p Pfam Description: Ribosomal L18p/L5e family
  misc_feature (1)..(300): Public GI ID no. 74845700
  misc_feature (1)..(300): Bit score of 472.7 for HMM based on sequences of Figure 35
  misc_feature (1)..(300): Functional Homolog Of SEQ ID NO. 1812
MGFVKVVKNKQYFKRYQVKFKRRREGKTDYYARKRLIVQDKNKYDTPKYRLIVRFSNRDITCQVAHSRIEGDKIVCAAYSHELPKYGVKVGLTNYAAAYCTGLLVARRLLKKLGLDRLYEGLKEANGEEYYVEPADEGPNAFRCNLDVGLMKTSTGARVFGAMKGAVDGGFNIPHSVKRFPGYDAEAKEYSAETHRKHILGLHVAEYMRKLEEEDEDAFNRQFSQYIKLGIVADDLENMYKKAHENIRSDPKRDRKPKKDVSKEPKRWNAKKLTNAERKQRVVEAKAAYLKELQGEEMES

SEQ ID NO: 1907 - protein, 300 aa, Lethenteron japonicum
  misc_feature (27)..(174): Pfam Name: Ribosomal_L18p Pfam Description: Ribosomal L18p/L5e family
  misc_feature (1)..(300): Public GI ID no. 90991371
  misc_feature (1)..(300): Bit score of 461.4 for HMM based on sequences of Figure 35
  misc_feature (1)..(300): Functional Homolog Of SEQ ID NO. 1812
MKGFIKTVKSKAYFKRYQVKFKRRREGKTDYFARKRLIVQDKNKYNTPKYRLIVRLTNRDVICQVAYAKIEGDVMVCAAYSHELSKYGITVGLTNYAAAYCTGLLLARRLLAKLGLDKVYEGQTDVTGDEFNVESVDGQPGAFTCYLDAGLTRTTTGNKVFGALKGAVDGGLSIPHSTKRFPGYDSESKEFNADVHRKHILGVNVADYMRSLMENDEDAYKRQFSRYIKGGVVPDMVEGLFKKAHETIRENPVHEKKPKKEVTKKPKRWNRAKLSLAQRKNRVAQKKASFLRAQASEPAE

SEQ ID NO: 1908 - protein, 300 aa, Acyrthosiphon pisum
  misc_feature (26)..(173): Pfam Name: Ribosomal_L18p Pfam Description: Ribosomal L18p/L5e family
  misc_feature (1)..(300): Public GI ID no. 193627230
  misc_feature (1)..(300): Bit score of 473.8 for HMM based on sequences of Figure 35
  misc_feature (1)..(300): Functional Homolog Of SEQ ID NO. 1812
MGFVKVVKNKQYFKRYQVKFKRRREGKTDYYARKRLIVQDKNKYDTPKYRLIVRFSNRDITCQVAHSRIEGDKIVCAAYSHELPKYGIKVGLTNYAAAYCTGLLVARRLLKKLGLDRLYEGLKEANGEEYYVEPADEGPNAFRCNLDVGLMKTSTGARVFGAMKGAVDGGFNIPHSVKRFPGYDAEAKEYSAETHRKHILGLHVAEYMRKLEEEDEDSYNRQFSQYIKLGIVADDLENMYKKAHENIRSDPKRDRKPKKEVSKEPKRWNAKKLTNAERKQRVVDAKAAYLKELQGEEMES

SEQ ID NO: 1909 - protein, 297 aa, Mus musculus
  misc_feature (26)..(173): Pfam Name: Ribosomal_L18p Pfam Description: Ribosomal L18p/L5e family
  misc_feature (1)..(297): Public GI ID no. 23956082
  misc_feature (1)..(297): Bit score of 461.6 for HMM based on sequences of Figure 35
  misc_feature (1)..(297): Functional Homolog Of SEQ ID NO. 1812
MGFVKVVKNKAYFKRYQVRFRRRREGKTDYYARKRLVIQDKNKYNTPKYRMIVRVTNRDIICQIAYARIEGDMIVCAAYAHELPKYGVKVGLTNYAAAYCTGLLLARRLLNRFGMDKIYEGQVEVNGGEYNVESIDGQPGAFTCYLDAGLARTTTGNKVFGALKGAVDGGLSIPHSTKRFPGYDSESKEFNAEVHRKHIMGQNVADYMRYLMEEDEDAYKKQFSQYIKNNVTPDMMEEMYKKAHAAIRENPVYEKKPKREVKKKRWNRPKMSLAQKKDRVAQKKASFLRAQERAAES

SEQ ID NO: 1910 - protein, 300 aa, Aspergillus clavatus NRRL 1
  misc_feature (26)..(176): Pfam Name: Ribosomal_L18p Pfam Description: Ribosomal L18p/L5e family
  misc_feature (1)..(300): Public GI ID no. 121701409
  misc_feature (1)..(300): Bit score of 435.0 for HMM based on sequences of Figure 35
  misc_feature (1)..(300): Functional Homolog Of SEQ ID NO. 1812
MPFHKQVKNSAYYSRYQTKYRRRREGKTDYYARKRLITQAKNKYNAPKYRLVVRFTNRDIITQIVYSEISGDKVFASAYSHELKRYGITQGLTNWAAAYATGLLLARRTLKKLGLDEQFAGVEEADGEYKLTEAVETDDGTRRPFKAFLDVGLVRTSTGARVFGAMKGASDGGIFIPHSENRFPGFDIESEELDAETLRNYIFGGHVSEYMETLADDDEERYRSQFIKYIESEIDAGDIEELYTEAHAAIREDPFKKDEDEGAKKTKEEWKAESKKYQKAKLTHAERKARVEQKIRELAA

SEQ ID NO: 1911 - protein, 297 aa, Taeniopygia guttata
  misc_feature (26)..(173): Pfam Name: Ribosomal_L18p Pfam Description: Ribosomal L18p/L5e family
  misc_feature (1)..(297): Public GI ID no. 197128747
  misc_feature (1)..(297): Bit score of 456.2 for HMM based on sequences of Figure 35
  misc_feature (1)..(297): Functional Homolog Of SEQ ID NO. 1812
  misc_feature (188)..(188): Xaa is any aa, unknown, or other
MGFVKVVKNKAYFKRYQVKFRRRREGKTDYYARKRLVIQDKNKYNTPKYRMIVRVTNRDIICQIAYARIEGDMIVCAAYAHELPKYGVKVGLTNYAAAYCTGLLLARRLLNKFGLDKIYEGQVEVTGDEYNVESVDGKPGAFTCYLDAGLARTTTGNKVLGALKGAVDGGLSIPHSTKRFPGYDSESXEFNAEVHRKHIMRQNVADYMRYLMEEDEDAYKKQFSQYIKNNVTPDGMEEMYKKAHAAIRDNPVHEKKPKRDVKKKRWNCPKMSLAQKKDRVAQKKASFLRAQERRTES

SEQ ID NO: 1912 - protein, 300 aa, Barentsia elongata
  misc_feature (26)..(173): Pfam Name: Ribosomal_L18p Pfam Description: Ribosomal L18p/L5e family
  misc_feature (1)..(300): Public GI ID no. 159145700
  misc_feature (1)..(300): Bit score of 458.0 for HMM based on sequences of Figure 35
  misc_feature (1)..(300): Functional Homolog Of SEQ ID NO. 1812
MGFVKVVKNKAYFKRYQVKFKRRRQGLTDYFARKRLVIQDRNKYNTPKYRLIVRFTNKDVVCQIAYAKIEGDQIMCAAYSHELPRYGVKVGLTNYAAAYCTGLLVARRMLQKLKLDTVYQGVDEVTGDDYYVEDVDDGPGAFRCYLDVGLARTTTGARVFGAMKGAVDGGLNIPYSNKRFPGFDTESGEFSADVHRQHIFGQHVAGYMRSLEDEDEDAFKKQFSKYIDAGIAADGVEAMYKNCHAAIRADPAAKATKDKTKGKRFNRSKMSKAQREDRVKQKKASFLRAQEDIRHARTLN

SEQ ID NO: 1913 - protein, 297 aa, Callithrix jacchus
  misc_feature (26)..(173): Pfam Name: Ribosomal_L18p Pfam Description: Ribosomal L18p/L5e family
  misc_feature (1)..(297): Public GI ID no. 167206806
  misc_feature (1)..(297): Bit score of 456.6 for HMM based on sequences of Figure 35
  misc_feature (1)..(297): Functional Homolog Of SEQ ID NO. 1812
MGFVKVVKNKAYFKRYQVKFRRRREGKTDYYARKRLVIQDKNKYNTPKYRMIVRVTNRDIICQIAYARIEGDMIVCAAYAHELPKYGVKVGLTNCAAAYCTGLLLARRLLNRFGMDKIYEGQVEVTGDEYNVESIDDQPGAFTCYLDAGFARTTTGNKVFGALKGAVDGGLSIPHSTKRFPGYDSESKEFNAEVHRKHMMGQNVADYMRYLMEEDEDAYKKQFSQYIKNSITPDMMEEMYKKAHAAIRENPVYEKKPKKEVKKKRWNRPKMSLAQKTDRVAQKKASFLRAQERAAES

SEQ ID NO: 1914 - protein, 367 aa, Neosartorya fischeri NRRL 181
  misc_feature (93)..(243): Pfam Name: Ribosomal_L18p Pfam Description: Ribosomal L18p/L5e family
  misc_feature (1)..(367): Public GI ID no. 119495376
  misc_feature (1)..(367): Bit score of 428.6 for HMM based on sequences of Figure 35
  misc_feature (1)..(367): Functional Homolog Of SEQ ID NO. 1812
MVYRCCGVLSDFRCGCPPLVANLNLRWDAATLSETIHKVGPRNFQPLQSSSAANVDNSVFQIAATVKMPFHKLVKNSAYYSRYQTKYRRRREGKTDYYARKRLITQAKNKYNAPKYRLVVRFTNRDIITQIVYSEITGDKVFASAYSHELKRYGITQGLTNWAAAYATGLLLARRTLKKLGLDEQFTGVEEADGEYKLTEAVETDDGTRRPFKAFLDVGLVRTSTGARVFGAMKGASDGGIFIPHSENRFPGFDIESEELDAETLRNYIFGGHVSEYMETLADDDEERYRSQFAKYIENEIDAGDLEDIYAEAHKAIREDPFKKDEDEEPKKSKEEWKAESKKYRKTKLSHEERKARVEQKIRELAA

SEQ ID NO: 1915 - protein, 297 aa, Ashbya gossypii ATCC 10895
  misc_feature (26)..(173): Pfam Name: Ribosomal_L18p Pfam Description: Ribosomal L18p/L5e family
  misc_feature (1)..(297): Public GI ID no. 45185790
  misc_feature (1)..(297): Bit score of 446.0 for HMM based on sequences of Figure 35
  misc_feature (1)..(297): Functional Homolog Of SEQ ID NO. 1812
MAFIKSIKNSAYHSRFQTPFRRRREGKTDYYARKRLVTQHKAKYNTPKYRLVVRFTNKDIICQVVSSTITGDIVLAAAYSHELPRYGITHGLTNWSAAYATGLLIARRTLQKLGLDETYKGVEEPEGEYELTEAVEDGPRPFKVYLDIGLQRTTTGARVFGALKGASDGGLYVPHSENRFPGWDFESEELDADLLRTYIFGGHVSAYMEELADDDEERYSELFKGYIADGIEADAIEDIYTEAHAAIRADPSFKPTEKKFTKEQYAAESKKFRQVKLTKEERKARVAAKIAALAAQE

SEQ ID NO: 1916 - protein, 308 aa, Babesia bovis T2Bo
  misc_feature (26)..(173): Pfam Name: Ribosomal_L18p Pfam Description: Ribosomal L18p/L5e family
  misc_feature (1)..(308): Public GI ID no. 156089549
  misc_feature (1)..(308): Bit score of 445.6 for HMM based on sequences of Figure 35
  misc_feature (1)..(308): Functional Homolog Of SEQ ID NO. 1812
MAFIRVLKSKAYFKRFQVKYRRRREGKTDYYCRRRMVLQDKNKYASPKYRFVVRFTNKRIICQIISATIVGDKVHASADSTELKHYGVNVGLTNYAAAYCTGLLLARRLLTQLKLDNQFVGKEQADGTSFHIEEEDHDRRPFKALLDVGIKIVTTGNKVFGALKGACDGGLHIPHSEKRFPGFSVGDDKQTNYDAEVHRERIMGIHVANYMREMKEEDPEKYKSHFSAFLRAGINEDNIEEMYAKAHAAIRQNPIVPKTKKDPPSRTIKGHTVITADGKKYIRNKKITKAQRMERVRQKMLMCAQAEE

SEQ ID NO: 1917 - protein, 303 aa, Oikopleura dioica
  misc_feature (36)..(183): Pfam Name: Ribosomal_L18p Pfam Description: Ribosomal L18p/L5e family
  misc_feature (1)..(303): Public GI ID no. 74848092
  misc_feature (1)..(303): Bit score of 436.0 for HMM based on sequences of Figure 35
  misc_feature (1)..(303): Functional Homolog Of SEQ ID NO. 1812
MAKKGRGRSKGTFVAVLKNKAYFKRYQPKFKRRREGKTDYFARKRLCVQDKNKYNTPKYRLVVRVTNKDIIAQIAYARLQGDVIVTSAYAHELPRYGVSVGLTNYSAAYATGLLIGRRVLQKFGLDSMYEGQIEVDGDEFYEEADAAEKASFRCYLDTGLARTSTGARIFGVLKGCADAGIDIPHSPKRFPGFADGKLNAEAHKDHIFGGHVGDYMEKLEEENEEAYKRQFSRFIKNGINSENIEEMYKKAHAAIRADPSPKAKVEKTVDKKRWNRAKISYAQRRARVAQVKASFLRAQEAEE

SEQ ID NO: 1918 - protein, 306 aa, Theileria parva strain Muguga
  misc_feature (26)..(173): Pfam Name: Ribosomal_L18p Pfam Description: Ribosomal L18p/L5e family
  misc_feature (1)..(306): Public GI ID no. 71030018
  misc_feature (1)..(306): Bit score of 422.1 for HMM based on sequences of Figure 35
  misc_feature (1)..(306): Functional Homolog Of SEQ ID NO. 1812
MTFLRVVKNKAYFRRFQVKFRRRREGKTDYYARRRLVAQDKNKYDSPKYRLVVRLTNKRVICQIVSSTLVGDKVHASADSSELVHYGVKVGLTNYAAAYCTGLLLARRLLTKLKLDSQFVGKVEADGELYHVEEEDNERRPFKALLDVGIKNVTTGNRVFGALKGACDGGLHVPHSEKRFPGYSVDDENNGSYDAQAHRDRIFGTHVANYMEYLKEEDPEKYKRQFSAYLKLGLDSESLEDMYAKAHENIRKNPVLPTKPKRKLKHVREGSKVLTSKGSYVRNVKISKAQRRERVKQKISLLVNES

SEQ ID NO: 1919 - protein, 325 aa, Anopheles gambiae
  misc_feature (26)..(173): Pfam Name: Ribosomal_L18p Pfam Description: Ribosomal L18p/L5e family
  misc_feature (1)..(325): Public GI ID no. 152031669
  misc_feature (1)..(325): Bit score of 449.6 for HMM based on sequences of Figure 35
  misc_feature (1)..(325): Functional Homolog Of SEQ ID NO. 1812
MGFVKVVKNKQYFKRYQVRFRRRREGKTDYYARKRLIFQDKNKYNTPKFRLIVRLSNRDITCQIAYARIEGDRIVCAAYSHELPRYGVKVGLTNYAAAYCTGLLVARRILQKLRLDTLYAGCTDVTGEEYLVEPVDEGPAAFRCYLDVGLARTTTGARVFGAMKGAVDGGLNIPHSVKRFPGYSAENKSFNAEMHRDHIFGLHVANYMRTLEEEDEEAFKRQFSKYISLGIKADDIENIYKNAHASIRIPPSRRNPRRRSPRSGGRWPSCRSPPARRRSRSTRPTSWPRSRPTSKPKRPRRRRPFFFSSWWCIILVLPCSSPVRR

SEQ ID NO: 1920 - protein, 281 aa, Taenia solium
  misc_feature (8)..(154): Pfam Name: Ribosomal_L18p Pfam Description: Ribosomal L18p/L5e family
  misc_feature (1)..(281): Public GI ID no. 170783723
  misc_feature (1)..(281): Bit score of 407.5 for HMM based on sequences of Figure 35
  misc_feature (1)..(281): Functional Homolog Of SEQ ID NO. 1812
MFRWRREGKTDYYARKRLIWQDKNKYNTPKYRFVVRFTNKDIVCQIIYACMDGDRVMATAYSHELPRYGVKIGLTNYPAAYCTGLLLARRVLKKLKLDSMYQGQTEVNGENYLVESNDKRGAFKCFLDVGLRRTSSGANIFGALKGAVDGGLNIPHSSKRFPGNDSESGEYNAEAHRARIFGQHIAEYMRSLKEESDEAYKRQFGVYLRLGIEADDIEPMYQKAHAAIRQDPSYTKKERPEVKHRRFNRKKLTLKERRERVRQKKAHYLSQLQKDLAVVGA

SEQ ID NO: 1921 - protein, 300 aa, Aspergillus fumigatus
  misc_feature (26)..(176): Pfam Name: Ribosomal_L18p Pfam Description: Ribosomal L18p/L5e family
  misc_feature (1)..(300): Public GI ID no. 19577350
  misc_feature (1)..(300): Bit score of 420.8 for HMM based on sequences of Figure 35
  misc_feature (1)..(300): Functional Homolog Of SEQ ID NO. 1812
MPFHKLVKNSAYYSRYQTKYRRRREGKTDYYARKRLITQAKNKYNAPKYRLVVRFTNRDIITQIVYSEITGDKVFASAYSHELKRYGITQGLTNWAAAYATGLLLARRTLKKLGLDEQFTGVEEPDGEYKLTEAVETDDGTRRPFKAFLDVGLVRTSTGARVFGAMKGASDGGIFIPHSENRFPGYDIESEELDAETLRNYIFGGHVSEYMETLADDDEERYRSQFAKYIENEIDAGDLEEIYAEAHKAIREDPFKKDEDEKPKKSKEEWKAESKKYKKAKLSREEKKARVEQKIRELAA

SEQ ID NO: 1922 - protein, 296 aa, Myxine glutinosa
  misc_feature (26)..(173): Pfam Name: Ribosomal_L18p Pfam Description: Ribosomal L18p/L5e family
  misc_feature (1)..(296): Public GI ID no. 5007074
  misc_feature (1)..(296): Bit score of 429.8 for HMM based on sequences of Figure 35
  misc_feature (1)..(296): Functional Homolog Of SEQ ID NO. 1812
MGFVKVVKNRAYFRRYQVKFKRRREGKTDYYARKRLVIQDKNKYNTPKYRLIVRITNKDIICQLAYAKIEGDVIVCASYSHELPKYGIPVGLTNYAAAYCSGLLVARRVLRKFGIDRVYEGQPEVTGDEFNVESVERGPGAFTCYLDTGLARTTTGNKVFGVLKGAVDGGLSIPHSTRRFPGYDSESKEFNPDIHRQHIFGTNISNYMKQLLEDDEDLYKKQFSRYIKHAITPDMLESMYENAHARIRKNPIRKKKPKWTGKCKRWNRAKLSLAQRNDRVAQKKASYLRAKQQQAT

SEQ ID NO: 1923 - protein, 300 aa, Aspergillus niger CBS 513.88
  misc_feature (26)..(176): Pfam Name: Ribosomal_L18p Pfam Description: Ribosomal L18p/L5e family
  misc_feature (1)..(300): Public GI ID no. 145240087
  misc_feature (1)..(300): Bit score of 423.2 for HMM based on sequences of Figure 35
  misc_feature (1)..(300): Functional Homolog Of SEQ ID NO. 1812
MPFHKLVKNSAYYSRYQTKYRRRREGKTDYYARKRLITQAKNKYNAPKYRLVVRFTNRDIITQIVYSEISGDKVFASAYSHELKRYGITNGLTNWAAAYATGLLLARRTLKKLGLDEQFPGVEEADGEYTLTEAAETDEGSRRPFKAFLDVGLARTSTGARVFGAMKGASDGGIFVPHSESRFPGFDIESEELDAETLRNYIFGGHVAEYMEGLADDDEERFTSQFHKYQEAGIEAGDIEELYTEAHKAIREDPFKKDEDAGEKKTKEEWKAESKKFRQQRLTREQRKERVEQKIRELAA

SEQ ID NO: 1924 - protein, 297 aa, Candida glabrata CBS138
  misc_feature (26)..(173): Pfam Name: Ribosomal_L18p Pfam Description: Ribosomal L18p/L5e family
  misc_feature (1)..(297): Public GI ID no. 50294105
  misc_feature (1)..(297): Bit score of 434.1 for HMM based on sequences of Figure 35
  misc_feature (1)..(297): Functional Homolog Of SEQ ID NO. 1812
MVFIQNLKTSAYHSRFQTPFRRRREGKTDYYQRKRLVAQHKAKYNSPKYRLVVRFTNKDIICQIVSSTITGDIVLAAAYSHELPRYGITHGLTNWAAAYATGLLIARRALQKLGLDETYKGVEEVEGEYELTEAVEDGPRPFKVYLDIGLQRTTTGARVFGALKGASDGGLYVPHSENRFPGWDFEAEELDAELLRSYIFGGHVSQYMEELADDDEERFSELFKGYLADDIDADSIEDIYASAHEAIRADPSFKPTEKKFTKEQYAAESKKYKAKKLTKEERDARVAAKIAALAGQQ

SEQ ID NO: 1925 - protein, 306 aa, Theileria annulata strain Ankara
  misc_feature (26)..(173): Pfam Name: Ribosomal_L18p Pfam Description: Ribosomal L18p/L5e family
  misc_feature (1)..(306): Public GI ID no. 84995804
  misc_feature (1)..(306): Bit score of 418.3 for HMM based on sequences of Figure 35
  misc_feature (1)..(306): Functional Homolog Of SEQ ID NO. 1812
MTFLRVVKNKAYFRRFQVKFRRRREGKTDYYARRRLVAQDKNKYDSPKYRLVVRLTNKRVICQIVSSTLVGDKVHASADSSELVHYGVKVGLTNYAAAYCTGLLLARRLLTKLKLDSQFVGKVEADGELYHVEEDDNERRPFKALLDVGIKNVTTGNRVFGALKGACDGGLHVPHSEKRFPGYSVDDENNGTYDAQAHRDRIFGTHVANYMEYLKEEDPEKYKKQFSAYLKLGLDSESLEDMYASAHENIRKNPVLPTKPKRKLKHVREGSKVLTSKGSYVRNVKITKAQRRERVKQKISLLVNES

SEQ ID NO: 1926 - protein, 297 aa, Kluyveromyces lactis NRRL Y-1140
  misc_feature (26)..(173): Pfam Name: Ribosomal_L18p Pfam Description: Ribosomal L18p/L5e family
  misc_feature (1)..(297): Public GI ID no. 50306789
  misc_feature (1)..(297): Bit score of 435.5 for HMM based on sequences of Figure 35
  misc_feature (1)..(297): Functional Homolog Of SEQ ID NO. 1812
MAFIKDIKTSAYHSRYQTPFRRRREGKTDYYARKRLVAQHKAKYNTPKYRLVVRFTNKDIITQIVSSTITGDIVLAAAYSHELPRYGITHGLTNWSAAYATGLLLARRTLQKLGLDETYPGVEEVEGEYELTEAVEDGPRPFKVYLDVGLQRTTTGARIFGALKGASDGGLYVPHSENRFPGWDFEAEELDADLLRTYIFGGHVSQYMEELADDDEERYRELFKGYLADDIDADAVEDIYADAHAAIREDPAFKPTEKKFTKEQYAAESKKYRQVKLTREERKARVAAKISALAPQE

SEQ ID NO: 1927 - protein, 302 aa, Coprinopsis cinerea okayama7#130
  misc_feature (26)..(175): Pfam Name: Ribosomal_L18p Pfam Description: Ribosomal L18p/L5e family
  misc_feature (1)..(302): Public GI ID no. 169861151
  misc_feature (1)..(302): Bit score of 455.1 for HMM based on sequences of Figure 35
  misc_feature (1)..(302): Functional Homolog Of SEQ ID NO. 1812
MPFVKKQKTDAYFSRFQVKFRRRREGKTDYYARKRLVTQAKNKYNAPKYRLVVRLTNKDIIVQVVYARIQGDFILTQAHSRELPRYGIKHGLTNWAAAYATGLLAARRALTKLGLADKYEGVTEPDGTLQITEALDDDDAPRPFKAFLDVGLRRTSTGARVFGAMKGASDGGIYIPHSEKRFPGYDPESKSLDAEVLQKYIYGGHVAEYMESLEEEDDERFKKQFASYLADDIGSDDIEDIYKNAHAAIRADPTFKPTTKTKDWKAESLKYKVPRLTLEQRKERIAEKIAKFQAGGFDEDDE

SEQ ID NO: 1928 - protein, 300 aa, Aspergillus oryzae RIB40
  misc_feature (26)..(176): Pfam Name: Ribosomal_L18p Pfam Description: Ribosomal L18p/L5e family
  misc_feature (1)..(300): Public GI ID no. 169763400
  misc_feature (1)..(300): Bit score of 414.2 for HMM based on sequences of Figure 35
  misc_feature (1)..(300): Functional Homolog Of SEQ ID NO. 1812
MPFHKQVKNSAYYSRYQTKYRRRREGKTDYYARKRLITQAKNKYNAPKYRLVVRFTNRDIITQIVYSEISGDKVFASAYAHELKRYGITNGLTNWAAAYATGLLLARRTLKKLGIDEQFPGVEEADGEYSLTEAVETDDGERRPFKAFLDVGLARTSTGARVFAAMKGASDGGILVPHSENRFPGYDIETEELDAETLRNYIFGGHVAEYMEGLADDDEERYRGQFHKYLENEVEAGDIEDLYTEAHKAIREDPFKKDEDEGSKKTKEEWKAESKKFQKKKLTHAERKARVEQKIRELAA

SEQ ID NO: 1929 - protein, 301 aa, Gibberella zeae PH-1
  misc_feature (25)..(175): Pfam Name: Ribosomal_L18p Pfam Description: Ribosomal L18p/L5e family
  misc_feature (1)..(301): Public GI ID no. 46136989
  misc_feature (1)..(301): Bit score of 409.5 for HMM based on sequences of Figure 35
  misc_feature (1)..(301): Functional Homolog Of SEQ ID NO. 1812
MPFKLVKNSAYYSRYQTKYKRRQQGKTDYYARKRLITQAKNKYNAPKYRLVVRFTNKDIICQIVTSEISGDKVFISAYAHELKAYGIEHGLTNWAAAYATGLLVARRALKKLGLDEDFAGVEEADGEYKLTEAAETDDGERRPFKVFLDVGLKRTSTGARVFGAMKGASDGGILVPHSEKRFPGYDMETKELDADTLRNYIFGGHVAEYMETLADDDEERFRSQFQKYVDDDVEAEGLEDLYTEAHAAIREDPFKKVESDAPKKTKEEWKEISQKYKSKKLTKEEKEKRVQERIQEIMQRD

SEQ ID NO: 1930 - protein, 301 aa, Aspergillus nidulans FGSC A4
  misc_feature (27)..(177): Pfam Name: Ribosomal_L18p Pfam Description: Ribosomal L18p/L5e family
  misc_feature (1)..(301): Public GI ID no. 67517624
  misc_feature (1)..(301): Bit score of 416.4 for HMM based on sequences of Figure 35
  misc_feature (1)..(301): Functional Homolog Of SEQ ID NO. 1812
MAPYSKTVKSSAYYSRYQTKYRRRREGKTDYYARKRLITQAKNKYNAPKYRLVVRFTNRDIVTQIVYSEITGDKVFASAYSHELKRYGITNGLTNWAAAYATGLLLARRTLKKLGLDEDFTGVEEPDGEFSLTEAAETEEGTRRPFKAFLDVGLARTSTGARVFGAMKGASDGGIFIPHSESRFPGYDIEAEELDAETLRSYIFGGHVAEYMEGLADDDEERFRGQFHKYTENEIDAGDIEELYAEAHKAIRADPFKKDESEGPKKTKEEWKAESKKYRKTKLSHEEKKARVEAKIRELAA

SEQ ID NO: 1931 - protein, 295 aa, Botryotinia fuckeliana B05.10
  misc_feature (26)..(174): Pfam Name: Ribosomal_L18p Pfam Description: Ribosomal L18p/L5e family
  misc_feature (1)..(295): Public GI ID no. 154294907
  misc_feature (1)..(295): Bit score of 422.4 for HMM based on sequences of Figure 35
  misc_feature (1)..(295): Functional Homolog Of SEQ ID NO. 1812
MPFTKLVKNSAYYSRYQTKYKRRRSGKTDYYARKRLITQAKNKYNAPKYRLVVRFTNRDIVMQIVTSEITGDKVFCAAYSHELKAYGIEHGLTNWAAAYCTGLLIARRVLKKLGMDKDFTGVEEADGEYQLTEAAGDEERRPFKAFLDVGLHRTSTGARIFGAMKGASDGGILVPHSENRFPGYDMESKELDAETLRKYIFGGHVAEYMETLADDDEERYKSQFQGYIDDEIEADGLEELYQEAHKAIREDPFKKAEGEKKSKDEYKQESLKFKGRKLTKDEKRERVKAKIAELK

SEQ ID NO: 1932 - protein, 296 aa, Sclerotinia sclerotiorum 1980
  misc_feature (26)..(174): Pfam Name: Ribosomal_L18p Pfam Description: Ribosomal L18p/L5e family
  misc_feature (1)..(296): Public GI ID no. 156044424
  misc_feature (1)..(296): Bit score of 424.6 for HMM based on sequences of Figure 35
  misc_feature (1)..(296): Functional Homolog Of SEQ ID NO. 1812
MPFTKLVKNSAYYSRYQTKYKRRRSGKTDYYARKRLITQAKNKYNAPKYRLVVRFTNRDIVMQIVTSEITGDKVFCAAYSHELKAYGIEHGLTNWAAAYCTGLLIARRVLKKLGMDKDFTGVEEADGEYQLTEAAGDEERRPFKAFLDVGLHRTSTGARIFGAMKGASDGGILVPHSENRFPGYDMETKELDAETLRKYIFGGHVAEYMETLADDDEERYKSQFQGYIDDEIEADGLEELYQEAHKAIREDPFKKVDGEKKSKDEYKQESLKYKGRKLTKDEKRERVKAKIAELRE

SEQ ID NO: 1933 - protein, 301 aa, Neurospora crassa N150
  misc_feature (26)..(176): Pfam Name: Ribosomal_L18p Pfam Description: Ribosomal L18p/L5e family
  misc_feature (1)..(301): Public GI ID no. 85098188
  misc_feature (1)..(301): Bit score of 442.0 for HMM based on sequences of Figure 35
  misc_feature (1)..(301): Functional Homolog Of SEQ ID NO. 1812
MAFHKLVKNSAYYSRFQTKYKRRREGKTDYYARKRLITQAKNKYNAPKYRLVVRFTNRDIILQIVSSEITGDKVFASAYSHELKAYGIEHGLTNWAAAYATGLLLARRVLKKLGLDETFKGVEEADGEYKLTEAAETDDGERRPFKAFLDVGLARTSTGARVFGAMKGASDGGIFIPHSENRFPGYDMESEELDAETLKKYIFGGHVAEYMETLADDDEERYKSQFNRYIEDDLEADGLEDLYAEAHAAIREDPFKKAESEAPKKTKEEWKAESLKYKKSKLTREQRAAGVQERIAALRSE

SEQ ID NO: 1934 - protein, 295 aa, Brugia malayi
  misc_feature (26)..(172): Pfam Name: Ribosomal_L18p Pfam Description: Ribosomal L18p/L5e family
  misc_feature (1)..(295): Public GI ID no. 170586178
  misc_feature (1)..(295): Bit score of 416.7 for HMM based on sequences of Figure 35
  misc_feature (1)..(295): Functional Homolog Of SEQ ID NO. 1812
MGFVKVVKNKAYFKRYQVKLKRRREGKTDYYARKRLTVQDKNKYNTPKYRLIVRFTNRDVIAQIAYSRIEGDVVVCSAYSHELPRYGIKVGLTNYASAYATGLLLARRHLLNIGLAEAYKGVEEATGDDYNVEKEGERAPFRAVLDVGLARTVTGAKVFAVMKGVADGGIDVPHSETRFFGYNSETKYNAEAHRDRILGKHVADYMALLKEQDEDAYKQHFSRFIAANISADDIVDMYKKAHEAIRKNPAREPKEPKEVTKKRWTAKKGSLAVRKNRVKNKKAYLKMLKAQQEAQ

SEQ ID NO: 1935 - protein, 301 aa, Podospora anserina DSM 980
  misc_feature (26)..(176): Pfam Name: Ribosomal_L18p Pfam Description: Ribosomal L18p/L5e family
  misc_feature (1)..(301): Public GI ID no. 171694355
  misc_feature (1)..(301): Bit score of 432.3 for HMM based on sequences of Figure 35
  misc_feature (1)..(301): Functional Homolog Of SEQ ID NO. 1812
MAFHKLVKNSAYYSRFQTKYKRRREGKTDYYARKRLITQAKNKYNAPKYRLVVRFSNRDIITQIVTSEITGDKIFAAAYSHELRAYGIEHGLTNWAAAYATGLLLARRVLKKLGLDEQFAGVEEADGEYTLTEATETDDGERRPFKAFLDVGLSRTSTGARVFGVMKGASDGGILVPHSENRFPGFDMESEELDAETLKKYIFGGHVAEYMETLADDDEERYKGQFVKYIEDDLEADSLEDLYAEAHKAIREDPFKKYESDAPKKTKEEWKAESKKYRQSKLTHEQRKAGVQERIAALLQE

SEQ ID NO: 1936 - protein, 304 aa, Ustilago maydis 521
  misc_feature (32)..(180): Pfam Name: Ribosomal_L18p Pfam Description: Ribosomal L18p/L5e family
  misc_feature (1)..(304): Public GI ID no. 71021101
  misc_feature (1)..(304): Bit score of 427.3 for HMM based on sequences of Figure 35
  misc_feature (1)..(304): Functional Homolog Of SEQ ID NO. 1812
MIFAIKQPFVKTVKSNSYFSRYQVKYRRRREGRTDYYARKRLVSQAKNKYNAPKYRLVVRFSNRYVTCQIVHAKIVGDFVLTQASSKELPRYGVKTGLSNWTAAYATGLLVARRALTLLGLADKYEGVTEPDGEMAEVEPLGDDEPRPFKCFLDVGLKRTSTGSRVFGALKGASDGGIFIPHSEKRFPGFDPEAKELDAELLRSYIYGGHVAEYMESLEEEDDERFKKQFSTALEQDIGSEDLEDMWTEAFEKIREDPSFTPSDKSGKDWAAESKKYKATKLTYEQRKAKIADKIAAFKAGAEL

SEQ ID NO: 1937 - protein, 249 aa, Phoronis muelleri
  misc_feature (26)..(173): Pfam Name: Ribosomal_L18p Pfam Description: Ribosomal L18p/L5e family
  misc_feature (1)..(249): Public GI ID no. 188572500
  misc_feature (1)..(249): Bit score of 381.8 for HMM based on sequences of Figure 35
  misc_feature (1)..(249): Functional Homolog Of SEQ ID NO. 1812
  misc_feature (202)..(202): Xaa is any aa, unknown, or other
  misc_feature (203)..(203): Xaa is any aa, unknown, or other
  misc_feature (204)..(204): Xaa is any aa, unknown, or other
  misc_feature (205)..(205): Xaa is any aa, unknown, or other
  misc_feature (206)..(206): Xaa is any aa, unknown, or other
  misc_feature (207)..(207): Xaa is any aa, unknown, or other
  misc_feature (230)..(230): Xaa is any aa, unknown, or other
MGFVKVVKNKAYFKRFQVKFKRRREGRTDYFARKRLVVQVKNKYNTPKYRMIVRFTNKDITCQIAYARIVGDMIICAAYAHELPKYGVKVGLTNYAAAYCTGLLLARRLLKKFNMDELYQGQTEVDGDEYYVEDADDGPGAFRCYLDVGLARTTTGARVFGAMKGAVDGGLDIPHSSKRFPGYDSEGDQFNAEVHRNHIFGXXXXXXMASLQEEDEDAFKRQFSQYIKLXITPDSVEEMYKKCHAAIRE

SEQ ID NO: 1938 - protein, 297 aa, Saccharomyces cerevisiae
  misc_feature (26)..(173): Pfam Name: Ribosomal_L18p Pfam Description: Ribosomal L18p/L5e family
  misc_feature (1)..(297): Public GI ID no. 133003
  misc_feature (1)..(297): Bit score of 423.9 for HMM based on sequences of Figure 35
  misc_feature (1)..(297): Functional Homolog Of SEQ ID NO. 1812
MAFQKDAKSSAYSSRFQTPFRRRREGKTDYYQRKRLVTQHKAKYNTPKYRLVVRFTNKDIICQIISSTITGDVVLAAAYSHELPRYGITHGLTNWAAAYATGLLIARRTLQRLGLDETYKGVEEVEGEYELTEAVEDGPRPFKVFLDIGLQRTTTGARVFGALKGASDGGLYVPHSENRFPGWDFETEEIDPELLRSYIFGGHVSQYMEELADDDEERFSELFKGYLADDIDADSLEDIYTSAHEAIRADPAFKPTEKKFTKEQYAAESKKYRQTKLSKEERAARVAAKIAALAGQQ

SEQ ID NO: 1939 - protein, 302 aa, Magnaporthe grisea 70-15
  misc_feature (26)..(176): Pfam Name: Ribosomal_L18p Pfam Description: Ribosomal L18p/L5e family
  misc_feature (1)..(302): Public GI ID no. 39971465
  misc_feature (1)..(302): Bit score of 436.8 for HMM based on sequences of Figure 35
  misc_feature (1)..(302): Functional Homolog Of SEQ ID NO. 1812
MPFHKLVKNSAYYSRFQTKYKRRQQGKTDYYARKRLITQAKNKYNAPKYRLVVRFTNRDIIMQIVTSEISGDKVFASAYSHELKAYGITHGLTNWAAAYATGLLIARRVLKKLGLDEDFTGVEEPEGEFTLTEAAETDEGTRRPFKAYLDVGLARTSTGARVFGAMKGASDGGILIPHSENRFPGFDIESKELDSETLKKYIFGGHVAEYMETLADDDEERYKSQFQQYIDEDIDADGLEDIYTEAHAAIREDPFKKPEGAEAKKSKEEYKKESLKFKAKKLTLAERKARVQERIAELRDAE

SEQ ID NO: 1940 - protein, 299 aa, Ajellomyces capsulatus NAm1
  misc_feature (26)..(176): Pfam Name: Ribosomal_L18p Pfam Description: Ribosomal L18p/L5e family
  misc_feature (1)..(299): Public GI ID no. 154271618
  misc_feature (1)..(299): Bit score of 411.1 for HMM based on sequences of Figure 35
  misc_feature (1)..(299): Functional Homolog Of SEQ ID NO. 1812
MPFTKLVKNSAYFSRYQTKFKRRREGKTDYYARKRLITQAKNKYNAPKYRMVVRFTNRDIITQIVTAEMTGDKVFASAYSHELKRYGIKHGLTNWAAAYATGLLLARRALKKLGLDEDFVGVEEPEGEYSLTEAAETDEGTRRPFKVVLDVGLQRTSTGARVFAAMKGASDGGILIPHSESRFPGYDIETKELDAETLRRYIFGGHVAEYMETLADDDEERYKSQFQKYIDDDVDAGDLEEIYAEAHKGIRADPFKKDEDAGPKKTKEEWKAESLKYRSKKLTRAEKEARVQEKIRELA

SEQ ID NO: 1941 - protein, 301 aa, Aspergillus terreus NIH2624
  misc_feature (26)..(177): Pfam Name: Ribosomal_L18p Pfam Description: Ribosomal L18p/L5e family
  misc_feature (1)..(301): Public GI ID no. 115491879
  misc_feature (1)..(301): Bit score of 412.2 for HMM based on sequences of Figure 35
  misc_feature (1)..(301): Functional Homolog Of SEQ ID NO. 1812
MAFHKLVKNSAYYSRYQTKYRRRREGKTDYYARKRLITQAKNKYNAPKYRLVVRFTNRDIITQIVYSEISGDKVFASAYSHELKRYGITNGLTNWAAAYATGLLLARRTLTKLGLDKDFTGVEEADGEYNLTEAIETEDGNTRRPFKAFLDVGLARTSTGARVFGAMKGASDGGILVPHSENRFPGFDIETEELDAETLRNYIFGGHVAEYMEGLADDDEERFRGQFHKYTENEIDAGDLEDLYAEAHKAIREDPFKKDEEEGSKKSKEEWKAESKKYRQKKLSHAERKARVEQKIRELAA

SEQ ID NO: 1942 - protein, 300 aa, Pyrenophora tritici-repentis Pt-1C-BFP
  misc_feature (26)..(176): Pfam Name: Ribosomal_L18p Pfam Description: Ribosomal L18p/L5e family
  misc_feature (1)..(300): Public GI ID no. 189207733
  misc_feature (1)..(300): Bit score of 420.0 for HMM based on sequences of Figure 35
  misc_feature (1)..(300): Functional Homolog Of SEQ ID NO. 1812
MPFSKLQKNDAYFSRYQVKYKRRRQGKTDYYARKRLITQAKNKYNAPKYRLVVRFTNKDIICQIIHSELSGDKVFMAAYAHELKAYGITHGLTNWSSAYATGLLLARRVLKKLELDEDFVGVEEADGEFTLTEAAEIDGEERRPFKVFLDVGLTRTSTGARVFGAMKGCSDGGVFVPHSENRFPGYDIEGKELDAETLRKYIFGGHVAEYMETLADDDEERYKSQFSGYIEDDIEADGLEELYQDAHKQIREDPWKKEEGAGPKKSKDEWKAESLKYRTKKLTKAEKEERVKAKIAEITA

SEQ ID NO: 1943 - protein, 301 aa, Chaetomium globosum CBS 148.51
  misc_feature (26)..(176): Pfam Name: Ribosomal_L18p Pfam Description: Ribosomal L18p/L5e family
  misc_feature (1)..(301): Public GI ID no. 116197729
  misc_feature (1)..(301): Bit score of 424.5 for HMM based on sequences of Figure 35
  misc_feature (1)..(301): Functional Homolog Of SEQ ID NO. 1812
MAFHKLVKNSAYYSRFQTKYRRRREGKTDYYARKRLIAQAKNKYNAPKYRLVVRFTNRDIITQIVTSEINGDKVFAAAYSHELRAYGIEHGLTNWAAAYATGLLLARRVLKKLGLDGDFAGVEEADGEYTLTEAAETDDGERRPFKANLDVGLARTSTGARVFGVMKGASDGGILVPHSENRFPGFDMETEELDAETLKKYILGGHVAEYMETLADDDEERYKGQFVKYIEDEVEADALEELYTDAHAAIREDPFKKYESDAPKKTKEEWKQESLKYRKSKLTYEQRQERVKARIAELREE

SEQ ID NO: 1944 - protein, 358 aa, Lodderomyces elongisporus NRRL YB-4239
  misc_feature (86)..(233): Pfam Name: Ribosomal_L18p Pfam Description: Ribosomal L18p/L5e family
  misc_feature (1)..(358): Public GI ID no. 149235570
  misc_feature (1)..(358): Bit score of 419.1 for HMM based on sequences of Figure 35
  misc_feature (1)..(358): Functional Homolog Of SEQ ID NO. 1812
MFSHQQMNRTKKKEKNQKASSERKKKLKLKLKLIRKIFSSTFFPLFSFIFLFITNTIILKMPFQKTLKTSAYHSRFQTPFRRRQEGKTDYYQRKRLVTQHKAKYNTPKYRLVVRFTNKDIIAQIISAQITGDVVLTAAYAHELPRYGIKHGLTNWSAAYAVGLLVARRALQKLGLDETYVGVEEVEGEYQLTEAVEDAPRPFKVFLDIGLQRTTTGARVFGVLKGASDGGLYVPHSPNRFPGWDIEAEELDAELLRKYIFGGHVSEYMEELMDDDEEKFRTLFKKYIEDEIEAEDVEEIYANAHEKIREDPSFKPTEKKFTKEQYAAESKKYRQTKLTKAEREEKIAKKIAAFQAENN

SEQ ID NO: 1945 - protein, 292 aa, Dictyostelium discoideum AX4
  misc_feature (26)..(173): Pfam Name: Ribosomal_L18p Pfam Description: Ribosomal L18p/L5e family
  misc_feature (1)..(292): Public GI ID no. 66816906
  misc_feature (1)..(292): Bit score of 404.4 for HMM based on sequences of Figure 35
  misc_feature (1)..(292): Functional Homolog Of SEQ ID NO. 1812
MGFVKVVKTKAYYSRYQVQFRRRREGKTDYQQRHRLITQDKNKYNSPKYRLVARITNTDVIAQVVYSKIVGDFVLCAAYAHELPRFGVKVGLTNYASCYATGLLLARRLLAKLKLADLYKGAEKVDGKVFLVKPVDDKPRPFKANLDVGLARTSTGAKVFAVLKGAVDGGIYVPHGETRFAGYNAESKKLNAETLRGYIFGKHVASYMTLLQTEDEDAYKKIFSQYIKNGVAPKDIETIYANAHKAIRANPAPAAKSTKSYKDIKSKNLSKRTLKQKKARVASIKASYKARL

SEQ ID NO: 1946 - protein, 297 aa, Pichia stipitis CBS 6054
  misc_feature (26)..(173): Pfam Name: Ribosomal_L18p Pfam Description: Ribosomal L18p/L5e family
  misc_feature (1)..(297): Public GI ID no. 126133112
  misc_feature (1)..(297): Bit score of 418.6 for HMM based on sequences of Figure 35
  misc_feature (1)..(297): Functional Homolog Of SEQ ID NO. 1812
MAFQKALKSSSYHSRFQTPFRRRQEGKTDYYQRKRLVTQHKAKYNTPKYRLVVRFSNKDIVAQIVSSQITGDVVLTAAYAHELPKYGINHGLTNWSAAYAVGLLVARRALQKLGLDETYQGVEEVEGEFELVEAVEDGPRPFKVFLDIGLQRTTTGARIFGVLKGASDGGLYVPHSPNRFPGWDIEAEELDAELLRKYIFGGHVAEYIEELMDDDEEKYRTLFKSYIADEIEAEDIEELYTEAHAKIREDPVFKPTEKKFTKEQYAAESKKFRQVKLTREERQAKINKKIADFQAEN

SEQ ID NO: 1947 - protein, 297 aa, Vanderwaltozyma polyspora DSM 70294
  misc_feature (26)..(173): Pfam Name: Ribosomal_L18p Pfam Description: Ribosomal L18p/L5e family
  misc_feature (1)..(297): Public GI ID no. 156843920
  misc_feature (1)..(297): Bit score of 420.1 for HMM based on sequences of Figure 35
  misc_feature (1)..(297): Functional Homolog Of SEQ ID NO. 1812
MAFQLNVKTSAYHSRFQTPFRRRREGKTDYYQRKRLVCQHKAKYNTPKYRLVVRFTNKDIICQIVSSTITGDVVLAAAYSHELPRYGITHGLTNWSAAYATGLLIARRALQKLGLDETYKGVEEVEGEYELTEAVEDGPRPFKVFLDVGLQRTTTGARVFGALKGASDGGLYVPHSENRFPGWDFESEEIDPDLLRSYIFGGHVSQYMEELADDDEERFSELFKGYLADDIDADAVEDIYAEAHTAIRADPAFKPTEKKFTKEQYAAESKKFRQVKLTREERVARVAAKIAALAGQQ

SEQ ID NO: 1948 - protein, 305 aa, Laccaria bicolor S238N-H82
  misc_feature (26)..(175): Pfam Name: Ribosomal_L18p Pfam Description: Ribosomal L18p/L5e family
  misc_feature (1)..(305): Public GI ID no. 170091820
  misc_feature (1)..(305): Bit score of 441.7 for HMM based on sequences of Figure 35
  misc_feature (1)..(305): Functional Homolog Of SEQ ID NO. 1812
MPFVKKLKSDAYFSRFQVKYRRRREGKTDYYARKRLVTQAKNKYNAPKYRLVVRFTNRDIIVQIVYARLQGDFVLTAAHSRELPRYGINHGLTNWSAAYATGLLCARRALTKLGLADKYEGVTEPDGTLKLTEVLDEEDAPRPFKCYLDVGLKRTSTGSRVFGAMKGASDGGIFIPHSEKRFPGFDPESKELDAEVLKKYIFGGHVAEYMESLEEEDDERFKKQFATYLADGVGSDDIEEIYTNAHSAIREDPTFKPTDKSQDWRSESVKHKDKKLTHAQRQANIAAKIEKFKAGGDAGADDEED

SEQ ID NO: 1949 - protein, 290 aa, Monosiga brevicollis MX1
  misc_feature (19)..(166): Pfam Name: Ribosomal_L18p Pfam Description: Ribosomal L18p/L5e family
  misc_feature (1)..(290): Public GI ID no. 167519038
  misc_feature (1)..(290): Bit score of 400.7 for HMM based on sequences of Figure 35
  misc_feature (1)..(290): Functional Homolog Of SEQ ID NO. 1812
MDKAYYKRFQVKYRRRREGKTDYYARTRLVRQEKNKYNTPKYRLIVRRTTSDVVAQIAYSRLEGDYIMAAAYSHELPQFGFKVGLTNWSACYATGLLVARRLLTKLNLADTYKGVEEPNGEDYFVEEAEDKPRPFRCYLDVGLAPTTTGSRVFGVMKGAVDGGLAIPHNHKRFPGYDAEAKEMDAEVVRDYIFGEHVANYMRELQDEDDEAFRKQFAKYIKLGVGADDIEDMITEAHEKIRENPIIPKKSQEGKEHKSYKKIPLSYAQRKDRIKQKKESFRKKLAAEADA

SEQ ID NO: 1950 - protein, 308 aa, Aspergillus fumigatus Af293
  misc_feature (34)..(184): Pfam Name: Ribosomal_L18p Pfam Description: Ribosomal L18p/L5e family
  misc_feature (1)..(308): Public GI ID no. 70995808
  misc_feature (1)..(308): Bit score of 393.3 for HMM based on sequences of Figure 35
  misc_feature (1)..(308): Functional Homolog Of SEQ ID NO. 1812
MIAPAALCFGHLSFPQARQEQRVLQTKYRRRREGKTDYYARKRLITQAKNKYNAPKYRLVVRFTNRDIITQIVYSEITGDKVFASAYSHELKRYGITQGLTNWAAAYATGLLLARRTLKKLGLDEQFTGVEEPDGEYKLTEAVETDDGTRRPFKAFLDVGLVRTSTGARVFGAMKGASDGGIFIPHSENRFPGYDIESEELDAETLRNYIFGGHVSEYMETLADDDEERYRSQFAKYIENEIDAGDLEEIYAEAHKAIREDPFKKDEDEKPKKSKEEWKAESKKYKKAKLSREEKKARVEQKIRELAA

SEQ ID NO: 1951 - protein, 305 aa, Leishmania braziliensis MHOM/BR/75/M2904
  misc_feature (26)..(179): Pfam Name: Ribosomal_L18p Pfam Description: Ribosomal L18p/L5e family
  misc_feature (1)..(305): Public GI ID no. 154344695
  misc_feature (1)..(305): Bit score of 399.2 for HMM based on sequences of Figure 35
  misc_feature (1)..(305): Functional Homolog Of SEQ ID NO. 1812
MPFVKVVKNKAYFKRFQVKYRRRREGKTDYHARRQMVLQDKTKFGSPKYRLVVRTTNKDIIAQIVQAKIAGDEVLMAAYAHELPAFGIEHGLTNYAAAYATGLLLARRTLAKLGIADKFQGAKEADGSYSAVRTKKDDQGDDEARFPFKAILDVGLARTTTGARVFGVLKGAVDGGISVPHRPNRFPGYSKEKSALDAKVHRDRIFGKHVAEYLKQVKEEASSNPDEKCVQFSKYMEAKVAPESIECMYKKAHAAIRADPSKSLPKKAKKEGAKHKSYKTKKMSGAEKRAAAKAKVAAIRERLGK

SEQ ID NO: 1952 - protein, 300 aa, Coccidioides immitis RS
  misc_feature (26)..(176): Pfam Name: Ribosomal_L18p Pfam Description: Ribosomal L18p/L5e family
  misc_feature (1)..(300): Public GI ID no. 119181612
  misc_feature (1)..(300): Bit score of 414.3 for HMM based on sequences of Figure 35
  misc_feature (1)..(300): Functional Homolog Of SEQ ID NO. 1812
MPFTKLVKNSAYYSRYQTKFKRRRQGKTDYYARKRLITQAKNKYNSPKYRLVVRFTNRDIITQIVTSELTGDKVIACAYAHELKRYGIKNGLTNWSAAYATGLLLARRTLKKLGLDEDFVGVEEPEGEFTLTEAAETDEGTRRPFKAFLDVGLHRTSTGARVFAAMKGASDGGILVPHSENRFPGFDIETEELDAETLRKYIFGGHVAEYMEGLADDDEERYKSQFQMYIDNGLEAGELEDMYAEAHKAIREDPFKKDEEAGPKKSKEEWKAESLKYKAKKLSRAEKNARAQEKIRELAE

SEQ ID NO: 1953 - protein, 305 aa, Leishmania major strain Friedlin
  misc_feature (26)..(179): Pfam Name: Ribosomal_L18p Pfam Description: Ribosomal L18p/L5e family
  misc_feature (1)..(305): Public GI ID no. 72547732
  misc_feature (1)..(305): Bit score of 395.4 for HMM based on sequences of Figure 35
  misc_feature (1)..(305): Functional Homolog Of SEQ ID NO. 1812
MPFVKVVKNKAYFKRFQVKYRRRREGKTDYHARRQMVLQDKTKFGSPKYRLVVRITNKDIIAQIVQAKIVGDEVVMAAYAHELPAFGIEHGLTNYAAAYATGLLLARRTLAKLGIADKFQGAKEADGSYSAVRTKKDDEGDDEERFPFKAILDVGLARTTTGARVFGVLKGAVDGGMAVPHRPNRFPGYNKEKSSLDAKVHRDRIFGKHVADYLKQVKEEASSNPDEKCVQFSKYMAAKVLPESIEGMYKKAHAAIRADPSKSLPKKAKKEGVAHKSYKTKKLSGAEKRAAAKAKVAAIRERLGK

SEQ ID NO: 1954 - DNA, 994 bp, Arabidopsis thaliana
  misc_feature (1)..(994): Ceres Annot ID no. 529860
  misc_feature (1)..(994): Ceres SEED LINE ID no. CW00318
  misc_feature (1)..(994): Encodes the peptide sequence at SEQ ID NO. 1955
atctcccactctttatctctcctttctttctcctagttctctttatctcatactcctctacatttcaaagaagtttctcaattggttgagatggattattcttcgatgcatcagaatgtgatgggagtatcttcatgttcaacacaagattatcaaaaccagaagaaaccattgtcggcgactaggccagctccaccagagcaatcattaagatgccctcgctgtgactccaccaacacaaagttctgctactacaacaactacagtctctctcaacctcgctacttctgcaaatcttgtaggagatactggaccaagggtggaatcctaagaaacatcccaatcggtggtgcttaccggaaacacaaacgctcctcctccgcaaccaaaagcctcagaacaacccctgagcccacgatgacccatgacggcaaatcattcccaacggcgagttttggctataataataataacattagcaacgaacagatggagcttgggttagcatatgccttgttgaacaagcaacctctaggggtttcttcacatctagggttcggaagctctcagtctccaatggccatggatggcgtgtatgggaccacgagccatcagatggagaacacggggtatgcgtttggaaatggtggaggcggtatggagcagatggcgacaagtgatccaaacagggttttgtggggattcccctggcagatgaacatgggaggaggaagtggtcatggtcatggtcatgttgatcagattgattcagggagagagatttggagcagtactgtcaactacattaatactggtgctttattgtagtctatttattttaaaatttgggtttgattagggtttggattgtggtcgtcttggttagagaaagggataatatgagtttggggttaatggtaaaagaaaatagatatgttgtgctttctttaaagattttcagttacttgggaaatgaattgtgtttttttgtttg

SEQ ID NO: 1955 - protein, 245 aa, Arabidopsis thaliana
  misc_feature (35)..(97): Pfam Name: zf-Dof Pfam Description: Dof domain, zinc finger
  misc_feature (1)..(245): Ceres SEED LINE ID no. CW00318
  misc_feature (1)..(245): Ceres Annot ID no. 529860
  misc_feature (1)..(245): Bit score of 495.2 for HMM based on sequences of Figure 27
  misc_feature (1)..(245): in Figure 27
MDYSSMHQNVMGVSSCSTQDYQNQKKPLSATRPAPPEQSLRCPRCDSTNTKFCYYNNYSLSQPRYFCKSCRRYWTKGGILRNIPIGGAYRKHKRSSSATKSLRTTPEPTMTHDGKSFPTASFGYNNNNISNEQMELGLAYALLNKQPLGVSSHLGFGSSQSPMAMDGVYGTTSHQMENTGYAFGNGGGGMEQMATSDPNRVLWGFPWQMNMGGGSGHGHGHVDQIDSGREIWSSTVNYINTGALL

SEQ ID NO: 1956 - protein, 343 aa, Vitis vinifera
  misc_feature (23)..(85): Pfam Name: zf-Dof Pfam Description: Dof domain, zinc finger
  misc_feature (1)..(343): Public GI ID no. 147810484
  misc_feature (1)..(343): Bit score of 652.2 for HMM based on sequences of Figure 27
  misc_feature (1)..(343): Functional Homolog Of SEQ ID NO. 1955
  misc_feature (1)..(343): in Figure 27
  misc_feature (282)..(282): Xaa is any aa, unknown, or other
MDTQSLESMLVCSKAQQERKPRPPEQALKCPRCDSTNTKFCYYNNYSLSQPRYFCKSCRRYWTKGGTLRNVPVGGGCRKNKRSSSSSSSKRTQDQPLTTNPNPLNVLPPLTYDSNDLTLAFARLQKQTGGQLGYDDHHHDLALMGNPNNTHCDVLGNQCVNTCGTTTPGLLDALRTNFLETPSGYHNLYYGFGNGGMGGEVENGGVGGEHMVLPYEEMSGATTTAVTVTTMKQELCHGREDQLGIVSGFLGIGISVKLKAEGRKHEHQFRDRFCYRKQTKSXLGYGRESLWTKQGVCSHLMKGIGHVAADWIGPDGPGSNAGRLSYYKARASIGLKQHCLYMF

SEQ ID NO: 1957 - protein, 296 aa, Pisum sativum
  misc_feature (34)..(96): Pfam Name: zf-Dof Pfam Description: Dof domain, zinc finger
  misc_feature (1)..(296): Public GI ID no. 37051125
  misc_feature (1)..(296): Bit score of 660.4 for HMM based on sequences of Figure 27
  misc_feature (1)..(296): Functional Homolog Of SEQ ID NO. 1955
  misc_feature (1)..(296): in Figure 27
MDSSSEQQHQQMSNQSLESMLTCSKGEQDKKAKPQPEALKCPRCDSSNTKFCYYNNYSLSQPRYFCKSCRRYWTKGGTLRNVPVGGGCRKNKRSSSSVSRRIQDQAFVNNPNPVTCFPSLSYDSNDLTLALARLQKGQLGFDHEHDFSILGNHANSNININTNTSCAVLNNHGMNHSSNNHGFFEALMGSQNNVQNLYYGYGNRDMGEVDNGNVSGEMMLPYDHEMSIATTQAVTVTTMKQEMCNVREQNESRVLLGFPWQFNNGDSNMDEIDHSGRAGWNGLTSPWHGLLNSPLM

SEQ ID NO: 1958 - protein, 285 aa, Glycine max
  misc_feature (23)..(85): Pfam Name: zf-Dof Pfam Description: Dof domain, zinc finger
  misc_feature (1)..(285): Public GI ID no. 112363376
  misc_feature (1)..(285): Bit score of 594.7 for HMM based on sequences of Figure 27
  misc_feature (1)..(285): Functional Homolog Of SEQ ID NO. 1955
  misc_feature (1)..(285): in Figure 27
MNPSSGQPQQMSSQSVEKKPKPHPEQALKCPRCDSTNTKFCYYNNYSLSQPRYFCKSCRRYWTKGGTLRNVPVGGGCRKKRSSSLKRAQGQTLTPNLNPLTTLPHLSYDSNDFTLAVARFQKQSSGQLGYNDRDLSTLGNPTTGSFCDILGNSGMNPSSANPSFLDAIRTGFLETQNHLQNLYCMYGNGDLGEVDNGNSGVVGVSGEMMLPYDQVIMSNATTQSVSVMKQEMCSRREQSERRVLGGFPWQINADTNIGELDSGRTIASWNSFTNSWHGFLQSPLM

SEQ ID NO: 1959 - DNA, 1116 bp, Oryza sativa
  misc_feature (1)..(1116): Ceres Annot ID no. 1702519
  misc_feature (1)..(1116): Encodes the peptide sequence at SEQ ID NO. 1960
atggcgccggcggccggggacgacgcggtggtgccgcgaaagggagctggaggtggggggacgacgacgccgccgccgccgccaccggcgcagcagcagcagcagcagccgctcccgccgccgccgccgcaggagcaggggttgcggtgcccgcggtgcgactcgccgaacaccaagttctgctactacaacaactacagcctcagccagccgcgccacttctgcaagacgtgccggaggtactggaccaagggcggcgcgctccgcaacgtcccagtcggcggcggctgccgcaagaacaagcgatcccgctccgcggcggcggcatcgcgcctctcgctcaacctgccgacggtggagggtatcggcggtgcagcggccgaccccgctgcggcggctgctgccaggctggggtttcttggcggtggaacaacgatgatgatgtcgtcgtcgacgtcgccgctcggtggcgccgccgccgcggtggccgacttccagcagggcggcgccgtcgggatgctgccgctgccgcggctccaatcccccgccggcggcggcgtcgggcatcatcagtacgtgccgttcggggagtggccctcgggggacattgccggcggcaacgcggtgaacggcggcggcggccacggcgcggtgagcagcaccatcgcgtcgtccatcgagtcgctcagcttcatcaaccaggacctgcactggaagctgcagcagcagaggctcgccaccatgttcctcggcccgccgggctccgcctccgccgccgccgccgccgcccaggccaacgacggtggcggcaacggcgcccaagccacagcgtcagggcatgctgccggaggaggcggtggcgccttcatgcacatggctggtagtgttcccagcatggaggcggccatgccgtcggcgacgtcgtggttcatggacagctgctcctacgggctcccttccccaccgccgcctgccactgccgccgtggccgccaccaccagcagtaacctcaacagcggcggccggagtagcggcggcgatgataacgccacctccaactgcggcagcgcgatcccggcgtggggcgacatctcgacgttcgcgatgctgccctag

SEQ ID NO: 1960 - protein, 371 aa, Oryza sativa
  misc_feature (43)..(105): Pfam Name: zf-Dof Pfam Description: Dof domain, zinc finger
  misc_feature (1)..(371): Ceres Annot ID no. 1702519
  misc_feature (1)..(371): Bit score of 712.5 for HMM based on sequences of Figure 27
  misc_feature (1)..(371): Functional Homolog Of SEQ ID NO. 1955
  misc_feature (1)..(371): in Figure 27
MAPAAGDDAVVPRKGAGGGGTTTPPPPPPAQQQQQQPLPPPPPQEQGLRCPRCDSPNTKFCYYNNYSLSQPRHFCKTCRRYWTKGGALRNVPVGGGCRKNKRSRSAAAASRLSLNLPTVEGIGGAAADPAAAAAARLGFLGGGTTMMMSSSTSPLGGAAAAVADFQQGGAVGMLPLPRLQSPAGGGVGHHQYVPFGEWPSGDIAGGNAVNGGGGHGAVSSTIASSIESLSFINQDLHWKLQQQRLATMFLGPPGSASAAAAAAQANDGGGNGAQATASGHAAGGGGGAFMHMAGSVPSMEAAMPSATSWFMDSCSYGLPSPPPPATAAVAATTSSNLNSGGRSSGGDDNATSNCGSAIPAWGDISTFAMLP

SEQ ID NO: 1961 - DNA, 1506 bp, Zea mays
  misc_feature (1)..(1506): Ceres Clone ID no. 286416
  misc_feature (1)..(1506): Encodes the peptide sequence at SEQ ID NO. 1962
ctcttctctccacatctcccctcggactactactgcatccaaggagcaaagaattgtgggggtagcaaaggaattggagttcttgcatggatgcagcccactggcagcagggcctagggctggtgaagcccatggaggagatgctgatggcggccaacgcgggcgccgcaaatccgagccaaagctcgaatccgaacccgccggcgccggcgccgtcgttggcacctggggggctcctgggcggtggcgcgccggcgcccctggcgggcgcgggtagtaccgagcggcgcgcgcggccgcagaaggagaaggcgctcaactgcccgcggtgcaactccaccaacaccaaattctgctactacaacaactacagcctccagcagccacgctacttctgcaagacgtgccgccgctactggacggagggcggatccctccgcaacgtccccgtgggcggcggctcccgcaagaacaagcgctcctcatcgtcggcgtcggcgtctgcctccacctccggctcggtcacgagctcgtccatggccagcacggcgggggccgggtccaagaacccgaagctggcgcacgagggcgcccacgacctcaacctggcgttcccgcaccacggtggcctgcacgcccccgagttcgcggcgttcccgagtctggagagcagcaacgtgtgcaacccgggcggcgggatgacgagcaacggtcggggcggcggcgcggggcccgcggtcggcgcgctctcggcaatggagctgttgcggagctccggctgctacatgccgctgcagatgccgatgccgatggcgatgccaggagattacacggcggcagggttcgcgctcggagagtaccgcacgccgccgcctccaccgtcacagagcgtgctcgggttctctctcgacgcgcacgggccggggtccggtgctaccgcggcggggtacggttccagcgcggggttgcagggcgtgccggagaacgcgggcaggttattgttccccttcgaagacttgaagccgccggttggctctgaaggtgggggtggtgcaaccggtggcgccagcgatggaaatagcagccatactcagtttgaccacaacaacaaggagcaaggcggcggcggcacgggtgccgggcacgacacgccggggttctggagcggcatgatcggcggcagtggcgcttcttggtaatggagaaacatgcacggccggggggcggcgccatgcatggctcatgcaaaggctccctgcgagcgtgcatgggcatgcagtagagacaagggttcaataagaggttggcattggtggtggttgccctgacatgggagtgtttgatctctttcctagtactgggtcctggtggtgttcttcgtctgttctcgccgtcgtcgtcgcgagttcatgtgtgttttgctgaccatcgactttaattggggctctaacacaccagaggtcatgttacataagcttgaccgacatctctcggtcgtcttttccc

SEQ ID NO: 1962 - protein, 370 aa, Zea mays
  misc_feature (72)..(134): Pfam Name: zf-Dof Pfam Description: Dof domain, zinc finger
  misc_feature (1)..(370): Ceres Clone ID no. 286416
  misc_feature (1)..(370): Bit score of 730.1 for HMM based on sequences of Figure 27
  misc_feature (1)..(370): Functional Homolog Of SEQ ID NO. 1955
  misc_feature (1)..(370): in Figure 27
MDAAHWQQGLGLVKPMEEMLMAANAGAANPSQSSNPNPPAPAPSLAPGGLLGGGAPAPLAGAGSTERRARPQKEKALNCPRCNSTNTKFCYYNNYSLQQPRYFCKTCRRYWTEGGSLRNVPVGGGSRKNKRSSSSASASASTSGSVTSSSMASTAGAGSKNPKLAHEGAHDLNLAFPHHGGLHAPEFAAFPSLESSNVCNPGGGMTSNGRGGGAGPAVGALSAMELLRSSGCYMPLQMPMPMAMPGDYTAAGFALGEYRTPPPPPSQSVLGFSLDAHGPGSGATAAGYGSSAGLQGVPENAGRLLFPFEDLKPPVGSEGGGGATGGASDGNSSHTQFDHNNKEQGGGGTGAGHDTPGFWSGMIGGSGASW

SEQ ID NO: 1963 - DNA, 1071 bp, Sorghum bicolor
  misc_feature (1)..(1071): Ceres Annot ID no. 8702387
  misc_feature (1)..(1071): Encodes the peptide sequence at SEQ ID NO. 1964
atggaggagatgctgatggcggccaacgcgggcgccgcgaatccgagccaaggctccaataatccgaacccgccggcgccggcacctggcggtgccctgcgcggtggtggcgcgccggcggcgccgctggcaggcgcgggtagcaccgagcggcgcgcgcggccgcagaaggagaaggcgctcaactgcccgcggtgcaactccaccaacaccaagttctgctactacaacaactacagcctccagcagccacgctacttctgcaagacgtgccgccgctactggacggagggcggatccctccggaacgtccccgtgggcggcggctcccgcaagaacaagcgctcctcgtcgtcggcgtccgcgtccgcctccacctccgcctcggtcacgagctcgtccatggccagcgcggagggggcggcggcgtccaagaacccgaagctggcgcacgagggcgcgcacgacctcaacctagcgttcccgcaccacggtggcctgcacgcccccgagttcgcggcgttcccgagcctggagagcagcaacgtgtgcaacccgggcggcgggatgacgagcaacggccggggcggcggcgcgggccccgcggtcggcgcgctctcggcaatggagctcttgcggagctccggctgctacatgccgctgcagatgccgatgcagatgcaaggagattacacggcggcagagttcgcgctcggagacttccgcacgccgccgcctccaccgtcgcagagcgtgctcgggttctctctggacgcgcacgggccggggtccggtgctgccgccgcggggtacggttccagcgcgggattgcagggagtgacggagaacgcgggcaggttattgttccccttcgaggacttgaagccgccggttagctctggaggtggtggtgtggccggtggtgcaaccggtggcgccggcgatggaaatagcaaccataatcagtttgaccacaacaaggagcaagacggcggcggcggtccgggtgccggccacgacacgccggggttctggagcggcatgatcggcggcagtggcgcttcttggtaa

SEQ ID NO: 1964 - protein, 356 aa, Sorghum bicolor
  misc_feature (56)..(118): Pfam Name: zf-Dof Pfam Description: Dof domain, zinc finger
  misc_feature (1)..(356): Ceres Annot ID no. 8702387
  misc_feature (1)..(356): Bit score of 696.2 for HMM based on sequences of Figure 27
  misc_feature (1)..(356): Functional Homolog Of SEQ ID NO. 1955
  misc_feature (1)..(356): in Figure 27
MEEMLMAANAGAANPSQGSNNPNPPAPAPGGALRGGGAPAAPLAGAGSTERRARPQKEKALNCPRCNSTNTKFCYYNNYSLQQPRYFCKTCRRYWTEGGSLRNVPVGGGSRKNKRSSSSASASASTSASVTSSSMASAEGAAASKNPKLAHEGAHDLNLAFPHHGGLHAPEFAAFPSLESSNVCNPGGGMTSNGRGGGAGPAVGALSAMELLRSSGCYMPLQMPMQMQGDYTAAEFALGDFRTPPPPPSQSVLGFSLDAHGPGSGAAAAGYGSSAGLQGVTENAGRLLFPFEDLKPPVSSGGGGVAGGATGGAGDGNSNHNQFDHNKEQDGGGGPGAGHDTPGFWSGMIGGSGASW

SEQ ID NO: 1965 - DNA, 1305 bp, Gossypium hirsutum
  misc_feature (1)..(1305): Ceres Clone ID no. 1951902
  misc_feature (1)..(1305): Encodes the peptide sequence at SEQ ID NO. 1966
attctctcactcatctcttttctctccacacccccttaaaacaatgcctgctgattccggcgataggcgtcaggttgcagttccaggaactatggcgtcccacccaccacctaagctgacggagccacttccatgccctcggtgcgactccaccaacaccaagttctgctactacaacaactacaacctctctcagcctcgctacttctgcaaggcatgccgccgttactggactcaaggaggaactctccgtaacgtgccggtaggtggcgggacccgcaaggcttccaagcgctcacgttgttcttctggctcttctccttccgttgcagtttcttcttcctcgagcttgacgcatgaagctgagtccgctcctgttgttaaccctgcccccgttatgcctggactcggaataaaacctgaaatgggtttggccgacgtgaatttgaatgaaaccgtggaccttcctgtcaatggaggcttcacttcgttcttgaactcgcagggagaagggtacttgacgcttggtggatacggatttggagctggttcagggtttgatggggtttgggcttatcctggaaatggttatcttggtggctttagtggcggaggtggtggtggtgggtccggtggtgccgtaggtggaaataattcggggtgtaacacatggcaagcaacaagcgatgttgaaggtggcggaggattaagtgatggggaatgctttggttggccagggcttgcaatttctgcaccagggaaaggtttgaagtgaggaaaaaggattcagccatttcgagtaaaaaaacgaaggtgtcgattttaactgtttgtttttgtgccatcgcgattgaaaagtttgctggttagtggtgttgtggcttttatagagaggaacgattataatagagtagataatagactgttgatcaaagtgtggccttattgtggtgggtagtggattcctatgttcttagggtttcgttttttgacgactctgtaaatctttgaagaaatgaatgcataaaccacagtttttctttcaaataaagaagttagaaaataccagtctaagcacgcagatttctgcttttggtgatcttgttaaggaagccattaattatatagaatgcggagcagcaacacatggaaacgaccagaatgaaagatttcaacatagacgttccagttataaggagctacagtatatatgtgatggggataacaatggagttctgttcttctccgggacatcatatgggggacatccttgggttaaccctgttgtgtataagagaattacta

SEQ ID NO: 1966 - protein, 243 aa, Gossypium hirsutum
  misc_feature (24)..(86): Pfam Name: zf-Dof Pfam Description: Dof domain, zinc finger
  misc_feature (1)..(243): Ceres Clone ID no. 1951902
  misc_feature (1)..(243): Bit score of 418.1 for HMM based on sequences of Figure 27
  misc_feature (1)..(243): Functional Homolog Of SEQ ID NO. 1955
  misc_feature (1)..(243): in Figure 27
MPADSGDRRQVAVPGTMASHPPPKLTEPLPCPRCDSTNTKFCYYNNYNLSQPRYFCKACRRYWTQGGTLRNVPVGGGTRKASKRSRCSSGSSPSVAVSSSSSLTHEAESAPVVNPAPVMPGLGIKPEMGLADVNLNETVDLPVNGGFTSFLNSQGEGYLTLGGYGFGAGSGFDGVWAYPGNGYLGGFSGGGGGGGSGGAVGGNNSGCNTWQATSDVEGGGGLSDGECFGWPGLAISAPGKGLK

SEQ ID NO: 1967 - protein, 299 aa, Solanum demissum
  misc_feature (32)..(94): Pfam Name: zf-Dof Pfam Description: Dof domain, zinc finger
  misc_feature (1)..(299): Public GI ID no. 113205234
  misc_feature (1)..(299): Bit score of 612.8 for HMM based on sequences of Figure 27
  misc_feature (1)..(299): Functional Homolog Of SEQ ID NO. 1955
  misc_feature (1)..(299): in Figure 27
MDQQQQEMSSQTLESMLVCTKPDQDQKKPRPAEQQPQKCPRCDSANTKFCYYNNYSLTQPRYFCKSCRRYWTKGGTLRNVPVGGGCRKNKKLSSTTSAKRSSQDNISPNISNPIPSYDSSTDLSLAFARLQKQTNAHLEIDQEHDNNNMSMMYNTGNNCTSTTFLDALRGGFLENAPNHPGLFHHNMYNYANMGQLVENGEMGMSYDQDQMSIGTSTTMMTTIVKQEMCNMARSTEGHDLNNSNNNNKVLCGFPWQQMNGDHHVNNMNTNDFEYSTNKQSWNGFGGSSNWHGLINSPLM

SEQ ID NO: 1968 - protein, 245 aa, Arabidopsis thaliana
  misc_feature (35)..(97): Pfam Name: zf-Dof Pfam Description: Dof domain, zinc finger
  misc_feature (1)..(245): Public GI ID no. 5689615
  misc_feature (1)..(245): Bit score of 488.4 for HMM based on sequences of Figure 27
  misc_feature (1)..(245): Functional Homolog Of SEQ ID NO. 1955
  misc_feature (236)..(236): Xaa is any aa, unknown, or other
MDYSSMHQNVMGVSSCSSQDYQNQKKPLSATRPAPPEQSLRCPRCDSTNTKFCYYNNYSLSQPRYFCKSCRRYWTKGGILRNIPIGGAYRKHKRSSSATKSLRTTPEPTMTHDGKSFPTASFGYNNNNISNEQMELGLAYALLNKQPLGVSSHLGFGSSQSPMAMDGVYGTTSHQMENTGYAFGNGGGGMEQMATSDPNRVLWGFPWQMNMGGGSGHGHGHVDQIDSGREIWSSTXNYINTGALL

SEQ ID NO: 1969 - DNA, 907 bp, Glycine max
  misc_feature (1)..(907): Ceres Clone ID no. 1107598
  misc_feature (1)..(907): Encodes the peptide sequence at SEQ ID NO. 1970
atttacctcacttctttgcatgacttcctaaactctctctatactcttctctcttctacactttgctctaccctctttcccttccctcaagtactatcatacacatcacacacacaagcaaaaactcttgctttccttttcaagttcttaaactcatcacttacctcaggagtttgcatattttctttgtatggatggatccttccagtggacaacaccagcaaatgtctagccagtcattggagaacatgttggcatgttcaaaagcacagcaagagaggaagccaaggcctcagccagaacaggctctgaagtgtcccagatgtgactccaccaacaccaaattctgctactacaataattacagcctctcccaaccaaggtatttctgcaagtcctgcaggagatattggaccaaaggaggtacacttaggaatgtccctgtgggaggagggtgcaggaagaacaaaaggtcatcatcatcatcatcttcaacatcaaagagagttcaagaccaagcattcacaccaaatcctaactctctcattggccttccttcattgtcctatgactcaagtgacctcactcttgcattggcaaggcttcaaaagcagtcatgtgggcaattggggtatgatgagcatgatctttcaatgttggggaaccaccacccaagcaccccatgtgataatatccttggcatgcatcatcactcatcatcatccacaaacccagggttcttggatgccctcagaagtgggttccttggaacacaaagtagtaatatgcagcagaatctgtactatggatatgggaatggagacatgggggaggtggacaatggaaatgcttcttgtggtggagagatgatgatgatgccttataatgattaagaaatgagtgttga

SEQ ID NO: 1970 - protein, 232 aa, Glycine max
  misc_feature (34)..(96): Pfam Name: zf-Dof Pfam Description: Dof domain, zinc finger
  misc_feature (1)..(232): Ceres Clone ID no. 1107598
  misc_feature (1)..(232): Bit score of 335.5 for HMM based on sequences of Figure 27
  misc_feature (1)..(232): Functional Homolog Of SEQ ID NO. 1955
MDPSSGQHQQMSSQSLENMLACSKAQQERKPRPQPEQALKCPRCDSTNTKFCYYNNYSLSQPRYFCKSCRRYWTKGGTLRNVPVGGGCRKNKRSSSSSSSTSKRVQDQAFTPNPNSLIGLPSLSYDSSDLTLALARLQKQSCGQLGYDEHDLSMLGNHHPSTPCDNILGMHHHSSSSTNPGFLDALRSGFLGTQSSNMQQNLYYGYGNGDMGEVDNGNASCGGEMMMMPYND

SEQ ID NO: 1971 - DNA, 1316 bp, Glycine max
  misc_feature (1)..(1316): Ceres Clone ID no. 543840
  misc_feature (1)..(1316): Encodes the peptide sequence at SEQ ID NO. 1972
attacctcacttctttgcatgactacttcctaaactcttctcttctacactttgctctctaccctctttctttctctttctttttcccttccctcaagtactatcatacacaaacacaaggtacttcacatacccacatacacacacataagcaaaaactcttacttccctttttcaagttcttaaactcatcactacttaactcaggagtgtgcatattttcgttgtatggatggatccttctagtggacaacaccagcaaatgtctagccagtcattggagaacatgttggcatgttcaaaagcccaccaagagagaaaaccaacgcctcagccagaacaagctctaaagtgccccagatgtgactccaccaacaccaaattctgctactacaacaattacagcctttcccagccaaggtacttctgcaagtcatgcaggagatattggaccaaaggaggtacacttaggaatgtccctgtgggaggagggtgcaggaagaacaaaaggtcatcatcatcatcttcaacatcaaagagagttcaagatcaagcattcacaccaaatgttaaccctctcactggccttccttcattaatgtcttatgactccaatgacctcactcttgcattggcaaggcttcaaaagcagtcatgtgggcaattagggtatgatgatcatgatctttcaatgttggggaaccaccacacaaacaccccatgtggtgataatatccttggcatgcatcaccactcatcatcctcatccacaaacccagggttcttggatgccctcagaagtgggttccttggaacacaaagtaataataatatgcatcagaatatgtactatggatatgggaatggggacatgggggaggtggacaatggtggtggggttggggttagtagtagtggagagatgatgatgatgatgatgccttataataatgatcaagaaatgagtattgcatccacacaggcagtgacagtcaccaccatgaagcaagagatttgcaacggaagggaacaaaaggtgttgtggggttttccatggcaactcaatggagacacaaacatgggtgaacttgactcaggaagagctagtaattggaatggcatcaattcatcatggcatggacttctcaacagtcccctaatgtagacaacaaccacagggcctctactactgataattttatttccttaatttctcatgttttgttttactaaaaatgttattagtctaattaggattttcaatatccttttgagtgctgggttaattaattacaggggtttggttgattcccttg

SEQ ID NO: 1972 - protein, 310 aa, Glycine max
  misc_feature (34)..(96): Pfam Name: zf-Dof Pfam Description: Dof domain, zinc finger
  misc_feature (1)..(310): Ceres Clone ID no. 543840
  misc_feature (1)..(310): Bit score of 536.6 for HMM based on sequences of Figure 27
  misc_feature (1)..(310): Functional Homolog Of SEQ ID NO. 1955
MDPSSGQHQQMSSQSLENMLACSKAHQERKPTPQPEQALKCPRCDSTNTKFCYYNNYSLSQPRYFCKSCRRYWTKGGTLRNVPVGGGCRKNKRSSSSSSTSKRVQDQAFTPNVNPLTGLPSLMSYDSNDLTLALARLQKQSCGQLGYDDHDLSMLGNHHTNTPCGDNILGMHHHSSSSSTNPGFLDALRSGFLGTQSNNNMHQNMYYGYGNGDMGEVDNGGGVGVSSSGEMMMMMMPYNNDQEMSIASTQAVTVTTMKQEICNGREQKVLWGFPWQLNGDTNMGELDSGRASNWNGINSSWHGLLNSPLM

SEQ ID NO: 1973 - protein, 283 aa, Pisum sativum
  misc_feature (32)..(94): Pfam Name: zf-Dof Pfam Description: Dof domain, zinc finger
  misc_feature (1)..(283): Public GI ID no. 6092016
  misc_feature (1)..(283): Bit score of 373.2 for HMM based on sequences of Figure 27
  misc_feature (1)..(283): Functional Homolog Of SEQ ID NO. 1955
MDPSSQQMSRQSSMENMLVCSKEQQESKPKPQPEQALKCPRCDSTNTKFCYYNNYSLTQPRYFCKSCRRYWTKGGTLRNVPVGGGCRKNKRSSSSKRIQDQAFAPNHNPFSNLPHFDQSNDFALRLARLQKQSCGGQMGYDENELSMLGNSGSSMNQSMSINHGFMDAIRSGLFLGNGMHYNNSVQNMYGGGYGNGDNGEVNSGNNNCGVSEEMMFNYDQEMSHCNAAINMKQEQSESRVFGGFPWQINGGIGNMGEVEQARASWNNGFTTPSWQGLLHSPLM

SEQ ID NO: 1974 - protein, 472 aa, Hordeum vulgare subsp. vulgare
  misc_feature (146)..(208): Pfam Name: zf-Dof Pfam Description: Dof domain, zinc finger
  misc_feature (1)..(472): Public GI ID no. 20372847
  misc_feature (1)..(472): Bit score of 302.2 for HMM based on sequences of Figure 27
  misc_feature (1)..(472): Functional Homolog Of SEQ ID NO. 1955
MTYGGERRGSNPTTVIHKTFLPLPLFRVLETTSSSCSSPSFPRPYFSPPVHSAAGEDFRRRAREAIGIDPWMDAAQWHQGLGLVKPMEEMIMAGNPNPNPNGNPSPQPAPPSGAEAQRAPLPGPPAAGAGAAAGTGSTERKAARPQKEKAINCPRCNSTNTKFCYYNNYSLQQPRYFCKTCRRYWTEGGSLRNVPVGGGSRKNKRSSSSVVSSAAGAVSTSGAASGTVPVGGMPAKNPKLMHEGAHDLNLAFPHHHGRVLHPSEFAAFPSLESSSVCNPGGAMAANGVGGGRGMGTFSAMELLRSTGCYVPLPQVQLGMPPEYAAAGFALGEFRMPLQHQQQHHQQQQQQQQQHHQHQHQHQQHQQQQQQQQVQNMLGFSLDTGGGGDGGGYGGGLQGAQESATGRMLFPFEDLKPGANAAGGGGASGGDQFEHSKEQGGGGGHETLGFWNNSMIGNGSSNDAGGGGGGGSW

SEQ ID NO: 1975 - protein, 472 aa, Hordeum vulgare subsp. vulgare
  misc_feature (146)..(208): Pfam Name: zf-Dof Pfam Description: Dof domain, zinc finger
  misc_feature (1)..(472): Public GI ID no. 20372895
  misc_feature (1)..(472): Bit score of 302.2 for HMM based on sequences of Figure 27
  misc_feature (1)..(472): Functional Homolog Of SEQ ID NO. 1955
MTYGGERRGSNPTTVIHKTFLPLPLFRVLETTSSSCSSPSFPRPSFSPPVHSAAGEDFRRRAREAIGIDPWMDAAQWHQGLGLVKPMEEMIMAGNPNPNPNGNPSPQPAPPSGAEAQRAPLPGPPAAGAGAAAGTGSTERKAARPQKEKAINCPRCNSTNTKFCYYNNYSLQQPRYFCKTCRRYWTEGGSLRNVPVGGGSRKNKRSSSSVVSSAAGAVSTSGAASGTVPVGGMPAKNPKLMHEGAHDLNLAFPHHHGRVLHPSEFAAFPSLESSSVCNPGGAMAANGVGGGRGMGTFSAMELLRSTGCYVPLPQVQLGMPPEYAAAGFALGEFRMPLQHQQQHHQQQQQQQQQHHQHQHQHQQHQQQQQQQQVQNMLGFSLDTGGGGDGGGYGGGLQGAQESATGRMLFPFEDLKPGANAAGGGGASGGDQFEHSKEQGGGGGHETLGFWNNSMIGNGSSNDAGGGGGGGSW

SEQ ID NO: 1976 - protein, 360 aa, Oryza sativa subsp. japonica
  misc_feature (55)..(117): Pfam Name: zf-Dof Pfam Description: Dof domain, zinc finger
  misc_feature (1)..(360): Public GI ID no. 38344272
  misc_feature (1)..(360): Bit score of 438.9 for HMM based on sequences of Figure 27
  misc_feature (1)..(360): Functional Homolog Of SEQ ID NO. 1955
MLMAANAAAGANPNPAATAPSSVTGGALRGGGGGGAPPVAGGAGAGSTERRARPQKEKALNCPRCNSTNTKFCYYNNYSLQQPRYFCKTCRRYWTEGGSLRNVPVGGGSRKNKRSSSSAASASPASASTANSVVTSASMSMSMASTGGGASKNPKLVHEGAQDLNLAFPHHGGLQAPGEFPAFPSLESSSVCNPGGPMGTNGRGGGALSAMELLRSTGCYMPLQVPMQMPAEYATPGFALGEFRAPPPPPQSSQSLLGFSLDAHGSVGGPSAAGFGSSAGLQGVPESTGRLLFPFEDLKPTVSSGTGGGGASGGGAGVDGGHQFDHGKEQQAGGGGGGPGGHDTPGFWNGMIGGGSGTSW

SEQ ID NO: 1977 - DNA, 1616 bp, Triticum aestivum
  misc_feature (1)..(1616): Ceres Clone ID no. 738478
  misc_feature (1)..(1616): Encodes the peptide sequence at SEQ ID NO. 1978
ataggagggacaattccactcactgcccaaccacagcgccttcctcctctctctcccctccatccgctcaagaaatctaccagaagcagctcagcaagccgcaggagctcctcttcgtcttccggccgtcgtcctcctcctggtattcagatttctggggaaagaattgtttgggaggtagcctggcgattggagccttcgcatggatgcagcccactggccccaggggctagggctggtgaagccaatggaggagatgctgatgggagcaccaagctcgaaccagcaggtgcaaggctcaaatccgaatccaccggcgcaggccccgtcgtcggcgcctggggctggaggccccatgaggggcgggacgccggccatggcagtggcagcctccggggttggagcgggtagcacggagcggcggccgcggccgcagaaggagaaggcgatcaactgtccccggtgcaactccaccaacaccaagttctgctactacaacaactacagcctccagcagccgcgctacttctgcaagacgtgccgccggtactggacggaaggcgggtcgctgcgcaacgtccccgtcggcggcggctcccgcaagaacaagcgctcttcgtcgtcgtccgcgtcagcgagcgcctcagcggctgcctcggcgactgcgtccgtcgcgaactcgtccatgctcggggcggcgccgaacaagaacccgaagctggcgcacgagggcgcagcgcacgacctgaacctcgcgttcccgcaccaccaaggcgggatgcaggcgcaggcggactacatggcgttcccgagcctggagagcagcagcatgtgcaacccgggcggcggcggaatggcggccaatggcgcccgtgccggtggcgcgctctccgcgatggagctgctccggagcaccggctgctatatgccgctgcagatgccgatgcagatgcccggggagtacggcgccgcggggttctcgctcggggagttccgcgcgccggcgccaccgcagtcgcagagcttgctaggcttctcgctggacgcgcacggttcggtgggcggggcttccatggcggggtacggctccggtgccgggatgcaagggatgcaggacaggtcgggcaggttgctgttcgcgttcgaggacttgaagccgacggcaaactctggcgccggtggcggtgagagcggtggtggttctggcgcaggcgtggatggcggcgaccatcagttcgagcaaggcaacaaggagcaacaaggcaacggcacccccgttgggcagcccgacacgccggggttctggaacggcatgatcggcggcggcggcacctggtaacgtggacggcggcgcccatgcatgcatagttcatcgtcggctgtgcgtgcatgcatgcgcttccaagctgcagctggagatagggcacaaaggtttaataagatggtggatatggtgtttgatatctttctttctttctttctttctggtgttcttgttcttcttcttcttcttccttggaattgtgctctagccgtttatttgtgtttggtgatcgacttgggggctagctagctctaacacatcagactatcagagtatacagcattttaatccc

SEQ ID NO: 1978 - protein, 378 aa, Triticum aestivum
  misc_feature (78)..(140): Pfam Name: zf-Dof Pfam Description: Dof domain, zinc finger
  misc_feature (1)..(378): Ceres Clone ID no. 738478
  misc_feature (1)..(378): Bit score of 436.5 for HMM based on sequences of Figure 27
  misc_feature (1)..(378): Functional Homolog Of SEQ ID NO. 1955
MDAAHWPQGLGLVKPMEEMLMGAPSSNQQVQGSNPNPPAQAPSSAPGAGGPMRGGTPAMAVAASGVGAGSTERRPRPQKEKAINCPRCNSTNTKFCYYNNYSLQQPRYFCKTCRRYWTEGGSLRNVPVGGGSRKNKRSSSSSASASASAAASATASVANSSMLGAAPNKNPKLAHEGAAHDLNLAFPHHQGGMQAQADYMAFPSLESSSMCNPGGGGMAANGARAGGALSAMELLRSTGCYMPLQMPMQMPGEYGAAGFSLGEFRAPAPPQSQSLLGFSLDAHGSVGGASMAGYGSGAGMQGMQDRSGRLLFAFEDLKPTANSGAGGGESGGGSGAGVDGGDHQFEQGNKEQQGNGTPVGQPDTPGFWNGMIGGGGTW

SEQ ID NO: 1979 - DNA, 573 bp, Arabidopsis thaliana
  misc_feature (1)..(573): Ceres Clone ID no. 11830
  misc_feature (1)..(573): Ceres SEED LINE ID no. CW00264
  misc_feature (1)..(573): Encodes the peptide sequence at SEQ ID NO. 1980
aaacttcctaactagatagatcagatctggatctctctgcaccactcattgccttctctagaaacatgtcaactttcttgataaggatacttcttcctttgcttatcatagcaatgactcttcctcgacgttcagaggcagagtcggaacaatggtgcatagcggatgaacaaacgccagacgatgagttgcaagcagccttagactgggcttgcggaaaaggtggagcagactgcagcaaaatgcagcaggaaaaccagccttgcttcttgcctaacacaatcagagatcatgcctcctttgctttcaacagttactaccaaacttataaaaacaaaggtggttcttgttacttcaaaggagctgccatgatcactgagcttgaccccagccatggttcttgccagtatgagtataacccctgattcaaacgacacagcaaagacaagatacagcaagatgaaaagctatgattttgcatttatacgttttctctatgtaatgttttcattccaaagcagtatccatgtactgttctcccattacactccagtctgagataaaaatttcttc

SEQ ID NO: 1980 - protein, 119 aa, Arabidopsis thaliana
  misc_feature (29)..(115): Pfam Name: X8 Pfam Description: X8 domain
  misc_feature (1)..(119): Ceres SEED LINE ID no. CW00264
  misc_feature (1)..(119): Ceres Clone ID no. 11830
  misc_feature (1)..(119): Bit score of 332.4 for HMM based on sequences of Figure 34
  misc_feature (1)..(119): in Figure 34
MSTFLIRILLPLLIIAMTLPRRSEAESEQWCIADEQTPDDELQAALDWACGKGGADCSKMQQENQPCFLPNTIRDHASFAFNSYYQTYKNKGGSCYFKGAAMITELDPSHGSCQYEYNP

SEQ ID NO: 1981 - DNA, 354 bp, Populus balsamifera subsp. trichocarpa
  misc_feature (1)..(354): Ceres Annot ID no. 1472114
  misc_feature (1)..(354): Encodes the peptide sequence at SEQ ID NO. 1982
atgccaatcctttggaaaaggacaatgctagcccttcttatcctgtccatagctcctaggaaatcagatggggagttagagcaatggtgcatagcagatgagcagaccccagatgatgagttgcagatagcattggactgggcttgtgggaaaggtggtgcagactgcagtaagattcaagtgaaccagccttgctatttgccaaatactgtgagagaccatgcttcctatgccttcaacaactacttccagaagttcaagcacaaaggtggatcttgctacttcaaaggagctgctatcattacagaacttgaccccagtcatagctcttgccagtacgagttccatccctga

SEQ ID NO: 1982 - protein, 117 aa, Populus balsamifera subsp. trichocarpa
  misc_feature (28)..(113): Pfam Name: X8 Pfam Description: X8 domain
  misc_feature (1)..(117): Ceres Annot ID no. 1472114
  misc_feature (1)..(117): Bit score of 337.4 for HMM based on sequences of Figure 34
  misc_feature (1)..(117): Functional Homolog Of SEQ ID NO. 1980
  misc_feature (1)..(117): in Figure 34
MPILWKRTMLALLILSIAPRKSDGELEQWCIADEQTPDDELQIALDWACGKGGADCSKIQVNQPCYLPNTVRDHASYAFNNYFQKFKHKGGSCYFKGAAIITELDPSHSSCQYEFHP

SEQ ID NO: 1983 - DNA, 458 bp, Glycine max
  misc_feature (1)..(458): Ceres Clone ID no. 1058242
  misc_feature (1)..(458): Encodes the peptide sequence at SEQ ID NO. 1984
aacaaagcctctcttatctttttcaccaaaaatggcaacattcatgctgaagttggtgcttcctctacttttcctgttcatgattcctccgaaaacagcgtatgcggagtttgagcaatggtgtgtagctgatgagcagaccacggagtctgagttgcaggcagccttggattgggcttgtgggaaagggggtgcagattgtagcaaaattcaagtaaaccaaccttgctatttaccaaacacattgaaagaccatgcttcttatgccttcaacagctactatcagaagttcaagcacagtggaggttcttgctacttcagaggagctgccataacaacagaagtggatcctagtcatggttcttgtcactatgatttcattccctgatgacaaccgtgaatgaagacttaaaataactgcagcaaaaactagagctcgtgcctttgtgtgtttgtgt

SEQ ID NO: 1984 - protein, 118 aa, Glycine max
  misc_feature (29)..(114): Pfam Name: X8 Pfam Description: X8 domain
  misc_feature (1)..(118): Ceres Clone ID no. 1058242
  misc_feature (1)..(118): Bit score of 329.4 for HMM based on sequences of Figure 34
  misc_feature (1)..(118): Functional Homolog Of SEQ ID NO. 1980
  misc_feature (1)..(118): in Figure 34
MATFMLKLVLPLLFLFMIPPKTAYAEFEQWCVADEQTTESELQAALDWACGKGGADCSKIQVNQPCYLPNTLKDHASYAFNSYYQKFKHSGGSCYFRGAAITTEVDPSHGSCHYDFIP

SEQ ID NO: 1985 - protein, 153 aa, Vitis vinifera
  misc_feature (28)..(109): Pfam Name: X8 Pfam Description: X8 domain
  misc_feature (1)..(153): Public GI ID no. 147772269
  misc_feature (1)..(153): Bit score of 317.6 for HMM based on sequences of Figure 34
  misc_feature (1)..(153): Functional Homolog Of SEQ ID NO. 1980
  misc_feature (1)..(153): in Figure 34
MPIALLRIVLGLLLLVSTGTKSAGEFEQWCIADEQTPDDELQAGIDWACGEGGADCSKIQVNKPCYLPNTVRDHASYAFNNYYQKFKNKGGTCYFNGAAMITELDPITFGMAKSHTADQIIESDLDQSHQRWHHSHLTWYFFCKYSMFVQATP

SEQ ID NO: 1986 - protein, 123 aa, Picea sitchensis
  misc_feature (34)..(119): Pfam Name: X8 Pfam Description: X8 domain
  misc_feature (1)..(123): Public GI ID no. 116784922
  misc_feature (1)..(123): Bit score of 323.6 for HMM based on sequences of Figure 34
  misc_feature (1)..(123): Functional Homolog Of SEQ ID NO. 1980
  misc_feature (1)..(123): in Figure 34
MATTTATILWPLPLLLVLMIFVSAANLTEGAVAQWCIADPQAPDDMLQSALDWVCGYGGADCSKTQPNQECFLPDNLASHASIAFNSYWQKLKHQGASCYFDSAALVTESDPSHDGCEYDFVA

SEQ ID NO: 1987 - DNA, 390 bp, Populus balsamifera subsp. trichocarpa
  misc_feature (1)..(390): Ceres Annot ID no. 1525524
  misc_feature (1)..(390): Encodes the peptide sequence at SEQ ID NO. 1988
atgccaatcctttggaaaaggacaatgctagcccttcttatcctgtccatagctcctaggaaatcagatggggagttagagcaatggtgcatagcagatgagcagaccccagatgatgagttgcagatagcattggactgggcttgtgggaaaggtggtgcagactgcagtaagattcaagtgaaccagccttgctatttgccaaatactgtgagagaccatgcttcctatgccttcaacaactacttccagaagttcaagcacaaaggtggatcttgctacttcaaaggagctgctatcattacagaacttgaccccagtaagcacttgctaagctttttttttttttttaatttttttatctctagttatttctcgacttgtttttaa

SEQ ID NO: 1988 - protein, 129 aa, Populus balsamifera subsp. trichocarpa
  misc_feature (28)..(110): Pfam Name: X8 Pfam Description: X8 domain
  misc_feature (1)..(129): Ceres Annot ID no. 1525524
  misc_feature (1)..(129): Bit score of 305.2 for HMM based on sequences of Figure 34
  misc_feature (1)..(129): Functional Homolog Of SEQ ID NO. 1980
MPILWKRTMLALLILSIAPRKSDGELEQWCIADEQTPDDELQIALDWACGKGGADCSKIQVNQPCYLPNTVRDHASYAFNNYFQKFKHKGGSCYFKGAAIITELDPSKHLLSFFFFFNFFISSYFSTCF

SEQ ID NO: 1989 - DNA, 357 bp, Populus balsamifera subsp. trichocarpa
  misc_feature (1)..(357): Ceres Annot ID no. 1453309
  misc_feature (1)..(357): Encodes the peptide sequence at SEQ ID NO. 1990
atgtcaccaaattttccaaggattcttctcctagctctgtccttccatgctttaatgctgcaaaaatcagagggtcaatttgaggaatggtgcatagctgatgagcaaacaccagatgatgagttgcaaagggccatggactgggcatgtgggaagggaggtgcagattgcagcaagattcaaatgaatcaaccttgttatatgccaaatacaataagggatcatgcctcttatgccttcaatgattattaccagaagtttaagcataaaggagcaacttgttacttcaacgctgctgctctcatcaccgatcttgatccaagtcagcactcttgcaaatttgattatcttccctga

SEQ ID NO: 1990 - protein, 118 aa, Populus balsamifera subsp. trichocarpa
  misc_feature (29)..(114): Pfam Name: X8 Pfam Description: X8 domain
  misc_feature (1)..(118): Ceres Annot ID no. 1453309
  misc_feature (1)..(118): Bit score of 260.8 for HMM based on sequences of Figure 34
  misc_feature (1)..(118): Functional Homolog Of SEQ ID NO. 1980
MSPNFPRILLLALSFHALMLQKSEGQFEEWCIADEQTPDDELQRAMDWACGKGGADCSKIQMNQPCYMPNTIRDHASYAFNDYYQKFKHKGATCYFNAAALITDLDPSQHSCKFDYLP

SEQ ID NO: 1991 - protein, 119 aa, Populus balsamifera subsp. trichocarpa
  misc_feature (30)..(115): Pfam Name: X8 Pfam Description: X8 domain
  misc_feature (1)..(119): Public GI ID no. 118481810
  misc_feature (1)..(119): Bit score of 260.8 for HMM based on sequences of Figure 34
  misc_feature (1)..(119): Functional Homolog Of SEQ ID NO. 1980
MMSPNFPRILLLALSFHALMLQKSEGQFEEWCIADEQTPDDELQRAMDWACGKGGADCSKIQMNQPCYMPNTIRDHASYAFNDYYQKFKHKGATCYFNAAALITDLDPSQHSCKFDYLP

SEQ ID NO: 1992 - DNA, 375 bp, Arabidopsis thaliana
  misc_feature (1)..(375): Ceres Annot ID no. 826234
  misc_feature (1)..(375): Encodes the peptide sequence at SEQ ID NO. 1993
atggggtatcttatttttgtagcgaaagcggagttcggacaatggtgtgtagccgatggacagataccagataatgtgatacaagcagccgtagactgggcttgtcaaacaggtggagcagactgcagtacgattcagcctaaccagccttgcttcttgcccaacactgtcaaggaccatgcctctgttgtcttcaataactattaccagcgttataagcgcaacggcggttcctgtaacttcaacagcactgcatttatcacacaaaccgaccctagtaagcaactttatctaaaccctttttgttacagttatttaagctctttgatcaatcaaaatcttgaaccatctgtttctgattatctcatgatttga

SEQ ID NO: 1993 - protein, 124 aa, Arabidopsis thaliana
  misc_feature (14)..(104): Pfam Name: X8 Pfam Description: X8 domain
  misc_feature (1)..(124): Ceres Annot ID no. 826234
  misc_feature (1)..(124): Bit score of 163.0 for HMM based on sequences of Figure 34
  misc_feature (1)..(124): Functional Homolog Of SEQ ID NO. 1980
MGYLIFVAKAEFGQWCVADGQIPDNVIQAAVDWACQTGGADCSTIQPNQPCFLPNTVKDHASVVFNNYYQRYKRNGGSCNFNSTAFITQTDPSKQLYLNPFCYSYLSSLINQNLEPSVSDYLMI

SEQ ID NO: 1994 - DNA, 915 bp, Populus balsamifera subsp. trichocarpa
  misc_feature (1)..(915): Ceres Annot ID no. 1466045
  misc_feature (1)..(915): Encodes the peptide sequence at SEQ ID NO. 1995
atgggttctggaggaggtcttcaatatttctcaatcttcctcttgtacctgtctctctattcaggtcatccaagtgttgctggaacgcctactttggaatcaatccagaaacataaaatagtaggcgaccaagaaaacaggatgctcatctcacacgcagtgtccaccacccaactagacacaattacaggaggggttcccgtcatcaatccaacaactcctggaacaactcctatagtaaatccagtagactctcctccggcatcaactggaatcagcccaatacctacgacgcccccagctggtataaatccagtagactctcctccggcaccaattggaatcagcccaatacctacgacgcccccagctggtataatgaccccagtcactccgaaccccccggcttccacaaatccaacctcttcaggagggcaatggtgcattgcaagcaccattgcttcacaaaccgccttgcaggtagctattgactacgcttgtggctttggtggggcagactgttctgcaattcaacctggttcaggttgttataatccaaacaccctccgcgatcatgcttcatatgccttcaatagctactaccagaagaatccaggttccacaagctgcgtttttggcggaacagcacaacttaccaacaccgatccaagtaatggaaactgtcactatgaatcgtcatccacgacaacaccaagcacaagctcaccagttaacccgaccccaactatgacgactcccgcaacaaccagcttccctgatggaccaccagcagtttatggcgtggcagaaccaaccggcgagcccagctcagccacctctatttcatgcagtttactgctcctctattccacaactgctattgtggggtttcttgttgctacaaaacatctctga

SEQ ID NO: 1995 - protein, 178 aa, Populus balsamifera subsp. trichocarpa
  misc_feature (20)..(104): Pfam Name: X8 Pfam Description: X8 domain
  misc_feature (1)..(178): Ceres Annot ID no. 1466045
  misc_feature (1)..(178): Bit score of 114.1 for HMM based on sequences of Figure 34
  misc_feature (1)..(178): Functional Homolog Of SEQ ID NO. 1980
MTPVTPNPPASTNPTSSGGQWCIASTIASQTALQVAIDYACGFGGADCSAIQPGSGCYNPNTLRDHASYAFNSYYQKNPGSTSCVFGGTAQLTNTDPSNGNCHYESSSTTTPSTSSPVNPTPTMTTPATTSFPDGPPAVYGVAEPTGEPSSATSISCSLLLLYSTTAIVGFLVATKHL

SEQ ID NO: 1996 - DNA, 412 bp, Glycine max
  misc_feature (1)..(412): Ceres Clone ID no. 1248956
  misc_feature (1)..(412): Encodes the peptide sequence at SEQ ID NO. 1997
aaaactccctcaatataacaactttctccaatggcagcaccaaagctggttcctttattgttattactaaccataataacaacaacgaagaatgtgttgggtcaaggaggaacagcgagctggtgtgtagcgaggagtgacgccagcagcgacgcactgcaaacggcgttggactatgcttgtggggccggtggggattgtcttcctcttcaaccagatggactctgttttctccctaacaccattcaagctcacgcttcttatgccttcaacagctactaccagcgcaggaccagagctcctggttcatgtgattttgctgccactgccaccattgccactagtgatcccagctatggatcttgtgtttacccttcttctgcaagagacggcatggaaccccgaagaatgg

SEQ ID NO: 1997 - protein, 127 aa, Glycine max
  misc_feature (30)..(114): Pfam Name: X8 Pfam Description: X8 domain
  misc_feature (1)..(127): Ceres Clone ID no. 1248956
  misc_feature (1)..(127): Bit score of 124.5 for HMM based on sequences of Figure 34
  misc_feature (1)..(127): Functional Homolog Of SEQ ID NO. 1980
MAAPKLVPLLLLLTIITTTKNVLGQGGTASWCVARSDASSDALQTALDYACGAGGDCLPLQPDGLCFLPNTIQAHASYAFNSYYQRRTRAPGSCDFAATATIATSDPSYGSCVYPSSARDGMEPRRM

SEQ ID NO: 1998 - DNA, 884 bp, Glycine max
  misc_feature (1)..(884): Ceres Clone ID no. 1650911
  misc_feature (1)..(884): Encodes the peptide sequence at SEQ ID NO. 1999
attttttctctaaacacttctctctctctctctctctctctccacctttaccaaccaagcaaagcaaaacaatcacagctatagctagcaaactccctcaatataacaactttctccaatggcagcaccaaagctggttcctttattgttattactaaccataataacaacaacgaagaatgtgttgggtcaaggaggaacagcgagctggtgtgtagcgaggagtgacgccagcagcgacgcactgcaaacggcgttggactatgcttgtggggccggtggggattgtcttcctcttcaaccagatggactctgttttctccctaacaccattcaagctcacgcttcttatgccttcaacagctactaccagcgcaggaccagagctcctggttcatgtgattttgctgccactgccaccattgccactagtgatcccagctatggatcttgtgtttacccttcttctgcaagtgctgctggaggaccaaatacaccaaccacaacacctccaatgaacaacccaaatgtgcctacatctaccacaacaacaccaatctttggtgggggcaacactggtggactaactcctggaatgagcactccattcccagacagttctagagcacattcagaggcaacagcaacatggtttttagctttatgttcctctcttattatattcattatctcttagcctatgtaagatcttggaccaggcttacagttttgtcagaagttgaaagcggcgagcctttgttgtttataaccttattttatgcaactacctcttatatcccccactattttaatttataaggttatgaacatgttaagcatggcaaacatggtttattcaggaaagagcagagctaggttgtagc

SEQ ID NO: 1999 - protein, 192 aa, Glycine max
  misc_feature (30)..(114): Pfam Name: X8 Pfam Description: X8 domain
  misc_feature (1)..(192): Ceres Clone ID no. 1650911
  misc_feature (1)..(192): Bit score of 124.5 for HMM based on sequences of Figure 34
  misc_feature (1)..(192): Functional Homolog Of SEQ ID NO. 1980
MAAPKLVPLLLLLTIITTTKNVLGQGGTASWCVARSDASSDALQTALDYACGAGGDCLPLQPDGLCFLPNTIQAHASYAFNSYYQRRTRAPGSCDFAATATIATSDPSYGSCVYPSSASAAGGPNTPTTTPPMNNPNVPTSTTTTPIFGGGNTGGLTPGMSTPFPDSSRAHSEATATWFLALCSSLIIFIIS

SEQ ID NO: 2000 - DNA, 690 bp, Populus balsamifera subsp. trichocarpa
  misc_feature (1)..(690): Ceres Annot ID no. 1495956
  misc_feature (1)..(690): Encodes the peptide sequence at SEQ ID NO. 2001
atgttagcagatgagaatagtagacaggcagaccatggaacaaaacaagttgtcgtggatgcgagttctatttccagtacccgaaaggacatcaccaccccgataacaactgttcccacaataattcccaccactcccactgcttcaactccagtaataaacccaaattctgagcctgattccacatcgcctgctaccatgacaccaatggtaaccccaacctcaacggcatcacctgtatctcccggagctagctggtgtatcgctagccaaagtgcatcaccaacagcgttacaagttgctttggactatgcttgtggctatggtggtgctgattgctcagcaattcagccaagtggaagctgttacaatccaaatactctccgtgatcatgcctcttatgcattcaacagctattatcagaagaatccagtgcccagtagctgtaattttggaggaactgctgttactactagcaccaatccaagtacggggacatgtcaatttccctccacaagcacaagctcatcaatcttgaacaccacaaattcaaatggagcaactgtttatggtgcagtcccttcaaatcctaccccatcggtagctgccagaattaacgagacaccacattttatgtctgtgacatttctcatcgtgtttctggctcaattaacatcttctctgtgctag

SEQ ID NO: 2001 - protein, 160 aa, Populus balsamifera subsp. trichocarpa
  misc_feature (16)..(100): Pfam Name: X8 Pfam Description: X8 domain
  misc_feature (1)..(160): Ceres Annot ID no. 1495956
  misc_feature (1)..(160): Bit score of 103.6 for HMM based on sequences of Figure 34
  misc_feature (1)..(160): Functional Homolog Of SEQ ID NO. 1980
MVTPTSTASPVSPGASWCIASQSASPTALQVALDYACGYGGADCSAIQPSGSCYNPNTLRDHASYAFNSYYQKNPVPSSCNFGGTAVTTSTNPSTGTCQFPSTSTSSSILNTTNSNGATVYGAVPSNPTPSVAARINETPHFMSVTFLIVFLAQLTSSLC

SEQ ID NO: 2002 - DNA, 683 bp, Panicum virgatum
  misc_feature (1)..(683): Ceres Clone ID no. 2008765
  misc_feature (1)..(683): Encodes the peptide sequence at SEQ ID NO. 2003
atctgtctggccatggcgtggtgggccaaatgagaaggctgctactgttgataatgctttggcctacaatacaaacctcatacgtcatgtactgaataattctggtacacccagccaaccaatgaatcagtcaagcacctacatctttgagctattcaatgaggatcttcgctcaggacctgaatcggagaaaagttgggggattatgtttcctaacgcaaccactgtgtactctctatcatttgaggatgtggccacaactatcccagaatcaccggccctgcgtggaatgttttgtgtggcaaattctagtgcaccccatagtgcacttaagcatagtttggattgggcatgtggccctggctctgcaaactgcagtgcaattcagcctgggcaaccatgctatgaatcagataacattgtagctgttgcatcatatgctttcaatgattattatcatagaacacaagctagtggtggcacgtgcagctttaatggcactgcaatgataacatctactgatccaagccatggctcatgcattttcgctggaagcactggcgccaacagcgatggtggtacagcctccgggcccgtaagccctgacagttttgcttcgagatcccaatcctgctggttgactcacctagcagctgcattgttgctcattctagtggtgtaaa

SEQ ID NO: 2003 - protein, 186 aa, Panicum virgatum
  misc_feature (57)..(142): Pfam Name: X8 Pfam Description: X8 domain
  misc_feature (1)..(186): Ceres Clone ID no. 2008765
  misc_feature (1)..(186): Bit score of 101.0 for HMM based on sequences of Figure 34
  misc_feature (1)..(186): Functional Homolog Of SEQ ID NO. 1980
MNQSSTYIFELFNEDLRSGPESEKSWGIMFPNATTVYSLSFEDVATTIPESPALRGMFCVANSSAPHSALKHSLDWACGPGSANCSAIQPGQPCYESDNIVAVASYAFNDYYHRTQASGGTCSFNGTAMITSTDPSHGSCIFAGSTGANSDGGTASGPVSPDSFASRSQSCWLTHLAAALLLILVV

SEQ ID NO: 2004 - DNA, 783 bp, Zea mays
  misc_feature (1)..(783): Ceres Clone ID no. 100817949
  misc_feature (1)..(783): Encodes the peptide sequence at SEQ ID NO. 2005
gagcacctacatctttgagctgttcaacgaggataatcggtcagggcctgtatcagagcaaaattgggggatcatgtttcccaatgcaaccactatatactctctatcatttgaggacgtggccacaactattcctgaatcaccagctttacgtggggtgttttgtgttgcaaatccaagtgcaccccatagtgcactgaagcatagtttggattgggcatgtggccctggttctgcaaactgcagtgcaattcaacctgggaaaccatgctatgcatcagatgatattgtagctgttgcttcttatgctttcaatgattattaccatagaacacagtctagtggcggtacatgcaacttcaacggcaccgcaatgataacatcaactgatccaagccatggttcatgcgttttcgctggaagcactggcgccaacggcggaacggcctctgggcctgtaagcccagacagttttgcttcaaaatccaaaacctgctggttgactcacctagtagccacattgttgctgcccattctatttgtagtgatgtaaaacattgtaaccatgtcacattttggatgagatgcccgcaatttatcgtggatcttgtcattagatactgtagtgactagtgacccatttgggtctgctgtattcaggtagatgccatgtaatcttatcccaagatttgttggcctaggaatcagtatttcgtcaaatcatcaattttgactgtcaactcggaaaattgagctgtgacaatccgagacctctctgaaatg

SEQ ID NO: 2005 - protein, 183 aa, Zea mays
  misc_feature (53)..(138): Pfam Name: X8 Pfam Description: X8 domain
  misc_feature (1)..(183): Ceres Clone ID no. 100817949
  misc_feature (1)..(183): Bit score of 100.2 for HMM based on sequences of Figure 34
  misc_feature (1)..(183): Functional Homolog Of SEQ ID NO. 1980
STYIFELFNEDNRSGPVSEQNWGIMFPNATTIYSLSFEDVATTIPESPALRGVFCVANPSAPHSALKHSLDWACGPGSANCSAIQPGKPCYASDDIVAVASYAFNDYYHRTQSSGGTCNFNGTAMITSTDPSHGSCVFAGSTGANGGTASGPVSPDSFASKSKTCWLTHLVATLLLPILFVVM

SEQ ID NO: 2006 - DNA, 910 bp, Zea mays
  misc_feature (1)..(910): Ceres Clone ID no. 100821842
  misc_feature (1)..(910): Encodes the peptide sequence at SEQ ID NO. 2007
aaggagcgcgagaaggagatcctcgtcccctcccgcccccgtacgtctcccctccatcttccattcttccacatatccccacacaattgccgtctcgctccacattcccttcgcaccacctttcccctctctctctccctctctctccctctctcactcgctctttctccggggccgccattcctgctccgtccactcccaccacatgcggcggcgcgggcgcctccccgcggcgctgtggctcgttgtcgtgacgttggcggcgctggtggcgcgacctgcgtgtgcggcgtggtgcatcgcgcggagcgaggcctcggacaaggcgctgcagtcggcgctggactatgcgtgcggccccgcgaggggtgccgactgcgcgcccatccaggccagcggcytctgctacctgcccaacaccctcgccgcgcatgcytcttacgccttcaactccatcttccagcgctcccgcgccgcgccgggggcctgcgayttcgccggcaccgccaccgtcacggtcacggaccctagttatggatcatgcacctacccttcatctccaagcactgccgggcaaacaggatcacctggttcaacgtccatgccagggactcccacgtccttgtcgccaaaaggcaccgggagcactggaggattaaatccacctgacgtcgattcgaccgactccaatgttaaacctctggcgaccacatccctcccatctcttgttctgtcctgtttcatgtatattttcttgcagttgtggtgatgcatggatgatctagttaggttcagtagagcattgagatgcagcattgttgcatcgtgatttaagagacaccacaacagttttgtttcagggaattggttggttggtggtagccgttgtaacctgccgttcaagtgaaag

SEQ ID NO: 2007 - protein, 187 aa, Zea mays
  misc_feature (29)..(115): Pfam Name: X8 Pfam Description: X8 domain
  misc_feature (1)..(187): Ceres Clone ID no. 100821842
  misc_feature (1)..(187): Bit score of 112.9 for HMM based on sequences of Figure 34
  misc_feature (1)..(187): Functional Homolog Of SEQ ID NO. 1980
  misc_feature (66)..(66): Xaa is any aa, unknown, or other
  misc_feature (77)..(77): Xaa is any aa, unknown, or other
  misc_feature (96)..(96): Xaa is any aa, unknown, or other
MRRRGRLPAALWLVVVTLAALVARPACAAWCIARSEASDKALQSALDYACGPARGADCAPIQASGXCYLPNTLAAHXSYAFNSIFQRSRAAPGACXFAGTATVTVTDPSYGSCTYPSSPSTAGQTGSPGSTSMPGTPTSLSPKGTGSTGGLNPPDVDSTDSNVKPLATTSLPSLVLSCFMYIFLQLW

SEQ ID NO: 2008 - DNA, 722 bp, Panicum virgatum
  misc_feature (1)..(722): Ceres Clone ID no. 2001181
  misc_feature (1)..(722): Encodes the peptide sequence at SEQ ID NO. 2009
ctaccgccgctcttgtcctgacacggagtgaccccgccagccgctgccactgcacagacacacactcctctcccacactctgctcgcatctcttcttcttcttctctctctctagaagaggaacgagcaagcagctgaggtgagccgagcgcaggtgccccatctctctccctccctccctggagttccttgggtgatcttcggtagcggcggaaccatgaaggcgctggtggtggcggtgctgcttctgctctcctccaccctcgccgcgtcacaatggtgcgtgtgcaggcaggatgcgccgcaggcctcgctgcagaagaccatcgactacgcctgcggcgcgggggcggactgcaactccatccatgagaacgggccgtgctacaaccccaacaacgtccccgcgcactgctcctgggcggccaacagctactaccagaacaacaaggccaagggcgccacctgcgacttcaccggcaccgccaccctcaccaccagcgatccaagttcttctggctgctctttccctacaagtgcaaggtacattgtgcacttcacttaaattaactgtataccatgatccatgaagttacttactactgccactacggactggttgagtagtcattcatatttcgaaattgtgcattttcggaactggcaccccatgaaacctatgcatcatcttgaatcagatcttttgtaatgtagtaaattct

SEQ ID NO: 2009 - protein, 115 aa, Panicum virgatum
  misc_feature (20)..(104): Pfam Name: X8 Pfam Description: X8 domain
  misc_feature (1)..(115): Ceres Clone ID no. 2001181
  misc_feature (1)..(115): Bit score of 103.8 for HMM based on sequences of Figure 34
  misc_feature (1)..(115): Functional Homolog Of SEQ ID NO. 1980
MKALVVAVLLLLSSTLAASQWCVCRQDAPQASLQKTIDYACGAGADCNSIHENGPCYNPNNVPAHCSWAANSYYQNNKAKGATCDFTGTATLTTSDPSSSGCSFPTSARYIVHFT

SEQ ID NO: 2010 - DNA, 701 bp, Panicum virgatum
  misc_feature (1)..(701): Ceres Clone ID no. 2030722
  misc_feature (1)..(701): Encodes the peptide sequence at SEQ ID NO. 2011
agagtgaaaagcaggatctgtttcaagttctgtaacctctgcttcagccatgaagaggaaggagctgatgatcgtgcacggccttctgattcttggatggttcatagcctctgcagctggccgcatcgcaccgcaggagaaggcggagtcggtgaccccgataccgacgctgtcgccgccagaaggcaacacgacgttcatcaacggcgtgacgtggtgcgtggcccggccgggcgcctcccaggaggacctccagaacgcgctggactgggcgtgcggccccggcggcgccgactgctcccagctgcagccgggcggccggtgctaccagccgaacacgctcctcacccacgcctcctacgccttcaacatcttctaccagcagaacggcaactccgacatcgcctgcaacttcggcggcgccggagccctcgtcaagcgggacccgagttttggatcatgcaagttcctggcatctgagacttctgcagcagcttcctcggcgatgttgggaagggcgtggacggccatggtcgctgcatctctgatcgcgcttcggctgatagtttaggaattctccattcgtgatgtagacacggtctcttgcgtgaaggttgagggctcacgattcctttgttttggatctcgtaaactatcattatgtttttgtatggctattttattattttatttaatggact

SEQ ID NO: 2011 - protein, 173 aa, Panicum virgatum
  misc_feature (55)..(140): Pfam Name: X8 Pfam Description: X8 domain
  misc_feature (1)..(173): Ceres Clone ID no. 2030722
  misc_feature (1)..(173): Bit score of 107.6 for HMM based on sequences of Figure 34
  misc_feature (1)..(173): Functional Homolog Of SEQ ID NO. 1980
MKRKELMIVHGLLILGWFIASAAGRIAPQEKAESVTPIPTLSPPEGNTTFINGVTWCVARPGASQEDLQNALDWACGPGGADCSQLQPGGRCYQPNTLLTHASYAFNIFYQQNGNSDIACNFGGAGALVKRDPSFGSCKFLASETSAAASSAMLGRAWTAMVAASLIALRLIV

SEQ ID NO: 2012 - DNA, 889 bp, Zea mays
  misc_feature (1)..(889): Ceres Clone ID no. 343585
  misc_feature (1)..(889): Encodes the peptide sequence at SEQ ID NO. 2013
acacacacacacacacacacacacacacacacgggggaggaaagagggccgagtgaaaagcagggacagtcttgcggttttgtaacttgtggttcagccatgaagaggaaggagctggtgatcatgcacggcggcgttttggttcttggttggttcatagcctctgcggtcgccggacgcttggcgccacaggagaaggcagagtcggtgacgccgatcccgacgctgtcgccgccggagggcaacacgacgttcatcgacggcgtgacgtggtgcgtggcccggccgggcgccacccaggaggacctccagagcgcgctggactgggcgtgcgggcccggcggcgccgactgctcccagctgcagccgggcgggcggtgctaccagccggacacgctcctcacccacgcctcctacgccttcaacatcttctaccagcagaacggcaactccgacgtcgcctgcaacttcggcggcgctggagccctcgtcaagcgggacccaagtttcggatcgtgcaagttcttggcgtctgagacatccggggcagcagcctcgtcggcgatgctggacagaagggcgtggatagccatggtcgctgcatctctgatcgccctctggcggagagtttagaaatcctccatcttcctcatatgcttcgcctcatcgagcactgggtgccgccggagaatgctacacgtgacgtgacgcgaaatgagtgcgatggtggtttcttcttgtggttctgtatgtaaggaacggtgctactacctttttcgtgtagaattccttggagaacggatatactactagtaataactagtcgtgtttagacaaaatggcttccacaggagtttgtcaggatttataaaacttttttttgttatac

SEQ ID NO: 2013 - protein, 177 aa, Zea mays
  misc_feature (57)..(142): Pfam Name: X8 Pfam Description: X8 domain
  misc_feature (1)..(177): Ceres Clone ID no. 343585
  misc_feature (1)..(177): Bit score of 109.0 for HMM based on sequences of Figure 34
  misc_feature (1)..(177): Functional Homolog Of SEQ ID NO. 1980
MKRKELVIMHGGVLVLGWFIASAVAGRLAPQEKAESVTPIPTLSPPEGNTTFIDGVTWCVARPGATQEDLQSALDWACGPGGADCSQLQPGGRCYQPDTLLTHASYAFNIFYQQNGNSDVACNFGGAGALVKRDPSFGSCKFLASETSGAAASSAMLDRRAWIAMVAASLIALWRRV

SEQ ID NO: 2014 - DNA, 707 bp, Panicum virgatum
  misc_feature (1)..(707): Ceres Clone ID no. 1869093
  misc_feature (1)..(707): Encodes the peptide sequence at SEQ ID NO. 2015
acacgcacagacacactcctctcccacactctgccgcacctcttcttcttctctgttctctctctctctagaagaggaacaagcagctgaggtgagccgaagccgagcgcagctgccccatctctatccctccctccctggaggtctctcgcgtgctcacagggacaggggcgttcctcggccgggcgagcttcggtagcggcggaccatgaaggcgctggtggtggcggtgctgcttctgctctcctccaccctcgccgcgtcacaatggtgcgtgtgcaggcaggatgcgccgcaggccgcgctgcagaagaccatcgactacgcctgcggcgcgggggcggactgcaactccatccatgagaacgggccgtgctacaaccccaacaacgtccccgcgcactgctcctgggcggccaacagctactaccagaacaacaaggccaagggcgccacctgcgacttcaccggcaccgccactctcaccaccagcgacccaagttcttctggctgctctttcccaacaagtgcaaggtacattgtgaacttcacttaaattaactgtataccatgatccatgaagttacttactactgccactaaggacttgttgagtatttcataccggagtaaatatttcgaaattgtgcattttgggaactggtaccccatgaaacctatgcatcatcttgaatcagatcttttgt

SEQ ID NO: 2015 - protein, 115 aa, Panicum virgatum
  misc_feature (20)..(104): Pfam Name: X8 Pfam Description: X8 domain
  misc_feature (1)..(115): Ceres Clone ID no. 1869093
  misc_feature (1)..(115): Bit score of 103.3 for HMM based on sequences of Figure 34
  misc_feature (1)..(115): Functional Homolog Of SEQ ID NO. 1980
MKALVVAVLLLLSSTLAASQWCVCRQDAPQAALQKTIDYACGAGADCNSIHENGPCYNPNNVPAHCSWAANSYYQNNKAKGATCDFTGTATLTTSDPSSSGCSFPTSARYIVNFT

SEQ ID NO: 2016 - DNA, 1108 bp, Panicum virgatum
  misc_feature (1)..(1108): Ceres Clone ID no. 1790958
  misc_feature (1)..(1108): Encodes the peptide sequence at SEQ ID NO. 2017
cagctgaggtgagccgaagccgagcgcagctgccccatctctatccctccctccctggaggtctctcgcgtgctcacagggacaggggcgttcctcggccgggcgagcttcggtagcggcggaccatgaaggcgctggtggtggcggtgctgcttctgctctcctccaccctcgccgcgtcacaatggtgcgtgtgcaggcaggatgcgccgcaggccgcgctgcagaagaccatcgactacgcctgcggcgcgggggcggactgcaactccatccatgagaacgggccgtgctacaaccccaacaacgtccccgcgcactgctcctgggcggccaacagctactaccagaacaacaaggccaagggcgccacctgcgacttcaccggcaccgccactctcaccaccagcgacccaagttcttctggctgctctttcccaacaagtgcaagcgctgttggaacaatgaccccgactactggaggcacaatgggaggaaccccaggaacaggaaccttcacgcccggtgccggcaccaccggcaccaccggcactggcatgggaaccggcagtactactggaaccactggcactgggttcggtttaggaccagcaggcaccggcgccggtatggacactgcagcggcgggcttgctcccaagggctggtctggtcgccgtcctcaccatgctcttccccgccatcgcattcgcatgacatttgatccctagagacaagtccctactcctactagcagctagtagaaagtacaccacccttttggtaagcttgcttcaggaatgctctgatgatccatggagaaaggaagagaaacctaatgcatcctgtccgaaactccactagcggctgctaggtgtttggtgccgatggggattcatgggtggggtgtcgttttgtttctgtgtgaccacaccatgttcttctgcgtgctctgtaatttggtgggatggctgtctctgtcatgcaaggacgattgtctaccttttatttctgttattaatcatgtaaatgtagggaagccagtaggttagctagaggctggttgcaagagaatgctgctgggacaatgccatggtgtgcttttcatc

SEQ ID NO: 2017 - protein, 196 aa, Panicum virgatum
  misc_feature (20)..(104): Pfam Name: X8 Pfam Description: X8 domain
  misc_feature (1)..(196): Ceres Clone ID no. 1790958
  misc_feature (1)..(196): Bit score of 103.3 for HMM based on sequences of Figure 34
  misc_feature (1)..(196): Functional Homolog Of SEQ ID NO. 1980
MKALVVAVLLLLSSTLAASQWCVCRQDAPQAALQKTIDYACGAGADCNSIHENGPCYNPNNVPAHCSWAANSYYQNNKAKGATCDFTGTATLTTSDPSSSGCSFPTSASAVGTMTPTTGGTMGGTPGTGTFTPGAGTTGTTGTGMGTGSTTGTTGTGFGLGPAGTGAGMDTAAAGLLPRAGLVAVLTMLFPAIAFA

SEQ ID NO: 2018 - DNA, 366 bp, Populus balsamifera subsp. trichocarpa
  misc_feature (1)..(366): Ceres Annot ID no. 1489440
  misc_feature (1)..(366): Encodes the peptide sequence at SEQ ID NO. 2019
atggctgttttagtgcttgcaatactcatgatggccatggctggtcgagcaagctgcacatggtgcgtttgcaaggaaatgggcaccccagtcctccagcagactctagactatgcttgtggagctggggctgactgtgttcctatccatcaaaatggtccttgtttcctacctaacactgtcagagctcattgcaattatgctgtcaacagctacttccaaaaaaagggtcaggctcaaggcgcttgtgatttcaaaggcgctgctatggtttctgcatctgatcctagcattaacggctgctcttacccttccagtgtcagaatgcgaaatctagatatcatttgctgtggcagaatggtttaa

SEQ ID NO: 2019 - protein, 121 aa, Populus balsamifera subsp. trichocarpa
  misc_feature (20)..(103): Pfam Name: X8 Pfam Description: X8 domain
  misc_feature (1)..(121): Ceres Annot ID no. 1489440
  misc_feature (1)..(121): Bit score of 94.3 for HMM based on sequences of Figure 34
  misc_feature (1)..(121): Functional Homolog Of SEQ ID NO. 1980
MAVLVLAILMMAMAGRASCTWCVCKEMGTPVLQQTLDYACGAGADCVPIHQNGPCFLPNTVRAHCNYAVNSYFQKKGQAQGACDFKGAAMVSASDPSINGCSYPSSVRMRNLDIICCGRMV

SEQ ID NO: 2020 - DNA, 908 bp, Glycine max
  misc_feature (1)..(908): Ceres Clone ID no. 1657593
  misc_feature (1)..(908): Encodes the peptide sequence at SEQ ID NO. 2021
atctcacaccactttctctctcttctactctctagcaaccattccaaataaccccttctctctccttccacctctaaaaatcagcaacatggccttgtttgctcttgcagtgcttcttttagccttcactggctcttcaagtgccacttggtgtgtttgcaaggaaggaagtgatgcaatattgcagaaaaccttagattatgcttgtggagctggggctgattgtaaccctttgcatcagaatggcccttgtttccaacccaacactgtgagagctcactgtaactatgcagttaacagctatttccaaaggaagggtcaagcacaaggatcctgtgactttgcaggaaccgccactgttactgcatcagatcccagcactggaggttgttcctaccctgcaagcgccaggtatgcatcttaaacccctcttgctcttcttcttttgtttccttttttttttagcttggaatttgattcttctaacctttgaacaattttacaaatttcccctttaactacctagtttaatttttattttccttttcttaaagttgtagtatatggtagctggtattgtctatagtacacacatgtagtagaatagtggctattgactttatgtggtagcaagtgactttacttttctcataataatagagactgtgagcactgcttaaattaaaattatctatcccccacaaaaggttctcttttggggggaagtggggggagagtgtgcattattcatttgtttggcatattctcagcttgaccaacgagtaatgtagttggatttccaaaccatattcatatgaaagggttgttcctggtcttacagattttgtgagctttataaaaaaaaattcacgtgttacattttgattcagagaataatgaattatgat

SEQ ID NO: 2021 - protein, 111 aa, Glycine max
  misc_feature (20)..(103): Pfam Name: X8 Pfam Description: X8 domain
  misc_feature (1)..(111): Ceres Clone ID no. 1657593
  misc_feature (1)..(111): Bit score of 91.5 for HMM based on sequences of Figure 34
  misc_feature (1)..(111): Functional Homolog Of SEQ ID NO. 1980
MALFALAVLLLAFTGSSSATWCVCKEGSDAILQKTLDYACGAGADCNPLHQNGPCFQPNTVRAHCNYAVNSYFQRKGQAQGSCDFAGTATVTASDPSTGGCSYPASARYAS

SEQ ID NO: 2022 - DNA, 481 bp, Arabidopsis thaliana
  misc_feature (1)..(481): Ceres Annot ID no. 887360
  misc_feature (1)..(481): Encodes the peptide sequence at SEQ ID NO. 2023
gaacaaatatcaatctataagcaataatataatggtcacaaaactgatgtctctatcattgacgctcatcttcgtcctcctcgtatctaccgtatccgtgaactcgacaccaagaaacctctcgcaggctgctgaaaacaaaggagtatggtgcatagcgggtgacaaagcgacagataagcaactgcaagcgaatatagattgggtttgcagcgacgaaggaggattccgtgactgtggagcgctcaattccggtggaccttgctttgaaccaaacacggtaagagatcacgcgtcgttcgcaatgaacttgtattaccagaaccttggtgccaccaaggaacaatgcaatttccataacactggcattgaagtttctaccgacccaagccatggctcgtgtattttcgtatcttattagaattctaattccgcttttatgtgggaacttgttaagcctaaactccagttaaataagttg

SEQ ID NO: 2023 - protein, 129 aa, Arabidopsis thaliana
  misc_feature (39)..(126): Pfam Name: X8 Pfam Description: X8 domain
  misc_feature (1)..(129): Ceres Annot ID no. 887360
  misc_feature (1)..(129): Bit score of 90.5 for HMM based on sequences of Figure 34
  misc_feature (1)..(129): Functional Homolog Of SEQ ID NO. 1980
MVTKLMSLSLTLIFVLLVSTVSVNSTPRNLSQAAENKGVWCIAGDKATDKQLQANIDWVCSDEGGFRDCGALNSGGPCFEPNTVRDHASFAMNLYYQNLGATKEQCNFHNTGIEVSTDPSHGSCIFVSY

SEQ ID NO: 2024 - protein, 174 aa, Vitis vinifera
  misc_feature (35)..(120): Pfam Name: X8 Pfam Description: X8 domain
  misc_feature (1)..(174): Public GI ID no. 225446539
  misc_feature (1)..(174): Bit score of 94.4 for HMM based on sequences of Figure 34
  misc_feature (1)..(174): Functional Homolog Of SEQ ID NO. 1980
MKFSLFLFLLLTVTLPLHSLAAQSKAQNGVVTLELWCVAKNNADNPALQTALDWACGPGGADCSPIQQGGPCYDSQDLQKTASFAFNDYYLKHGLSDDSCGFDNTAALTSLNPSFGNCKFPSSFTVSNGSFVGSTNTMGMGPASADLSGCSRIAGRWVQALITVHLLIAVILIL

SEQ ID NO: 2025 - protein, 175 aa, Oryza sativa subsp. japonica
  misc_feature (25)..(109): Pfam Name: X8 Pfam Description: X8 domain
  misc_feature (1)..(175): Public GI ID no. 115455431
  misc_feature (1)..(175): Bit score of 92.6 for HMM based on sequences of Figure 34
  misc_feature (1)..(175): Functional Homolog Of SEQ ID NO. 1980
MAATAPRLLLMALMAATLAGRSEGAWCICRQDMPDSTLQKTLDYACGDGADCKPIQQSGACFSPDTVKAHCSYAVNSFYQRNNQNSQACVFSGTATLVTTDPSSNGCMYPASASAAGTGTPTSGTGGSTGVDGPPGMGLGPSSFNDNSGASLLPEVGTAMWILILACSIMVLNFS

SEQ ID NO: 2026 - protein, 158 aa, Picea sitchensis
  misc_feature (23)..(108): Pfam Name: X8 Pfam Description: X8 domain
  misc_feature (1)..(158): Public GI ID no. 116793199
  misc_feature (1)..(158): Bit score of 103.0 for HMM based on sequences of Figure 34
  misc_feature (1)..(158): Functional Homolog Of SEQ ID NO. 1980
MPNTPITTFSPPEGNTTFIDGTTWCVASPAANQLDLQEALDWACGPGLADCSGIQPGQSCYQPSNLLSVASYAFNMYYQSNGNSPVACNFGGTGMITSSDPSHGICQFLTSGNTNTNSFPTSSRSPGISGWLIPGVLFLAHLLNITEWRGTLPQPLHL

SEQ ID NO: 2027 - protein, 176 aa, Oryza sativa subsp. indica
  misc_feature (55)..(140): Pfam Name: X8 Pfam Description: X8 domain
  misc_feature (1)..(176): Public GI ID no. 125557245
  misc_feature (1)..(176): Bit score of 96.2 for HMM based on sequences of Figure 34
  misc_feature (1)..(176): Functional Homolog Of SEQ ID NO. 1980
MKRKQLIMHSLLILGWFIVSAAGARVAPQEKAESATPIPTLSPPEGNMTFVDGVTWCVARPGVSQEDLQNALDWACGQGGADCTPLQPGGRCYQPDTLLSHASYAFNIFYQQNGNSDIACNFGGAGTIIKRNPSFGSCKFLASETSAASALTRGSMWMIFAAASMMFLHLRVFQSV

SEQ ID NO: 2028 - DNA, 598 bp, Glycine max
  misc_feature (1)..(598): Ceres Clone ID no. 603590
  misc_feature (1)..(598): Encodes the peptide sequence at SEQ ID NO. 2029
aacgtcacccatttctctttcttcccttccttcactcaccgataactctcccacaatgaccacccgaaaaagcctcgttctttcgctcctcctccttctgggcctctccccgctctgcgccggcgccgctccgccgcaggagctgtggtgcgtggcgaagaacaacgcggaggacgcggcgctgcaggctgcgctggactgggcctgcggggctggcggcgccgactgcggcccaatccagcgcggtgggccctgctacgaccccaccagcgtgcagaatacggcgtcgttttccttcaacgactattttytgaaacatggcatgaccgacgatagctgcaacttcaacaacaacgctgccgtcacttccttgaaccctagtcagtcaaacactcaaaccccactttctcaatgtggataaaaaaaatcatgtcttaagatgttaatttgtttcatgaagctaatgcctcattcttttttgttttggggcttctgttttcaggtcatgataattgcaagttcccctccgggtaaattgagcttggattttacwctttttttttttttggaatttgtcaattatgaatttttgttgatc

SEQ ID NO: 2029 - protein, 121 aa, Glycine max
  misc_feature (30)..(116): Pfam Name: X8 Pfam Description: X8 domain
  misc_feature (1)..(121): Ceres Clone ID no. 603590
  misc_feature (1)..(121): Bit score of 96.3 for HMM based on sequences of Figure 34
  misc_feature (1)..(121): Functional Homolog Of SEQ ID NO. 1980
  misc_feature (86)..(86): Xaa is any aa, unknown, or other
MTTRKSLVLSLLLLLGLSPLCAGAAPPQELWCVAKNNAEDAALQAALDWACGAGGADCGPIQRGGPCYDPTSVQNTASFSFNDYFXKHGMTDDSCNFNNNAAVTSLNPSQSNTQTPLSQCG

SEQ ID NO: 2030 - DNA, 531 bp, Brassica napus
  misc_feature (1)..(531): Ceres Clone ID no. 981503
  misc_feature (1)..(531): Encodes the peptide sequence at SEQ ID NO. 2031
attgcgtcgtcactgttagatcttccagcttcctgaaacctttaacggtaactttctggcgaatcagcgactttaaaactctctttaccttcttcgtaacgcttctttagcttcatcttcatcttcatcccactctcttctctctctctctgctgaaacgattatgactctccctcacctccatctctctctcctcgccgcgacggcgattatgttagtggcgattgcggatgcgcaggccgggggacaagtgcttcaagcggagctttggtgcgtcgcgaagaacaacgcggaagattcgtcgctacagacggcgatcgattgggcatgtggacaaggaggcgcggactgtagtccgatccagcagggtagagcttgcaacgacccgacggatatccagaagatggcgtcgtatgtgttcaacaactactacttgaagaacggactcgccgacgatgcttgcaatttcaacaacaacgctgctctcacttccatcaatcccagtcaaggaacttgcagatacccttcgag

SEQ ID NO: 2031 - protein, 122 aa, Brassica napus
  misc_feature (35)..(120): Pfam Name: X8 Pfam Description: X8 domain
  misc_feature (1)..(122): Ceres Clone ID no. 981503
  misc_feature (1)..(122): Bit score of 93.1 for HMM based on sequences of Figure 34
  misc_feature (1)..(122): Functional Homolog Of SEQ ID NO. 1980
MTLPHLHLSLLAATAIMLVAIADAQAGGQVLQAELWCVAKNNAEDSSLQTAIDWACGQGGADCSPIQQGRACNDPTDIQKMASYVFNNYYLKNGLADDACNFNNNAALTSINPSQGTCRYPS

SEQ ID NO: 2032 - DNA, 922 bp, Gossypium hirsutum
  misc_feature (1)..(922): Ceres Clone ID no. 1919739
  misc_feature (1)..(922): Encodes the peptide sequence at SEQ ID NO. 2033
aaactctctctctctctctctctctctctctctctctctctttcatttcttttctttttctctcccacaagttgcagttgcagagcttcgccattgttgtcttccttcaagctttttcagtttcttattcactcttcttcaacacccttttgatttttgctcttcaaccatggctgctttagtgcttccgctgctcatcctggctgccattactggccgctcaagtggcaactggtgtatatgcaaagatggtgtaagtgatacagtattgcagaagacactggactatgcatgtggtgcaggcgccgactgtaaccctatccacttgaagggatcctgttttaaccccgacactgttaaggctcattgcagttacgccgttaacagttacttccaaagaaaaggccaagctcaaggctcttgtgatttttccggcactgccaccgttactaccgctgaccccagctatactggttgtgctttcccatctagtgccagtaccgcaggcaccaccacaacaccaacaactacaccgtcatccaccacaccctcgtccgtgaacccaatcaacaacaccccaacaagcacaacaccattcggttcgacaacacctactggaatattgggaggagttggcaacggcttaggcccgtccggaactgggatcaacacagattacagtactgatggaggatttaggctgcaatactgcttctcttcctatgcaaccctcttgatttcaggattgatgctattgtggggttaaaagaagttacaagggaacatgttttctggtcattcagtcttgttctcttctagtgtatggtgttgttgatctaagaacatgtttgctaagggttttttttttttttttttggttatggattttaatcattttaaaagcatgacttttatgggtatg

SEQ ID NO: 2033 - protein, 198 aa, Gossypium hirsutum
  misc_feature (21)..(105): Pfam Name: X8 Pfam Description: X8 domain
  misc_feature (1)..(198): Ceres Clone ID no. 1919739
  misc_feature (1)..(198): Bit score of 90.2 for HMM based on sequences of Figure 34
  misc_feature (1)..(198): Functional Homolog Of SEQ ID NO. 1980
MAALVLPLLILAAITGRSSGNWCICKDGVSDTVLQKTLDYACGAGADCNPIHLKGSCFNPDTVKAHCSYAVNSYFQRKGQAQGSCDFSGTATVTTADPSYTGCAFPSSASTAGTTTTPTTTPSSTTPSSVNPINNTPTSTTPFGSTTPTGILGGVGNGLGPSGTGINTDYSTDGGFRLQYCFSSYATLLISGLMLLWG

SEQ ID NO: 2034 - DNA, 1106 bp, Arabidopsis thaliana
  misc_feature (1)..(1106): Ceres Clone ID no. 93867
  misc_feature (1)..(1106): Ceres SEED LINE ID no. CW00398
  misc_feature (1)..(1106): Encodes the peptide sequence at SEQ ID NO. 2035
aataaccttttcggtgctcaagcgccgtttctagggtttttctctgaggaagaaagcgtttcatttgtctgaatttcatcgaaaatggcggaaagaggaggagaaggcggcacagagcgtggcggtgaccgtggtgacttcggacgtggattcggcggtggacgtggcggtggccgtggccgtgatcgtggtccaagaggccgtggacgacgtggaggccgtgcctcggaagaaacgaaatgggttccagtgaccaaactaggtcgtctagtggctgacaataaaataacgaagctagagcagatctatctccattctctccccgtgaaggagtaccaaatcatagatcatcttgttggacctacgttgaaagacgaggttatgaagatcatgcctgttcagaaacaaaccagagctggtcaaagaactagattcaaggcctttgttgttgttggtgatggaaatggtcatgttggtttgggtgtcaagtgttctaaggaagttgcaactgccattagaggagctattattcttgctaagctttctgttgtcccggtgaggagaggttactgggggaataagattgggaagccacacactgtgccttgtaaggttactgggaagtgtggttctgttactgtgagaatggttcctgctccgagaggttctggtattgttgctgctagggttcctaagaaggttcttcagttcgctggtattgatgatgtctttacttcttctagaggatctaccaaaacactcggaaactttgtcaaggcgacatttgactgcttacagaagacatatgggttccttacaccagagttctggaaagagactagattctccagatcgccctaccaagagcacactgatttcttgtcgactaaggctgtttctgcaaccaaggttatcacggagggtgaagaccaagcttaagactttcatgagataagttttggttgttcttaatactaattcctactttgaaaaagagtagttttttttcttgattatctatgagttttgttattggtggtttcgttactgttttggattttgttagatgtttgcgttaatgcaaatttcaatgaaatagcttttgc

SEQ ID NO: 2035 - protein, 284 aa, Arabidopsis thaliana
  misc_feature (94)..(160): Pfam Name: Ribosomal_S5 Pfam Description: Ribosomal protein S5, N-terminal domai
  misc_feature (177)..(250): Pfam Name: Ribosomal_S5_C Pfam Description: Ribosomal protein S5, C-terminal domai
  misc_feature (1)..(284): Ceres SEED LINE ID no. CW00398
  misc_feature (1)..(284): Ceres Clone ID no. 93867
  misc_feature (1)..(284): Bit score of 676.6 for HMM based on sequences of Figure 37
  misc_feature (1)..(284): in Figure 37
MAERGGEGGTERGGDRGDFGRGFGGGRGGGRGRDRGPRGRGRRGGRASEETKWVPVTKLGRLVADNKITKLEQIYLHSLPVKEYQIIDHLVGPTLKDEVMKIMPVQKQTRAGQRTRFKAFVVVGDGNGHVGLGVKCSKEVATAIRGAIILAKLSVVPVRRGYWGNKIGKPHTVPCKVTGKCGSVTVRMVPAPRGSGIVAARVPKKVLQFAGIDDVFTSSRGSTKTLGNFVKATFDCLQKTYGFLTPEFWKETRFSRSPYQEHTDFLSTKAVSATKVITEGEDQA

SEQ ID NO: 2036 - DNA, 1090 bp, Brassica napus
  misc_feature (1)..(1090): Ceres Clone ID no. 1070374
  misc_feature (1)..(1090): Encodes the peptide sequence at SEQ ID NO. 2037
acgctaacacacatcaccgcagccatttccatctctcaaccaacttcaaacaatggctgaacgaggcggagaacgaggtgccgagcgaggaggagaccgcggcggtttcggacgcggattcggaggaggtcgcggcgacagaggaggccggggaggtccgagaggccgaggcggcagacgcggaggacgtccgacagaggaggagaagtggaccccagtgaccaagctcggccgtctcgtgcaagccggaaagatccagaagctcgagcagatctacctccactccctccccgtcaaggagtaccagatcatcgacctcctcgttggccccaccttgaaagacgaggtgatgaagatcatgccggttcagaaacagaccagggccggtcagaggacgaggttcaaggcctttgtcgtcgtcggagacacgaacgggcacgttggtttgggtgtgaagtgctccaaggaggtggcgacggcgatcagaggtgggattatattggcgaagttgtcggttattccggtgaggagagggtactgggggaacaagattgggaagccgcatacggttccttgtaaggttacggggaagtgtgggtccgttacggtgaggatggtgccggctccgaggggtgcggggattgtggcggctagggttcctaagaaggtgcttcagttcgctgggattgatgatgtgtttacttcgtcgagggggtctactaagactcttggaaacttcgtaaaggctacattcgactgtctccagaagacttatggattcctgacaccagagttctggaaagagacgagctttaaaaagtcaccgtaccaggagtacactgatctgctggccgagaagggaattgcaaccaaagccatcaccgaggttgaagaccaagccgcctcctaaataaacaaacaaacaatgtcccccttgttttgtttttggatgatcctttcatgagttttattttgttcgaacctttagtatatgttgtttgctggattgctgctttcttatgttttcatcatctcccccaaacaaagttatttttgctctagtttttttttataatcgatggtcatgccc

SEQ ID NO: 2037 - protein, 285 aa, Brassica napus
  misc_feature (94)..(160): Pfam Name: Ribosomal_S5 Pfam Description: Ribosomal protein S5, N-terminal domai
  misc_feature (177)..(250): Pfam Name: Ribosomal_S5_C Pfam Description: Ribosomal protein S5, C-terminal domai
  misc_feature (1)..(285): Ceres Clone ID no. 1070374
  misc_feature (1)..(285): Bit score of 689.7 for HMM based on sequences of Figure 37
  misc_feature (1)..(285): Functional Homolog Of SEQ ID NO. 2035
  misc_feature (1)..(285): in Figure 37
MAERGGERGAERGGDRGGFGRGFGGGRGDRGGRGGPRGRGGRRGGRPTEEEKWTPVTKLGRLVQAGKIQKLEQIYLHSLPVKEYQIIDLLVGPTLKDEVMKIMPVQKQTRAGQRTRFKAFVVVGDTNGHVGLGVKCSKEVATAIRGGIILAKLSVIPVRRGYWGNKIGKPHTVPCKVTGKCGSVTVRMVPAPRGAGIVAARVPKKVLQFAGIDDVFTSSRGSTKTLGNFVKATFDCLQKTYGFLTPEFWKETSFKKSPYQEYTDLLAEKGIATKAITEVEDQAAS

SEQ ID NO: 2038 - DNA, 1043 bp, Glycine max
  misc_feature (1)..(1043): Ceres Clone ID no. 1619978
  misc_feature (1)..(1043): Encodes the peptide sequence at SEQ ID NO. 2039
aatcccgcactgtgcttctcattctcttctaaaaacgccgcagtctcttctctctcagaaaccctaatggcagagcgcggaggtggcgaacgtggcggcgaccgtggcggtttcggacgcggcttcggcgggcgagggcgcggaggcgacaggggccgcggccggcgtagaggtccccgccgcgaggaggaggagaagtgggtcccggtgactaagctgggacgcctggtgaaggaaggaagaatccgaagcctggagcagatctacctccactcgctgcccatcaaagagcaccagatcatcgacacgctggtgggccccaccctgaaggacgaggtgatgaagatcacgccggtccagaagcagacccgggccgggcagagaacccgtttcaaggccttcgtggtcgtcggcgacaacaacggccacgtgggtctaggcgtgaagtgcagcaaggaagtggccaccgcaattcgtggcgcgattattctcgcgaagctttcggttattcccgtgaggaggggttactgggggaacaagattgggaagccccacaccgttccgtgcaaggttaccgggaagtgtgggtccgttaccgttaggatggttcccgcgcctaggggttccgggattgtggcggctagggttcccaagaaggtgctgcagtttgctggtattgatgatgttttcacctcctccaggggatccaccaagacccttggcaacttcgttaaggctacttttgattgcttgatgaaaacctatggattcctgacaccagaattctggaaggagactcgcttctccaaatctccattccaagagtacacagatctattggcaaaaccaacagggaagactctaatcttggaggaggaaagggtggatgcttgatttgctagttttggttttatggatgttttagagacattgttatttacctttgttggttctgtgctttacttttggttttgatagacggtggtatgtctctgtatggattttgattgtttcaagttttaatttaattgactgtagttttg

SEQ ID NO: 2039 - protein, 275 aa, Glycine max
  misc_feature (86)..(152): Pfam Name: Ribosomal_S5 Pfam Description: Ribosomal protein S5, N-terminal domai
  misc_feature (169)..(242): Pfam Name: Ribosomal_S5_C Pfam Description: Ribosomal protein S5, C-terminal domai
  misc_feature (1)..(275): Ceres Clone ID no. 1619978
  misc_feature (1)..(275): Bit score of 694.8 for HMM based on sequences of Figure 37
  misc_feature (1)..(275): Functional Homolog Of SEQ ID NO. 2035
  misc_feature (1)..(275): in Figure 37
MAERGGGERGGDRGGFGRGFGGRGRGGDRGRGRRRGPRREEEEKWVPVTKLGRLVKEGRIRSLEQIYLHSLPIKEHQIIDTLVGPTLKDEVMKITPVQKQTRAGQRTRFKAFVVVGDNNGHVGLGVKCSKEVATAIRGAIILAKLSVIPVRRGYWGNKIGKPHTVPCKVTGKCGSVTVRMVPAPRGSGIVAARVPKKVLQFAGIDDVFTSSRGSTKTLGNFVKATFDCLMKTYGFLTPEFWKETRFSKSPFQEYTDLLAKPTGKTLILEEERVDA

SEQ ID NO: 2040 - DNA, 1070 bp, Gossypium hirsutum
  misc_feature (1)..(1070): Ceres Clone ID no. 1869432
  misc_feature (1)..(1070): Encodes the peptide sequence at SEQ ID NO. 2041
aaacttagccgccccatttcatcgctcccactatctgatccctcaaagcctacagaaaaaaaaaggagagcaaaaaatggcagaaagaggcggcggagaacgtggcgcttttaggcgcggcttcggtggaggaaggggtgaccgtggtccaagaggcaggcgccgtggccgcaaggacgaagaggagaaatgggtacccgtcacgaaactcggccgtttagtcaaatccgggaaaatcacgtccctcgaacaaatttacctccactctctccctatcaaagagtaccaaatcatcgaccagctcgtcggcccttccttgaaagacgaagtcatgaagatcactcccgtccagaaacaaacacgtgccggccagcgcacgcgtttcaaggccttcgtcgtcgtcggagacggaaacggacacgtcgggttgggtgtcaagtgcagcaaagaagttgcgacggccataagaggggcgataatattggcgaagttgtcggttatcccggtgaggagaggttattgggggaataagatcgggaaaccccatacggtgccgtgtaaggttaccgggaaatgtggatccgttactgttaggatggtgcctgctccgagaggtgcggggattgtggctgctagggtccccaagaaagttcttcagtttgcagggatcgaagatgttttcacttcttccaggggatccactaagactcttggtaactttgtcaaggccacctttgagtgtcttctgaaaacttatggtttcttgactcccgatttctggaaagagactcgtttcacaaggtctcctttccaagagtatactgatctgttgggaaagccggcaaagacccttgtacttgaagatgcagagaggttggacgtatagttcccgatatacgagtcattagtaagttgcgccttccaagcctgcgtggctgcgtagggtagcaatatgaagttctgttttgtttcttaaaagaatcttaatttatatgttatgtcttgtttggttggtttttcatgaaattttcggttattgtttaaggcatggaacatttttgttttccttt

SEQ ID NO: 2041 - protein, 269 aa, Gossypium hirsutum
  misc_feature (80)..(146): Pfam Name: Ribosomal_S5 Pfam Description: Ribosomal protein S5, N-terminal domai
  misc_feature (163)..(236): Pfam Name: Ribosomal_S5_C Pfam Description: Ribosomal protein S5, C-terminal domai
  misc_feature (1)..(269): Ceres Clone ID no. 1869432
  misc_feature (1)..(269): Bit score of 668.2 for HMM based on sequences of Figure 37
  misc_feature (1)..(269): Functional Homolog Of SEQ ID NO. 2035
  misc_feature (1)..(269): in Figure 37
MAERGGGERGAFRRGFGGGRGDRGPRGRRRGRKDEEEKWVPVTKLGRLVKSGKITSLEQIYLHSLPIKEYQIIDQLVGPSLKDEVMKITPVQKQTRAGQRTRFKAFVVVGDGNGHVGLGVKCSKEVATAIRGAIILAKLSVIPVRRGYWGNKIGKPHTVPCKVTGKCGSVTVRMVPAPRGAGIVAARVPKKVLQFAGIEDVFTSSRGSTKTLGNFVKATFECLLKTYGFLTPDFWKETRFTRSPFQEYTDLLGKPAKTLVLEDAERLDV

SEQ ID NO: 2042 - DNA, 1199 bp, Zea mays
  misc_feature (1)..(1199): Ceres Clone ID no. 295792
  misc_feature (1)..(1199): Encodes the peptide sequence at SEQ ID NO. 2043
gcacggcccagtccaacttctcgttcccccaaaccctaatccctttctccactgccacgttgtatagtaagccgccgccagcttcaacgcagctgccctcccaaaccctcgcgccgccgctccccagcacatcgctcccagcgcgccaaatcggcggcaacctcggacccttcactcacccagctatggcggagcgaggcggcgagcgtggcggagaacgcggcggcgagcgtggcggttttggccgcgggttcggtcgcggcgggcgcggcgaccgtggtggtcgccgtggtggccggcgcggcggccgccagcaggaggaggagaagtgggtgcccgtcaccaagctcgggcgcctcgtgaaggagaaccggatcaacaagattgaggagatctacctgcactcgctgccggtcaaggagcaccagatcgtggagaccctcgtcccggggctcaaggacgaggtgatgaagatcacgcccgtccagaagcagacccgcgccgggcagcgcacgcgcttcaaggccttcgtcgtcgtcggcgacggggacggccacgtcgggctcggcgtcaagtgcgccaaggaggtcgccaccgccatccgtggcgccatcatcctggccaagctctcggtcgtgcccgtcaggaggggctactggggaaacaagatcggccagccgcacactgtgccctgcaaggtcaccggcaagtgcgggtccgtcaccgtgcgcatggtgccggcgcccagggggtccgggattgtcgctgcccgcgtgcccaagaaggtcctccagttcgccggcattgaggatgtctttacctcgtcccgtggctccaccaagacactcggtaacttcgtcaaggcaacctttgattgtctgatgaagacctacggcttcctcacccctgagttctgggccgagaccaagtatgccaagaccccgttccaggagttcaccgacctcttggctaagccgacaaagggtcttctgatcgaggctcccaccgagacagtggaagcttgaacgtcttaktttactgttcccaagtgtcscsaaaagagttttctgtactagctacatattttaaatgtcattttgaattatgatgagaaaccaaggtatgcacccaagataattgatgtcctgttgttttcttatgtgtgtatcgaacgcctgagatgtcctgttgttttctgt

SEQ ID NO: 2043 - protein, 279 aa, Zea mays
  misc_feature (89)..(155): Pfam Name: Ribosomal_S5 Pfam Description: Ribosomal protein S5, N-terminal domai
  misc_feature (172)..(245): Pfam Name: Ribosomal_S5_C Pfam Description: Ribosomal protein S5, C-terminal domai
  misc_feature (1)..(279): Ceres Clone ID no. 295792
  misc_feature (1)..(279): Bit score of 694.3 for HMM based on sequences of Figure 37
  misc_feature (1)..(279): Functional Homolog Of SEQ ID NO. 2035
  misc_feature (1)..(279): in Figure 37
MAERGGERGGERGGERGGFGRGFGRGGRGDRGGRRGGRRGGRQQEEEKWVPVTKLGRLVKENRINKIEEIYLHSLPVKEHQIVETLVPGLKDEVMKITPVQKQTRAGQRTRFKAFVVVGDGDGHVGLGVKCAKEVATAIRGAIILAKLSVVPVRRGYWGNKIGQPHTVPCKVTGKCGSVTVRMVPAPRGSGIVAARVPKKVLQFAGIEDVFTSSRGSTKTLGNFVKATFDCLMKTYGFLTPEFWAETKYAKTPFQEFTDLLAKPTKGLLIEAPTETVEA

SEQ ID NO: 2044 - DNA, 831 bp, Populus balsamifera subsp. trichocarpa
  misc_feature (1)..(831): Ceres Annot ID no. 1474944
  misc_feature (1)..(831): Encodes the peptide sequence at SEQ ID NO. 2045
atggaagagcgcccccctgcagaacgtggatccttcggtcgtggcttcggtggacgtggagaccggggaggccgaggtggacgtggagatcgcggtggacgaggccgacgccgctctggccgcaaagaggaggaagagaaatgggtaccagtcacaaaactaggccgccttgtaaaagatggcaaaatctcctccgtggagcaaatctacctccactcactacccatcaaagagtaccaaatcatagacacccttattggtcctatcttgaaagatgaggtgatgaaaatcaccccagttcagaaacaaacaagagccggtcagcgaaccaggttcaaggcctttgttgttgttggtgatgggaatggacatgttggtttgggtgtgaagtgtgctaaagaagtggccactgccattcgtggggctattattttggcaaaactctctattattccggtgaggagagggtactgggggaacaagatcggaaagccacatactgtgccttgtaaggttacagggaagtgtggcagtgtgactgtgagaatggtccccgcccctcgtggagctgggattgttgctgccagggttcctaagaaggtgcttcagtttgctggaattgatgatgtttttacatcttccagaggatctactaagactcttggaaactttgttaaggccacatttgactgcttgctgaagacttatgggttccttacacctgacttctggaaggagactcgcttcataaggtcaccattccaagagtacacagatctgttggcaaaacccactagcaaggttctcatcactgaggttcatgaagattga

SEQ ID NO: 2045 - protein, 276 aa, Populus balsamifera subsp. trichocarpa
  misc_feature (89)..(155): Pfam Name: Ribosomal_S5 Pfam Description: Ribosomal protein S5, N-terminal domai
  misc_feature (172)..(245): Pfam Name: Ribosomal_S5_C Pfam Description: Ribosomal protein S5, C-terminal domai
  misc_feature (1)..(276): Ceres Annot ID no. 1474944
  misc_feature (1)..(276): Bit score of 667.0 for HMM based on sequences of Figure 37
  misc_feature (1)..(276): Functional Homolog Of SEQ ID NO. 2035
  misc_feature (1)..(276): in Figure 37
MEERPPAERGSFGRGFGGRGDRGGRGGRGDRGGRGRRRSGRKEEEEKWVPVTKLGRLVKDGKISSVEQIYLHSLPIKEYQIIDTLIGPILKDEVMKITPVQKQTRAGQRTRFKAFVVVGDGNGHVGLGVKCAKEVATAIRGAIILAKLSIIPVRRGYWGNKIGKPHTVPCKVTGKCGSVTVRMVPAPRGAGIVAARVPKKVLQFAGIDDVFTSSRGSTKTLGNFVKATFDCLLKTYGFLTPDFWKETRFIRSPFQEYTDLLAKPTSKVLITEVHED

SEQ ID NO: 2046 - DNA, 1081 bp, Panicum virgatum
  misc_feature (1)..(1081): Ceres Clone ID no. 1819159
  misc_feature (1)..(1081): Encodes the peptide sequence at SEQ ID NO. 2047
cccaaacccccgccgccgctgccaagcacatcgcacccggcgcgatttccccggcgagagcccaccccccatcccacccaaccatggcggaccgcggaggcgagagaggcggagagcgcggcggcgagcgtggcggcttcggccgcgggttcgggcgcggcgggcgcggcgaccgcggcgggcgcaggggcggccggcgcggcgggcgccagcaggaggaggagaagtgggtgcccgtgaccaagctcgggcgcctcgtcaaggagggcaggatcaagcagatggaggagatctacctccactcgctccccgtcaaggagcaccagatcgtggaggccctcctccccgggctcaaggacgaggtcatgaagatcacgccggtgcagaagcagacgcgcgccggccagcgcacgcgcttcaaggccttcgtcgtcgtcggcgacggcaacggccacgtcgggctcggggtcaagtgcgccaaggaggtggccaccgccatccgcggcgccatcatcctcgccaagctgtcagtcgtgcccgtcaggaggggctactgggggaacaagatcggccagccgcacaccgtgccgtgcaaggtcaccggcaagtgcggctccgtcaccgtgcgcatggtgccggcgcccagggggtccgggatcgtcgccgcccgcgtgcccaagaaggtgctccagttcgctggcattgaggatgtgttcacctcctcccgcggctccaccaagacgctcggtaactttgtcaaggccacctttgattgtctcatgaagacctatggcttccttactcctgagttctgggatgagactaagtttgcgaagaccccattccaggagttcaccgatctcttggccaagccaacaaagggacttgtgatcgaggctccagtggagactgtagaagcttaaacctgttggaagttcagagcaaagtttccttgtagtagaaactggtttcctatctacttttgtgtgggttattatgtattactgtctcggatatctcagttttgaattgtaaaccttaaggtatgcacttaaatatccagatggtctgttcttgtttt

SEQ ID NO: 2047 - protein, 279 aa, Panicum virgatum
  misc_feature (89)..(155): Pfam Name: Ribosomal_S5 Pfam Description: Ribosomal protein S5, N-terminal domai
  misc_feature (172)..(245): Pfam Name: Ribosomal_S5_C Pfam Description: Ribosomal protein S5, C-terminal domai
  misc_feature (1)..(279): Ceres Clone ID no. 1819159
  misc_feature (1)..(279): Bit score of 696.1 for HMM based on sequences of Figure 37
  misc_feature (1)..(279): Functional Homolog Of SEQ ID NO. 2035
  misc_feature (1)..(279): in Figure 37
MADRGGERGGERGGERGGFGRGFGRGGRGDRGGRRGGRRGGRQQEEEKWVPVTKLGRLVKEGRIKQMEEIYLHSLPVKEHQIVEALLPGLKDEVMKITPVQKQTRAGQRTRFKAFVVVGDGNGHVGLGVKCAKEVATAIRGAIILAKLSVVPVRRGYWGNKIGQPHTVPCKVTGKCGSVTVRMVPAPRGSGIVAARVPKKVLQFAGIEDVFTSSRGSTKTLGNFVKATFDCLMKTYGFLTPEFWDETKFAKTPFQEFTDLLAKPTKGLVIEAPVETVEA

SEQ ID NO: 2048 - protein, 273 aa, Vitis vinifera
  misc_feature (84)..(150): Pfam Name: Ribosomal_S5 Pfam Description: Ribosomal protein S5, N-terminal domai
  misc_feature (167)..(240): Pfam Name: Ribosomal_S5_C Pfam Description: Ribosomal protein S5, C-terminal domai
  misc_feature (1)..(273): Public GI ID no. 225441799
  misc_feature (1)..(273): Bit score of 680.4 for HMM based on sequences of Figure 37
  misc_feature (1)..(273): Functional Homolog Of SEQ ID NO. 2035
  misc_feature (1)..(273): in Figure 37
MAERGGGGERGGFGRGFGRGGRGDRGRGGRRRSAGRREEEEKWVPVTKLGRLVKDGKIRTVEEIYLHSLPIKEHQIIDTLVGPSLKDEVMKIMPVQKQTRAGQRTRFKAFVVVGDGNGHVGLGVKCSKEVATAIRGAIILAKLSVIPVRRGYWGNKIGKPHTVPCKVTGKCGSVTVRMVPAPRGAGIVAARVPKKVLQFAGIEDVFTSSRGSTKTLGNFVKATFDCLLKTYAYLTPDFWRETRYTKSPFQEHTDLLAKPTKAIYQDDVERVEA

SEQ ID NO: 2049 - protein, 276 aa, Oryza sativa subsp. japonica
  misc_feature (87)..(153): Pfam Name: Ribosomal_S5 Pfam Description: Ribosomal protein S5, N-terminal domai
  misc_feature (170)..(243): Pfam Name: Ribosomal_S5_C Pfam Description: Ribosomal protein S5, C-terminal domai
  misc_feature (1)..(276): Public GI ID no. 34393314
  misc_feature (1)..(276): Bit score of 679.5 for HMM based on sequences of Figure 37
  misc_feature (1)..(276): Functional Homolog Of SEQ ID NO. 2035
  misc_feature (1)..(276): in Figure 37
MAERGGGGERGGERGGFGRGFGRGGRGDRGRGGRGGRRGPRQEEEKWVPVTKLGRLVKENKIHKIEEIYLHSLPVKEHQIVEQLVPGLKDEVMKITPVQKQTRAGQRTRFKAFVVVGDGDGHVGLGVKCAKEVATAIRGAIILAKLSVVPVRRGYWGNKIGKPHTVPCKVTGKCGSVTVRMVPAPRGSGIVAAHVPKKVLQFAGIEDVFTSSRGSTKTLGNFVKATFDCLMKTYGFLTPDFWRETRFIKTPFQEYTDLLARPKGLVIEAPAEKIEA

SEQ ID NO: 2050 - DNA, 1112 bp, Triticum aestivum
  misc_feature (1)..(1112): Ceres Clone ID no. 1320533
  misc_feature (1)..(1112): Encodes the peptide sequence at SEQ ID NO. 2051
ctctaccacccttcaccgccgccacagcctccagaccctatctcccccgtcggagctccctgcccccaaccccccacccccaaacaaccatggcggaccgcggcggcgagcgtggtggcgaccgcggaggcgaacgcggcgggttcggccgcggcttcgggcgcggcgggcgcggggaccgtggcgggcgccgcggcggccgtcgtggccctcgccaggaggaggagaagtgggtgcccgtcaccaagctcggccgcctcgtcaaggagggccggttcaccaagatggaggagatctacctccactcgctccccgtcaaggagcaccagatcgtggagcagctctgcccggggctcaaggacgaggtgatgaagatcactcccgtgcagaagcagacccgcgccggccagcggacccgcttcaaggcgttcgtcgtcgtcggcgacagcaacggccacgtcgggctcggcgtcaagtgcgccaaggaggtggcaacggccatccgcggcgccatcatcctcgccaagctctccatcgtgcccgtcaggaggggctactgggggaacaagatcggcctgccccacaccgtgccctgcaaggtcaccggcaagtgcggctctgtcaccgtgcgcatggtgcctgccccgaggggttctggaatcgtcgccgctcgtgtccccaagaaggtgctccagttcgctggtattgatgatgtcttcacttcctcgcgtggatccaccaagacacttggcaacttcgtcaaggcaaccttcgactgcctgatgaagacctatggattcctcacccctgacttctggagggagacgaccttcaccaaggggccgtaccaggagttcaccgacatcttggcgaagccgacaaaggccttgatgcttgatgcaccagttgagaagatagaagcttaggatgttggcgtaaatggtttttgctagctgggagctgtgtaatgcactatgctttatttagttattaagactttgaatcgtgctgcttcaggatgtctctctgccgtcaagtgttggtttgtggaactatgctactctcttttatcgtcaatggatgctacataattatagataaaaaaaaaaaag

SEQ ID NO: 2051 - protein, 278 aa, Triticum aestivum
  misc_feature (88)..(154): Pfam Name: Ribosomal_S5 Pfam Description: Ribosomal protein S5, N-terminal domai
  misc_feature (171)..(244): Pfam Name: Ribosomal_S5_C Pfam Description: Ribosomal protein S5, C-terminal domai
  misc_feature (1)..(278): Ceres Clone ID no. 1320533
  misc_feature (1)..(278): Bit score of 683.2 for HMM based on sequences of Figure 37
  misc_feature (1)..(278): Functional Homolog Of SEQ ID NO. 2035
  misc_feature (1)..(278): in Figure 37
MADRGGERGGDRGGERGGFGRGFGRGGRGDRGGRRGGRRGPRQEEEKWVPVTKLGRLVKEGRFTKMEEIYLHSLPVKEHQIVEQLCPGLKDEVMKITPVQKQTRAGQRTRFKAFVVVGDSNGHVGLGVKCAKEVATAIRGAIILAKLSIVPVRRGYWGNKIGLPHTVPCKVTGKCGSVTVRMVPAPRGSGIVAARVPKKVLQFAGIDDVFTSSRGSTKTLGNFVKATFDCLMKTYGFLTPDFWRETTFTKGPYQEFTDILAKPTKALMLDAPVEKIEA

SEQ ID NO: 2052 - protein, 280 aa, Physcomitrella patens subsp. patens
  misc_feature (90)..(156): Pfam Name: Ribosomal_S5 Pfam Description: Ribosomal protein S5, N-terminal domai
  misc_feature (173)..(246): Pfam Name: Ribosomal_S5_C Pfam Description: Ribosomal protein S5, C-terminal domai
  misc_feature (1)..(280): Public GI ID no. 168002136
  misc_feature (1)..(280): Bit score of 681.1 for HMM based on sequences of Figure 37
  misc_feature (1)..(280): Functional Homolog Of SEQ ID NO. 2035
  misc_feature (1)..(280): in Figure 37
MAERGGERGGFGRGFGRGDRGDRGGRGDRGRGDRRGGRRGAKRDEEEKWVPVTKLGRLVKDGKIKSLEQIYLFSLPIKEHQIVEFFLGSALKDEVMKIMPVQKQTRAGQRTRFKAFVVVGDNNGHVGLGVKCSKEVATAIRGAIILAKLSVIPVRRGYWGNKIGKPHTVPCKVTGKCGSVTVRLVPAPRGSGIVAARVPKKVLQFAGIEDVFTSSRGSTKTLGNFVKATFECLLKTYGFLTPDLWRETRFSKSPFQEFTDFLAKPHKISVVEDVEKTPVY

SEQ ID NO: 2053 - protein, 280 aa, Picea sitchensis
  misc_feature (90)..(156): Pfam Name: Ribosomal_S5 Pfam Description: Ribosomal protein S5, N-terminal domai
  misc_feature (173)..(246): Pfam Name: Ribosomal_S5_C Pfam Description: Ribosomal protein S5, C-terminal domai
  misc_feature (1)..(280): Public GI ID no. 116791016
  misc_feature (1)..(280): Bit score of 693.3 for HMM based on sequences of Figure 37
  misc_feature (1)..(280): Functional Homolog Of SEQ ID NO. 2035
  misc_feature (1)..(280): in Figure 37
MAERGGGFGRGADRGGGFGRGFGRGRGDRGRGDRRGGRRGARRDEEEKWVPVTKLGRLVKEGKIRSLEQIYLFSLAVKEHQIVEAMLGPQLKDEVMKIMPVQKQTRAGQRTRFKAFVVVGDGNGHVGLGVKCSKEVATAIRGAIILAKLSVIPVRRGYWGNKIGKPHTVPVKVTGKCGSVTVRMVPAPRGAGIVAARVPKKVLQFAGIEDVFTSSRGSTKTLGNFVKATFECLLKTYGFLTPDLWRETRFSKSPFQEYTDLLAKPAKALVLEDVDKEVIL

SEQ ID NO: 2054 - protein, 274 aa, Chlamydomonas reinhardtii
  misc_feature (170)..(243): Pfam Name: Ribosomal_S5_C Pfam Description: Ribosomal protein S5, C-terminal domai
  misc_feature (87)..(153): Pfam Name: Ribosomal_S5 Pfam Description: Ribosomal protein S5, N-terminal domai
  misc_feature (1)..(274): Public GI ID no. 159462880
  misc_feature (1)..(274): Bit score of 643.8 for HMM based on sequences of Figure 37
  misc_feature (1)..(274): Functional Homolog Of SEQ ID NO. 2035
  misc_feature (1)..(274): in Figure 37
MADRGGERAERGERGSFGRGFGGRGDRGRGRGARRARGKKEDEEKWVPCTKLGRLVQQGKIKSLEQIYLFSMPVKEYQIVEYFLGSALKDEVMKIMPVQKQTRAGQRTRFKAFVVVGDFNGHIGLGVKCAKEVATAIRGAIIQAKMSVVPVRRGYWGNKIGKVHTVPTKVTGKCGSVTIRLTPAPRGAGIVAARTPKKVLQMAGIEDCYTCSRGSTKTLGNFVRATFNALSRTYGFLTPELWRESKYTKAPFQEFTDFLAKPHIGESKGEAYAY

SEQ ID NO: 2055 - protein, 271 aa, Ostreococcus tauri
  misc_feature (172)..(245): Pfam Name: Ribosomal_S5_C Pfam Description: Ribosomal protein S5, C-terminal domai
  misc_feature (89)..(155): Pfam Name: Ribosomal_S5 Pfam Description: Ribosomal protein S5, N-terminal domai
  misc_feature (1)..(271): Public GI ID no. 116055788
  misc_feature (1)..(271): Bit score of 593.6 for HMM based on sequences of Figure 37
  misc_feature (1)..(271): Functional Homolog Of SEQ ID NO. 2035
  misc_feature (1)..(271): in Figure 37
MSDRGGFSRGFGRGGERGRGDRGRGDRGRGRGRGRGPRGRGGEDKDAWVPCTKLGRLVQQGKIKSLEHIFLFSIPIKEHQIVEHFIGAELKDEVMKICPVQKQTTAGQRMRFKAFVVVGDCNGHIGLGVKACKEVAHSIQGSMILAKLNVVPVRRGYWGSKLGAPHTIPTKVHGKCGSVHVRLIPAPRGAGIVASGTVKKVLAMAGLHDVYTCSRGHTRTLGNSVKATYAALKSTYGFLTPDLWATTRFTKPPAQEFTDLLAKPAKAARDI

SEQ ID NO: 2056 - protein, 284 aa, Arabidopsis thaliana
  misc_feature (94)..(160): Pfam Name: Ribosomal_S5 Pfam Description: Ribosomal protein S5, N-terminal domai
  misc_feature (177)..(250): Pfam Name: Ribosomal_S5_C Pfam Description: Ribosomal protein S5, C-terminal domai
  misc_feature (1)..(284): Public GI ID no. 15217951
  misc_feature (1)..(284): Bit score of 677.0 for HMM based on sequences of Figure 37
  misc_feature (1)..(284): Functional Homolog Of SEQ ID NO. 2035
MAERGGEGGAERGGDRGDFGRGFGGGRGGGRGRDRGPRGRGRRGGRASEETKWVPVTKLGRLVADNKITKLEQIYLHSLPVKEYQIIDHLVGPTLKDEVMKIMPVQKQTRAGQRTRFKAFVVVGDGNGHVGLGVKCSKEVATAIRGAIILAKLSVVPVRRGYWGNKIGKPHTVPCKVTGKCGSVTVRMVPAPRGSGIVAARVPKKVLQFAGIDDVFTSSRGSTKTLGNFVKATFDCLQKTYGFLTPEFWKETRFSRSPYQEHTDFLSTKAVSATKVITEGEDQA

SEQ ID NO: 2057 - protein, 284 aa, Arabidopsis thaliana
  misc_feature (94)..(160): Pfam Name: Ribosomal_S5 Pfam Description: Ribosomal protein S5, N-terminal domai
  misc_feature (177)..(250): Pfam Name: Ribosomal_S5_C Pfam Description: Ribosomal protein S5, C-terminal domai
  misc_feature (1)..(284): Public GI ID no. 21539457
  misc_feature (1)..(284): Bit score of 673.0 for HMM based on sequences of Figure 37
  misc_feature (1)..(284): Functional Homolog Of SEQ ID NO. 2035
MAERGGESGAERGGDRGDFGRGFGGGRGGGRGRDRGPRGRGRRGGRASEETKWVPVTKLGRLVADNKITKLEQIYLHSLPVKEYQIIDHLVGPTLKDEVMKIMPVQKQTRAGQRTRFKAFVVVGDGNGHVGLGVKCSKEVATAIRGAIILAKLSVVPVRRGYWGNKIGKPHTVPCKVTGKCGSVTVRMVPAPRGSGIVAARVPKKVLQFAGIDDVFTSSRGSTKTLGKFVKATFDCLQKTYGFLTPEFWKETRFSRSPYQEHTDFLSTKAVSATKVITEGEDQA

SEQ ID NO: 2058 - DNA, 1190 bp, Arabidopsis thaliana
  misc_feature (1)..(1190): Ceres Clone ID no. 17415
  misc_feature (1)..(1190): Encodes the peptide sequence at SEQ ID NO. 2059
agaaaccctaaaaatccttattgtagcagctggagcaatatatatcccaatttgccgcaactagggttttctcttcctcacgcaaagcaatacatcgcagtctcccactgattcagcagctctttgaactactcttcgacaatggcggaacgtggtggagaacgtggtgttgagcgtggtggagaacgtggtgatttcggacgaggattcggaggccgtggaggtcgtggagatcgtggagggcgtggacgtggaggccgtggtggtcgtcgtggagggcgtgccagtgaagaagagaaatgggttccagtgaccaagcttggtcgtcacgtggcggctggtcatatcaagcagatagagcagatctatcttcattcactcccggttaaggagtaccagatcattgatatgctcatcggtccaacattgaaggatgaggtaatgaaaatcatgccggttcagaaacaaaccagggctggtcaaaggactagattcaaggcctttgttgtcgttggagatggtaatggtcatgttgggttgggagtgaaatgctctaaggaagttgctacggccattagaggagcgattattctcgctaagctgtctgttgttccagtgaggagaggttactggggtaacaagattgggaagccacatacggttccttgtaaggtgactgggaagtgtggatctgtgacagtgaggatggttccagctcctagaggttctggtattgtggctgctagagttcctaagaaggttcttcaattcgctggaattgatgatgttttcacttcctccaggggatccaccaaaactcttggaaacttcgtcaaggctacattcgattgccttcagaagacttacggattccttaccccagagttctggaaggagacaagattctctagatcaccataccaagagcacactgatttcctggcgtccaaggctctttcgaccagcaaacccgacccagtggttgaagaccaagcctaaacaatgcttccaccttgtgttctttttggattataatccttcatgagttaattttggttgaacctttggtagtatatgttgctggattgtgcaccttctgttttcatctcctcttccaaactactttatttttgcttatggatcttaatgttctagttttgcttttacttttgttgagaaaagttaaatcc

SEQ ID NO: 2059 - protein, 285 aa, Arabidopsis thaliana
  misc_feature (95)..(161): Pfam Name: Ribosomal_S5 Pfam Description: Ribosomal protein S5, N-terminal domai
  misc_feature (178)..(251): Pfam Name: Ribosomal_S5_C Pfam Description: Ribosomal protein S5, C-terminal domai
  misc_feature (1)..(285): Ceres Clone ID no. 17415
  misc_feature (1)..(285): Bit score of 681.5 for HMM based on sequences of Figure 37
  misc_feature (1)..(285): Functional Homolog Of SEQ ID NO. 2035
MAERGGERGVERGGERGDFGRGFGGRGGRGDRGGRGRGGRGGRRGGRASEEEKWVPVTKLGRHVAAGHIKQIEQIYLHSLPVKEYQIIDMLIGPTLKDEVMKIMPVQKQTRAGQRTRFKAFVVVGDGNGHVGLGVKCSKEVATAIRGAIILAKLSVVPVRRGYWGNKIGKPHTVPCKVTGKCGSVTVRMVPAPRGSGIVAARVPKKVLQFAGIDDVFTSSRGSTKTLGNFVKATFDCLQKTYGFLTPEFWKETRFSRSPYQEHTDFLASKALSTSKPDPVVEDQA

SEQ ID NO: 2060 - DNA, 1050 bp, Arabidopsis thaliana
  misc_feature (1)..(1050): Ceres Clone ID no. 101250
  misc_feature (1)..(1050): Encodes the peptide sequence at SEQ ID NO. 2061
aacacaccgaaaactgaatcaaatctcctagctcttctacgcaaaatcgagtgcatcgacaatggcggaacgtggtgtcgaacgtggtggagatcgcggcgatttcggacgtggattcggtggtcgcggcggtggaagaggtggtccgagaggtcgtggtcgccgtgcaggtcgtgctccagaggaggagaaatgggtgccagtgactaagcttggtcgtctcgtaaaggaaggtaagatcacaaagattgagcagatctacctccattctctcccagtcaaggagtaccagatcatagatttactcgtcggtccttcattgaaagacgaagtgatgaaaatcatgccggttcaaaaacaaaccagagccggtcagagaacgagattcaaggccttcatcgtcgtcggagatagtaacggtcacgtcggattaggagtcaaatgctccaaggaagttgcgacggcgatcagaggcgcgatcattctcgcgaaattgtctgtggttccgatacgaagaggttattggggtaacaagattggaaaaccacatacggttccgtgtaaggtaaccgggaaatgtggatctgttactgtacgtatggttccagctccgagaggttctggtattgtggcggctagagttcctaagaaggttcttcaattcgctggaattgatgatgtctttacttcttctagaggatccaccaaaactcttggaaacttcgtcaaggcaacatttgattgtctgcagaagacatacggattccttacaccggaattctggaaagagacgagattctcaaaatcaccataccaagagcacactgatttcttgcttatacctcctggcgtcaagatcagcgaggttgttgtagacaaaagcgtagagtaataccactttatcttgttacatgagacttgagtgttgtcaaaagctcaagtcagattttgttccaaccttggttttttgatttgtcggttataatgtctttagtaatctagatacgtatctgttttacactttgaattcaatcatacgaatcttcttat

SEQ ID NO: 2061 - protein, 276 aa, Arabidopsis thaliana
  misc_feature (86)..(152): Pfam Name: Ribosomal_S5 Pfam Description: Ribosomal protein S5, N-terminal domai
  misc_feature (169)..(242): Pfam Name: Ribosomal_S5_C Pfam Description: Ribosomal protein S5, C-terminal domai
  misc_feature (1)..(276): Ceres Clone ID no. 101250
  misc_feature (1)..(276): Bit score of 653.8 for HMM based on sequences of Figure 37
  misc_feature (1)..(276): Functional Homolog Of SEQ ID NO. 2035
MAERGVERGGDRGDFGRGFGGRGGGRGGPRGRGRRAGRAPEEEKWVPVTKLGRLVKEGKITKIEQIYLHSLPVKEYQIIDLLVGPSLKDEVMKIMPVQKQTRAGQRTRFKAFIVVGDSNGHVGLGVKCSKEVATAIRGAIILAKLSVVPIRRGYWGNKIGKPHTVPCKVTGKCGSVTVRMVPAPRGSGIVAARVPKKVLQFAGIDDVFTSSRGSTKTLGNFVKATFDCLQKTYGFLTPEFWKETRFSKSPYQEHTDFLLIPPGVKISEVVVDKSVE

SEQ ID NO: 2062 - DNA, 1150 bp, Glycine max
  misc_feature (1)..(1150): Ceres Clone ID no. 1243814
  misc_feature (1)..(1150): Encodes the peptide sequence at SEQ ID NO. 2063
ctacttagagcagccaaaccttacgcattccatttctctctattcgctctctttcaatcacaacaacatggccgaacgtggaggcggagaccgtgccggtttcggtcgcggctttggcggtcgtggacgcggcggcgacaggggacgagggcggcgcagggcaggagggcgccgcgacgaggaggagaagtgggtcccagtgacgaagctggggcgcctggtgaaggaggggaaaattcggagcctggagcagatctacctacactcgctcccaatcaaggagcaccaaatcattgacaccctcgtggggcccaccctgaaggacgaggtgatgaagatcatgcccgtccagaagcagacccgcgccggtcagcgaacccgcttcaaggccttcgtggtggtcggcgacaacaacggccacgtcggtctcggagtgaagtgcagcaaggaagtcgccaccgccatacgcggcgccatcattctcgcaaagctctctgttattcctgtgaggagaggctattggggtaacaagatcggaaagccccacaccgttccctgcaaggttaccggaaagtgtggctccgtcaccgtccgcatggtccccgcccctcgtgggtccggaatcgtcgccgctagggtccccaagaaggtcttgcagttcgctggaatcgatgacgtcttcacttcctccaggggttccaccaaaaccctcggaaatttcgtcaaggctacttttgactgtttgctgaaaacctacggttttctaacacctgaattctggaaggagactcggttctccaaatcaccattccaagagtacactgatctattggcaaagccaacagggaaggcccttatcctcgaggaggaaagggtggaggcttgagttagcagaagcagcagcagttttgatgttatcggatgattgtgcctcgtcttaagcatgctaggacccagtaattatatgttttgctaccttttgttatttcattttctattgaaggacatattatatatctccatgctttttgttttttctcaaatttagttgaatggatattatttactgaactttcaaacaggggtttattaaatttttcatgctgtcccaactaaatcataattcaaagaaaagaaaatgtgtttctgc

SEQ ID NO: 2063 - protein, 272 aa, Glycine max
  misc_feature (83)..(149): Pfam Name: Ribosomal_S5 Pfam Description: Ribosomal protein S5, N-terminal domai
  misc_feature (166)..(239): Pfam Name: Ribosomal_S5_C Pfam Description: Ribosomal protein S5, C-terminal domai
  misc_feature (1)..(272): Ceres Clone ID no. 1243814
  misc_feature (1)..(272): Bit score of 679.1 for HMM based on sequences of Figure 37
  misc_feature (1)..(272): Functional Homolog Of SEQ ID NO. 2035
MAERGGGDRAGFGRGFGGRGRGGDRGRGRRRAGGRRDEEEKWVPVTKLGRLVKEGKIRSLEQIYLHSLPIKEHQIIDTLVGPTLKDEVMKIMPVQKQTRAGQRTRFKAFVVVGDNNGHVGLGVKCSKEVATAIRGAIILAKLSVIPVRRGYWGNKIGKPHTVPCKVTGKCGSVTVRMVPAPRGSGIVAARVPKKVLQFAGIDDVFTSSRGSTKTLGNFVKATFDCLLKTYGFLTPEFWKETRFSKSPFQEYTDLLAKPTGKALILEEERVEA

SEQ ID NO: 2064 - DNA, 1101 bp, Gossypium hirsutum
  misc_feature (1)..(1101): Ceres Clone ID no. 1840067
  misc_feature (1)..(1101): Encodes the peptide sequence at SEQ ID NO. 2065
atgaacccttatctccgtctataaacctaaaccctaaaagggcttaaaaccctatctccatatactcacctcatataaaaccttgacttcctgccctttttgctcattacttcatctctacatcccgaaacaaaaagcaaataatggcagaaagaggcggcggcgaacgcggtgctttcaggcgtggcttcggcggcgggagatccgaccgtgggccaagaggtcggcgccgtggccgcaaggatgaggaggagaaatgggttcctgttacaaaacttggccgtttagtcaaatcgggaaaaatcacatccctcgaacaaatttacctccactccctccccatcaaggagtaccaaatcatcgaccaactcgttggcccttcactgaaagacgaggtgatgaagatcactcccgtccagaaacaaacacgtgccggccagcgcactcgtttcaaggcattcgttgtcgtcggcgacggaaacgggcacgttgggttgggggtgaagtgcagcaaagaagtagcgacggcaataagaggggcgataatattggccaagttgtcggtgataccagtaaggagaggctactgggggaataagatcgggaagcctcatacagtgccgtgtaaggttaccggaaaatgtggttcggtcactgttaggatggtgccagctcctagaggtgcggggattgtggctgctagggtgcccaagaaggtgcttcagtttgctgggattgaagatgttttcacttcttcaaggggttctaccaagactcttggtaactttgtaaaggccaccttcgagtgtcttctgaaaacttatggtttcttgactcctgatttctggaaagagactcgattcacaagatctcctttccaagagtatactgatctgttgggaaagccatcaaagacgctcgtactcgaggatgtcgagagagtggatgtatgatgtgccttcagggccttagaatagtaaaatatcaagttccttttgtgtagtttaagttaaaatgatgctatcttcactctttttgattgcttttgtattgtcagagagatatttggaatttcagcaaccgcatattgtttttctctcg

SEQ ID NO: 2065 - protein, 269 aa, Gossypium hirsutum
  misc_feature (80)..(146): Pfam Name: Ribosomal_S5 Pfam Description: Ribosomal protein S5, N-terminal domai
  misc_feature (163)..(236): Pfam Name: Ribosomal_S5_C Pfam Description: Ribosomal protein S5, C-terminal domai
  misc_feature (1)..(269): Ceres Clone ID no. 1840067
  misc_feature (1)..(269): Bit score of 664.1 for HMM based on sequences of Figure 37
  misc_feature (1)..(269): Functional Homolog Of SEQ ID NO. 2035
MAERGGGERGAFRRGFGGGRSDRGPRGRRRGRKDEEEKWVPVTKLGRLVKSGKITSLEQIYLHSLPIKEYQIIDQLVGPSLKDEVMKITPVQKQTRAGQRTRFKAFVVVGDGNGHVGLGVKCSKEVATAIRGAIILAKLSVIPVRRGYWGNKIGKPHTVPCKVTGKCGSVTVRMVPAPRGAGIVAARVPKKVLQFAGIEDVFTSSRGSTKTLGNFVKATFECLLKTYGFLTPDFWKETRFTRSPFQEYTDLLGKPSKTLVLEDVERVDV

SEQ ID NO: 2066 - DNA, 1093 bp, Gossypium hirsutum
  misc_feature (1)..(1093): Ceres Clone ID no. 1853717
  misc_feature (1)..(1093): Encodes the peptide sequence at SEQ ID NO. 2067
accttctttccgtctcaccatttgtctccaaccctaaccaaaggcaaaaggaaaaaaaatggcagaaagaggcggaggtgaacgccgcgctttcaggcgtggctttggtggtggtagaggtgaccgtggtccaagaggcaggcgccgcggccgcaaggacgaagaggaaaaatgggtacccgtcacgaaactcggccgcttagtcaaagccggcaagatcacatcccttgagcaaatctacctccattctctccctatcaaggagtaccaaatcatcgaccaactcgtcggcccttcactgaaagacgaggtcatgaagatcactccagttcagaaacaaactcgcgccggtcagcgtacgcgcttcaaggccttcgtcgtcgtcggtgacggaaatggacacgttggactcggtgtcaaatgtagcaaagaagttgcgacggctataagaggggcgatcatattggctaagttgtcagtgataccggttagaagaggttactggggaaataagatcggaaaaccccatactgttccatgcaaggttaccgggaaatgtgggtccgtcaccgttaggatggtgccggctcctagaggtgctggtattgtggctgctagggttcccaaaaaggtgcttcagtttgctggaattgaagatgtcttcacttcttcaaggggttcaaccaaaactcttggaaactttgtcaaggccacctttgaatgtcttctgaaaacatatggtttcttgacaccggatttctggagagagactcgtttcacaaggtctccattccaggagtatactgatctgttgggaaagccatcgaagacccttgtactggaagatgtcgagagagttgatatctgattgaagatcaacagtgtcattacttattagtaagttggatgtgtgtctaggtcctttctatgttgcaatctttacttgtgtctttgcttgttttgattttgtcatgagattaaatcagtaatggttcaattttgttgtgttttttcatctggattctttataaagattgtggatgagttgaggacttgtctatttatatgctgcttgcttgtgaattaatgtttc

SEQ ID NO: 2067 - protein, 269 aa, Gossypium hirsutum
  misc_feature (80)..(146): Pfam Name: Ribosomal_S5 Pfam Description: Ribosomal protein S5, N-terminal domai
  misc_feature (163)..(236): Pfam Name: Ribosomal_S5_C Pfam Description: Ribosomal protein S5, C-terminal domai
  misc_feature (1)..(269): Ceres Clone ID no. 1853717
  misc_feature (1)..(269): Bit score of 662.4 for HMM based on sequences of Figure 37
  misc_feature (1)..(269): Functional Homolog Of SEQ ID NO. 2035
MAERGGGERRAFRRGFGGGRGDRGPRGRRRGRKDEEEKWVPVTKLGRLVKAGKITSLEQIYLHSLPIKEYQIIDQLVGPSLKDEVMKITPVQKQTRAGQRTRFKAFVVVGDGNGHVGLGVKCSKEVATAIRGAIILAKLSVIPVRRGYWGNKIGKPHTVPCKVTGKCGSVTVRMVPAPRGAGIVAARVPKKVLQFAGIEDVFTSSRGSTKTLGNFVKATFECLLKTYGFLTPDFWRETRFTRSPFQEYTDLLGKPSKTLVLEDVERVDI

SEQ ID NO: 2068 - DNA, 813 bp, Populus balsamifera subsp. trichocarpa
  misc_feature (1)..(813): Ceres Annot ID no. 1506849
  misc_feature (1)..(813): Encodes the peptide sequence at SEQ ID NO. 2069
atggcagagcgcccccccgcagaacgtggttccttcggccgtggtttcggtggccgtggtggacgtggagaccgtggtggccgaggccgccgccgcggtggacgcaaagaggaagaagaaaaatgggttcccgtcaccaaactaggccgccttgtgaaagacggaaaaatatcctccgtcgaacaaatctaccttcactccctacccatcaaggagtatcaaatcattgacactctcattggccctgctttgaaagatgaggtgatgaaaatcaccccagttcagaaacaaaccagagccggtcagcgaacccggttcaaggcctttgttgttgttggcgattgcaatggacatgttgggttgggtgtgaagtgtgctaaagaggtggctactgccattcgcggggctattattttggctaaactgtcgattattcctgtgagaagagggtactggggaaacaagatcggaaagccacatactgtgccttgtaaggttacagggaagtgtggaagtgtaactgtgagaatggttcctgcccctcgtggagctgggatcgttgctgctagggttccaaagaaggtgcttcagtttgctgggattgatgatgttttcacatcatccagaggatctaccaagactcttgggaacttcgtcaaggcaacatttgactgcttgctgaagacttatgggttccttacacctgacttttggaaggagacccgcttcataagatctccattccaagagtacacagatctcttggcaaagcctactagcaaggttctcatcgctgaggttcaacaagaatga

SEQ ID NO: 2069 - protein, 270 aa, Populus balsamifera subsp. trichocarpa
  misc_feature (83)..(149): Pfam Name: Ribosomal_S5 Pfam Description: Ribosomal protein S5, N-terminal domai
  misc_feature (166)..(239): Pfam Name: Ribosomal_S5_C Pfam Description: Ribosomal protein S5, C-terminal domai
  misc_feature (1)..(270): Ceres Annot ID no. 1506849
  misc_feature (1)..(270): Bit score of 669.1 for HMM based on sequences of Figure 37
  misc_feature (1)..(270): Functional Homolog Of SEQ ID NO. 2035
MAERPPAERGSFGRGFGGRGGRGDRGGRGRRRGGRKEEEEKWVPVTKLGRLVKDGKISSVEQIYLHSLPIKEYQIIDTLIGPALKDEVMKITPVQKQTRAGQRTRFKAFVVVGDCNGHVGLGVKCAKEVATAIRGAIILAKLSIIPVRRGYWGNKIGKPHTVPCKVTGKCGSVTVRMVPAPRGAGIVAARVPKKVLQFAGIDDVFTSSRGSTKTLGNFVKATFDCLLKTYGFLTPDFWKETRFIRSPFQEYTDLLAKPTSKVLIAEVQQE

SEQ ID NO: 2070 - DNA, 1015 bp, Gossypium hirsutum
  misc_feature (1)..(1015): Ceres Clone ID no. 1895361
  misc_feature (1)..(1015): Encodes the peptide sequence at SEQ ID NO. 2071
aattggacagcataccctccctcttggtaacacatacaaaccaataacaaaatggcagaaagaggcggaggagagcgtggagctttcaggcgtggctttggtggaagatccgaccgtggcccaagaggaaggcgtcgtggccgcagagaggaagaagagaaatgggtgcccgtaactaagcttgggcgtttggtcaaaaccggaaaaatcacgtcccttgagcaaatctacctccactccctccccatcaaagagtaccaaatcatcgaccaactcgttggcccttcattgaaagatgaggtcatgaagatcactccagtccagaaacaaacccgtgccgggcagcgtacccgtttcaaggccttcgtcgtcgttggcgacggaaatgggcacgtcggcttgggagttaagtgtagcaaagaagttgcaacggctataagaggggccataatattggcgaaattatcggttataccggtgaggagagggtattgggggaataagatcggaaaacctcacacagtgccctgcaaagttactgggaaatgtgggtctgtcactgttaggatggtgcccgcaccgagaggtgccggtattgtggctgctagggtgcccaagaaggtgctccagttcgctggaattgacgatgtttttacttcttctaggggttctactaagacgcttggtaacttcgttaaggccacctttgagtgtctattgaaaacgtacggcttcttgactcctgatttctggaaggagactcgtttcacaaggtctcctttccaggagtatactgatctgttgggaaagccagcgaagactcttgttcttgaagatgcagagagggtggatgtgtgatggtgattaagagggctttagtgcctagggtagtaatatcaacttcttttttgcctatcaagacaatgcctatgttcacttctttgcttctttgcttctttggttgtcataagaaatttaatctcaagttttgttttaatcaatccggatttgattc

SEQ ID NO: 2071 - protein, 268 aa, Gossypium hirsutum
  misc_feature (79)..(145): Pfam Name: Ribosomal_S5 Pfam Description: Ribosomal protein S5, N-terminal domai
  misc_feature (162)..(235): Pfam Name: Ribosomal_S5_C Pfam Description: Ribosomal protein S5, C-terminal domai
  misc_feature (1)..(268): Ceres Clone ID no. 1895361
  misc_feature (1)..(268): Bit score of 662.5 for HMM based on sequences of Figure 37
  misc_feature (1)..(268): Functional Homolog Of SEQ ID NO. 2035
MAERGGGERGAFRRGFGGRSDRGPRGRRRGRREEEEKWVPVTKLGRLVKTGKITSLEQIYLHSLPIKEYQIIDQLVGPSLKDEVMKITPVQKQTRAGQRTRFKAFVVVGDGNGHVGLGVKCSKEVATAIRGAIILAKLSVIPVRRGYWGNKIGKPHTVPCKVTGKCGSVTVRMVPAPRGAGIVAARVPKKVLQFAGIDDVFTSSRGSTKTLGNFVKATFECLLKTYGFLTPDFWKETRFTRSPFQEYTDLLGKPAKTLVLEDAERVDV

SEQ ID NO: 2072 - DNA, 1007 bp, Gossypium hirsutum
  misc_feature (1)..(1007): Ceres Clone ID no. 1793726
  misc_feature (1)..(1007): Encodes the peptide sequence at SEQ ID NO. 2073
attggacaggaaaccctcgctcttgtaaacacatacaaaccaatagccaaatggcagaaagaggcggaggagagcgtggagctttcaggcgtggctttggtggaagatccgaccgtggcccaagaggaaggcgtcgtggccgcagagaggaagaagagaaatgggtgcccgtaactaagcttgggcgtttggtaaaaactggaaaaatcacgtcccttgagcaaatatacctccactccctccccatcaaagagtaccaaatcatcgaccaactcgttggcccttcattgaaagatgaggtcatgaagatcactccagtccagaaacaaacccgtgccgggcaacgtacccgtttcaaggccttcgtagtcgttggcgacggaaatgggcacgtcggcttgggagttaagtgtagcaaagaagtcgcaacggctataagaggggcgataatattggcgaaattgtcggttataccggtgaggagagggtattgggggaataagattggaaagcctcacacagtgccctgcaaagttactgggaaatgtgggtctgtcactgttaggatggtgcccgctccgagaggtgccggtattgtggctgctagggtgcccaagaaggtgctccagtttgctggaattgaggatgtttttacttcttctaggggttctactaagacgcttggtaacttcgttaaggccacctttgagtgtctattgaaaacctacggcttcttgactcctgatttctggaaggagactcgtttcgcaaggtctcctttccaggagtatactgatctgttgggaaagccagcgaagactcttgtacttgaagatgcagagagggtggatgtgtgatggtgattaagagggctttagtgcctagggtagtaatatcaacttcttttttgcctatcaagacaatgcctatgttcacttctttgcttcttcggttgtcataggaaatttaagctcaagttttgttttaatcaatccggattttattcg

SEQ ID NO: 2073 - protein, 268 aa, Gossypium hirsutum
  misc_feature (79)..(145): Pfam Name: Ribosomal_S5 Pfam Description: Ribosomal protein S5, N-terminal domai
  misc_feature (162)..(235): Pfam Name: Ribosomal_S5_C Pfam Description: Ribosomal protein S5, C-terminal domai
  misc_feature (1)..(268): Ceres Clone ID no. 1793726
  misc_feature (1)..(268): Bit score of 661.5 for HMM based on sequences of Figure 37
  misc_feature (1)..(268): Functional Homolog Of SEQ ID NO. 2035
MAERGGGERGAFRRGFGGRSDRGPRGRRRGRREEEEKWVPVTKLGRLVKTGKITSLEQIYLHSLPIKEYQIIDQLVGPSLKDEVMKITPVQKQTRAGQRTRFKAFVVVGDGNGHVGLGVKCSKEVATAIRGAIILAKLSVIPVRRGYWGNKIGKPHTVPCKVTGKCGSVTVRMVPAPRGAGIVAARVPKKVLQFAGIEDVFTSSRGSTKTLGNFVKATFECLLKTYGFLTPDFWKETRFARSPFQEYTDLLGKPAKTLVLEDAERVDV

SEQ ID NO: 2074 - DNA, 1108 bp, Triticum aestivum
  misc_feature (1)..(1108): Ceres Clone ID no. 1448380
  misc_feature (1)..(1108): Encodes the peptide sequence at SEQ ID NO. 2075
ctcttccacccttcaccgccgccagcgccacagcctccaaaccctcgatctcccgcatcggagctccctgcccccaaccccccacccccacccaaccatggcggaccgcggcggcgagcgtggtggcgaccgcggaggcgagcgcggcgggttcggccgcggcttcgggcgcggcgggcgcggggaccgtggcgggcgccgcggcggccgtcgtggccctcgccaggaggaggagaagtgggtgcccgtcaccaaactcggccgcctcgtcaaggagggccgcttcaccaagatggaggagctctacctccactcgctacccatcaaggagcaccagatcgtggagcagctctgcccggggctcaaggacgaggtgatgaagatcacccccgtgcagaagcagacccgcgccggccagcggacccgcttcaaggcgttcgtcgtcgtcggcgacagcaacggccacgtcgggctcggcgtcaagtgcgccaaggaggtggccacggccatccgcggcgccatcatcctcgcaaagctctccatcgtgcccgttaggaggggctactgggggaacaagatcggcctgccccacaccgtgccctgcaaggtcaccggcaagtgcggctctgtcaccgtgcgcatggtgcccgccccgaggggttctggaatcgtcgccgcgcgcgtccccaagaaggtgctccagttcgctggtattgatgacgtcttcacttcctcgcgtggatccaccaagaccctcggcaacttcgtcaaggcaaccttcgactgcctgatgaagacctatggattcctcacccctgacttctggagggagacgaccttcaccaaggcaccgtaccaggagttcactgacattttggcgaagccgacgaaggccctgatgcttgatgcaccagccgagaagatagaagcttaggatgtccgtgtaaagggtttttactagctgggagctgtctaatgcactttgctttattcagttattaatactttgaatcgtgctgtttcaggatgtctctgtttgccgtcaagtgttggtttgtggaactatgctactctcttttatcgtcaatggacgctacataattatggc

SEQ ID NO: 2075 - protein, 278 aa, Triticum aestivum
  misc_feature (88)..(154): Pfam Name: Ribosomal_S5 Pfam Description: Ribosomal protein S5, N-terminal domai
  misc_feature (171)..(244): Pfam Name: Ribosomal_S5_C Pfam Description: Ribosomal protein S5, C-terminal domai
  misc_feature (1)..(278): Ceres Clone ID no. 1448380
  misc_feature (1)..(278): Bit score of 683.1 for HMM based on sequences of Figure 37
  misc_feature (1)..(278): Functional Homolog Of SEQ ID NO. 2035
MADRGGERGGDRGGERGGFGRGFGRGGRGDRGGRRGGRRGPRQEEEKWVPVTKLGRLVKEGRFTKMEELYLHSLPIKEHQIVEQLCPGLKDEVMKITPVQKQTRAGQRTRFKAFVVVGDSNGHVGLGVKCAKEVATAIRGAIILAKLSIVPVRRGYWGNKIGLPHTVPCKVTGKCGSVTVRMVPAPRGSGIVAARVPKKVLQFAGIDDVFTSSRGSTKTLGNFVKATFDCLMKTYGFLTPDFWRETTFTKAPYQEFTDILAKPTKALMLDAPAEKIEA

SEQ ID NO: 2076 - DNA, 885 bp, Populus balsamifera subsp. trichocarpa
  misc_feature (1)..(885): Ceres Annot ID no. 1453696
  misc_feature (1)..(885): Encodes the peptide sequence at SEQ ID NO. 2077
atggcagagcgcccccccgcagaacgtggttccttcggccgtggtttcggtggccgtggtggacgtggagaccgtggtggccgaggccgccgccgcggtggacgcaaagaggaagaagaaaaatgggttcccgtcaccaaactaggccgccttgtgaaagacggaaaaatatcctccgtcgaacaaatctaccttcactccctacccatcaaggagtatcaaatcattgacactctcattggccctgctttgaaagatgaggtgatgaaaatcaccccagttcagaaacaaaccagagccggtcagcgaacccggttcaaggcctttgttgttgttggcgattgcaatggacatgttgggttgggtgtgaagtgtgctaaagaggtggctactgccattcgcggggctattattttggctaaactgtcgattattcctgtgagaagagggtactggggaaacaagatcggaaagccacatactgtgccttgtaaggttacagggaagtgtggaagtgtaactgtgagaatggttcctgcccctcgtggagctgggatcgttgctgctagggttccaaagaaggtgcttcagtttgctgggattgatgatgttttcacatcatccagaggatctaccaagactcttgggaacttcgtcaagttgttgggtgttagtatccataggattaagggtttgtatttgggtggatatctaaccttttttcatctgcaggcaacatttgactgcttgctgaagacttatgggttccttacacctgacttttggaaggagacccgcttcataagatctccattccaagagtacacagatctcttggcaaagcctactagcaaggttctcatcgctgaggttcaacaagaatga

SEQ ID NO: 2077 - protein, 294 aa, Populus balsamifera subsp. trichocarpa
  misc_feature (83)..(149): Pfam Name: Ribosomal_S5 Pfam Description: Ribosomal protein S5, N-terminal domai
  misc_feature (166)..(263): Pfam Name: Ribosomal_S5_C Pfam Description: Ribosomal protein S5, C-terminal domai
  misc_feature (1)..(294): Ceres Annot ID no. 1453696
  misc_feature (1)..(294): Bit score of 634.5 for HMM based on sequences of Figure 37
  misc_feature (1)..(294): Functional Homolog Of SEQ ID NO. 2035
MAERPPAERGSFGRGFGGRGGRGDRGGRGRRRGGRKEEEEKWVPVTKLGRLVKDGKISSVEQIYLHSLPIKEYQIIDTLIGPALKDEVMKITPVQKQTRAGQRTRFKAFVVVGDCNGHVGLGVKCAKEVATAIRGAIILAKLSIIPVRRGYWGNKIGKPHTVPCKVTGKCGSVTVRMVPAPRGAGIVAARVPKKVLQFAGIDDVFTSSRGSTKTLGNFVKLLGVSIHRIKGLYLGGYLTFFHLQATFDCLLKTYGFLTPDFWKETRFIRSPFQEYTDLLAKPTSKVLIAEVQQE

SEQ ID NO: 2078 - DNA, 1092 bp, Panicum virgatum
  misc_feature (1)..(1092): Ceres Clone ID no. 1725377
  misc_feature (1)..(1092): Encodes the peptide sequence at SEQ ID NO. 2079
ttcgcgccgccgcagcacccaatccttcatccccctcactcaccggagcgccgcggccccccacccttcagcaagccatggcggagcgcggcggggagcgcggtggcgagcgcggcgggttcggcaggggcttcggccgcggcggccgcggcgaccgtggcgggcgccgtggtgggcggcgcgggcagcgccaggaggaggagaagtgggtccccgtcaccaagctcggccgcctcgtgaaggagcagaagatcaccaagatcgaggagatctacctgcactcgctccccgtcaaggagcaccagatcgtggagaccctcctccctggcctcaaggacgaggtcatgaagatcacgcccgtgcagaagcagacgcgcgccgggcagcgcacccgcttcaaggccttcgtcgtcgtcggggactgcgacggccacgtcgggctcggcgtcaagtgcgccaaggaggtggccaccgccatccgcggcgccatcatcctcgccaagctctccgtcgtgcccgtcaggaggggctactggggtaacaagatcggccagccgcacaccgtgccgtgcaaggtcaccggcaagtgcggctccgtcacagtgcgcatggtgcccgcccccaggggttccggcatcgtcgccgcgcgcgtgcccaagaaggtgctgcagttcgctggcattgaggatgtcttcacctcgtcccgcggctccaccaagactcttggcaacttcgtcaaggcaaccttcgactgcctgatgaagacctacggtttccttacacctgagttctggaaggagaccagtttctccaggaccccgttccagcagttcactgatatcctggcaaagcctaccaagggtcttatgcttgaggccccagttgagacagtagaggcttaggatgttggagtaaagagttctacttgcttcgagttctctaatgcacctactatatcatagttaagaacttagggagtcaactttcggtcttctttgcctggatgttgctattttctgtcaagttttggattatggtgcaatgctactcctattgctgaatgctacataaatgtctcatgaatcgtcttcc

SEQ ID NO: 2079 - protein, 274 aa, Panicum virgatum
  misc_feature (84)..(150): Pfam Name: Ribosomal_S5 Pfam Description: Ribosomal protein S5, N-terminal domai
  misc_feature (167)..(240): Pfam Name: Ribosomal_S5_C Pfam Description: Ribosomal protein S5, C-terminal domai
  misc_feature (1)..(274): Ceres Clone ID no. 1725377
  misc_feature (1)..(274): Bit score of 671.6 for HMM based on sequences of Figure 37
  misc_feature (1)..(274): Functional Homolog Of SEQ ID NO. 2035
MAERGGERGGERGGFGRGFGRGGRGDRGGRRGGRRGQRQEEEKWVPVTKLGRLVKEQKITKIEEIYLHSLPVKEHQIVETLLPGLKDEVMKITPVQKQTRAGQRTRFKAFVVVGDCDGHVGLGVKCAKEVATAIRGAIILAKLSVVPVRRGYWGNKIGQPHTVPCKVTGKCGSVTVRMVPAPRGSGIVAARVPKKVLQFAGIEDVFTSSRGSTKTLGNFVKATFDCLMKTYGFLTPEFWKETSFSRTPFQQFTDILAKPTKGLMLEAPVETVEA

SEQ ID NO: 2080 - protein, 274 aa, Oryza sativa subsp. japonica
  misc_feature (84)..(150): Pfam Name: Ribosomal_S5 Pfam Description: Ribosomal protein S5, N-terminal domai
  misc_feature (167)..(240): Pfam Name: Ribosomal_S5_C Pfam Description: Ribosomal protein S5, C-terminal domai
  misc_feature (1)..(274): Public GI ID no. 115456089
  misc_feature (1)..(274): Bit score of 680.4 for HMM based on sequences of Figure 37
  misc_feature (1)..(274): Functional Homolog Of SEQ ID NO. 2035
MAERGGERGGERGGFGRGFGRGGRGDRGGRRGGRRGPRQEEEKWVPVTKLGRLVKEGRFSKIEEIYLHSLPVKEHQIVETLVPGLKDEVMKITPVQKQTRAGQRTRFKAFVVVGDNNGHVGLGVKCAKEVATAIRGAIILAKLSVVPVRRGYWGNKIGQPHTVPCKVTGKCGSVTVRMVPAPRGSGIVAARVPKKVLQFAGIEDVFTSSRGSTKTLGNFVKATFDCLMKTYGFLTPDFWRDTKFVKSPFQEYTDLLAKPTKALMIDAPVENVEA

SEQ ID NO: 2081 - DNA, 825 bp, Sorghum bicolor
  misc_feature (1)..(825): Ceres Annot ID no. 8632056
  misc_feature (1)..(825): Encodes the peptide sequence at SEQ ID NO. 2082
atggcggagcgcggcggtgagcgtggcggcgagcgcggagggttcggccgtggcttcgggcgcggtggacgcggcgaccgtggcgggcgccgcggcggccgtcgtggcccgcgtcaggaggaagagaagtgggtacccgtcaccaagctcggccgcctcgtcaaggagagcaagatcaacaagatcgaggagatctacctccactcgctccccgtcaaggagcaccagatcatcgagaccctcgtcccggggctcaaggatgaggtcatgaagatcactccagtccagaagcagacccgcgccgggcagcgcacccgcttcaaggccttcgtcgtcgtcggcgatggcgacggtcacgtcggcctgggagtcaagtgcgccaaggaggtggccacagccatccgcggcgccatcatcctcgccaagctctctgtcgtccccgtcaggaggggttactggggtaacaagatcgggcagccgcacacagtgccctgcaaggtcaccggcaagtgtggctccgtcaccgtgcgcatggtgcccgcacccaggggttctggcatcgtcgccgcgcgtgtgcccaagaaggtgctgcagttcgctggcattgaggatgtcttcacctcgtcccgtggctccactaagacccttggcaacttcgtcaaggcgaccttcgactgcttgatgaagacctatggcttccttactcctgaattctggactcagaccaaattctccatgactccattccagcagttcacagaccttctgggaaagcccaccaagggtcttgtgcttgaggctccaactgagacagcagaggcttag

SEQ ID NO: 2082 - protein, 274 aa, Sorghum bicolor
  misc_feature (84)..(150): Pfam Name: Ribosomal_S5 Pfam Description: Ribosomal protein S5, N-terminal domai
  misc_feature (167)..(240): Pfam Name: Ribosomal_S5_C Pfam Description: Ribosomal protein S5, C-terminal domai
  misc_feature (1)..(274): Ceres Annot ID no. 8632056
  misc_feature (1)..(274): Bit score of 666.1 for HMM based on sequences of Figure 37
  misc_feature (1)..(274): Functional Homolog Of SEQ ID NO. 2035
MAERGGERGGERGGFGRGFGRGGRGDRGGRRGGRRGPRQEEEKWVPVTKLGRLVKESKINKIEEIYLHSLPVKEHQIIETLVPGLKDEVMKITPVQKQTRAGQRTRFKAFVVVGDGDGHVGLGVKCAKEVATAIRGAIILAKLSVVPVRRGYWGNKIGQPHTVPCKVTGKCGSVTVRMVPAPRGSGIVAARVPKKVLQFAGIEDVFTSSRGSTKTLGNFVKATFDCLMKTYGFLTPEFWTQTKFSMTPFQQFTDLLGKPTKGLVLEAPTETAEA

SEQ ID NO: 2083 - DNA, 756 bp, Gossypium hirsutum
  misc_feature (1)..(756): Ceres Clone ID no. 100058895
  misc_feature (1)..(756): Encodes the peptide sequence at SEQ ID NO. 2084
ccctcaaagcctacaaaaaaagagcaaaaaatggcagaaagaggcggcggagagcgtggcgcttttaggcgcggcttcggtggaggaaggggtgaccgtggtccaagaggcaggcgccgtggccgcaaggacgaagaggagaaatgggtacccgtcacgaaactcggccgtttagtcaaatccgggaaaatcacgtccctcgaacaaatttacctccactctctccctatcaaagagtaccaaatcatcgaccagctcgtcggcccttccttgaaagacgaagtcatgaagatcactcccgtccagaaacaaacacgtgcaggccagcgcacgcgtttcaaggccttcgtcgtcgtcggagacggaaacggacacgtcggattgggtgtcaagtgcagcaaagaagttgcgacggctataagaggggcgataatattggcgaagttgtcggttatcccggtgaggagaggttactgggggaataagatcgggaaaccccatacggtgccgtgtaaggttaccgggaaatgtggatccgttactgttaggatggtgcctgctccgagaggtgcggggattgtggctgctagggtccccaagaaagttcttcagtttgcagggatcgaagatgttttcacttcttccaggggatccaccaagactcttggtaactttgtcaaggccacctttgagtgtcttctgaaaacttatggtttcttgactcccgatttctggaaagagactcgtttcacaagg

SEQ ID NO: 2084 - protein, 242 aa, Gossypium hirsutum
  misc_feature (80)..(146): Pfam Name: Ribosomal_S5 Pfam Description: Ribosomal protein S5, N-terminal domai
  misc_feature (163)..(236): Pfam Name: Ribosomal_S5_C Pfam Description: Ribosomal protein S5, C-terminal domai
  misc_feature (1)..(242): Ceres Clone ID no. 100058895
  misc_feature (1)..(242): Bit score of 579.2 for HMM based on sequences of Figure 37
  misc_feature (1)..(242): Functional Homolog Of SEQ ID NO. 2035
MAERGGGERGAFRRGFGGGRGDRGPRGRRRGRKDEEEKWVPVTKLGRLVKSGKITSLEQIYLHSLPIKEYQIIDQLVGPSLKDEVMKITPVQKQTRAGQRTRFKAFVVVGDGNGHVGLGVKCSKEVATAIRGAIILAKLSVIPVRRGYWGNKIGKPHTVPCKVTGKCGSVTVRMVPAPRGAGIVAARVPKKVLQFAGIEDVFTSSRGSTKTLGNFVKATFECLLKTYGFLTPDFWKETRFTR

SEQ ID NO: 2085 - DNA, 1065 bp, Zea mays
  misc_feature (1)..(1065): Ceres Clone ID no. 100925979
  misc_feature (1)..(1065): Encodes the peptide sequence at SEQ ID NO. 2086
cacccgtccagcaccgccactgttcgcgccgccgtagcccccaaaccaccatcaccctccggagcgtcgcagcgatcccaccctcattctcccctttacccgtccatggcggagcgcggcggcgagcgtggcggcgagcgcggcgggtttggccgcggcttcggtcgcggcgggcgcggcgaccgtggcggacgccgaggcggccgtcgcggcccgcgtcaggaggaagagaagtgggtccccgttacgaagctcggccgcctcgtcaaggagaacaggatcaccaagatcgaggagatctacctccactcgctccccgtcaaggagcaccagatcatcgagaccctcgtgccggggctcaaggacgaggtgatgaagatcacgcccgttcagaagcagacccgcgccggacagcgcacccgcttcaaggcctttgtcgtcgtgggcgactgcgacggccacgtcggcctgggagtcaagtgcgccaaggaggtggctaccgccatccgcggcgccatcatcctcgccaagctctccgttgttcccgtcaggagaggctactggggaaacaagattgggcagccacacaccgtgccctgcaaggtcaccggcaagtgcgggtccgtcaccgtgcgcatggtgcctgcgcccaggggttctggcatcgtcgccgcgcgcgtgcccaagaaggtgctgcagttcgctggcattgaggatgtcttcacctcgtcccgtggctccattaagacccttggcaacttcgtcaaggcaaccttcgactgcctcatgaagacctacggcttccttactcctgaattctggagtcagaccaagttctccatgactccgttccagcagtacacggacctgctggcgaagcccaccaagggtcttgtgcttgaggccccaactgagacagtagaggcttaggatggtttgtgctgtctaaatgcactttctatgttatagttaagaactgttgtcaactttcaaaaaaaaactttgggttttgttttgccctggatgttctttgttgtcaagttttggatataacagtactctttt

SEQ ID NO: 2086 - protein, 274 aa, Zea mays
  misc_feature (84)..(150): Pfam Name: Ribosomal_S5 Pfam Description: Ribosomal protein S5, N-terminal domai
  misc_feature (167)..(240): Pfam Name: Ribosomal_S5_C Pfam Description: Ribosomal protein S5, C-terminal domai
  misc_feature (1)..(274): Ceres Clone ID no. 100925979
  misc_feature (1)..(274): Bit score of 667.5 for HMM based on sequences of Figure 37
  misc_feature (1)..(274): Functional Homolog Of SEQ ID NO. 2035
MAERGGERGGERGGFGRGFGRGGRGDRGGRRGGRRGPRQEEEKWVPVTKLGRLVKENRITKIEEIYLHSLPVKEHQIIETLVPGLKDEVMKITPVQKQTRAGQRTRFKAFVVVGDCDGHVGLGVKCAKEVATAIRGAIILAKLSVVPVRRGYWGNKIGQPHTVPCKVTGKCGSVTVRMVPAPRGSGIVAARVPKKVLQFAGIEDVFTSSRGSIKTLGNFVKATFDCLMKTYGFLTPEFWSQTKFSMTPFQQYTDLLAKPTKGLVLEAPTETVEA

SEQ ID NO: 2087 - DNA, 1117 bp, Triticum aestivum
  misc_feature (1)..(1117): Ceres Clone ID no. 841942
  misc_feature (1)..(1117): Encodes the peptide sequence at SEQ ID NO. 2088
cttagccgccgccacagcctccagctccaaaccctcatcccccccatcggagctcccctgcccccaaccccccacccccacccagccatggcggaccgcggcggcgagcgtggtgtcggcgagcgcggcggcttcgggcgcggcttcggtcgcggcgggcgcggggaccgtggcgggcgccgcggcggccgccgtggccctcgccaggaggaggagaagtgggtgcccgtcaccaagctcggccgcctcgtcaaggagggccgcttcaccaagatggaggagatctacctacactcgctccccgtcaaggagcaccagatcgtggagacgctctgcccggggctcaaggacgaggtgatgaagatcaccccggtgcagaagcagacccgcgccgggcagcgcacccgcttcaaggccttcgtcgtcgtcggcgacagcaacggccacgtcggcctcggcgtcaagtgcgccaaggaggtggccacggccatccgcggcgccatcatcctcgccaagctctcgatcgtgcccgtcaggaggggctactgggggaacaagatcggcctgccccacaccgtgccctgcaaggtcaccggcaagtgcggctccgtcaccgtgcgcatggtgcccgcccccaggggttccggaatcgtcgccgcccgcgtccccaagaaggtgctgcagttcgccgggatcgatgatgtcttcacttcctcgcgtggatccaccaagacccttggcaacttcgtcaaggctacctttgactgcctgatgaagacctatggattcctcactcctgacttctggagggagacaaccttcaccaaggcgccgtaccaggagttcaccgacatcttggcgaagccgaccaaggccctgatgcttgatgcaccagctgagaagatagaagcttaggatgaagggtttttactagctgggagctgtctgttgcactttgctttattatagtcgagaaccaggtgtctttgaattgtgctacttgtggaagtctctgtttgctgtcaaagttttggattatggtgcaatgctactctgttattggcaatggatgctacataattatgccaattgcagtgttatttgtctagatgtttgg

SEQ ID NO: 2088 - protein, 275 aa, Triticum aestivum
  misc_feature (85)..(151): Pfam Name: Ribosomal_S5 Pfam Description: Ribosomal protein S5, N-terminal domai
  misc_feature (168)..(241): Pfam Name: Ribosomal_S5_C Pfam Description: Ribosomal protein S5, C-terminal domai
  misc_feature (1)..(275): Ceres Clone ID no. 841942
  misc_feature (1)..(275): Bit score of 670.2 for HMM based on sequences of Figure 37
  misc_feature (1)..(275): Functional Homolog Of SEQ ID NO. 2035
MADRGGERGVGERGGFGRGFGRGGRGDRGGRRGGRRGPRQEEEKWVPVTKLGRLVKEGRFTKMEEIYLHSLPVKEHQIVETLCPGLKDEVMKITPVQKQTRAGQRTRFKAFVVVGDSNGHVGLGVKCAKEVATAIRGAIILAKLSIVPVRRGYWGNKIGLPHTVPCKVTGKCGSVTVRMVPAPRGSGIVAARVPKKVLQFAGIDDVFTSSRGSTKTLGNFVKATFDCLMKTYGFLTPDFWRETTFTKAPYQEFTDILAKPTKALMLDAPAEKIEA

SEQ ID NO: 2089 - DNA, 1000 bp, Panicum virgatum
  misc_feature (1)..(1000): Ceres Clone ID no. 1776801
  misc_feature (1)..(1000): Encodes the peptide sequence at SEQ ID NO. 2090
actcttcgcgccgccggagtacccaaattctcatccccctcactcaccggagcgccgcagccccctcaccacccccacccttcacccggccatggcggagcgcggcggagagcgcggtggcgagcgcggcgggttcggccggggcttcggccgcggcggccgcggcgaccgtggcgggcgccgtggtggccggcgcgggcagcgccaggaggaggagaagtgggtccccgtcaccaagctcggccgcctcgtgaaggagcaaaagatcagcaagatcgaggagatctacctacactcgctccccgtcaaggagcaccagatcgtggagaccctcgtccctggcctcaaggacgaggtcatgaagatcacgcccgtgcagaagcagacgcgcgccgggcagcgcacccgcttcaaggccttcgtcgtcgtcggagactgcgacggccacgtcgggctcggcgtcaagtgcgccaaggaggtggccaccgccatccgcggcgccatcatcctcgccaagctctccgtcgtgcccgtcaggagggggtactggggtaacaagatcggccagccgcacaccgtgccctgcaaggtcaccggcaagtgcggttccgtcaccgtgcgcatggtgcccgctcccaggggttccggcatcgtcgccgcgcgcgtgcctaagaaggtgctgcagttcgctggcattgaggatgtcttcacctcgtcccgtggctccaccaagactcttggcaacttcgtgaaggcaaccttcgactgcctgatgaagacctacggtttccttacacctgagttctggaaggagaccagcttcaggatgaccccgttccagcagttcactgatctcctggcaatccctaccaagggtcttatgctcgaggccccagttgagacagtagaagcttaggatattggagtaaagagttctactcgcttcgagttgtctaatgcactttctatattatagttaagaactttgggagtcaacttt

SEQ ID NO: 2090 - protein, 274 aa, Panicum virgatum
  misc_feature (84)..(150): Pfam Name: Ribosomal_S5 Pfam Description: Ribosomal protein S5, N-terminal domai
  misc_feature (167)..(240): Pfam Name: Ribosomal_S5_C Pfam Description: Ribosomal protein S5, C-terminal domai
  misc_feature (1)..(274): Ceres Clone ID no. 1776801
  misc_feature (1)..(274): Bit score of 666.1 for HMM based on sequences of Figure 37
  misc_feature (1)..(274): Functional Homolog Of SEQ ID NO. 2035
MAERGGERGGERGGFGRGFGRGGRGDRGGRRGGRRGQRQEEEKWVPVTKLGRLVKEQKISKIEEIYLHSLPVKEHQIVETLVPGLKDEVMKITPVQKQTRAGQRTRFKAFVVVGDCDGHVGLGVKCAKEVATAIRGAIILAKLSVVPVRRGYWGNKIGQPHTVPCKVTGKCGSVTVRMVPAPRGSGIVAARVPKKVLQFAGIEDVFTSSRGSTKTLGNFVKATFDCLMKTYGFLTPEFWKETSFRMTPFQQFTDLLAIPTKGLMLEAPVETVEA

SEQ ID NO: 2091 - DNA, 767 bp, Musa acuminata
  misc_feature (1)..(767): Ceres Clone ID no. 1732292
  misc_feature (1)..(767): Encodes the peptide sequence at SEQ ID NO. 2092
aagtccttgaaaccttcatcccatccgtactggcaagcatggctgagcgcggcggtggcgatcgtggcggcttcgggcgcgggtttggccgcgggttcggccgcggccggggtcggggagaccgtgggcgcggaaggcgcggtggcggccggcgtgatgaggaggagaagtgggtgcccgtcaccaagctcggccgcctcgtgaaggagggtaagatcactagcctcgagcagatctacctccactccctacctgtgaaggagcaccagatcatcgataccctcctcggtggccgcctcaaggatgaggtcatgaagatcatgccggtccagaagcagacccgcgctggccagcgcacccgcttcaaggccttcgtcgtcgtcggcgacaccgacggccacgtcggcctcggcgtgaagtgcgccaaggaggtagccaccgccatccgcggcgccatcattttggccaagctgtcggtgatccccgtcaggagaggctactgggggaacaagatcgggaagccgcacactgtgccctgtaaggtcaccgggaagtgcgggtcggtcaccgtccgaatggtgcccgcgccgaggggggcggggatcgtggctgctcgtgtcccgaagaaggtgctccagtttgctgggatcgaggacgtgttcacttcgtctcgtggttcgaccaagactctcgggaactttgtgaaggctacctttgattgtcttatgaagacctacggtttcctgacacctgacttctggatggag

SEQ ID NO: 2092 - protein, 243 aa, Musa acuminata
  misc_feature (86)..(152): Pfam Name: Ribosomal_S5 Pfam Description: Ribosomal protein S5, N-terminal domai
  misc_feature (169)..(242): Pfam Name: Ribosomal_S5_C Pfam Description: Ribosomal protein S5, C-terminal domai
  misc_feature (1)..(243): Ceres Clone ID no. 1732292
  misc_feature (1)..(243): Bit score of 566.6 for HMM based on sequences of Figure 37
  misc_feature (1)..(243): Functional Homolog Of SEQ ID NO. 2035
MAERGGGDRGGFGRGFGRGFGRGRGRGDRGRGRRGGGRRDEEEKWVPVTKLGRLVKEGKITSLEQIYLHSLPVKEHQIIDTLLGGRLKDEVMKIMPVQKQTRAGQRTRFKAFVVVGDTDGHVGLGVKCAKEVATAIRGAIILAKLSVIPVRRGYWGNKIGKPHTVPCKVTGKCGSVTVRMVPAPRGAGIVAARVPKKVLQFAGIEDVFTSSRGSTKTLGNFVKATFDCLMKTYGFLTPDFWME

SEQ ID NO: 2093 - protein, 270 aa, Picea sitchensis
  misc_feature (80)..(146): Pfam Name: Ribosomal_S5 Pfam Description: Ribosomal protein S5, N-terminal domai
  misc_feature (163)..(236): Pfam Name: Ribosomal_S5_C Pfam Description: Ribosomal protein S5, C-terminal domai
  misc_feature (1)..(270): Public GI ID no. 116780779
  misc_feature (1)..(270): Bit score of 672.2 for HMM based on sequences of Figure 37
  misc_feature (1)..(270): Functional Homolog Of SEQ ID NO. 2035
MAERGGGFGRGFGRGRGDRGRGDRRGGRRGPRRDEEEKWVPVTKLGRLVKEGKIRSLEQIYLFSLAVKEHQIVEAMLGPQLKDEVMKIMPVQKQTRAGQRTRFKAFVVVGDGNGHVGLGVKCSKEVATAIRGAIILAKLSVIPVRRGYWGNKIGKPHTVPVKVTGKCGSVTVRMVPAPRGAGIVAARVPKKVLQFAGIEDVFTSSRGSTKTLGNFVKATFECLLKTYGFLTPDLWRETRFSKSPFQEYTDLLAKPAKALILEDVDKEALV

SEQ ID NO: 2094 - DNA, 897 bp, Populus balsamifera subsp. trichocarpa
  misc_feature (1)..(897): Ceres Annot ID no. 1492957
  misc_feature (1)..(897): Encodes the peptide sequence at SEQ ID NO. 2095
atggccgccgccgtcatctctgttctcctcctccaaaaactacatcgcctccacacaccaaccctagttttgcaatcatggcagacagaggagcaggaggagaacggggaggcgaccgtggagccttccgccgtggattcggcggcccaacgcggaggacgaggtggtcgccgccgtgctcgccgtgatgaggaggaaaaatgggtcccagttaccaagcttggccgtctcgttcgcgacggaaaaatccgatctctcgaacaaatctacctccactcactcccaatcaaagagtatcaaattattgacacccttgttggaccaggcatgaaggatgaggtcatgaagatcactccggttcagaaacaaacacgtgccggtcaaaggactaggtttaaggcctttgtggttgttggtgatgggaatggacacgtgggtttgggagttaagtgttcgaaggaagtggcgactgccattcgtggggctattatactggccaaattgtcggttattcctgtgaggagagggtattggggtaacaaaattgggcagccacatactgtgccttgtaaggttactgggaagtgtgggtctgtaactgtgaggatggtgcctgctcctcgtggtgcgggaattgtcgcggctagagtgccgaagaaggtgcttcaatttgctgggattgaggatgtttttacgtcttccagagggtctactaagactcttggcaactttgtcaaggccacttttgactgtctcttgaaaacctatggtttcttgactcctgatttctggacggagactcgctttatcaaatctcctttccaagagttcactgatctactagcaaagccaacaaaaacccttgtccttgaagatgtggagagagtggaggcctga

SEQ ID NO: 2095 - protein, 298 aa, Populus balsamifera subsp. trichocarpa
  misc_feature (109)..(175): Pfam Name: Ribosomal_S5 Pfam Description: Ribosomal protein S5, N-terminal domai
  misc_feature (192)..(265): Pfam Name: Ribosomal_S5_C Pfam Description: Ribosomal protein S5, C-terminal domai
  misc_feature (1)..(298): Ceres Annot ID no. 1492957
  misc_feature (1)..(298): Bit score of 620.8 for HMM based on sequences of Figure 37
  misc_feature (1)..(298): Functional Homolog Of SEQ ID NO. 2035
MAAAVISVLLLQKLHRLHTPTLVLQSWQTEEQEENGEATVEPSAVDSAAQRGGRGGRRRARRDEEEKWVPVTKLGRLVRDGKIRSLEQIYLHSLPIKEYQIIDTLVGPGMKDEVMKITPVQKQTRAGQRTRFKAFVVVGDGNGHVGLGVKCSKEVATAIRGAIILAKLSVIPVRRGYWGNKIGQPHTVPCKVTGKCGSVTVRMVPAPRGAGIVAARVPKKVLQFAGIEDVFTSSRGSTKTLGNFVKATFDCLLKTYGFLTPDFWTETRFIKSPFQEFTDLLAKPTKTLVLEDVERVEA

SEQ ID NO: 2096 - DNA, 1010 bp, Triticum aestivum
  misc_feature (1)..(1010): Ceres Clone ID no. 1073758
  misc_feature (1)..(1010): Encodes the peptide sequence at SEQ ID NO. 2097
ttagccgccgccacagcctccagctccaaaccctcatctcccccatccaagctcactgcccccaaccccccacccccacccagccatggcggaccgcggcggcgagcgtggtgtcggcgagcgcggcggcgaccgcggcgtcaccaagctcggccgcctcgtcaaggagggccgctttaccaagatggaggagatctacctccactcgctccccgtcaaggagcaccagatcgtggagacgctctgcccggggctcaaggacgaggtgatgaagatcaccccggtccagaagcagacccgcgccggacagcgcacccgcttcaaggccttcgtcgtcgtcggcgacagcaacggccacgtcggcctcggcgtcaagtgcgccaaggaggtggccacggccatccgcggcgccatcatcctcgccaagctctcaatcgtgcccgtcaggcggggctactgggggaacaagatcggccagccccacaccgtgccctgcaaggtcaccggcaagtgcggctccgtcaccgtgcgcatggtgcccgcccccaggggttctggaatcgtcgccgcccgcgtccccaagaaggtgctgcagttcgccgggatcgatgatgtcttcacttcctcgcgtggatccaccaagacccttggcaacttcgtcaaggcaaccttcgactgcctgatgaagacctatggattcctcacccctgacttctggagggagacaaccttcaccaaggcgccgtaccaggagttcaccgacatcttggcgaagccgaccaaggccctgatgcttgatgcaccagccgagaagatagaagcttaggatgtttgccatgaaagggtttttactagctgggagctgtctgttgcactttgctttattatagtcgagaacaaggtgtctttgaattgtgctacttgtggaagtctctgtttgctgtcaaagttttggattatggtgcaatgctactctctgttatcggcaaaggatgctacataattatgcc

SEQ ID NO: 2097 - protein, 246 aa, Triticum aestivum
  misc_feature (56)..(122): Pfam Name: Ribosomal_S5 Pfam Description: Ribosomal protein S5, N-terminal domai
  misc_feature (139)..(212): Pfam Name: Ribosomal_S5_C Pfam Description: Ribosomal protein S5, C-terminal domai
  misc_feature (1)..(246): Ceres Clone ID no. 1073758
  misc_feature (1)..(246): Bit score of 573.7 for HMM based on sequences of Figure 37
  misc_feature (1)..(246): Functional Homolog Of SEQ ID NO. 2035
MADRGGERGVGERGGDRGVTKLGRLVKEGRFTKMEEIYLHSLPVKEHQIVETLCPGLKDEVMKITPVQKQTRAGQRTRFKAFVVVGDSNGHVGLGVKCAKEVATAIRGAIILAKLSIVPVRRGYWGNKIGQPHTVPCKVTGKCGSVTVRMVPAPRGSGIVAARVPKKVLQFAGIDDVFTSSRGSTKTLGNFVKATFDCLMKTYGFLTPDFWRETTFTKAPYQEFTDILAKPTKALMLDAPAEKIEA

SEQ ID NO: 2098 - protein, 273 aa, Ostreococcus lucimarinus CCE9901
  misc_feature (174)..(247): Pfam Name: Ribosomal_S5_C Pfam Description: Ribosomal protein S5, C-terminal domai
  misc_feature (91)..(157): Pfam Name: Ribosomal_S5 Pfam Description: Ribosomal protein S5, N-terminal domai
  misc_feature (1)..(273): Public GI ID no. 145355259
  misc_feature (1)..(273): Bit score of 586.7 for HMM based on sequences of Figure 37
  misc_feature (1)..(273): Functional Homolog Of SEQ ID NO. 2035
MSDRGGFSRGFGRGGERGRGDRGRGDRGRGDRGRGRGRGRGRGGDDKDVWVPCTKLGRLVQQGKIKSLEHIFLFSLPIKEHQIVEHFIGGELKDEVMKICPVQKQTTAGQRMRFKAFVVVGDCNGHIGLGVKACKEVAHSIQGSMILAKLNIVPVRRGYWGSKLGEPHTIPTKVHGKCGSVHVRLIPAPRGAGIVASGTVKKVLAMAGLHDVYTCSRGHTRTLGNSVKATYEALKNSYGFLTPDLWAETRFAKPPAQEFTDLLSKPDRKARDY

SEQ ID NO: 2099 - DNA, 877 bp, Panicum virgatum
  misc_feature (1)..(877): Ceres Clone ID no. 2004511
  misc_feature (1)..(877): Encodes the peptide sequence at SEQ ID NO. 2100
aacaaacgctaaaaaagtaacagtttctgtactttattgatcccacatggctgacgcgcctgctgctgctgcccccgcccccaccgaggcgcgcggccgcggattcggccgtggcggccgtggcggccgcggtggccgtggtggccgcggcggtgccgagtccaaggaatgggtgccgtgcaccaagctaggccgcctcgtgaaggacaagaagatcagctcgctggaggagatctacctgtactccatcccgatcaaggagcaccaggtcgtcgacgctttcctcggcgagggcacgctcaaggatgaggtgatgaagatcttccccgtccagaaggtgacgtccgccggccagcgcacccgcttcaaggcgtacaccgttgtcggtgactcgaacggtcacgtcggcgttggcagccgcgtcggtaaggaggtcgcgatctgcatccgctcgtcgctgatcgccgccaagctgaacctcatcccggtccgccgtggctactggggtaacaagctcggccagccgcacaccgtgccgatgaaggtgaccggcaagtccggctccgtctgggtgcgcctcgtcccggcgccgcgtggcacgggcatcgtcgccgccccggtcccgacgaagatcctccagttcgccggcatcgaggacgtgtacaccgcgtcgatgggctcgacccgcacgacgtccaacttcatcatggcgacgttctacgcgctgcgcaagacgtacgcgttcttgacgccggacctgtggcccgccaccgccgcgcagaaggaccccacggacgagcactcggagttcctctcgtcccacaaggccgtgaccgcgtaaaatcatgagggatttctctccacctctcgcagattg

SEQ ID NO: 2100 - protein, 264 aa, Panicum virgatum
  misc_feature (167)..(240): Pfam Name: Ribosomal_S5_C Pfam Description: Ribosomal protein S5, C-terminal domai
  misc_feature (84)..(150): Pfam Name: Ribosomal_S5 Pfam Description: Ribosomal protein S5, N-terminal domai
  misc_feature (1)..(264): Ceres Clone ID no. 2004511
  misc_feature (1)..(264): Bit score of 451.8 for HMM based on sequences of Figure 37
  misc_feature (1)..(264): Functional Homolog Of SEQ ID NO. 2035
MADAPAAAAPAPTEARGRGFGRGGRGGRGGRGGRGGAESKEWVPCTKLGRLVKDKKISSLEEIYLYSIPIKEHQVVDAFLGEGTLKDEVMKIFPVQKVTSAGQRTRFKAYTVVGDSNGHVGVGSRVGKEVAICIRSSLIAAKLNLIPVRRGYWGNKLGQPHTVPMKVTGKSGSVWVRLVPAPRGTGIVAAPVPTKILQFAGIEDVYTASMGSTRTTSNFIMATFYALRKTYAFLTPDLWPATAAQKDPTDEHSEFLSSHKAVTA

SEQ ID NO: 2101 - protein, 293 aa, Monodelphis domestica
  misc_feature (184)..(257): Pfam Name: Ribosomal_S5_C Pfam Description: Ribosomal protein S5, C-terminal domai
  misc_feature (101)..(167): Pfam Name: Ribosomal_S5 Pfam Description: Ribosomal protein S5, N-terminal domai
  misc_feature (1)..(293): Public GI ID no. 126335470
  misc_feature (1)..(293): Bit score of 561.7 for HMM based on sequences of Figure 37
  misc_feature (1)..(293): Functional Homolog Of SEQ ID NO. 2035
MADDAGAAGGAGGPGGPGVGGRGGFRGGFGSGGRGRGRGRGRGRGRGRGARGGKAEDKEWVPVTKLGRLVKDMKIKSLEEIYLFSLPIKESEIIDFFLGPSLKDEVLKIMPVQKQTRAGQRTRFKAFVAIGDYNGHVGLGVKCSKEVATAIRGAIILAKLSIVPVRRGYWGNKIGKPHTVPCKVTGRCGSVLVRLIPAPRGTGIVSAPVPKKLLMMAGIDDCYTSARGCTATLGNFAKATFDAISKTYSYLTPDLWKETVFTKSPYQEFTDHLVKTHTRVSVQRTQAAAVATT

SEQ ID NO: 2102 - protein, 281 aa, Xenopus laevis
  misc_feature (171)..(244): Pfam Name: Ribosomal_S5_C Pfam Description: Ribosomal protein S5, C-terminal domai
  misc_feature (88)..(154): Pfam Name: Ribosomal_S5 Pfam Description: Ribosomal protein S5, N-terminal domai
  misc_feature (1)..(281): Public GI ID no. 148232341
  misc_feature (1)..(281): Bit score of 566.6 for HMM based on sequences of Figure 37
  misc_feature (1)..(281): Functional Homolog Of SEQ ID NO. 2035
MADDAGGNRGGFRGGFGGGGRGRGRGRGRGRGRGRGARGGKADDKEWVPVTKLGRLVKDMKIKSLEEIYLFSLPIKESEIIDFFLGSTLKDEVLKIMPVQKQTRAGQRTRFKAFVAIGDYNGHVGLGVKCSKEVATAIRGAIILAKLSIVPVRRGYWGNKIGKPHTVPCKVTGRCGSVLVRLIPAPRGTGIVSAPVPKKLLMMAGIDDCYTSARGCTATLGNFAKATFDAISKTYSYLTPDLWKETVFAKSPYQEYTDHLAKTHTRVSVQRTEAAAVPATS

SEQ ID NO: 2103 - protein, 282 aa, Salmo salar
  misc_feature (173)..(246): Pfam Name: Ribosomal_S5_C Pfam Description: Ribosomal protein S5, C-terminal domai
  misc_feature (90)..(156): Pfam Name: Ribosomal_S5 Pfam Description: Ribosomal protein S5, N-terminal domai
  misc_feature (1)..(282): Public GI ID no. 213512306
  misc_feature (1)..(282): Bit score of 573.2 for HMM based on sequences of Figure 37
  misc_feature (1)..(282): Functional Homolog Of SEQ ID NO. 2035
MADNAGGERGGFRGGFGSGDRGRGRGRGRGRGRGRGRGARGGKSEDKEWVPVTKLGRLVKDMKIKSLEEIYLYSLPIKESEIIDFFLGSSLKDEVLKIMPVQKQTRAGQRTRFKAFVAIGDYNGHVGLGVKCSKEVATAIRGAIILAKLSIVPVRRGYWGNKIGKPHTVPCKVTGRCGSVLVRLIPAPRGTGIVSAPVPKKLLTMAGIDDCYTSARGCTATLGNFAKATFDAISKTYSYLTPDLWKETVFTKSPYQEFTDHLAKTHTRVSVQRTAAAVPASS

SEQ ID NO: 2104 - protein, 293 aa, Mus musculus
  misc_feature (184)..(257): Pfam Name: Ribosomal_S5_C Pfam Description: Ribosomal protein S5, C-terminal domai
  misc_feature (101)..(167): Pfam Name: Ribosomal_S5 Pfam Description: Ribosomal protein S5, N-terminal domai
  misc_feature (1)..(293): Public GI ID no. 74151470
  misc_feature (1)..(293): Bit score of 554.9 for HMM based on sequences of Figure 37
  misc_feature (1)..(293): Functional Homolog Of SEQ ID NO. 2035
MADDAGAAGGPGGPGGPGLGGRGGFRGGFGSGLRGRGRGRDRGRGRGRGARGGKAEDKEWIPVTKLGRLVKDMKIKSLEEIYLFSLPIKESEIIDLFLGASLKDEVLKIMPVQKQTRAGQRTRFKAFVAIGDYNGHVGLGVKCSKEVATAIRGAIILAKLSIVPVRRGYWGNKIGKPHTVPCKVTGRCGSVLVRLIPAPRGTGIVSAPVPKKLLMMAGIDDCYTSARGCTATLGNFAKATFDAISKTYSYLTPDLWKETVFTKSPYQEFTDHLVKTHTRVSVQRTQAPAVATT

SEQ ID NO: 2105 - protein, 280 aa, Solea senegalensis
  misc_feature (171)..(244): Pfam Name: Ribosomal_S5_C Pfam Description: Ribosomal protein S5, C-terminal domai
  misc_feature (88)..(154): Pfam Name: Ribosomal_S5 Pfam Description: Ribosomal protein S5, N-terminal domai
  misc_feature (1)..(280): Public GI ID no. 124221922
  misc_feature (1)..(280): Bit score of 562.6 for HMM based on sequences of Figure 37
  misc_feature (1)..(280): Functional Homolog Of SEQ ID NO. 2035
MADDAGGRGGFRGGFGAGGRGGRGRGRGRGRGRGRGARGGKSEDKEWVPVTKLGRLVKDMKIKSLEEIYLYSLPIKESEIIDFFLGSGLKDEVLKIMPVQKQTRAGQRTRFKAFVAIGDYNGHVGLGVKCSKEVATAIRGAIILAKLSIVPVRRGYWGNKIGKPHTVPCKVTGRCGSVLVRLIPAPRGTGIVSAPVPKKLLMMAGIDDCYTSARGCTATLGNFAKATFDAISKTYSYLTPDLWKETVFTKSPYQEFTDHLAKTHTRVSVQRGQPVPPATS

SEQ ID NO: 2106 - protein, 281 aa, Silurana tropicalis
  misc_feature (171)..(244): Pfam Name: Ribosomal_S5_C Pfam Description: Ribosomal protein S5, C-terminal domai
  misc_feature (88)..(154): Pfam Name: Ribosomal_S5 Pfam Description: Ribosomal protein S5, N-terminal domai
  misc_feature (1)..(281): Public GI ID no. 56118428
  misc_feature (1)..(281): Bit score of 565.9 for HMM based on sequences of Figure 37
  misc_feature (1)..(281): Functional Homolog Of SEQ ID NO. 2035
MADDAGGNRGGFRGGFGSGGRGRGRGRGRGRGRGRGARGGKADDKEWVPVTKLGRLVKDMKIKSLEEIYLFSLPIKESEIIDFFLGSSLKDEVLKIMPVQKQTRAGQRTRFKAFVAIGDYNGHVGLGVKCSKEVATAIRGAIILAKLSIVPVRRGYWGNKIGKPHTVPCKVTGRCGSVLVRLIPAPRGTGIVSAPVPKKLLMMAGIDDCYTSARGCTATLGNFAKATFDAISKTYSYLTPDLWKETVFTKSPYQEYTDHLAKTHTRVSVQRTQAAAVPATS

SEQ ID NO: 2107 - protein, 280 aa, Danio rerio
  misc_feature (170)..(243): Pfam Name: Ribosomal_S5_C Pfam Description: Ribosomal protein S5, C-terminal domai
  misc_feature (87)..(153): Pfam Name: Ribosomal_S5 Pfam Description: Ribosomal protein S5, N-terminal domai
  misc_feature (1)..(280): Public GI ID no. 47086117
  misc_feature (1)..(280): Bit score of 561.8 for HMM based on sequences of Figure 37
  misc_feature (1)..(280): Functional Homolog Of SEQ ID NO. 2035
MADDAGGRGGFRGGFGTGGRGRGRGRGRGRGRGRGARGGKSEDKEWVPVTKLGRLVKDMKIKSLEEIYLYSLPIKESEIIDFFLGSALKDEVLKIMPVQKQTRAGQRTRFKAFVAIGDYNGHVGLGVKCSKEVATAIRGAIILAKLSIIPVRRGYWGNKIGKPHTVPCKVTGRCGSVLVRLIPAPRGTGIVSAPVPKKLLMMAGIDDCYTSARGCTATLGNFAKATFDAISKTYSYLTPDLWKETVFTKSPYQEFTDHLAKTHTRVSVQRTQGALPQGTS

SEQ ID NO: 2108 - protein, 293 aa, Pan troglodytes
  misc_feature (184)..(257): Pfam Name: Ribosomal_S5_C Pfam Description: Ribosomal protein S5, C-terminal domai
  misc_feature (101)..(167): Pfam Name: Ribosomal_S5 Pfam Description: Ribosomal protein S5, N-terminal domai
  misc_feature (1)..(293): Public GI ID no. 114647215
  misc_feature (1)..(293): Bit score of 553.3 for HMM based on sequences of Figure 37
  misc_feature (1)..(293): Functional Homolog Of SEQ ID NO. 2035
MADDAGAAGGHGGPGGPGMGNRGGFRGGFGSGIRGRGRGRGRGRGRGRGARGGKAEDKEWMPVTKLGRLVKDMKIKSLEEIYLFSLPIKESEIIDFFLGASLKDEVLKIMPVQKQTRAGQRTRFKAFVAIGDYNGHVGLGVKCSKEVATAIRGAIILAKLSIVPVRRGYWGNKIGKPHTVPCKVTGRCGSVLVRLIPAPRGTGIVSAPVPKKLLMMAGIDDCYTSARGCTATLGNFAKATFDAISKTYSYLTPDLWKETVFTKSPYQEFTDHLVKTHTRVSVQRTQAPAVATT

SEQ ID NO: 2109 - protein, 278 aa, Tribolium castaneum
  misc_feature (89)..(155): Pfam Name: Ribosomal_S5 Pfam Description: Ribosomal protein S5, N-terminal domai
  misc_feature (172)..(245): Pfam Name: Ribosomal_S5_C Pfam Description: Ribosomal protein S5, C-terminal domai
  misc_feature (1)..(278): Public GI ID no. 91081061
  misc_feature (1)..(278): Bit score of 564.1 for HMM based on sequences of Figure 37
  misc_feature (1)..(278): Functional Homolog Of SEQ ID NO. 2035
MADAAPAGGRGGFRGGLGGARGGRGGPRGRGRGRGRGRGRGKEDQKEWIPVTKLGRLVRDGKIRSLEEIYLFSLPIKEYEIIDFFIGPSLKDEVLKIMPVQKQTRAGQRTRFKAFVAIGDSNGHIGLGVKCSKEVATAIRGAIILAKLSVVPVRRGYWGNKIGKPHTVPCKVTGKCGSVTVRLIPAPRGTGIVSAPVPKKLLQMAGIEDCYTSARGSTGTLGNFAKATYAAIAKTYAYLTPDLWKEMPLTKTPYQEFADYLAKNHRPVSGQRPAEAGL

SEQ ID NO: 2110 - protein, 281 aa, Tetraodon nigroviridis
  misc_feature (172)..(245): Pfam Name: Ribosomal_S5_C Pfam Description: Ribosomal protein S5, C-terminal domai
  misc_feature (87)..(155): Pfam Name: Ribosomal_S5 Pfam Description: Ribosomal protein S5, N-terminal domai
  misc_feature (1)..(281): Public GI ID no. 47218049
  misc_feature (1)..(281): Bit score of 551.8 for HMM based on sequences of Figure 37
  misc_feature (1)..(281): Functional Homolog Of SEQ ID NO. 2035
MADDAGGRGGFRGGFGAGGRGRGRGRGRGRGRGRGARGGKSEDKEWVPVTKLGRLVKDLKIKTLEEIYLYSLPIKESEIIDFFLGSGLKDEVLKIMPVQKQTRAGQRTRFKAKAFVAIGDYNGHVGLGVKCSKEVATAIRGAIILAKLSIVPVRRGYWGNKIGKPHTVPCKVTGRCGSVLVRLIPAPRGTGIVSAPVPKKLLMMAGIDDCYTSARGCTATLGNFAKATFDAISKTYSYLTPDLWKETVFTKSPYQEFTDHLAKTHTRVSVQRGQTMQAASS

SEQ ID NO: 2111 - protein, 260 aa, Lethenteron japonicum
  misc_feature (170)..(243): Pfam Name: Ribosomal_S5_C Pfam Description: Ribosomal protein S5, C-terminal domai
  misc_feature (87)..(153): Pfam Name: Ribosomal_S5 Pfam Description: Ribosomal protein S5, N-terminal domai
  misc_feature (1)..(260): Public GI ID no. 90991375
  misc_feature (1)..(260): Bit score of 531.9 for HMM based on sequences of Figure 37
  misc_feature (1)..(260): Functional Homolog Of SEQ ID NO. 2035
MADDAGGNRGGFRGGFGSGARGRGRGRGRGRGRGRGRGGKSEDKEWNPVTKLGRLVKDMKIKSLEEIYLFSLPIKEFEIIDLFLGPALKDEVLKIMPVQKQTRAGQRTRFKAFVAIGDYNGHIGLGVKCSKEVATAIRGAIILAKLSIVPVRRGYWGNKISKPHTVPCKVTGRCGSVLVRLIPAPRGTGIVSAPVPKKLLTMAGIDDCYTSARGCTATLGNFAKATFDAISKTYSYLTPDLWKETVFIKSPYQEYSDHLA

SEQ ID NO: 2112 - protein, 281 aa, Strongylocentrotus purpuratus
  misc_feature (94)..(160): Pfam Name: Ribosomal_S5 Pfam Description: Ribosomal protein S5, N-terminal domai
  misc_feature (177)..(250): Pfam Name: Ribosomal_S5_C Pfam Description: Ribosomal protein S5, C-terminal domai
  misc_feature (1)..(281): Public GI ID no. 72010709
  misc_feature (1)..(281): Bit score of 557.4 for HMM based on sequences of Figure 37
  misc_feature (1)..(281): Functional Homolog Of SEQ ID NO. 2035
MADAAPDAAAPAGGRGGFRGGFGSGDRGRGRGRGRGRGRGRGRGRGKPEDKEWQPVTKLGRLVKDLKIKELEEIYLFSLPIKEFEIIDFFLGPALKDEVLKIMPVQKQTRAGQRTRFKAFVAIGDHNGHIGLGVKCSKEVATAIRGAIILAKLSIIPVRRGYWGNKIGKPHTVPCKVTGKCGSVLVRLIPAPRGTGIVSAPVPKKLLHMAGIEDCYTSACGQTATLGNFAKATFQAISKTYSYLTPDMWKETVFSRSPYQEFTDHLAKNHKGQASKPVPEA

SEQ ID NO: 2113 - protein, 293 aa, Cricetulus griseus
  misc_feature (184)..(257): Pfam Name: Ribosomal_S5_C Pfam Description: Ribosomal protein S5, C-terminal domai
  misc_feature (101)..(167): Pfam Name: Ribosomal_S5 Pfam Description: Ribosomal protein S5, N-terminal domai
  misc_feature (1)..(293): Public GI ID no. 37577051
  misc_feature (1)..(293): Bit score of 542.7 for HMM based on sequences of Figure 37
  misc_feature (1)..(293): Functional Homolog Of SEQ ID NO. 2035
MADDAGAAGGPGGPGGPGLGGRGGFRGGFGSGLRGRGRGRGRGRGRGRGARGGKAEDKEWIPVTKLGRLVKDMRIKSLEEIYLFSLPIKESEIIDFFLGASLKDEVLKIMPVQKQTRAGQRTRFKAFVAIGDYNGHVGLGVKCSKEVATAIRGAIILAKPSIVPVRRGYWGNKIGKPHTVPCKVTGRCGSVLVRLIPAPRGTGIVSAPVPKKLLMMAGIDDCYTSARGCTATLGNFAKATSDAISKTYSYLTPDLWKETVFTKSPYQEFTDHLVKAHTRVSVQRTQAAAVATT

SEQ ID NO: 2114 - protein, 275 aa, Aedes aegypti
  misc_feature (90)..(156): Pfam Name: Ribosomal_S5 Pfam Description: Ribosomal protein S5, N-terminal domai
  misc_feature (173)..(246): Pfam Name: Ribosomal_S5_C Pfam Description: Ribosomal protein S5, C-terminal domai
  misc_feature (1)..(275): Public GI ID no. 157125338
  misc_feature (1)..(275): Bit score of 542.3 for HMM based on sequences of Figure 37
  misc_feature (1)..(275): Functional Homolog Of SEQ ID NO. 2035
MADAAPAQRGGFRGGFGSRGGGGGRGGRGRGRGRGRGRGRGGKEDSKEWVPVTKLGRLVRDGKIRTLEEIYLYSLPIKEFEIIDFFLSRSLKDEVLKIMPVQKQTRAGQRTRFKAFVAIGDSNGHIGLGVKCSKEVATAIRGAIILAKLSVVPVRRGYWGNKIGKPHTVPCKVFGKCGSVLVRLIPAPRGTGIVSAPVPKKLLQMAGIEDCYTMTRGSTTTLGNFAKATYAAIAKTYAFLTPDLWKDLPLSKTPYQEYADFLEKTSKTGQRIIEL

SEQ ID NO: 2115 - protein, 285 aa, Lysiphlebus testaceipes
  misc_feature (96)..(162): Pfam Name: Ribosomal_S5 Pfam Description: Ribosomal protein S5, N-terminal domai
  misc_feature (179)..(252): Pfam Name: Ribosomal_S5_C Pfam Description: Ribosomal protein S5, C-terminal domai
  misc_feature (1)..(285): Public GI ID no. 62083451
  misc_feature (1)..(285): Bit score of 549.9 for HMM based on sequences of Figure 37
  misc_feature (1)..(285): Functional Homolog Of SEQ ID NO. 2035
MADAAPAATTGGFRGGFGSRGGAGGERGGSRGGRGGRGRGRGRGRGRGKEDQKEWVPVTKLGRLVRDGKIRTLEDIYLFSLPIKEFEIIDQFIGPSLKDEVLKIMPVQKQTRAGQRTRFKAFVAIGDSNGHIGLGVKCSKEVATAIRGAIILAKLSVVPVRRGYWGNKIGKPHTVPCKVTGKCGSVQVRLIPAPRGTGIVSAPVPKKLLQMAGIEDCYTSARGSTCTLGNFAKATYAAIAKTYAYLTPDLWKDMPLTETPYQEHADWLSKNHRPVTGGQRTTETV

SEQ ID NO: 2116 - protein, 288 aa, Nematostella vectensis
  misc_feature (85)..(151): Pfam Name: Ribosomal_S5 Pfam Description: Ribosomal protein S5, N-terminal domai
  misc_feature (168)..(241): Pfam Name: Ribosomal_S5_C Pfam Description: Ribosomal protein S5, C-terminal domai
  misc_feature (1)..(288): Public GI ID no. 156404514
  misc_feature (1)..(288): Bit score of 565.1 for HMM based on sequences of Figure 37
  misc_feature (1)..(288): Functional Homolog Of SEQ ID NO. 2035
MADAEPAGGRGGFRGGFGGRGRGRGRGRGRGRGRGRGKAEDKEWVPVTKLGRLVKDLKIKTLEHIYLFSLPIKEFEIIDFFLGAALKDEVLKIMPVQKQTRAGQRTRFKAFVAIGDSNGHVGLGVKCSKEVATAIRGAIILAKLSVIPVRRGYWGNKIGKPHTVPCKVTGKCGSTRVRLIPAPRGTGIVSAPVPKKLLQMAGIEDCYTSTRGQTATLGNFAKATFAAISETYAYLTPDMWKETVFTKTPYQEFTDYLSKNHSAGRSAAAAAAAAASAVAAEPAAPKAY

SEQ ID NO: 2117 - protein, 263 aa, Barentsia elongata
  misc_feature (88)..(154): Pfam Name: Ribosomal_S5 Pfam Description: Ribosomal protein S5, N-terminal domai
  misc_feature (171)..(244): Pfam Name: Ribosomal_S5_C Pfam Description: Ribosomal protein S5, C-terminal domai
  misc_feature (1)..(263): Public GI ID no. 159145750
  misc_feature (1)..(263): Bit score of 529.0 for HMM based on sequences of Figure 37
  misc_feature (1)..(263): Functional Homolog Of SEQ ID NO. 2035
MADTGAAGGRGGGFRGGFGDRGRGRGRGRGRGRGRGRGRGAKEEKEWVPVTKLGRLVKESKIKKIEDIYLFSLPIKESEIIDYFLGPVLKDEVLKIMPVQKQTRAGQRTRFKAFVAIGDFNGHVGLGVKCSKEVATAIRGAIILAKLSIIPVRRGYWGNKIGKPHTVPCKVTGKCGSVLVRLIPAPRGTGITAAGVPKKLITMAGIDDCYTSATGQTATLGNFAKATYQAIAATYGYLTPDLWPDLSFQKGPYQEFTDFLAKK

SEQ ID NO: 2118 - protein, 277 aa, Trichoplax adhaerens
  misc_feature (173)..(246): Pfam Name: Ribosomal_S5_C Pfam Description: Ribosomal protein S5, C-terminal domai
  misc_feature (90)..(156): Pfam Name: Ribosomal_S5 Pfam Description: Ribosomal protein S5, N-terminal domai
  misc_feature (1)..(277): Public GI ID no. 196000424
  misc_feature (1)..(277): Bit score of 544.5 for HMM based on sequences of Figure 37
  misc_feature (1)..(277): Functional Homolog Of SEQ ID NO. 2035
MADAAPAGERGGFGEGFGRGRGRGGGRGRGRGRGRGRGRGRGKGDEKEWVPVTKLGRLVKGGKIKRLEDIYLFSLPIKEAEIIDFFLGSKLKDEVLKIMPVQKQTRAGQRTRFKAFVAMGDYDGHVGLGVKCSKEVATSIRGAITLAKLSIVPVRRGYWGNKIGLPHTVPCKVTGKCGSVSMRLIPAPRGTGIVSAPVPKKLLQMAGVEDCYTSSTGQTRTLGNFAKATYSAIGKTYSYLTPDLWEPTKFSMTPYQEFTDFLSNKQIRTERPRPRAY

SEQ ID NO: 2119 - protein, 278 aa, Urechis caupo
  misc_feature (87)..(153): Pfam Name: Ribosomal_S5 Pfam Description: Ribosomal protein S5, N-terminal domai
  misc_feature (170)..(243): Pfam Name: Ribosomal_S5_C Pfam Description: Ribosomal protein S5, C-terminal domai
  misc_feature (1)..(278): Public GI ID no. 1350976
  misc_feature (1)..(278): Bit score of 560.4 for HMM based on sequences of Figure 37
  misc_feature (1)..(278): Functional Homolog Of SEQ ID NO. 2035
MADAPAPAGGRGGFRGGFGGRGRGRGRGRGRGRGRGRGAKDGDKEWVPVTKLGRLVKDMKIKTLEEIYLFSLPIKEFEIIDFFLGDALKDEVLKIMPVQKQTRAGQRTRFKAFVAIGDYNGHVGLGVKCSKEVATAIRGAIILAKLSVVPVRRGYWGNKIGKPHTVPCKVTGKCGSVLVRLIPAPRGTGIVSAPVPKKLLAMAGIDDCYTSARGQTATLGNFAKATYAAIAATYSYLTPDLWRETVFTKSPYQEYTDYLAKHHGRGAVTAHPTEEKPF

SEQ ID NO: 2120 - protein, 280 aa, Apis mellifera
  misc_feature (92)..(158): Pfam Name: Ribosomal_S5 Pfam Description: Ribosomal protein S5, N-terminal domai
  misc_feature (175)..(248): Pfam Name: Ribosomal_S5_C Pfam Description: Ribosomal protein S5, C-terminal domai
  misc_feature (1)..(280): Public GI ID no. 48103127
  misc_feature (1)..(280): Bit score of 543.7 for HMM based on sequences of Figure 37
  misc_feature (1)..(280): Functional Homolog Of SEQ ID NO. 2035
MADTAPAARGGFRGGFGSRGGGDRGGPRGRGRGGRGRGRGRGRGKEDSKEWIPVTKLGRLVRDGKIESLEHIYLFSLPIKEYEIIDKFLGVELKDEVLKIMPVQKQTRAGQRTRFKAFVAIGDYKGHIGLGVKCSKEVATAIRGAIILAKLSVVPVRRGYWGNKIGDPHTVPCKVTGKCGSVQVRLIPAPRGTGIVSAPVPKKLLQMAGIEDCYTSARGSTCTLGNFAKATYAAIAKTYAYLTPDLWHDQALRKAPYQEFADYLSKNHRVVGGQRPAEVV

SEQ ID NO: 2121 - protein, 278 aa, Nasonia vitripennis
  misc_feature (90)..(156): Pfam Name: Ribosomal_S5 Pfam Description: Ribosomal protein S5, N-terminal domai
  misc_feature (173)..(246): Pfam Name: Ribosomal_S5_C Pfam Description: Ribosomal protein S5, C-terminal domai
  misc_feature (1)..(278): Public GI ID no. 156550181
  misc_feature (1)..(278): Bit score of 558.3 for HMM based on sequences of Figure 37
  misc_feature (1)..(278): Functional Homolog Of SEQ ID NO. 2035
MADAAPAARGGFRGGFGSRGGDRGGRGRGGRGRGRGRGRGRGKEDAKEWIPVTKLGRLVRDGKISSLEEIYLFSLPIKEFEIIDFFIGTSLKDEVLKIMPVQKQTRAGQRTRFKAFVAIGDSNGHIGLGVKCSKEVATAIRGAIILAKLSVVPVRRGYWGNKIGKPHTVPCKVTGKCGSVQVRLIPAPRGTGIVSAPVPKKLLQMAGIEDCYTSARGSTCTLGNFAKATYAAIAKTYAYLTPDLWKEMPLTKTPYQEYADHLSKNHRPVVGSRPAEVN

SEQ ID NO: 2122 - protein, 273 aa, Aedes albopictus
  misc_feature (88)..(154): Pfam Name: Ribosomal_S5 Pfam Description: Ribosomal protein S5, N-terminal domai
  misc_feature (171)..(244): Pfam Name: Ribosomal_S5_C Pfam Description: Ribosomal protein S5, C-terminal domai
  misc_feature (1)..(273): Public GI ID no. 56417564
  misc_feature (1)..(273): Bit score of 542.9 for HMM based on sequences of Figure 37
  misc_feature (1)..(273): Functional Homolog Of SEQ ID NO. 2035
MADAAPAQRGGFRGGFGSRGGGRGGRGRGRGRGRGRGRGGKEDSKEWVPVTKLGRLVRDGKIRTLEEIYLYSLPIKEFEIIDFFLSRSLKDEVLKIMPVQKQTRAGQRTRFKAFVAIGDSNGHIGLGVKCSKEVATTIRGAIILAKLSVVPVRRGYWGNKIGKPHTVPCKVFGKCGSVLVRLIPAPRGTGIVSAPVPKKLLQMAGIEDCYTMTRGSTTTLGNFAKATYAAIAKTYAFLTPDLWKDLPLNKTPYQEYADFLEKTSKTGQRIIEL

SEQ ID NO: 2123 - DNA, 1147 bp, Arabidopsis thaliana
  misc_feature (1)..(1147): Ceres Clone ID no. 39378
  misc_feature (1)..(1147): Ceres SEED LINE ID no. CW00018
  misc_feature (1)..(1147): Encodes the peptide sequence at SEQ ID NO. 2124
tcactcactcacactactcaagtcaacgtttctaagattctccggcggagcgattatgtcaggatcttcttcaccgagcttgtggctggcaccgaatccgagcaagagatggggagagctcttcttcctcttctacactcctttttggctcactctctgtttaggcatcgttgttccttacaagctttacgagacattcacggagttggagtatctgcttctagctttggtttcagctgttcctgctttcgttatacccatgttactcgttggaaaggccgacagaagtttatgttggaaggaccgctattgggttaaggcaaatctctggataattgttttcagctatgtcggaaactacttttggactcactatttctttaaagttcttggagcgtcctatacttttccatcatggaaaatgaataatgtgcctcacacaacattcttcctaacacatgtttgcttcctcttttaccacgttgcatcgaacattactcttcggaggctacgccattccactgctgatttaccagattctctgaaatggtgttttgaggctgcatggatacttgcgctttcttatttcattgcatacttggagactattgctatcgcaaattttccttactatgagtttgtggaccgaagtgccatgtacagagttggatgtcttttctatgccatttacttcattgtgagcttcccaatgttcttcaggatggatgagaaatcaactgatgaatgggatttatctcgagtggctgttgatgctttgggtgctgctatgttggtaacaatcattcttgatctatggcgtctcttcttgggacctatagttcccttaccggagggacaaaactgccttcagtctggattaccatggttctccaattgaagattgaaagatcggttacttccaccaattcagggaattgacatgggactgagagagaaacctgcaaaggaatttccattaacactttacggaattgggaagcagttaatgcaggccatgtttctaaggcttttcttctccaactgctgatttgtttgttagttgtttttggttttcagtttctcttgatgaactttcccaatgtaacctttcaagttatcctttatagaacagaatggaacttcgttt

SEQ ID NO: 2124 - protein, 280 aa, Arabidopsis thaliana
  misc_feature (1)..(280): Ceres SEED LINE ID no. CW00018
  misc_feature (1)..(280): Ceres Clone ID no. 39378
  misc_feature (1)..(280): Bit score of 756.2 for HMM based on sequences of Figure 36
  misc_feature (1)..(280): in Figure 36
MSGSSSPSLWLAPNPSKRWGELFFLFYTPFWLTLCLGIVVPYKLYETFTELEYLLLALVSAVPAFVIPMLLVGKADRSLCWKDRYWVKANLWIIVFSYVGNYFWTHYFFKVLGASYTFPSWKMNNVPHTTFFLTHVCFLFYHVASNITLRRLRHSTADLPDSLKWCFEAAWILALSYFIAYLETIAIANFPYYEFVDRSAMYRVGCLFYAIYFIVSFPMFFRMDEKSTDEWDLSRVAVDALGAAMLVTIILDLWRLFLGPIVPLPEGQNCLQSGLPWFSN

SEQ ID NO: 2125 - DNA, 879 bp, Populus balsamifera subsp. trichocarpa
  misc_feature (1)..(879): Ceres Annot ID no. 1527229
  misc_feature (1)..(879): Encodes the peptide sequence at SEQ ID NO. 2126
atgggcggtaaagaatcatcagatagttctagttctagtcccagtttatggttggctccagaccctagtaaaagatggggagagattttctttctttgttatactcctttttggctcactctttgtttgggaattgtgattccttgcaagctgtacgagagctttacagaattggaatacttgctcctgggtttgatctcagctgttccttctttcttgataccaatgatgtttgtcggtaaggctgatagcaaattgtgttggaaggactgttattgggtcaaggccagtctatggataatcatttttagctatgttggaaattacttctggacccactattttttcacagttttgggagcttcttatacatttccatcttggaagatgaataatgtaccacatacaaccttccttctgacacatgtttgcttcctgttttatcacgtcacctcaaacatgacaattcgcagactacggcatgcggttgctgacttgccagattatcttcgatgggctgctgagggtgcatggattttggctctttcatacttcatagcatacctggagactttagctgtttctaatttcccttactatgagtttgtggaccgggcttcaatgtacaaagtaggttccttgttttatgccatctacttctttgtaagcttcccaatgtttctgaggattgatgagaaacctggtgatctatgggagttaccaagagtggctgttgattccctgggtgctgcaatgttggttacaataatacttgacttgtggcgaatctttttggggcctattgttccacttccagtaacaaaacaatgccttcaacagggactaccctggtttcctggacatgccactcagacataa

SEQ ID NO: 2126 - protein, 292 aa, Populus balsamifera subsp. trichocarpa
  misc_feature (1)..(292): Ceres Annot ID no. 1527229
  misc_feature (1)..(292): Bit score of 778.8 for HMM based on sequences of Figure 36
  misc_feature (1)..(292): Functional Homolog Of SEQ ID NO. 2124
  misc_feature (1)..(292): in Figure 36
MGGKESSDSSSSSPSLWLAPDPSKRWGEIFFLCYTPFWLTLCLGIVIPCKLYESFTELEYLLLGLISAVPSFLIPMMFVGKADSKLCWKDCYWVKASLWIIIFSYVGNYFWTHYFFTVLGASYTFPSWKMNNVPHTTFLLTHVCFLFYHVTSNMTIRRLRHAVADLPDYLRWAAEGAWILALSYFIAYLETLAVSNFPYYEFVDRASMYKVGSLFYAIYFFVSFPMFLRIDEKPGDLWELPRVAVDSLGAAMLVTIILDLWRIFLGPIVPLPVTKQCLQQGLPWFPGHATQT

SEQ ID NO: 2127 - DNA, 1388 bp, Glycine max
  misc_feature (1)..(1388): Ceres Clone ID no. 716942
  misc_feature (1)..(1388): Encodes the peptide sequence at SEQ ID NO. 2128
atacaagtggactgaaatctctggtagcatgctgacacacactcactcactgtcccacctgagcttgttaccaaactagttaccgtcgtcggagccatccactgggtgggcaatcacttattcaaacttcacatctcatctcatctctctcgcatccactgaaccaagatccctattccaaaatggccgcttctgcttcttccagtccgtggctggctccaaaccccagcaaaagatggggcgaactcttcttccttctctacacccctttctggctcaccctttgtctcggcattgttattcccttcaatctttacgagaaattcacagagctggagtacttgctcatcggattggtctcggctgttcctgctttcgttgttccattgctgctcgttggaaaggctgatagaagcatttcttggaaggatcgttattgggtcaaggccagtctctggataataatcttcagttatgttgggaattatttctggactcattacttttttacagttcttggtgcatcttatacctttccatcatggaaaatgaacaatgtaccacacacaacattcctgctcactcatgtttgcttcctgttttatcatgtttcatcgaacatgacactgcgtcgattacggcattttattgctggtttgccagaaaaacttcaatgggctactgaagctgcatggattcttgctcttgcttattttatagcatacctggagacactggctatttccaatttcccttattatcaattcgtggaccgggactctatgtataaagttggatctttgttttatgccatctactttattgtgagcttcccaatgtttttaaggatagatgagaaacctggcgataaatgggacttgcctagagtggctgttgatgctttgggagctgcaatgctggtcacaataatacttgatttgtggcgcatctttctgggtcctattgttccgatagcagacacaaaacagtgtcctcaagtaggattaccctggtttacaggacacgccaacctcaaatgagagttatgtggcaaattgtggttttcattacacaccaatgcaatctaaacatgcagattgttatgtggagaatctgcagaagaacccaaactaggacaatctttgtactagtgctgacactgttaaattcctgataagatcaatagtgtttgtagtactttcatgttgccttaggttgtagacaaggcaggtgacttaatagtatttattgaaattaatgacgaccgagttccttgcggcttggtccctatcctttttttttttttgtaatagtattattagtgtcatatgctcaagttttgttatttttattttattttaaagttggttgggaatattttaaaatat

SEQ ID NO: 2128 - protein, 285 aa, Glycine max
  misc_feature (1)..(285): Ceres Clone ID no. 716942
  misc_feature (1)..(285): Bit score of 776.7 for HMM based on sequences of Figure 36
  misc_feature (1)..(285): Functional Homolog Of SEQ ID NO. 2124
  misc_feature (1)..(285): in Figure 36
MAASASSSPWLAPNPSKRWGELFFLLYTPFWLTLCLGIVIPFNLYEKFTELEYLLIGLVSAVPAFVVPLLLVGKADRSISWKDRYWVKASLWIIIFSYVGNYFWTHYFFTVLGASYTFPSWKMNNVPHTTFLLTHVCFLFYHVSSNMTLRRLRHFIAGLPEKLQWATEAAWILALAYFIAYLETLAISNFPYYQFVDRDSMYKVGSLFYAIYFIVSFPMFLRIDEKPGDKWDLPRVAVDALGAAMLVTIILDLWRIFLGPIVPIADTKQCPQVGLPWFTGHANLK

SEQ ID NO: 2129 - protein, 287 aa, Vitis vinifera
  misc_feature (1)..(287): Public GI ID no. 225456280
  misc_feature (1)..(287): Bit score of 778.6 for HMM based on sequences of Figure 36
  misc_feature (1)..(287): Functional Homolog Of SEQ ID NO. 2124
  misc_feature (1)..(287): in Figure 36
MGGTGAASSSLWLATNPSKRWGELFFLLYTPFWLTLCLGIVVPYKLYENFTELEYLLLGLVSAVPSFLIPMQFAGEVDRSLCLKDRYWVKASLWIVIFSYVGNYFWTHYFFTVLGASYTFPSWKMNNVPHTTFLLTHVCFLFYHMSSNITLRRLRHSIADLPEKIQWFTEAAWILALAYFIAYLETIAISNFPYYQFVDRASMYKVGSLFYAIYFIVSFPMFLRIDEKPGNTWDLPRVAVDALGAAMLVTIILDLWRIFLGPIVLIPESNQCHQPGLPWFPGHGPKA

SEQ ID NO: 2130 - DNA, 1318 bp, Zea mays
  misc_feature (1)..(1318): Ceres Clone ID no. 285554
  misc_feature (1)..(1318): Encodes the peptide sequence at SEQ ID NO. 2131
acgcttcacactctctcggtggccagtggcctggtccgttcggctccgatttcccgattcgattccaaccatccctctcccggcgtcctgccgtcctgcgggagggaggtgcaagcggaaccagcccggcaatggcagctgcgcggcggccgggggcgaagcccaggggcggcggcggcgcggggaagaggagcgcgtggttggcggcggacggcagcaagcgctggggggaggccttcttcctgctctacacgcccttctggctcacgctctgcctcggtgtcgtcgtcccattcaagctctacgagaggttcacggagctggagtacctgatccttggcttggtgtccaccgtcccggcgttcgtcattcccctattcctcgtagggaaggcagatagtgttagaaatttcaaagatcgatattgggtcaaggctaatatttggattataatttttagctatgttggtaactacttctggacacattacttcttcacagttcttggcgcgtcatatacttttccatcatggaggatgaataatgtacctcatacgacatttctcctgacccatgcttgtttcctgttctatcatatggcatcaaatatgacacttcgtagattgcgccactctacagctcatttaccacagtctatttgctggttatttgaagctgcatggattttagcactgtcatacttcatagcgtacctggagaccctagccattgcaaatttcccgtactatgaattcgttgaccgggatataatgtacaaagtaggttccttgttctacgcaatatacttcatcgtcagcttcccaatgttttcaaggattgacgagaaagacgagaagtggagcctgtccagggtagccgtcgactctctgggcgcagcaatgctggtgacgataatactggacctatggcgcatatttctggggccaatagttcccgtcccagagtcgaggcagtgtggccaaccagggctcgcatggttccaagcgcagaacggaagcacctgattcagtgaagctgcaagttctgcgtttccacttgaatacttcatcatcacctagcattcaccgaggcggagatcttagagcaataaccctcgagagaaatcatggcctcactccttttgataaatagctgtgccttctgtggccggatgcaattgtgcaaatgccactttcagtagttatatttgtatgttttctccgtttggtgaattacagagagatatgtctgtaacgtgaacaagatcatgctgttctaattcctgaaactctatgtggtgctttgtgatcggattatt

SEQ ID NO: 2131 - protein, 297 aa, Zea mays
  misc_feature (1)..(297): Ceres Clone ID no. 285554
  misc_feature (1)..(297): Bit score of 785.9 for HMM based on sequences of Figure 36
  misc_feature (1)..(297): Functional Homolog Of SEQ ID NO. 2124
  misc_feature (1)..(297): in Figure 36
MAAARRPGAKPRGGGGAGKRSAWLAADGSKRWGEAFFLLYTPFWLTLCLGVVVPFKLYERFTELEYLILGLVSTVPAFVIPLFLVGKADSVRNFKDRYWVKANIWIIIFSYVGNYFWTHYFFTVLGASYTFPSWRMNNVPHTTFLLTHACFLFYHMASNMTLRRLRHSTAHLPQSICWLFEAAWILALSYFIAYLETLAIANFPYYEFVDRDIMYKVGSLFYAIYFIVSFPMFSRIDEKDEKWSLSRVAVDSLGAAMLVTIILDLWRIFLGPIVPVPESRQCGQPGLAWFQAQNGST

SEQ ID NO: 2132 - DNA, 1473 bp, Panicum virgatum
  misc_feature (1)..(1473): Ceres Clone ID no. 1818640
  misc_feature (1)..(1473): Encodes the peptide sequence at SEQ ID NO. 2133
accagtgcagtgaagcctgctcccccagacccccactccccgtttggccgcggagcccggcggcgactcggattccatcggatccttcctcggctggcgtccagcgcgcgacggaaccggccggccaatggcagctgcgcggcggccggcggcgggggcgaaggcgaggggcggcggtggaggcgcggggaggaggagcgcgtggctggccgcggacgggagcaaacgctggggggaggccttcttcctgctctacacgcccttctggctcacgctctgcctcggcgtcatcgtccccttcaagctctacgagaggttcacggagctggagtacctgattctcggattggtgtccaccgtgccggcgttcctcatccccctcttcctcgtagggaaggcagatagtgtgagaagtttgaaagatcgatactgggtcaaggctaatatctggattataatttttagctatgttggtaactacttctggacacattacttcttcacggttcttggtgcttcgtatacttttccctcatggcggatgaataatgtgccccacacgacgtttctcctgactcatgcttgtttcctgttctatcatatggcatcaaatatgacacttcgcagattacgtcactctacagctcacttaccacagtctattcgatggttatttgatgccgcatggattttggcactttcatacttcatcgcatacttggagaccctagccattgcaaatttcccgtattatgaatttgttgatcgggatataatgtacaaagtaggttcattgttctacgcaatatatttcattgtcagcttcccaatgttttcaaggatcgacgagaaagatgagaagtggaacctgtccagggtagctgttgactctttgggcgcagccatgctcgttacgataatactggacctctggcgcatatttctggggccaatagtacccatccccgagtccaggcggtgcggtcagccggggctcgcgtggttccatgcgcagaactaaagcatctgacccggcgaagctgcaatgatcctgtgtttccacgagcattattagagactgataaaatcctcctctcccgtcggctgaggctgcaccagaggcatgatgtgaagtgcagagcggctgtgtcatcgtgaatatttgcgtgttgtcgtcttgtaatgttatgtatcaggtccatgccatattggtactggtactctgctgaattctgcttggtctttgctaggatgcgtcagccacaggtgaagctagtagtgaataaagcttcgcacagagcagtaatttgcatgtctgtggtctatctgtacgatgtagcttcgccttcccgtggtccgcaacattgttgtagaaaggagagtggtttttttttttttttggttttgttctgcatttcattatggccatccatttgattgattaatagctatcgtgcaagggtgcattccagc

SEQ ID NO: 2133 - protein, 297 aa, Panicum virgatum
  misc_feature (1)..(297): Ceres Clone ID no. 1818640
  misc_feature (1)..(297): Bit score of 777.3 for HMM based on sequences of Figure 36
  misc_feature (1)..(297): Functional Homolog Of SEQ ID NO. 2124
  misc_feature (1)..(297): in Figure 36
MAAARRPAAGAKARGGGGGAGRRSAWLAADGSKRWGEAFFLLYTPFWLTLCLGVIVPFKLYERFTELEYLILGLVSTVPAFLIPLFLVGKADSVRSLKDRYWVKANIWIIIFSYVGNYFWTHYFFTVLGASYTFPSWRMNNVPHTTFLLTHACFLFYHMASNMTLRRLRHSTAHLPQSIRWLFDAAWILALSYFIAYLETLAIANFPYYEFVDRDIMYKVGSLFYAIYFIVSFPMFSRIDEKDEKWNLSRVAVDSLGAAMLVTIILDLWRIFLGPIVPIPESRRCGQPGLAWFHAQN

SEQ ID NO: 2134 - DNA, 1240 bp, Triticum aestivum
  misc_feature (1)..(1240): Ceres Clone ID no. 904080
  misc_feature (1)..(1240): Encodes the peptide sequence at SEQ ID NO. 2135
gcatacacacactccgcaagtgccacccagaaccgaatctcctccgctgcagccgcaagcagcgacagccccggcgaggcggcgactgaggagaggaggggctgctgacagcgggatcgagcgatgacagctgtccggcggcaggcggcggcgaagcggggcggaggcggcgcggccgggaagaacgcattgctggcggcggacgggagcaagaggtggggggagaagttcttcctgctgtacacgcccttctggctcacgctctgcctcggcgtcgtcgtccccttcaagctctacgagagtttcacggagctggaatatctggttcttggattggtgtcaaccgtgcctgcctttctcatccctctgttcctcgtaggaaaggcagatagtattagaagtttaaaagatcgttactgggtcaaggctaatgtttggattataattttcagttatgtcggtaactacttttggacgcattactttttcacagttcttggtgcgtcatatacttttccatcatggaggatgaataatgtaccccatacaacatttctcctgacccatgcctgcttcttattttatcacatggcatcaaatatgacacttcgtagattacgtcactctacagctcacctgccacagtctattcggtggttgtttgaagccgcgtggattttagcactctcatacttcattgcatacttggagaccctagccattgcaaattttccatattacgaattcgtcgatcgggacataatgtacaaagttggatcattgttttatgcaatttacttcctcgtcagctttccaatgttctcaaggatcgacgaaaaagcagagaagtgggaccttcccagggtggccgtcgatgctctgggcgcagccatgctcgtcacaataatactcgatttatggcgcatatttctggggccaatcgtacccatccccgaatcaagacggtgcgcacagccggggcttgcatggttccatgcgcagaatgaaagcgtctaatccaggaacaagatgaattcttctgttcccacatgtaccgtcgaccccagccattgccgctgtccttcaagagtgttcgcctctccattggagggatgaaaactgctgattaatggatcgatttgttgtctgcatgtagtatttgcttcgtgcgtgcgaatagcgaactggtaatttgtaagttcagcctgatcttagaacctgttttgaataagctagtggc

SEQ ID NO: 2135 - protein, 297 aa, Triticum aestivum
  misc_feature (1)..(297): Ceres Clone ID no. 904080
  misc_feature (1)..(297): Bit score of 779.3 for HMM based on sequences of Figure 36
  misc_feature (1)..(297): Functional Homolog Of SEQ ID NO. 2124
  misc_feature (1)..(297): in Figure 36
MTAVRRQAAAKRGGGGAAGKNALLAADGSKRWGEKFFLLYTPFWLTLCLGVVVPFKLYESFTELEYLVLGLVSTVPAFLIPLFLVGKADSIRSLKDRYWVKANVWIIIFSYVGNYFWTHYFFTVLGASYTFPSWRMNNVPHTTFLLTHACFLFYHMASNMTLRRLRHSTAHLPQSIRWLFEAAWILALSYFIAYLETLAIANFPYYEFVDRDIMYKVGSLFYAIYFLVSFPMFSRIDEKAEKWDLPRVAVDALGAAMLVTIILDLWRIFLGPIVPIPESRRCAQPGLAWFHAQNESV

SEQ ID NO: 2136 - protein, 326 aa, Oryza sativa subsp. indica
  misc_feature (1)..(326): Public GI ID no. 125534155
  misc_feature (1)..(326): Bit score of 771.0 for HMM based on sequences of Figure 36
  misc_feature (1)..(326): Functional Homolog Of SEQ ID NO. 2124
  misc_feature (1)..(326): in Figure 36
MAAPRRPAAAKARNGGGAGRTSRWMAADGSKRWGETFFLLYTPFWLTLCLGVVVPFKLYERFTELEYLVVGLVSTVPAFVIPLFLVGKADSVRSLKDRYWVKANIWIIIFSYVGNYFWTHYFFTILGASYTFPSWRMNNVPHTTFLLTHACFLFYHTTSNMTLRKLRHSTAHLPQFLRWSFEAAWVLALSYFIAYLETLAIANKICGNAFQSGQIPLDRPSGYTTFEHREKFPYYEFIDRDIMYKVGSLFYAIYFIVSFPMFSRIDENEEKWNLSRVAVDALGAAMLVTIILDLWRIFLGPIVPIPESRRCGQPGLAWFQVQKESV

SEQ ID NO: 2137 - protein, 280 aa, Arabidopsis thaliana
  misc_feature (1)..(280): Public GI ID no. 62320905
  misc_feature (1)..(280): Bit score of 755.5 for HMM based on sequences of Figure 36
  misc_feature (1)..(280): Functional Homolog Of SEQ ID NO. 2124
MSGSSSPSLWLAPNPSKRWGELFFLFYTPFWLTLCLGIVVPYKLYETFTELEYLLLALVSAVPAFVIPMLLVGKADRSLCWKDRYWVKANLWIIVFSYVGNYFWTHYFFKVLGASYTFPSWKMNNVPHTTFFLTHVCFLFYHVASNITLRRLRHSTADLPDSLKWCFEAAWILALSYFIAYLETIAIANFPYYEFVDRSAMYRVGCLFYAIYFIVSFPMFFRVDEKSTDEWDLSRVAVDALGAAMLVTIILDLWRLFLGPIVPLPEGQNCLQSGLPWFSN

SEQ ID NO: 2138 - DNA, 1149 bp, Sorghum bicolor
  misc_feature (1)..(1149): Ceres Annot ID no. 8724644
  misc_feature (1)..(1149): Encodes the peptide sequence at SEQ ID NO. 2139
atggagcgcaagcgcgggaaggcctatctgatgcctccctccgcactttttttcccctccctcccctctatcagaattcagaagcacctcggctcctccgtccgcgccgcgccagccaaccaccgccggcccacacactacacttccactctcgttggcctcttcttcggctccgatccgattcgattccatccctcggccggcgtcctgcgggagggaggtgcaagccgaaccagcccgccaatggcagctgcgcggcggccgggggcgacgaagcccaagggcggcggcggcgggggcgcggggaggaggaggagcgcgtggctggcggcggacgggagcaagcgctggggggaggccttcttcctgctctacacgcctttctggctcactctctgcctcggtgtcgtcgtccccttcaagctctacgagaggttcacggagctggagtacctgatccttggcttggtgtccaccgtgccggcgttcctcatccccctattcctcgtagggaaggcagatagtgttagaaatttcaaagatcgatactgggtcaaggctaatatttggattataatttttagctatgttggtaactacttctggacacattatttcttcacagttcttggcgcgtcatatacttttccatcatggaggatgaataatgtaccccatacgacgtttctcctgacccatgcttgtttcctgttctatcatatggcatcaaatatgacactccgtagattacgtcactctgcagctcacttaccacagtctattcgctggttatttgaagctgcatggattttagcactgtcatacttcatagcgtacttggagaccctagccattgcaaatttcccatactatgaatttgttgaccgggatataatgtacaaagtaggttccttgttctacgcaatatacttcatcgtcagcttcccaatgttttcaaggattgatgaaaaagatgagaagtggaacctatccagggtagctgttgactctctgggcgcagcgatgctcgtcacgataatactcgacctatggcgcatatttttggggccaatagttcctatcccagagtcgaggcagtgtggtcaaccggggctcgcatggttccaagtgcagaacgaaagcacctga

SEQ ID NO: 2139 - protein, 382 aa, Sorghum bicolor
  misc_feature (1)..(382): Ceres Annot ID no. 8724644
  misc_feature (1)..(382): Bit score of 783.6 for HMM based on sequences of Figure 36
  misc_feature (1)..(382): Functional Homolog Of SEQ ID NO. 2124
MERKRGKAYLMPPSALFFPSLPSIRIQKHLGSSVRAAPANHRRPTHYTSTLVGLFFGSDPIRFHPSAGVLREGGASRTSPPMAAARRPGATKPKGGGGGGAGRRRSAWLAADGSKRWGEAFFLLYTPFWLTLCLGVVVPFKLYERFTELEYLILGLVSTVPAFLIPLFLVGKADSVRNFKDRYWVKANIWIIIFSYVGNYFWTHYFFTVLGASYTFPSWRMNNVPHTTFLLTHACFLFYHMASNMTLRRLRHSAAHLPQSIRWLFEAAWILALSYFIAYLETLAIANFPYYEFVDRDIMYKVGSLFYAIYFIVSFPMFSRIDEKDEKWNLSRVAVDSLGAAMLVTIILDLWRIFLGPIVPIPESRQCGQPGLAWFQVQNEST

SEQ ID NO: 2140 - DNA, 903 bp, Sorghum bicolor
  misc_feature (1)..(903): Ceres Annot ID no. 8724715
  misc_feature (1)..(903): Encodes the peptide sequence at SEQ ID NO. 2141
atggcagggcggcggccgggggcgaagcccaggggcggtagcggcggcgcggggaggaggaggagcgcgtggatggcggaggacgggagcaagcgctggggggaggccttcttcctgctctacacgcccttctggctcacgctctgcctcggcgtcgtcgtccccttcaagctctacgagaggttcacggagctggagtacctgatccttggcttggtgtccacggtgccggcgttcgtcatcccactcttcctcgtagggaaggcagatagtgttagaaatttgaaagatcgatactgggtcaaggctaatatttggattataatttttagctatgtcggtaactacttctggacacattacttcttcacagttcttggcgcgtcatatacttttccatcatggaggatgaataatgtaccccatacgacgtttctcctgacccatgcttgtttcctgttctatcatatggcatcaaatatgacactccgtagattacgtcactctacagctaacttaccacagtctattcgctggttatttgaagctgcatggattttagcactgtcatacttcatagcgtacctggagaccctagccattgcaaatttcccatactatgaattcgttgaccgggatataatgtacaaagtaggttctttgttctatgcaatatacttcatcgtcagcttcccaatgttttcaaggattgacgagaaagatgagaagtggaacctgtccagggtggctgttgactctctgggcgcagcgatgctcgtcacgataatactggacctatggcgcatattcttggggccaatagttcccatcccagagtcgaggcattgtggtggtcagccagggctcgcatggttccaacaagtgcagaacgaaagcacctga

SEQ ID NO: 2141 - protein, 300 aa, Sorghum bicolor
  misc_feature (1)..(300): Ceres Annot ID no. 8724715
  misc_feature (1)..(300): Bit score of 768.2 for HMM based on sequences of Figure 36
  misc_feature (1)..(300): Functional Homolog Of SEQ ID NO. 2124
MAGRRPGAKPRGGSGGAGRRRSAWMAEDGSKRWGEAFFLLYTPFWLTLCLGVVVPFKLYERFTELEYLILGLVSTVPAFVIPLFLVGKADSVRNLKDRYWVKANIWIIIFSYVGNYFWTHYFFTVLGASYTFPSWRMNNVPHTTFLLTHACFLFYHMASNMTLRRLRHSTANLPQSIRWLFEAAWILALSYFIAYLETLAIANFPYYEFVDRDIMYKVGSLFYAIYFIVSFPMFSRIDEKDEKWNLSRVAVDSLGAAMLVTIILDLWRIFLGPIVPIPESRHCGGQPGLAWFQQVQNEST

SEQ ID NO: 2142 - protein, 326 aa, Oryza sativa subsp. japonica
  misc_feature (1)..(326): Public GI ID no. 62732798
  misc_feature (1)..(326): Bit score of 763.6 for HMM based on sequences of Figure 36
  misc_feature (1)..(326): Functional Homolog Of SEQ ID NO. 2124
MAAPRRPAAAKARNGGGAGRTSRWMAADGSKRWGETFFLLYTPFWLTLCLGVVVPFKLYERFTELEYLVVGLVSTVPAFVIPLFLVGKADSVRSLKDRYWVKANIWIIIFSYVGNYFWTHYFFTVLGASYTFPSWRMNNVPHTTFLLTHACFLFYHMTSNMSLRKLHHSTAHLPQFLRWSFEAAWVLALSYFIAYLETLAIANKICGNAFQSGQIPLDRPSGYTTFEHWEKFPYYEFIDRDIMYKVGSLFYAIYFIVSFPMFSRIDENEEKWSLSRVAVDALGAAMLVTIILDLWRIFLGPIVPIPESRRCGQPGLAWFQVQNESV

SEQ ID NO: 2143 - DNA, 903 bp, Populus balsamifera subsp. trichocarpa
  misc_feature (1)..(903): Ceres Annot ID no. 1473809
  misc_feature (1)..(903): Encodes the peptide sequence at SEQ ID NO. 2144
atgggcggtaaagaatcatcagatagttctagttctagtcccagtttatggttggctccagaccctagtaaaagatggggagagattttctttctttgttatactcctttttggctcactctttgtttgggaattgtgattccttgcaagctgtacgagagctttacagaattggaatacttgctcctgggtttgatctcagctgttccttctttcttgataccaatgatgtttgtcggtaaggctgatagcaaattgtgttggaaggactgttattgggtcaaggccagtctatggataatcatttttagctatgttggaaattacttctggacccactattttttcacagttttgggagcttcttatacatttccatcttggaagatgaataatgtaccacatacaaccttccttctgacacatgtttgcttcctgttttatcacgtcacctcaaacatgacaattcgcagactacggcatgcggttgctgacttgccagattatcttcgatgggctgctgagggtgcatggattttggctctttcatacttcatagcatacctggagactttagctgtttctaatgtgggtggtaaaacgattccgtgtctattgttattttcattcccttactatgagtttgtggaccgggcttcaatgtacaaagtaggttccttgttttatgccatctacttctttgtaagcttcccaatgtttctgaggattgatgagaaacctggtgatctatgggagttaccaagagtggctgttgattccctgggtgctgcaatggactaccctggtttcctggacatgccactcagacataacaaactacatggaaacccggtgacggtagccacagaggcaactcctaaacatggaatttcttgtacttga

SEQ ID NO: 2144 - protein, 300 aa, Populus balsamifera subsp. trichocarpa
  misc_feature (1)..(300): Ceres Annot ID no. 1473809
  misc_feature (1)..(300): Bit score of 644.9 for HMM based on sequences of Figure 36
  misc_feature (1)..(300): Functional Homolog Of SEQ ID NO. 2124
MGGKESSDSSSSSPSLWLAPDPSKRWGEIFFLCYTPFWLTLCLGIVIPCKLYESFTELEYLLLGLISAVPSFLIPMMFVGKADSKLCWKDCYWVKASLWIIIFSYVGNYFWTHYFFTVLGASYTFPSWKMNNVPHTTFLLTHVCFLFYHVTSNMTIRRLRHAVADLPDYLRWAAEGAWILALSYFIAYLETLAVSNVGGKTIPCLLLFSFPYYEFVDRASMYKVGSLFYAIYFFVSFPMFLRIDEKPGDLWELPRVAVDSLGAAMDYPGFLDMPLRHNKLHGNPVTVATEATPKHGISCT

SEQ ID NO: 2145 - protein, 322 aa, Physcomitrella patens subsp. patens
  misc_feature (1)..(322): Public GI ID no. 168012270
  misc_feature (1)..(322): Bit score of 473.1 for HMM based on sequences of Figure 36
  misc_feature (1)..(322): Functional Homolog Of SEQ ID NO. 2124
MEEVEYTNPWLASSASKRWGEVFFLLYSPFWILILLGVVVPLKLYESFQEAEYLILGLLTVAPCFLVPLIVVCKEDAERPFYKRYWFKANVWIAIFGFVGNYFWTHYFYTVLGAIYTFPSYKINHVPITTFLLTQPYFLLYHAVSNMTLRRLEHAIKNISNRQTRWLIQAGWVLLLSYITALTEALTISHFPYYEMVDRPTFYKVGSLFYAIYFIVSFPMFKRLDEDPSAPWTLSQVAVDALGASMLVTIILDSWRITVGPIADIPWAASQNECVQFGPPWLRPSSNIKGVKASYNWSPSGVTQESYGHSRLLERASKHTEL

SEQ ID NO: 2146 - protein, 275 aa, Chlamydomonas reinhardtii
  misc_feature (1)..(275): Public GI ID no. 159479658
  misc_feature (1)..(275): Bit score of 374.1 for HMM based on sequences of Figure 36
  misc_feature (1)..(275): Functional Homolog Of SEQ ID NO. 2124
MAGKNEGARWLALDPSKRWTEVFFLAYSPFWIIWALVLLVPFQLFEYCGNYGYMLIGISCAAPTFILPLFIRCKADQGKPMWQRFWVKANIWIAIFSFIGNYFWTHYFYKVLGASYTFVSWRLNDVPITLYLMTHGYFCFYHVVSNVLLRRVQTGLAKSSWLVRRTAMGLVVFALSYATAFMETLTIAHFPYYTFVDREKMYTVGSLFYAIYFFVSFPMFYRMDEYPQKRGSKWTSSEAALDSLAAGMLVTILLDLWRIGVGGIVDGKGAGLPWM

SEQ ID NO: 2147 - protein, 304 aa, Ostreococcus tauri
  misc_feature (1)..(304): Public GI ID no. 116057462
  misc_feature (1)..(304): Bit score of 222.9 for HMM based on sequences of Figure 36
  misc_feature (1)..(304): Functional Homolog Of SEQ ID NO. 2124
MTGATRDVWVDMAAIFTAVFGVVLAAYASLTPVRGGKMTSETEARSARWIVDARVNPSKASAETFVMRYSMCWIASVGVVIATKAYESFDRWGYLAYCGACAAPAIAWPLMFPSRADAGKPLGERYIVKANVWIAVFSFIGNYWYTHYFYGVLKAEYTFDAHRLNDVPISMYLMTHAYFMFYHVLSNAALRRIRTGYVDNAQRFVFECAAIGAMSYTTAFMESLTICGFPYYSFADRHMAYTLGSAFYGIYFLVSFPMFLRVDETKLMPMSQVFWEAMGSGMAVLCLLDFVRVYLRIPFQMRIQ

SEQ ID NO: 2148 - protein, 282 aa, Dictyostelium discoideum AX4
  misc_feature (1)..(282): Public GI ID no. 66827159
  misc_feature (1)..(282): Bit score of 255.3 for HMM based on sequences of Figure 36
  misc_feature (1)..(282): Functional Homolog Of SEQ ID NO. 2124
MTTKIVEEGYWFSKIPSKRWAEKFFLFYSPVWITVFSLIVATGAYKSFYDVEFFILGLVVSLPCVIYPLLFPCAADKGKPILERYWVKANIWIALFGFVGNYFWTHYFFVLLQATYRFPVEFKLNEVPVMLYFVTHAYFISYHAATTPILRRYWTAFGGRDNRTFLKTVGSILIVCAMAYFTAFMEAWTISSVPYYHIEDRTKMYTIGSTFYMLYFVISFPMFARIDETGPKHNEKWNISRAALEGLGSAMIVFILCDFWRLAIGSLNGEQVGQVFIGKSGV

SEQ ID NO: 2149 - DNA, 834 bp, Arabidopsis thaliana
  misc_feature (1)..(834): Ceres Annot ID no. 853198
  misc_feature (1)..(834): Ceres SEED LINE ID no. CW00703
  misc_feature (1)..(834): Encodes the peptide sequence at SEQ ID NO. 2150
atggataatcacacagctaaagacattggtatgaagagaagtgcttctgagctggctctacaagagtatctcactacaagccctctagacccttgtttcgacctcatgaaccgggattacacttgtgagttaagagatagtcttttgtggtctgagggattgtttccggctggaccttttcgcgatgcacagtcctcaatctgcgagaatctgtcagctgatagtccagtgtcagccaataaacctgaggtaagaggaggagttaggagaaccacaagtggatcttctcatgttaactctgatgacgaagatgccgagacagaagcagggcaatctgaaatgactaatgatcccaatgatctgaaacgtattagaaggatgaactcaaacagggaatcagcaaagaggtcgaggagaaggaagcaagagtacttggtagatcttgagactcaggttgattctttgaaaggcgataactcaacactgtacaagcagctcatagacgcaacacaacagtttcgtagcgctggaacaaataacagagttctcaaatcagatgttgaaactctgagagtcaaggtgaaactagcagaagatttggtagcgagagggtcactcactagcagcttgaatcaacttctacaaactcatctaagtccaccatcacactccatcagcagtctgcactacacgggaaatacctcgcccgccattacagtccacagtgaccaatctttgttccctggaatgacactttctggacagaactcaagccctggacttggtaatgtatccagtgaagctgttagctgcgtctcagacatctggccatga

SEQ ID NO: 2150 - protein, 277 aa, Arabidopsis thaliana
  misc_feature (118)..(181): Pfam Name: bZIP_1 Pfam Description: bZIP transcription factor
  misc_feature (1)..(277): Ceres SEED LINE ID no. CW00703
  misc_feature (1)..(277): Ceres Annot ID no. 853198
  misc_feature (1)..(277): Bit score of 596.0 for HMM based on sequences of Figure 29
  misc_feature (1)..(277): in Figure 29
MDNHTAKDIGMKRSASELALQEYLTTSPLDPCFDLMNRDYTCELRDSLLWSEGLFPAGPFRDAQSSICENLSADSPVSANKPEVRGGVRRTTSGSSHVNSDDEDAETEAGQSEMTNDPNDLKRIRRMNSNRESAKRSRRRKQEYLVDLETQVDSLKGDNSTLYKQLIDATQQFRSAGTNNRVLKSDVETLRVKVKLAEDLVARGSLTSSLNQLLQTHLSPPSHSISSLHYTGNTSPAITVHSDQSLFPGMTLSGQNSSPGLGNVSSEAVSCVSDIWP

SEQ ID NO: 2151 - DNA, 1020 bp, Populus balsamifera subsp. trichocarpa
  misc_feature (1)..(1020): Ceres Annot ID no. 1534418
  misc_feature (1)..(1020): Encodes the peptide sequence at SEQ ID NO. 2152
atggcgaagaagtccggaacacgtcaaacaatgaccaacatgcgtttaaacaatggattcgggaaggagttgaagctaatcaacgaaatggaggagcagaaagcaggaggaagtgatgggatgaagaaaagtgagtcagaattggctgatttttctgctgagatttatggcttcttcagtgatattttttctggtgatctttcttctttccctgtcaacaaaactcgggacatcgtgaatggtttctcaacttgtggtggattaacagaatcctgcttcctctggtctcaaaataccaatcccaagaattccagtgtttcagtgtctactgatgcccagtcatcactttgtgttggcagtccaatgtctgctaataaaccaagagtgaaagatagccaaactagagttgctgccagtgtttcgtctcctgaccaatcagatgaagatggtctgtctgagcagagcacaaaccctcatgacataaaacgtattagaaggatggtttcgaatagggagtcggctagacgatcgagaaaaagaaaacaagcacatttatcagatcttgaagttcagttgaagctagtagtagttgctgagagaaaggttgatcatatgacaggagaaaatgcatctctattcaagcaactttcagatgctacccaacaatttcgtactgctgaaacaaatcgtcgtgtgcttaactcagatgttgaagctttgagagccaaggtgaagttagcagaagatatggttgctcgaggttcattgacgtgtaataatttgaatcaatttcttcagagtcatctaacttctcctcaactgctcaataatcataacttacatctgatgccaaatgtctcaccaactataacaatccagggagatgaagcatatgccggaatgtcagtttcgggacagaattcaggacttggacttggaagtgcagatatcagcaatggcaatcttaataatggcatcttaagtgatgcagcaagctgtataacaaacatttggtcttaa

SEQ ID NO: 2152 - protein, 339 aa, Populus balsamifera subsp. trichocarpa
  misc_feature (158)..(217): Pfam Name: bZIP_1 Pfam Description: bZIP transcription factor
  misc_feature (1)..(339): Ceres Annot ID no. 1534418
  misc_feature (1)..(339): Bit score of 697.2 for HMM based on sequences of Figure 29
  misc_feature (1)..(339): Functional Homolog Of SEQ ID NO. 2150
  misc_feature (1)..(339): in Figure 29
MAKKSGTRQTMTNMRLNNGFGKELKLINEMEEQKAGGSDGMKKSESELADFSAEIYGFFSDIFSGDLSSFPVNKTRDIVNGFSTCGGLTESCFLWSQNTNPKNSSVSVSTDAQSSLCVGSPMSANKPRVKDSQTRVAASVSSPDQSDEDGLSEQSTNPHDIKRIRRMVSNRESARRSRKRKQAHLSDLEVQLKLVVVAERKVDHMTGENASLFKQLSDATQQFRTAETNRRVLNSDVEALRAKVKLAEDMVARGSLTCNNLNQFLQSHLTSPQLLNNHNLHLMPNVSPTITIQGDEAYAGMSVSGQNSGLGLGSADISNGNLNNGILSDAASCITNIWS

SEQ ID NO: 2153 - DNA, 1181 bp, Glycine max
  misc_feature (1)..(1181): Ceres Clone ID no. 1045493
  misc_feature (1)..(1181): Encodes the peptide sequence at SEQ ID NO. 2154
ttttttctctctccttctactctccccctctttctcattttccggtgacatggagtccaagtggggtggcgcccccgccagcatcatggcggcgaatttcgacgacttcaagtggatcgcctccatgttcgatcccggaaacgacgacgtcaagcccttctccgacgcagctttccaaaaccaggatgcagtaactgcattttcaacttgtggtggagtaacagatgatacccttgttcgttcccaaaacctcactcccattcaatccaccatttctgcaactattgattctcagtcttccttttgtggtaccgttgggagcccagtgtctgctaacaaaccaaacgtgagagataatcaagtaaaaggggtcgccaccactacaagtggttcctcacgtgagccatctgatgaggatgatgaagcaggtccttgtgaacaaagcacaaacgctattgatatgaagcgccttagaaggaaggtttctaatagagagtctgcaaggaggtccaggagaagaaaacaagcccatttggctgacctggagtggcaagttgaacggctgagactggaaaatgcaaacctatttaagcagcttacagatgccagccaacaatttcgtgacgctgatacgaataaccgagtcctaaaatcagatgtcgaagctttgagagctaaggtgaaattagctgaggatatggtcactcgtggcacactcacccctatcaacaaccagattcttcaaaatcagagttcactaaacaccccacctcaactcaacacaaataatctacaccgcatgacacatgtttcgccaaccatcaccgtccgtgggaatgatgatgcttcatatggaggtggaattacagttagtggacaaaattcacctcttggtgggcttggaaacttggataatattccttgcagcgatttcaatagtggaatcaatagtaataatgctgtgagctctatgactagcatgtggccttaacgttattcttattgcaccacatgacttgtgttgtagtagtactgtccggttagatccaactttatgcatgtcttggttttattagatttgtggttatattgtggaaaatattatataggtaacaaaaatgtggtatctacgtgtaagaatccatctagaatatttagcatggtgtgtgttaaatggtttc

SEQ ID NO: 2154 - protein, 313 aa, Glycine max
  misc_feature (135)..(195): Pfam Name: bZIP_1 Pfam Description: bZIP transcription factor
  misc_feature (1)..(313): Ceres Clone ID no. 1045493
  misc_feature (1)..(313): Bit score of 714.6 for HMM based on sequences of Figure 29
  misc_feature (1)..(313): Functional Homolog Of SEQ ID NO. 2150
  misc_feature (1)..(313): in Figure 29
MESKWGGAPASIMAANFDDFKWIASMFDPGNDDVKPFSDAAFQNQDAVTAFSTCGGVTDDTLVRSQNLTPIQSTISATIDSQSSFCGTVGSPVSANKPNVRDNQVKGVATTTSGSSREPSDEDDEAGPCEQSTNAIDMKRLRRKVSNRESARRSRRRKQAHLADLEWQVERLRLENANLFKQLTDASQQFRDADTNNRVLKSDVEALRAKVKLAEDMVTRGTLTPINNQILQNQSSLNTPPQLNTNNLHRMTHVSPTITVRGNDDASYGGGITVSGQNSPLGGLGNLDNIPCSDFNSGINSNNAVSSMTSMWP

SEQ ID NO: 2155 - protein, 303 aa, Lotus japonicus
  misc_feature (129)..(192): Pfam Name: bZIP_1 Pfam Description: bZIP transcription factor
  misc_feature (1)..(303): Public GI ID no. 193237559
  misc_feature (1)..(303): Bit score of 689.5 for HMM based on sequences of Figure 29
  misc_feature (1)..(303): Functional Homolog Of SEQ ID NO. 2150
  misc_feature (1)..(303): in Figure 29
MASSETADLNEFLNLDYDHLRYPDTADALFNTVCSAAFHNLLPDVVSSFSTCGGVTVTDTLYSQKLTPKCSTVTATNDSQSSICVGSPVSANKPNMGGENHLKGTSSGSSDRSDEDDDEAGPCEQSNNPQDVKRLRRKVSNRESARRSRRRKQAHLAELETQVEKLKLENATLYKQFTDASQQFREADTNNRVLKSGVEALRAKVKLAEDMVTRSSFTNQILQNPCQLSTPPQLNSNLRGMAHVSPTITIHGDNASYNGIRVGEQNFSTLGFGNLDHMTYNNNNNVNNIGVISDAMSCVTMWP

SEQ ID NO: 2156 - DNA, 1499 bp, Panicum virgatum
  misc_feature (1)..(1499): Ceres Clone ID no. 1811618
  misc_feature (1)..(1499): Encodes the peptide sequence at SEQ ID NO. 2157
actttcctccccgtcggccccctcggtgctcgccgtctctaaaagcaaggcggccttgtgggcgccgacgcggacgcagcagcgattccgggagagtgacagagatcggccgatcgatcgctggctagctagcttccagctgcggggacggccggggatgaagaagtgcgcgtcggagctgcagctggaggccttcatccgcagcccggatgaccacgacgtcgccgcgcaggcggcgttcgctgcgggcctgttctcccccggcgatctctccggcttcagcttcgccgactcgaacaccctcaacggaagcattcctaatcacatatggtcccataaccacaacgtgaggcatcccgcagtctccacgacaatcaagtcgcagtcatcaatctgtgcagcagcaagcccaacatcagcgaccaacctatatctgaaagagagccaaactctggggggaacaagtggttcagattccgatagcgaatcacagttggatatcgaaggcggtccatgcgagcaaagcacaaacccacaggacgtgaagagaatgcgacggtataccaagggcaagaacaatgctctgtgcaaccttttttattcattatttgcatcccgtgattgtatcaacaagaagatctggaagttgattttttttcctgcaatgaatgttgagcaaagatgcttatataggagtccagtccaacctaaattgattgcctcaaatcacaggatggtgtcgaatcgtgaatctgctcgtcggtcaaggaagagaaagcaagcccacttagctgatcttgagacacaggttgaccagctgcgaggcgaaaatgcttcactcttcaagcagctgacagacgccaaccagcaattcacaactgcagtcacggacaacaggatcctgaagtcagatgtcgaggccctcagagtcaaggtgaagctggcggaggacatggtggcccgcggcgccctgtcgtgcgggctgggcagcctcgggctgtcgcccgtcctgaacccgcggcagccgtgccggggccccgacgtgctgcccggcctggacttcgccggcgacgacgcgtgcttcgcggggttgtccccggcggagcaggtccagaactcgccgctgcagagcatcgccagcctcgagagcctcgagaaccggatgaccagcgaggtgacgagctgcggcggcgccggcgtcgacgtctggccgtgggacggcggcctgtccaagtgaagagaagaagccggagcgtggaacgcgcacgccgagggggggcagctactgccctgtacgcgtatcgatatgcatggtactagtatgaactgcaagtgtatggcagctgccattgcaatgtcagctggagtggtgaactgaacggacttgagtttttcagagtcctcgtctcgctcggtcggtatattgcctagtagttctgtaatacactaatactagaactgagtggcaaactagctactcatatataattatatatgct

SEQ ID NO: 2157 - protein, 359 aa, Panicum virgatum
  misc_feature (184)..(244): Pfam Name: bZIP_1 Pfam Description: bZIP transcription factor
  misc_feature (1)..(359): Ceres Clone ID no. 1811618
  misc_feature (1)..(359): Bit score of 728.9 for HMM based on sequences of Figure 29
  misc_feature (1)..(359): Functional Homolog Of SEQ ID NO. 2150
  misc_feature (1)..(359): in Figure 29
MKKCASELQLEAFIRSPDDHDVAAQAAFAAGLFSPGDLSGFSFADSNTLNGSIPNHIWSHNHNVRHPAVSTTIKSQSSICAAASPTSATNLYLKESQTLGGTSGSDSDSESQLDIEGGPCEQSTNPQDVKRMRRYTKGKNNALCNLFYSLFASRDCINKKIWKLIFFPAMNVEQRCLYRSPVQPKLIASNHRMVSNRESARRSRKRKQAHLADLETQVDQLRGENASLFKQLTDANQQFTTAVTDNRILKSDVEALRVKVKLAEDMVARGALSCGLGSLGLSPVLNPRQPCRGPDVLPGLDFAGDDACFAGLSPAEQVQNSPLQSIASLESLENRMTSEVTSCGGAGVDVWPWDGGLSK

SEQ ID NO: 2158 - DNA, 963 bp, Sorghum bicolor
  misc_feature (1)..(963): Ceres Annot ID no. 8671739
  misc_feature (1)..(963): Encodes the peptide sequence at SEQ ID NO. 2159
atgaagaagtgcccatcggagctggagctggaggccttcctccgcggccgggaggacgccacggcggcggcggcggcggcggtggccgagcagaagcctgtgcacgacgtcgctgcgctggcgccgttcggcgcaggtggcgtgttcccccccagcgatctgtccgccttcagcttcgctgactcgaacaccctcaatggaagcattcataatcacctatggtcccataaccacaacgtgaggcatcctgcagtctccacgacaatcgagtcgcaatcgtcaatctgtgcagcagcaagtccaacatcagctaccaacctatatctgaaagagagccaaactttgggtggcacaagtggttcagactccgatagtgaatcgctgttggatatcgagggtggtccatgcgaacaaagcacaaacccacaggacgtgaagagaatgcgacggatggtgtcgaaccgtgagtctgctcgacggtcgaggaagaggaagcaagcccacctagctgatcttgagacacaggttgaccagctgcgaggcgagaatgcatcgctctttaagcagctgacagacgccaaccagcaattcacaaccgcagtcacggacaacaggatcttgaaatcagatgtggaggccctcagagtcaaggtgaagctggcggaggacatggtggcccgtggcgcgctgtcgtgcgggctgggcagcctggggctgtcgccggtgctgaacccgcggcaggcgtgccgtggccccgacgtgctgtccggcctggacttccccggcgacgacgcgtgcttcacggggctgtccgcgacggagcagctccagaactcgccgctgcagagcatcgccagcctcgagagcctggagaaccggatggctagcgaggtgacgagctgcggcggccccggcgtcgacgtctggccgtgggatcactccaacggcgggctttccaagtga

SEQ ID NO: 2159 - protein, 320 aa, Sorghum bicolor
  misc_feature (142)..(202): Pfam Name: bZIP_1 Pfam Description: bZIP transcription factor
  misc_feature (1)..(320): Ceres Annot ID no. 8671739
  misc_feature (1)..(320): Bit score of 781.2 for HMM based on sequences of Figure 29
  misc_feature (1)..(320): Functional Homolog Of SEQ ID NO. 2150
  misc_feature (1)..(320): in Figure 29
MKKCPSELELEAFLRGREDATAAAAAAVAEQKPVHDVAALAPFGAGGVFPPSDLSAFSFADSNTLNGSIHNHLWSHNHNVRHPAVSTTIESQSSICAAASPTSATNLYLKESQTLGGTSGSDSDSESLLDIEGGPCEQSTNPQDVKRMRRMVSNRESARRSRKRKQAHLADLETQVDQLRGENASLFKQLTDANQQFTTAVTDNRILKSDVEALRVKVKLAEDMVARGALSCGLGSLGLSPVLNPRQACRGPDVLSGLDFPGDDACFTGLSATEQLQNSPLQSIASLESLENRMASEVTSCGGPGVDVWPWDHSNGGLSK

SEQ ID NO: 2160 - protein, 331 aa, Zea mays
  misc_feature (146)..(206): Pfam Name: bZIP_1 Pfam Description: bZIP transcription factor
  misc_feature (1)..(331): Public GI ID no. 212723754
  misc_feature (1)..(331): Bit score of 757.5 for HMM based on sequences of Figure 29
  misc_feature (1)..(331): Functional Homolog Of SEQ ID NO. 2150
  misc_feature (1)..(331): in Figure 29
MKKCPSELELEAFLRGREDATAAAAAAVAEQKPTHDIAALAPFGAGGVFPSSDLSAFSFADSNTLNGTGNIHNHLWSHNHNVRHPAVSTTIESQSSICAAAAASPTSATNLYLKESQALGGTSGSDSDSDSLLDIEGGPCEQSTNPQDVKRMRRMVSNRESARRSRKRKQAHLADLETQVDQLRGENASLFKQLTDANQQFTTAVTDNRILKSDVEALRVKVKLAEDMVARGALSCGLGSLGLSPALNPRQACRGPDVLSVSGLDFPGADDACFTGLSPAEQLQLQSSPLQSIAASLESLDNRMASEVTSCGGPGVDVWPWDHHSNGGLSK

SEQ ID NO: 2161 - protein, 298 aa, Oryza sativa subsp. japonica
  misc_feature (139)..(199): Pfam Name: bZIP_1 Pfam Description: bZIP transcription factor
  misc_feature (1)..(298): Public GI ID no. 115445455
  misc_feature (1)..(298): Bit score of 690.4 for HMM based on sequences of Figure 29
  misc_feature (1)..(298): Functional Homolog Of SEQ ID NO. 2150
  misc_feature (1)..(298): in Figure 29
MKKCPSELNFEAFFHGERGEDDADAAADQKPGGGPHPPPFAMFSAADLSSFGFADSVTSTITGVIPNHIWPQSQSLNARHPAVYTIESQSSICAAASPTSATTLNMKESQTLGGTSGSDSDSESLLDIEGGPCEQSTNPLDVKRMRRMVSNRESARRSRKRKQAHLADLETQVDQLRGENASLFKQLTDANQQFTTAVTDNRILKSDVEALRVKVKMAEDMVARGALSCGLGHLGGLSPALNPRQGACRVPDVLTGLDYAGDDPFTGLSPPEQVQMPGGGEVGDAWGWDNHSNGAMSK

SEQ ID NO: 2162 - DNA, 1268 bp, Triticum aestivum
  misc_feature (1)..(1268): Ceres Clone ID no. 616810
  misc_feature (1)..(1268): Encodes the peptide sequence at SEQ ID NO. 2163
ctctaaaagcaccggacgccgacgccacgtaccggagcacccaccagactcctcctccgcaactcagctcagctccctcccccactctccccgcagcgagcgagcgagcgagcgatcggcgatgaagaagtgcgcgtcggagctggagctggaggccttcatccgcgggcgggggctcgccgccgagcagaagcccggcagcgccgccgcgggcgcgaatggtccctacggcctcttctccgccgccgacctctccagcgccttcggcttcgccgactcggccctcaatggaaccattcagaatcacctgtggcctcagtccccgaacctcggcgcacggcatcccgcagtctccacgacaatcgagtcgcagtcgtcattctatgcagcgagtcccacgtcggccaccaatctgagtatcaaagagagccaagcattcggaggcacgagcggctcggactccgacagcgagtcgatgttcgacgacggtggcttgtgcgacaacggcacgaacccaacggacgttaagaggatgagacggatggtgtcgaaccgggagtcggcgcggcggtcgaggaagaggaagcaagctcacttggttgagctggagacgcaggtggatcagctccggggtgacaacgcgtcgatcttcaagcagctgacggacgcgaaccagcagttcacgacggcggtgacggacaaccggatcctcaagtcggacgtggaggcgctgcgggtgaaggtgaagctggcggaggacatggtggcgcgcggcgcgatgtcgtgcgggctgggccacctggggctgtccccggcggcgctgaacccgtgccgcgtcccggacgtgctggccggtctggacttcctccccggcggcgccgacgacgcctgcttcggcagcctgtccccggctgagcaggtgcagagctcgccgatgcagagcatggccagcctcgagagcctcgagcacagcagccggatgcagcacggcggcggcgccgacgccgtcgacgtctggggctgggactccagctccaacggcgccatgtccaagtgaagccatgcacgttcctccctgtctgcgtacctacctatgtcgaagtgtttgagctgatgaaaactcttgatggacttgagtttttcagagtcctctcgtgtcgcgtcagtcggtaataactctgcgtcttcggggtgcctagtagctatgtaatggaactttctacccagagtacatgtaatggtacgtaagaccatgtcagttaactgtg

SEQ ID NO: 2163 - protein, 311 aa, Triticum aestivum
  misc_feature (132)..(192): Pfam Name: bZIP_1 Pfam Description: bZIP transcription factor
  misc_feature (1)..(311): Ceres Clone ID no. 616810
  misc_feature (1)..(311): Bit score of 679.4 for HMM based on sequences of Figure 29
  misc_feature (1)..(311): Functional Homolog Of SEQ ID NO. 2150
  misc_feature (1)..(311): in Figure 29
MKKCASELELEAFIRGRGLAAEQKPGSAAAGANGPYGLFSAADLSSAFGFADSALNGTIQNHLWPQSPNLGARHPAVSTTIESQSSFYAASPTSATNLSIKESQAFGGTSGSDSDSESMFDDGGLCDNGTNPTDVKRMRRMVSNRESARRSRKRKQAHLVELETQVDQLRGDNASIFKQLTDANQQFTTAVTDNRILKSDVEALRVKVKLAEDMVARGAMSCGLGHLGLSPAALNPCRVPDVLAGLDFLPGGADDACFGSLSPAEQVQSSPMQSMASLESLEHSSRMQHGGGADAVDVWGWDSSSNGAMSK

SEQ ID NO: 2164 - DNA, 1545 bp, Populus balsamifera subsp. trichocarpa
  misc_feature (1)..(1545): Ceres Annot ID no. 1480933
  misc_feature (1)..(1545): Encodes the peptide sequence at SEQ ID NO. 2165
atggcgaagaagtccggaacacgtcaaacaatgaccaacatgcgtttaaacaatggattcgggaaggagttgaagctaatcaacgaaatggaggagcagaaagcaggaggaagtgatgggatgaagaaaagtgagtcagaattggctgatttttctgctgagatttatggcttcttcagtgatattttttctggtgatctttcttctttccctgtcaacaaaactcgggacatcgtgaatggtttctcaacttgtggtggattaacagaatcctgcttcctctggtctcaaaataccaatcccaagaattccagtgtttcagtgtctactgatgcccagtcatcactttgtgttggcagtccaatgtctgctaataaaccaagagtgaaagatagccaaactagagttgctgccagtgtttcgtctcctgaccaatcagatgaagatggtctgtctgagcagagcacaaaccctcatgacataaaacgtattagaaggatggtttcgaatagggagtcggctagacgatcgagaaaaagaaaacaagcacatttatcagatcttgaagttcagttgaagctagtagtagttgctgagagaaaggttgatcatatgacaggagaaaatgcatctctattcaagcaactttcagatgctacccaacaatttcgtactgctgaaacaaatcgtcgtgtgcttaactcagatgttgaagctttgagagccaaggtgaagttagcagaagatatggttgctcgaggttcattgacgtgtaataatttgaatcaatttcttcagagtcatctaacttctcctcaactgctcaataatcataacttacatctgatgccaaatgtctcaccaactataacaatccagggagatgaagcatatgccggaatgtcagtttcgggacagaattcaggacttggacttggaagtgcagatatcagcaatggcaatcttaataatggcatcttaagtgatgcagcaagctctagtgatgcaaatgacgaaaaacctggtgagaatgcacatgaagaacctgttgataaacaacatgatcaacccaaaaccaatagaggcagtgaagtggagtctaatggaggtgatagcatgttgagggagggaggctccaagactacagtgggtgctaagaaagcaagtctaaagggcgaattgagggaaaagacgcagggtagccacgagggtcctcaatgctacaaatgttgtggttttggccattatgctgcggttagccctaataaggatcacaagctggcttatatggtagaacgtgatcttgaaaaaaagtcagtcatcactgatcctaaggaggaggagagagggactgtcaattttcaacaggatttggaagaggagcatctccaaccaactgaactacccctctatgtggtgcataagactggaagagaaaaagtatattccacactcgtgtggaacatcgagaaatcggatttgatttattgtactgatagtactgcagaaaactatatcaagccccaactaatgatcattatctag

SEQ ID NO: 2165 - protein, 501 aa, Populus balsamifera subsp. trichocarpa
  misc_feature (145)..(204): Pfam Name: bZIP_1 Pfam Description: bZIP transcription factor
  misc_feature (1)..(501): Ceres Annot ID no. 1480933
  misc_feature (1)..(501): Bit score of 672.7 for HMM based on sequences of Figure 29
  misc_feature (1)..(501): Functional Homolog Of SEQ ID NO. 2150
MRLNNGFGKELKLINEMEEQKAGGSDGMKKSESELADFSAEIYGFFSDIFSGDLSSFPVNKTRDIVNGFSTCGGLTESCFLWSQNTNPKNSSVSVSTDAQSSLCVGSPMSANKPRVKDSQTRVAASVSSPDQSDEDGLSEQSTNPHDIKRIRRMVSNRESARRSRKRKQAHLSDLEVQLKLVVVAERKVDHMTGENASLFKQLSDATQQFRTAETNRRVLNSDVEALRAKVKLAEDMVARGSLTCNNLNQFLQSHLTSPQLLNNHNLHLMPNVSPTITIQGDEAYAGMSVSGQNSGLGLGSADISNGNLNNGILSDAASSSDANDEKPGENAHEEPVDKQHDQPKTNRGSEVESNGGDSMLREGGSKTTVGAKKASLKGELREKTQGSHEGPQCYKCCGFGHYAAVSPNKDHKLAYMVERDLEKKSVITDPKEEERGTVNFQQDLEEEHLQPTELPLYVVHKTGREKVYSTLVWNIEKSDLIYCTDSTAENYIKPQLMIII

SEQ ID NO: 2166 - protein, 288 aa, Glycine max
  misc_feature (119)..(182): Pfam Name: bZIP_1 Pfam Description: bZIP transcription factor
  misc_feature (1)..(288): Public GI ID no. 113367184
  misc_feature (1)..(288): Bit score of 459.3 for HMM based on sequences of Figure 29
  misc_feature (1)..(288): Functional Homolog Of SEQ ID NO. 2150
MAMTTTTESDLDYELRYLSLAVTDTFTAFQNLLPDAMTSFSACGLIDPLCSQNLTPKHSTITATIDSQSSICATSNVGSPVSANKPEGRENHTKGATSGSSEPSDEDDEAGACEQSTNPADMKRLRRKVSNRDSARRSRRRKQAQLSDLELQVEKLKVENATLYKQFTDASQHFREADTNNRVLKSDVEALRAKVKLAEDMVTRSSFTTLNNQLLQTQHHQMSTPQQLNTTNLRRMAHVSPTITVHGNDVSYNNGGQNSALGNLDMSFNDINEVMNDAMSCGTIWPLD

SEQ ID NO: 2167 - DNA, 1162 bp, Glycine max
  misc_feature (1)..(1162): Ceres Clone ID no. 657501
  misc_feature (1)..(1162): Encodes the peptide sequence at SEQ ID NO. 2168
actttcggtgatccgcgtctcaagtcggcagctcgcagagtctcttgatcctggtttcctcaccctagggttagggtttggtccctcttcaattaacttcaatatctgcgagagagcgtgagagtgacgcgcctcccgagagacgccatgggaggtgacagtgccattgaggaatccgaaggggtcaacgtcaacatcaacgttcgctgctccaacggtttcaagttttccgttcagattgccgtcgattccaccgttagttccttcaaggacgttgtcgctcgcaactgcgacatccctgccgaacaacagcgcctcatttacaagggtcgcatcttgaaggatgatcaaaccctacgaagctacgttgggagcccattgtctgctaataaaccaaacgcgagagataatcaagtaaaaggggccaccaccactacaagtggttcctcacgtgagccatctgatgaggatgatgaatcaggtccttgtgaacaaagcacaaacgctattgatgtgaagcgcctaagaaggaaggtttctaatcgagagtctgcaaggaggtccaggaggagaaaacaagcccatttggctgacctggagtggcaagtcgaacggttgagacttgaaaacgcaaacctatttaagcagcttacagatgccagccaacaatttcgtgaagctgatacaaataatcgagtcctaaaatcagatgtcgaagctttgagagctaaggtgaaattagctgaggatatgatcactcgtggcacactcacccctaccaacaaccagattcttcaaaatcagagtccactaaacaccccacctcaactcaacacgaataatttacgccgcatgggatatgtttcgccaaccttcaccgtccatgggaatgatgctactgcttcatatggtggtggaatcacagttagtggacaaaattcaccgcttggtgggcttggaaacttggataatattccatgcagcgatttcaatagtggagtcaatagcgataatgctgtgagctctatgactagcatgtggccttaattaacttgacggaatttttatgggtgatgttaggtgcactcagtattttttgaaaatgtcaaaactgccctccgctatcttcttcttttaaaagctgttttttttttgtgtgtgc

SEQ ID NO: 2168 - protein, 299 aa, Glycine max
  misc_feature (120)..(183): Pfam Name: bZIP_1 Pfam Description: bZIP transcription factor
  misc_feature (1)..(299): Ceres Clone ID no. 657501
  misc_feature (1)..(299): Bit score of 476.2 for HMM based on sequences of Figure 29
  misc_feature (1)..(299): Functional Homolog Of SEQ ID NO. 2150
MGGDSAIEESEGVNVNINVRCSNGFKFSVQIAVDSTVSSFKDVVARNCDIPAEQQRLIYKGRILKDDQTLRSYVGSPLSANKPNARDNQVKGATTTTSGSSREPSDEDDESGPCEQSTNAIDVKRLRRKVSNRESARRSRRRKQAHLADLEWQVERLRLENANLFKQLTDASQQFREADTNNRVLKSDVEALRAKVKLAEDMITRGTLTPTNNQILQNQSPLNTPPQLNTNNLRRMGYVSPTFTVHGNDATASYGGGITVSGQNSPLGGLGNLDNIPCSDFNSGVNSDNAVSSMTSMWP

SEQ ID NO: 2169 - DNA, 1410 bp, Panicum virgatum
  misc_feature (1)..(1410): Ceres Clone ID no. 1902421
  misc_feature (1)..(1410): Encodes the peptide sequence at SEQ ID NO. 2170
ctttcctccctccttcctctgctttcgctcgcttccgatcaccagaaaaaggcctttctttcccgtcgccccctcggtggtcgctgcggcgcccgtctctaaaagcaaggcctcgtgggcgccgacgcggacgcagcagcaatttcgggagagggcgagatcggccgatcgctagctagctagctacctgctgcgggccggggacgggatgaagaagtgcgcgtcggagctggagctggaggccttcatccgcagccgggatgacgccgccgccgcggcggcggcggccgagcacaagcccggccacgacatcgccgcgcaggccgcgttcgccgcgggcgtgttctcccccggcgacctctccgggttcagcttcgccgactcgaacaccctcaacggaagcattcctaatcacctatggtcccataaccacaacgtgaggcatcctgcagtctccacgacaatcgagtcgcagtcatcgatctgtgcagcagcagcaagtccaacatcagcaaccaacctatatctgaaagagagccaaactctggggggcacaagtggttcagattccgatagcgaatcactgttggatatcgaaggcggtccatgcgagcaaagcacaaacccacaggacgtgaagagaatgcggcggatggtgtcgaaccgtgaatccgctcggcggtcaaggaagagaaagcaagcccacttagctgatcttgagacacaggttgaccagctgcgaggcgaaaatgcttcactcttcaagcagctgacagacgccaaccagcaattcacaactgcagtcacggacaacaggatcctcaagtcagatgtcgaggccctcagagtcaaggtgaagctggcggaggacatggtggcccgcggcgcgctgtcgtgcgggctgggcagcctggggctgtcgccggtcctgaacccgcggcaggcgtgccggggccccgacgtgctgtccgggctggacttcaccggcggcgacgacgcgtgcttcgcggggctgtccccgacggagcaggtccagaactcgccgctgcagagccttgccagcctcgagaacaggatgaacaacgaggtgacgagctgcggcggccccggcgtcgacgtctggccgtgggacgccggcctgtccaagtgaagaggaaagcgcacgccgatggcaagctactgccctgtacgcgtatcgatatgcattggtactatatatatatgaactgcaagtgtatgtcagctgccattgctatgtcagctggagtcgtgaactgaacggacttgagtttttcagagtcctcgtctcggtcggtatattgcctagtagttctgtaatacactaatactagaactgagtggctaactagctactcttatataattatatatgctaagagactgaactcg

SEQ ID NO: 2170 - protein, 313 aa, Panicum virgatum
  misc_feature (140)..(200): Pfam Name: bZIP_1 Pfam Description: bZIP transcription factor
  misc_feature (1)..(313): Ceres Clone ID no. 1902421
  misc_feature (1)..(313): Bit score of 739.1 for HMM based on sequences of Figure 29
  misc_feature (1)..(313): Functional Homolog Of SEQ ID NO. 2150
MKKCASELELEAFIRSRDDAAAAAAAAEHKPGHDIAAQAAFAAGVFSPGDLSGFSFADSNTLNGSIPNHLWSHNHNVRHPAVSTTIESQSSICAAAASPTSATNLYLKESQTLGGTSGSDSDSESLLDIEGGPCEQSTNPQDVKRMRRMVSNRESARRSRKRKQAHLADLETQVDQLRGENASLFKQLTDANQQFTTAVTDNRILKSDVEALRVKVKLAEDMVARGALSCGLGSLGLSPVLNPRQACRGPDVLSGLDFTGGDDACFAGLSPTEQVQNSPLQSLASLENRMNNEVTSCGGPGVDVWPWDAGLSK

SEQ ID NO: 2171 - DNA, 1492 bp, Panicum virgatum
  misc_feature (1)..(1492): Ceres Clone ID no. 1812854
  misc_feature (1)..(1492): Encodes the peptide sequence at SEQ ID NO. 2172
acgcaaccagcccggaccgcactaccgccgtacggccacacggcggcgccgcggcggagtggcagactcgtagataccccgcgaaaccaggcccggaagacgccgcaaccctgctttccacgccggactccgctcgcagccggccactttcctccccgtcggccccctcggtgctcgccgtctctaaaagcaaggcggccttgtgggcgccgacgcggacgcagcagcgattccgggagagtgacagagatcggccgatcgatcgctggctagctagcttccagctgcggggacggccggggatgaagaagtgcgcgtcggagctgcagctggaggccttcatccgcagcccggatgaccacgacgtcgccgcgcaggcggcgttcgctgcgggcctgttctcccccggcgatctctccggcttcagcttcgccgactcgaacaccctcaacggaagcattcctaatcacatatggtcccataaccacaacgtgaggcatcccgcagtctccacgacaatcgagtcgcagtcatcaatctgtgcagcagcaagcccaacatcagcgaccaacctatatctgaaagagagccaaactctggggggaacaagtggttcagattccgatagcgaatcacagttggatatcgaaggcggtccatgcgagcaaagcacaaacccacaggacgtgaagagaatgcgacggatggtgtcgaatcgtgaatctgctcgtcggtcaaggaagagaaagcaagcccacttagctgatcttgagacacaggttgaccagctgcgaggcgaaaatgcttcactcttcaagcagctgacagacgccaaccagcaattcacaactgcagtcacggacaacaggatcctgaagtcagatgtcgaggccctcagagtcaaggtgaagctggcggaggacatggtggcccgcggcgccctgtcgtgcgggctgggcagcctcgggctgtcgcccgtcctgaacccgcggcagccgtgccggggccccgacgtgctgcccggcctggacttcgccggcaacgacgcgtgcttcgcggggttgtccccggcggagcaggtccagaactcgccgctgcagagcatcgccagcctcgagagcctcgagaaccggatgaccagcgaggtgacgagctgcggcggcgccggcgtcgacgtctggccgtgggacggcggcctgtccaagtgaagagaagaagccggagcgtggaacgcgcacgccgagggggggcagctactgccctgtacgcgtatcgatatgcatggtactagtatgaactgcaagtgtatggcagctgccattgcaatgtcagctggagtggtgaactgaacggacttgagtttttcagagtcctcgtctcgctcggtcggtatattgcctagtagttctgtaatacactaatactagaactgagtggcaaactagctactcatatataattatatatgctaagagactgaactccacagcat

SEQ ID NO: 2172 - protein, 301 aa, Panicum virgatum
  misc_feature (126)..(186): Pfam Name: bZIP_1 Pfam Description: bZIP transcription factor
  misc_feature (1)..(301): Ceres Clone ID no. 1812854
  misc_feature (1)..(301): Bit score of 733.6 for HMM based on sequences of Figure 29
  misc_feature (1)..(301): Functional Homolog Of SEQ ID NO. 2150
MKKCASELQLEAFIRSPDDHDVAAQAAFAAGLFSPGDLSGFSFADSNTLNGSIPNHIWSHNHNVRHPAVSTTIESQSSICAAASPTSATNLYLKESQTLGGTSGSDSDSESQLDIEGGPCEQSTNPQDVKRMRRMVSNRESARRSRKRKQAHLADLETQVDQLRGENASLFKQLTDANQQFTTAVTDNRILKSDVEALRVKVKLAEDMVARGALSCGLGSLGLSPVLNPRQPCRGPDVLPGLDFAGNDACFAGLSPAEQVQNSPLQSIASLESLENRMTSEVTSCGGAGVDVWPWDGGLSK

SEQ ID NO: 2173 - protein, 278 aa, Oryza sativa
  misc_feature (120)..(180): Pfam Name: bZIP_1 Pfam Description: bZIP transcription factor
  misc_feature (1)..(278): Public GI ID no. 13365772
  misc_feature (1)..(278): Bit score of 585.5 for HMM based on sequences of Figure 29
  misc_feature (1)..(278): Functional Homolog Of SEQ ID NO. 2150
MDIEAFIHGGSGGGDADADHPLGIFSAADLSGFGFADSSTITGGIPNHIWPQSQNLNARHPAVSTTIESQSSICAAASPTSATNLNMKESQTLGGTSGSDSESESLLDIEGGPCEQSTNPLDVKRVRRMVSNRESARRSRKRKQAHLADLESQVDQLRGENASLFKQLTDANQQFTTSVTDNRILKSDVEALRVKVKMAEDMVARGALSCGLGHLGGLSPALNPRQACRVPDVLAGLDYAGDDPFTAGLSQPEQLQMPGGEVVDAWGWDNHPNGGMSK

SEQ ID NO: 2174 - protein, 277 aa, Oryza sativa subsp. japonica
  misc_feature (119)..(179): Pfam Name: bZIP_1 Pfam Description: bZIP transcription factor
  misc_feature (1)..(277): Public GI ID no. 49388982
  misc_feature (1)..(277): Bit score of 583.2 for HMM based on sequences of Figure 29
  misc_feature (1)..(277): Functional Homolog Of SEQ ID NO. 2150
MDIEAFIHGGSGGGDADADHPLGIFSAADLSGFGFADSSTITGGIPNHIWPQSQNLNARHPAVSTTIESQSSICAASPTSATNLNMKESQTLGGTSGSDSESESLLDIEGGPCEQSTNPLDVKRVRRMVSNRESARRSRKRKQAHLADLESQVDQLRGENASLFKQLTDANQQFTTSVTDNRILKSDVEALRVKVKMAEDMVARGALSCGLGHLGGLSPALNPRQACRVPDVLAGLDYAGDDPFTAGLSQPEQLQMPGGEVVDAWGWDNHPNGGMSK

SEQ ID NO: 2175 - protein, 213 aa, Glycine max
  misc_feature (126)..(189): Pfam Name: bZIP_1 Pfam Description: bZIP transcription factor
  misc_feature (1)..(213): Public GI ID no. 113367144
  misc_feature (1)..(213): Bit score of 206.1 for HMM based on sequences of Figure 29
  misc_feature (1)..(213): Functional Homolog Of SEQ ID NO. 2150
MATTTTEFDLDYEFPDLDYDLRYLSLAGIDALTAFQNLLPDAAMTSFSACGLIDPHCSQNLTPMHSTITATIDSQSTICATSNVGSPISANKPEGRENRTKGATSGSSEPSDEDDEAGACEQSTNPADMKRLRRKVSNRDSARRSRRRKQAQLSELELQVEKLKVENATLYKQFTDASQHVREADTNNRVLTSDVDAMRAKVKLAEDMVTKSS

SEQ ID NO: 2176 - DNA, 864 bp, Sorghum bicolor
  misc_feature (1)..(864): Ceres Annot ID no. 8743947
  misc_feature (1)..(864): Encodes the peptide sequence at SEQ ID NO. 2177
atgaagaagtgcgcgtcggagctggagctggaggcgttcatcagggagagcggcgacgacgacgcccgcgccgccgccgccgggcgtagcaatcacgggtgcggcggaccaggcgagcccggagggagcgccgtggtgttctcgcccggcgtcggtttcgccgaatcgaacaccatggatgacagcagttggtggtatgggagcgtccgcacgccgaacccagtcatgtcgcggacagcgtccatctccgccagcctcgaggcaaccacctcagcgaatcatgctcttgaaagcgagtcagactccgacagcgaatcactctacgaggtagagggagttccatatgagcgaggcaacaaatctgtagaaacaaagcgaataagaaggatggtgtccaacagggagtctgcgcgacggtctaggcggagaaagcaggcacaattgtcagaacttgagtcacaggttgaacgacttaaaggtgaaaatgcaactctgttccagcgactttcagaagccaaccagcagttcagtactgcagtcacagacaacagaatcctcaagtccgatgtagaagcattaagagtcaaggtaaagatggcagaggatatggtagcgagaagtgctatatcctgtggcctaggcgatcttggcctggcaccatatctgaactcaagaaagatgtgccaagctttgaatatgctcacaaccacaggtttggatttacttgggagtgatgcgttcagaggtccaaccacagctccacaagtacaaaactcaccagtacaaagcactgcaagcctagagaatctggataatcgaaagtccaacgaggtgaccagttgcgcggcagacatttggccttga

SEQ ID NO: 2177 - protein, 287 aa, Sorghum bicolor
  misc_feature (121)..(181): Pfam Name: bZIP_1 Pfam Description: bZIP transcription factor
  misc_feature (1)..(287): Ceres Annot ID no. 8743947
  misc_feature (1)..(287): Bit score of 312.2 for HMM based on sequences of Figure 29
  misc_feature (1)..(287): Functional Homolog Of SEQ ID NO. 2150
MKKCASELELEAFIRESGDDDARAAAAGRSNHGCGGPGEPGGSAVVFSPGVGFAESNTMDDSSWWYGSVRTPNPVMSRTASISASLEATTSANHALESESDSDSESLYEVEGVPYERGNKSVETKRIRRMVSNRESARRSRRRKQAQLSELESQVERLKGENATLFQRLSEANQQFSTAVTDNRILKSDVEALRVKVKMAEDMVARSAISCGLGDLGLAPYLNSRKMCQALNMLTTTGLDLLGSDAFRGPTTAPQVQNSPVQSTASLENLDNRKSNEVTSCAADIWP

SEQ ID NO: 2178 - DNA, 1239 bp, Panicum virgatum
  misc_feature (1)..(1239): Ceres Clone ID no. 1810791
  misc_feature (1)..(1239): Encodes the peptide sequence at SEQ ID NO. 2179
actaccgcaccactccaccgcgccggagccgggaaggcagcaggaggaagaaagggcggccggcaccagcagccagcccactgccacgccgcgccggcggacgacggagatgaagaagtgcccgtcggagctgcagctggaggcgttcatccgggaaagcggcgccggcgccgcggagagcaagcccggaagcggaccgagcgagcccggcgggagcgacgtgttttcacccggcggcgtcggcttcggcgactcgaacaccatggatggaagcagttggtggtacgggagcatccgccccgcgaacccagtcgcgtcgcagacggcctccgtctccgctagccccagagcaaccaccccagcgaaccatactcttgaaagcgagtcagactccgacagcgaatcattgtatgaggtagaaggaggttcatgtgagcgaggcaccaaatctatggaaacaaagcgaataaggaggatggtgtccaacagggagtctgctcgacgatccaggcggagaaagcaggcacaattatctgaactcgagtcacaggtcgaacaacttaaaggtgaaaatgcaactctgttcaagcaactttcagaggccaaccagcagttcaccacagcagtcacggacaacagaatcctcaaatcggatgtagaagccttaagagtcaaggtaaagatggcagaggatatggtagcgagaagcgcaatgtcctgcggcctaggtgaccttggtctggcaccatatctgaattcaagaaagttgggccaagctttgaatatgctcacagtcacaggattggatttgctagggagtgaggcattcagaggtccaacggcagctcggcaggttcagaactcaccagtacaaagcactgcaagcctagagagtctggataacaggaagtccagcgaggtgaccagctgtgcggcagacatgtggccttgagattcaggacactgatcagattcatagcttgctaggcagaaaccgcaccagctcattacctcaaacaattggtgcctctggagcatagcttctgccaagtttccttgaaccatatttctacagaaggctttacacgatcactatgcatcgatcatttgatgtggttatctgatacttctccagtgggaaagataccatttacagaagttgtcatggcaagcagggaatgtggcaaacctcaagtatagtttcaagtataaaatgaccttgtctttgtacaaatctgc

SEQ ID NO: 2179 - protein, 280 aa, Panicum virgatum
  misc_feature (114)..(174): Pfam Name: bZIP_1 Pfam Description: bZIP transcription factor
  misc_feature (1)..(280): Ceres Clone ID no. 1810791
  misc_feature (1)..(280): Bit score of 359.1 for HMM based on sequences of Figure 29
  misc_feature (1)..(280): Functional Homolog Of SEQ ID NO. 2150
MKKCPSELQLEAFIRESGAGAAESKPGSGPSEPGGSDVFSPGGVGFGDSNTMDGSSWWYGSIRPANPVASQTASVSASPRATTPANHTLESESDSDSESLYEVEGGSCERGTKSMETKRIRRMVSNRESARRSRRRKQAQLSELESQVEQLKGENATLFKQLSEANQQFTTAVTDNRILKSDVEALRVKVKMAEDMVARSAMSCGLGDLGLAPYLNSRKLGQALNMLTVTGLDLLGSEAFRGPTAARQVQNSPVQSTASLESLDNRKSSEVTSCAADMWP

SEQ ID NO: 2180 - DNA, 1466 bp, Zea mays
  misc_feature (1)..(1466): Ceres Clone ID no. 297691
  misc_feature (1)..(1466): Encodes the peptide sequence at SEQ ID NO. 2181
gcgtcaccatccatttgacgaggcggtttatcccccagcaccccaaccaacctttccacgtaccaccgggtttctgtccgcgccccgcccttcaaaagcaggtccgcacgccggccggcgagacagacgacaccaccacgccgggacgggaggcacaggtgcggtctgcgtcgagagttggtccactggcaggccggaatgaagaagtgcgcgtcggagctggagctggaggcgttcatccgggagagcggcgaggacgcccgcgccgccgccggaggtagcagtccggggtgcggtggatcaagcgatcccggagggagcggcgtcttctcacccggcttcggtttcgccgactcggacaccatggatggaggcagttggtggtacgggaacgtccgcacgccgaacccagtcatgtcgcaggcggcgtccatatccgctagccccgggctaaccacctcagccaatcatgctcttgaaagcgagtcagactccgacagcgaatcactgtatgaggtagagggagttccatacgagcgaggtaacagatccattgagacgaagcgaataagaaggatggtgtccaatagggagtctgcgcggcggtctaggaggaggaaacaggcacagttgtctgaccttgagtcacaggttgaacgactcaaaggtgaaaacgcaacactgttccagcaactttcagatgccaaccaacagttcagtactgcagtcacagacaacagaatcctcaaatccgatgtagaagcgttaagaattaaggtaaagatggcagaggatatggtagcgagaagtgctgtatcgtgtggcctaggcgaccttggcctggcaccatacgtgaactcaaggaagatgtgccaagctttgaatgtgctcacagggttggatttactagggagtgatgcgttcaggggtccaaccgcaggtacacgagtacagaactcaccagtacagagcactgcaagcctagagagtctggataaccgaaagtccaacgaggtgaccagttgcgcggcggacatttggccttgagcttcaagccattgatctgattcaaagcttgctccaccctcaaaaaaaggaccagagtttgtcaactcaaatagctggtggcttgagcagagcttctggcacgagttctcttgaaccatatttccacataagctttataggatgcatcactcttttgatgtcacttagtttcaagtataaaatgaagctgtctttgtacaaagctgcaaatgagaagtaaatgaaacgtcctggacaaacttgtgaagtaggaatgatacataggctctatttccaggtcagatgagacagttatgtttacaacaaaaagcaatacatgttgtttagaaaccgctattaattcacaggaatgttcaatccagtacaagtcatctagtagatttgcacccctaccttctagtagattcaaccatgttttc

SEQ ID NO: 2181 - protein, 282 aa, Zea mays
  misc_feature (118)..(178): Pfam Name: bZIP_1 Pfam Description: bZIP transcription factor
  misc_feature (1)..(282): Ceres Clone ID no. 297691
  misc_feature (1)..(282): Bit score of 327.9 for HMM based on sequences of Figure 29
  misc_feature (1)..(282): Functional Homolog Of SEQ ID NO. 2150
MKKCASELELEAFIRESGEDARAAAGGSSPGCGGSSDPGGSGVFSPGFGFADSDTMDGGSWWYGNVRTPNPVMSQAASISASPGLTTSANHALESESDSDSESLYEVEGVPYERGNRSIETKRIRRMVSNRESARRSRRRKQAQLSDLESQVERLKGENATLFQQLSDANQQFSTAVTDNRILKSDVEALRIKVKMAEDMVARSAVSCGLGDLGLAPYVNSRKMCQALNVLTGLDLLGSDAFRGPTAGTRVQNSPVQSTASLESLDNRKSNEVTSCAADIWP

SEQ ID NO: 2182 - DNA, 1265 bp, Triticum aestivum
  misc_feature (1)..(1265): Ceres Clone ID no. 775677
  misc_feature (1)..(1265): Encodes the peptide sequence at SEQ ID NO. 2183
attcagccagccgctatcatattcatctcccccaacggagctttccacgtccccttcccgtgccccataaaagccgtcgccggcgacgctgtcagcccccgcaacggaggcctcgccaagaaagacagacagacagacgcacggagtgacgacaacaccaccaccgtgacgagaagacggagaggcaggcggccgccggagatgaagaagtgcgcgtcggagctggagttcgaggccttcattcggcagcacctcgccgccgccgaggccgaggccgaggcccagcggggcaggcctggccacggaaacgacgacggcgggttcggcggcgaccccggcgccagagcggacgtgttctcccccggcagcggcctgccgggcctctgctttggcgactcgcagaacgccctggagctggaagggagcaaccccggccacttgtggtggtccgaaggcctccgggcgccgccgcaccacgctgccccggcgccaacccagtcgcaaacgcccgccgtttccgcttgcccgagggaaacaatctcagggaaccaggctctcgaaaccgagtcggactctgacagcgagtcattggtcgagattcagggcggccgatgcaagcggagcggcaaatcatcagataccaggcgaataagaaggatggtgtccaacagggagtcagctcgacggtccaggaggaggaagcatgcgcagctgactgaccttgagttgcaggtcgagcaacttaaaagtgaaagtgcaaccctcttcaagcaactgacagaggcaaatcagcagttcaccaccgcggtcactgacaacaggatcctcaaatcagatgtagagaccttaagaatcaaggtaaaaatggcagaagacatggtggctagaggcgcagtgtcatgcggcctaggacagcagctcggattggcaccatttctgaactccaggaagatgtgacaaagccttggtgagcgttctcacaggcacagggttgaacttgaaagggaaccatgcactcttcagaggtttctagctctagctcttcaagttcagacatcggcggtacgaagcactgcaagtctagagtgctcgaataaccagatgcccgcttgcccagcgaggcggccagatgtgtggatgccgtgtggcccggagattcacaccaaagcagggcctttatgtatagtaacgaacactggctgttgcatacctgacatatgtgcatgcctcgcaggctgcaaaggtactaaactctgaaggtagtg

SEQ ID NO: 2183 - protein, 251 aa, Triticum aestivum
  misc_feature (144)..(204): Pfam Name: bZIP_1 Pfam Description: bZIP transcription factor
  misc_feature (1)..(251): Ceres Clone ID no. 775677
  misc_feature (1)..(251): Bit score of 191.2 for HMM based on sequences of Figure 29
  misc_feature (1)..(251): Functional Homolog Of SEQ ID NO. 2150
MKKCASELEFEAFIRQHLAAAEAEAEAQRGRPGHGNDDGGFGGDPGARADVFSPGSGLPGLCFGDSQNALELEGSNPGHLWWSEGLRAPPHHAAPAPTQSQTPAVSACPRETISGNQALETESDSDSESLVEIQGGRCKRSGKSSDTRRIRRMVSNRESARRSRRRKHAQLTDLELQVEQLKSESATLFKQLTEANQQFTTAVTDNRILKSDVETLRIKVKMAEDMVARGAVSCGLGQQLGLAPFLNSRKM

SEQ ID NO: 2184 - protein, 295 aa, Oryza sativa subsp. japonica
  misc_feature (132)..(192): Pfam Name: bZIP_1 Pfam Description: bZIP transcription factor
  misc_feature (1)..(295): Public GI ID no. 115469364
  misc_feature (1)..(295): Bit score of 298.6 for HMM based on sequences of Figure 29
  misc_feature (1)..(295): Functional Homolog Of SEQ ID NO. 2150
MMKKCPSELQLEAFIREEAGAGDRKPGVLSPGDGARKSGLFSPGDGEMSVLDQSTLDGSGGGHQLWWPESVRTPPRAAAAFSATADERTPASISDDPKPTTSANHAPESDSDSDCDSLLEAERSPRLRGTKSTETKRIRRMVSNRESARRSRRRKQAQLSELESQVEQLKGENSSLFKQLTESSQQFNTAVTDNRILKSDVEALRVKVKMAEDMVARAAMSCGLGQLGLAPLLSSRKMCQALDMLSLPRNDACGFKGLNLGRQVQNSPVQSAASLESLDNRISSEVTSCSADVWP

SEQ ID NO: 2185 - DNA, 607 bp, Glycine max
  misc_feature (1)..(607): Ceres Clone ID no. 1238706
  misc_feature (1)..(607): Ceres SEED LINE ID no. CW00569
  misc_feature (1)..(607): Encodes the peptide sequence at SEQ ID NO. 2186
atcacaaccctttgaagtgttgtcattactcattacacaaagaggcaatggaggagtcaaagaaatacgagaggatggtgaagcagacaatggacaagaacaagaagaagaataacaaaaggggtcatggctctgggtcaggatccgggttgcttggggtgaaggtgaggaagctccaaatactgataccgggtggaaagagatgcaaccacccggatctgcttttatctaaaaccgtggattatattgtccacttgaagttgaagattaggttccttaaagcactctcagatatgtactctctctgaaaatcctagcactattcttctgcttcttcctctcttcgttgtcatataagctatggtaaggattttatttctatgtatatcaattgtcatttggagtttgctttatgtcgtattttcatttgttaaattggttatctatattcatgtttatccgacaatgtgtaagaaattgagtagtttgaaattctaaaatatgctttttgaacttcttggttttcccattgcaaggccttcgtatactgatggctaatatttgatgttataaattcatattatcttatatttgaagagttaagttt

SEQ ID NO: 2186 - protein, 86 aa, Glycine max
  misc_feature (1)..(86): Ceres SEED LINE ID no. CW00569
  misc_feature (1)..(86): Ceres Clone ID no. 1238706
  misc_feature (1)..(86): Bit score of 183.9 for HMM based on sequences of Figure 26
  misc_feature (1)..(86): in Figure 26
MEESKKYERMVKQTMDKNKKKNNKRGHGSGSGSGLLGVKVRKLQILIPGGKRCNHPDLLLSKTVDYIVHLKLKIRFLKALSDMYSL

SEQ ID NO: 2187 - DNA, 470 bp, Arabidopsis thaliana
  misc_feature (1)..(470): Ceres Clone ID no. 260808
  misc_feature (1)..(470): Encodes the peptide sequence at SEQ ID NO. 2188
atcacaactctaaagtgttgtcactcaacaaaaaggcaatggaggagtcgaagaaatacaaaagtatggtgaagcagacgatgaataagaagaagaaaaacaacaacaagaagggtcacggatctggatcacgatccgggttactccaaatgaaggtgaggaggctccaaatactgataccgggcgggcagacatgcaaccacccggatctgcttttatcaaagaccgttgattatattgtgcatttgaagttgaagcttaggttccttaaagcaatctccgaaatgtactctctttgaaaatcgtaagatttgtaaaactattcttcttcttgtcttcggtactatatagctatggtgtcgaagtttagttttccgtattatcgattatcatttgtagtttgctttatgttgcgatgttttaccttctttaatgtagtttgtctatatattttttatatatgttttgtc

SEQ ID NO: 2188 - protein, 86 aa, Arabidopsis thaliana
  misc_feature (1)..(86): Ceres Clone ID no. 260808
  misc_feature (1)..(86): Bit score of 186.2 for HMM based on sequences of Figure 26
  misc_feature (1)..(86): Functional Homolog Of SEQ ID NO. 2186
  misc_feature (1)..(86): in Figure 26
MEESKKYKSMVKQTMNKKKKNNNKKGHGSGSRSGLLQMKVRRLQILIPGGQTCNHPDLLLSKTVDYIVHLKLKLRFLKAISEMYSL

SEQ ID NO: 2189 - protein, 113 aa, Picea sitchensis
  misc_feature (1)..(113): Public GI ID no. 116786056
  misc_feature (1)..(113): Bit score of 261.0 for HMM based on sequences of Figure 26
  misc_feature (1)..(113): Functional Homolog Of SEQ ID NO. 2186
  misc_feature (1)..(113): in Figure 26
MGSKKKKTSKRTRVHANKKNVRRGIGLRRGRSAALRRTGYIQSKPGVLMGVYSMNIQRRLKKLQTLIPGGRSMLEVDVLLKKTADYIAYLKMQLLLLHEIEEVATEMDILHKS

SEQ ID NO: 2190 - DNA, 603 bp, Gossypium hirsutum
  misc_feature (1)..(603): Ceres Clone ID no. 1916112
  misc_feature (1)..(603): Encodes the peptide sequence at SEQ ID NO. 2191
aacccaaaaacacaaggcggttccttttgttatctctctttttaattttttttccaatttcatttcttcttgttttgcagttagaaagcttaagaaatttagtcacatttgttaatttctttcatttttttatgaaacgtatggagttaaggaggtgcaaagagttttctagggcgaaatggaggaggaggaggagaagatggacaggtgacagcggtgaccgtggcagtagatcagttcgaacaaaggtgaagaagttgcaaaggctaattccgggtgcaaaagggttgaagccggactggctgtttctaaggacagctgattatatattgcagttgagattacaagttaatatattgcaagctctttccaagatttatggaccctcacattaatgtttatgatattttatgtatattttgatacaaaacttacatggcataagatgccatataaaaaatgcatgctctttccttgataatgataaatatatgctatgttttttttttaatttagaatatattggtgggtttaatttcctttgcaattcatgttgtactacatgctatgaatgccgaagcacgtcgccccatgatctactgg

SEQ ID NO: 2191 - protein, 87 aa, Gossypium hirsutum
  misc_feature (1)..(87): Ceres Clone ID no. 1916112
  misc_feature (1)..(87): Bit score of 177.9 for HMM based on sequences of Figure 26
  misc_feature (1)..(87): Functional Homolog Of SEQ ID NO. 2186
  misc_feature (1)..(87): in Figure 26
MKRMELRRCKEFSRAKWRRRRRRWTGDSGDRGSRSVRTKVKKLQRLIPGAKGLKPDWLFLRTADYILQLRLQVNILQALSKIYGPSH

SEQ ID NO: 2192 - protein, 71 aa, Vitis vinifera
  misc_feature (1)..(71): Public GI ID no. 225424709
  misc_feature (1)..(71): Bit score of 134.4 for HMM based on sequences of Figure 26
  misc_feature (1)..(71): Functional Homolog Of SEQ ID NO. 2186
  misc_feature (1)..(71): in Figure 26
MEVSRCKEMSGEKLRRRRRRSVRRKVKKLQRLIPGGRGLQPDRLFLRTADYILHLRFQVNVLQALSKIYKP

SEQ ID NO: 2193 - protein, 117 aa, Arabidopsis thaliana
  misc_feature (1)..(117): Public GI ID no. 238478596
  misc_feature (1)..(117): Bit score of 109.6 for HMM based on sequences of Figure 26
  misc_feature (1)..(117): Functional Homolog Of SEQ ID NO. 2186
MHVKLSLWLKHFVVTILIYKYRPPSRPLHHNSVFISKKAMEESRSNREQRKQTKKKTGRGSGSGSIQIKMRKLRVLIPGGRRLNQPDLLLTKTADYIMHLELRIRFLKAISDIYSLS

SEQ ID NO: 2194 - protein, 89 aa, Ricinus communis
  misc_feature (1)..(89): Public GI ID no. 255560021
  misc_feature (1)..(89): Bit score of 105.5 for HMM based on sequences of Figure 26
  misc_feature (1)..(89): Functional Homolog Of SEQ ID NO. 2186
MGMNGCRDVSKVNWRRTTMGRRRRRRRRRGAATATTTSIQMRVKKLQRLIPGGEELQPDRLFLRTADYILHLELQVNVLQALSEIYTTP

SEQ ID NO: 2195 - DNA, 1650 bp, Arabidopsis thaliana
  misc_feature (1)..(1650): Ceres Annot ID no. 873343
  misc_feature (1)..(1650): Ceres SEED LINE ID no. CW00506
  misc_feature (1)..(1650): Encodes the peptide sequence at SEQ ID NO. 2196
ctcaaacatgtcaggagcaataacatgctctgcggccgatctcgccaccctacttggccccaacgccacggcggcggccgactacatttgcggccaattaggcaccgttaacaacaagttcaccgatgcagccttcgccatagacaacacctacctcctcttctctgcctaccttgtcttcgccatgcagctcggcttcgctatgctttgtgctggttctgttagagccaagaatacgatgaacatcatgcttaccaatgtccttgacgctgcagccggaggactcttctactatctctttggttacgcctttgcctttggaggatcctccgaagggttcattggaagacacaactttgctcttagagactttccgactcccacagctgattactctttcttcctctaccaatgggcgttcgcaatcgcggccgctggaatcacaagtggttcgatcgcagagaggactcagttcgtggcttacttgatatactcttctttcttaaccggatttgtttacccggttgtctctcactggttttggtccccggatggatgggccagtccctttcgttcagcggatgatcgtttgtttagcaccggagccattgactttgctggctccggtgttgttcacatggttggtggcatagcaggtttatggggtgctcttattgaaggtcctcgtcgtggtcggttcgagaaaggtggtcgcgctattgctctgcgcggccactctgcctcgctagtagtcttaggaaccttcctcctatggtttggatggtatggtttcaaccccggttccttcactaagatactcgttccgtataattctggttccaactacggccaatggagcggaatcggccgtacagcggttaacaccacactctcaggatgcacagcagctctaaccacactctttggtaaacgtctcctatcaggccactggaacgtaacggacgtttgcaacgggttactcggtgggtttgcggccataaccgcaggttgctccgtcgtagagccatgggcagcgattgtgtgcggcttcatggcttctgtcgtccttatcggatgcaacaagctcgcggagcttgtacaatatgatgatccactcgaggcagcccaactacatggagggtgtggcgcgtgggggttgatattcgtaggattgtttgccaaagagaagtatctaaacgaggtttatggcgccaccccgggaaggccatatggactatttatgggcggaggagggaagctgttgggagcacaattggttcaaatacttgtgattgtaggatgggttagtgccacaatgggaacactcttcttcatcctcaaaaggctcaatctgcttaggatctcggagcagcatgaaatgcaagggatggatatgacacgtcacggtggctttgcttatatctaccatgataatgatgatgagtctcatagagtggatcctggatctcctttccctcgatcagctactcctcctcgcgtttaattttcaactttttggtaatttattaccgtttaagtattgtttgggttttggttttgaaatataaatatttggatgttttggtttgttttaagtgacctatcgtctttttgtgtttataagtgttttagtttatgtttttttttttt

SEQ ID NO: 2196 - protein, 498 aa, Arabidopsis thaliana
  misc_feature (47)..(471): Pfam Name: Ammonium_transp Pfam Description: Ammonium Transporter Family
  misc_feature (1)..(498): Ceres SEED LINE ID no. CW00506
  misc_feature (1)..(498): Ceres Annot ID no. 873343
  misc_feature (1)..(498): Bit score of 1233.8 for HMM based on sequences of Figure 30
  misc_feature (1)..(498): in Figure 30
MSGAITCSAADLATLLGPNATAAADYICGQLGTVNNKFTDAAFAIDNTYLLFSAYLVFAMQLGFAMLCAGSVRAKNTMNIMLTNVLDAAAGGLFYYLFGYAFAFGGSSEGFIGRHNFALRDFPTPTADYSFFLYQWAFAIAAAGITSGSIAERTQFVAYLIYSSFLTGFVYPVVSHWFWSPDGWASPFRSADDRLFSTGAIDFAGSGVVHMVGGIAGLWGALIEGPRRGRFEKGGRAIALRGHSASLVVLGTFLLWFGWYGFNPGSFTKILVPYNSGSNYGQWSGIGRTAVNTTLSGCTAALTTLFGKRLLSGHWNVTDVCNGLLGGFAAITAGCSVVEPWAAIVCGFMASVVLIGCNKLAELVQYDDPLEAAQLHGGCGAWGLIFVGLFAKEKYLNEVYGATPGRPYGLFMGGGGKLLGAQLVQILVIVGWVSATMGTLFFILKRLNLLRISEQHEMQGMDMTRHGGFAYIYHDNDDESHRVDPGSPFPRSATPPRV

SEQ ID NO: 2197 - protein, 519 aa, Brassica napus
  misc_feature (47)..(471): Pfam Name: Ammonium_transp Pfam Description: Ammonium Transporter Family
  misc_feature (1)..(519): Public GI ID no. 11066960
  misc_feature (1)..(519): Bit score of 1226.2 for HMM based on sequences of Figure 30
  misc_feature (1)..(519): Functional Homolog Of SEQ ID NO. 2196
  misc_feature (1)..(519): in Figure 30
MSGAITCSAADLATLLGPNATAAADYICGQLGTVNNKFTDAAFAIDNTYLLFSAYLVFAMQLGFAMLCAGSVRAKNTMNIMLTNVLDAAAGGFFYYLFGYAFAFGGSSEGFIGRHNFALRDFPTPTADYSFFLYQWAFAIAAAGITSGSIAERTQFVAYLIYSSFLTGFVYPVVSHWFWSPDGWASPFRSADDRLFSTGAIDFAGSGVVHMVGGIAGLWGALIEGPRRGRFEKGGRAIALRGHSASLVVLGTFLLWFGWYGFNPGSFTKILVPYNSGSNYGQWSGIGRTAVNTTLSGCTAALTTLFGKRLLSGHWNVTDVCNGLLGGFAAITAGCSVVEPWAAIVCGFMTSLVLIGCNKLAELVQYGDPLEAAQLHGGCGAWGLIFVGLFAKEKYLNEVYGATPGRPYGLFMGGGGKLLGAQLVQILVIVGWVSATMGTLFFILKRLNLLRISEQHEMQGMDMTRHGGFAYIYHDNDDESHRVDPGSPFPRSALPLAFNFQLFGNLLPFKYCLGFGFEI

SEQ ID NO: 2198 - DNA, 2508 bp, Populus balsamifera subsp. trichocarpa
  misc_feature (1)..(2508): Ceres Annot ID no. 1462983
  misc_feature (1)..(2508): Encodes the peptide sequence at SEQ ID NO. 2199
atggcttccatgacctgctcagcgggcgatcttgctcagttactgggttccaacgttactaactccaccggggctgctgatttcatctgctcccaattcaacaccgcggctgacaacttctccgccacccaatatgctgtggacaacacatatctcctcttctccgcctaccttgtgttctccatgcaacttggcttcgccatgctctgtgcaggctccgtacgtgccaaaaacaccatgaacatcatgctcacaaatgttcttgacgctgcagccggtggcctcttttattacctctttggttttgcgtttgccttcgggactccctccaatgggttcattggcaaacacaactttggtcttaagaatttcccttcttcttcttttgattacagctactttctttatcagtgggcttttgctatagcggctgctgggataaccagtggttcaatagctgaaagaacccagtttgttgcttatttgatttactcttctttcttgactgggtttgtttaccctgttgtgtcccactggttctggtctggtgatgggtgggctagcgcgacaagaacagacggggatttgttgtttggtactggggttattgattttgcagggtctggtgtggtgcatatggtgggtgggattgctggtctttggggtgctctaattgaaggtccaagaatcggacgttttgaccattcaggcaaggctattgctttgcgtggtcacagtgcttcccttgtggttcttggcactttcttgctttggtttggttggtatgggtttaatcctgggtcattcactaagatcttgagtgcttaccctgctggtggctattatggtcaatggagcgcaattggtagaactgctgttacaacaaccctagctggttgcacagctgctttgaccactcttttcggtaaaagaattctgtctggtcattggaatgttactgatgtttgtaacggtttgcttggtgggtttgctgctattactgctgggtgctccgtggttgaaccatgggctgctataatatgcgggtttgttgcttctttagtgttgattggctgcaacaaattggctgagatcctcaagtttgatgacccgttagaggctgcacagttacacggtggatgcggcacttggggtgtcatcttcaccgccttatttgccacggagaagtatgtaagggaggtttacccgaacaaaccgaatcgtccatatgggttgttcatgggtggtggtggaaagctcttgggtgctcatttaatacagattttggtgattatcggatgggtcagtgcaaccatgggcccattgttctttgttcttcgcaagctcaagctcttgaggatctcatctgaggatgagatggctggtatggatatgacccggcatggcgggtttgcttacatttaccatgatgacgagtctaacaagcatggtttccagttgaagagagttgagcctacttctagaacccctaatgcaaacgttaaatgtcttgcggtggttgagaggtattggaatttgcaaatgcacgtgtccacttgttcccagacggaacgggaattgttttgggttttttcaagcaacgacaaacaaaagaaaaataaatcaagcgtggtgatttttttttatttcttttggcaaatgctcaacatgtgcttcgattctcgttatgaatttctgccttcagcagcagcagcagcagcttgtgatgctatctatattgttggaactggtaaaggagtaatatttcgccagccagttttggaggaattgacccttgttttaaatgctcaatgccgtggatatccatgtggcaagccaaaaaaaggttgccagtccaatttaaattttagacttgaatccaaggcaagagctaaaggacctgttttctgcggaaaagaaaaatcaaagcgagggttgaatcgttattttccatggattattatcgctaaataccggcggtgctacgcaggagttgcagtgccgcagcttgactggacaccagaacctcctgttgatttgctgattttgttcgggttagacaaaggtgtcatagtgtatatttgtgatagccgtggggttagagatttaaacgaaacagatttttatgaactcccagttgtcatgaaggctctaatgattcaacctgatgtcttctctgtgtgtgatcaagcttctgccaatttcttcattcttactatttgttctcccgtggtgaacaagggaactgcaagcgcaagtgaaatattggctggtgcattgaaagacaataaacgtgctgttttatatggagaacccacattttggaaaggcaagattcaatccgtttttcagctatctgatggttctggcttggctgttacagtcgctcggtatgagacacctgcccatacaggtattgataagaccatccactgcctaaatcttttccgaaggatgaggggggtttctgtggctgcctccaagactctgaatctacttgctacgtga

SEQ ID NO: 2199 - protein, 835 aa, Populus balsamifera subsp. trichocarpa
  misc_feature (49)..(473): Pfam Name: Ammonium_transp Pfam Description: Ammonium Transporter Family
  misc_feature (1)..(835): Ceres Annot ID no. 1462983
  misc_feature (1)..(835): Bit score of 1291.7 for HMM based on sequences of Figure 30
  misc_feature (1)..(835): Functional Homolog Of SEQ ID NO. 2196
  misc_feature (1)..(835): in Figure 30
MASMTCSAGDLAQLLGSNVTNSTGAADFICSQFNTAADNFSATQYAVDNTYLLFSAYLVFSMQLGFAMLCAGSVRAKNTMNIMLTNVLDAAAGGLFYYLFGFAFAFGTPSNGFIGKHNFGLKNFPSSSFDYSYFLYQWAFAIAAAGITSGSIAERTQFVAYLIYSSFLTGFVYPVVSHWFWSGDGWASATRTDGDLLFGTGVIDFAGSGVVHMVGGIAGLWGALIEGPRIGRFDHSGKAIALRGHSASLVVLGTFLLWFGWYGFNPGSFTKILSAYPAGGYYGQWSAIGRTAVTTTLAGCTAALTTLFGKRILSGHWNVTDVCNGLLGGFAAITAGCSVVEPWAAIICGFVASLVLIGCNKLAEILKFDDPLEAAQLHGGCGTWGVIFTALFATEKYVREVYPNKPNRPYGLFMGGGGKLLGAHLIQILVIIGWVSATMGPLFFVLRKLKLLRISSEDEMAGMDMTRHGGFAYIYHDDESNKHGFQLKRVEPTSRTPNANVKCLAVVERYWNLQMHVSTCSQTERELFWVFSSNDKQKKNKSSVVIFFYFFWQMLNMCFDSRYEFLPSAAAAAACDAIYIVGTGKGVIFRQPVLEELTLVLNAQCRGYPCGKPKKGCQSNLNFRLESKARAKGPVFCGKEKSKRGLNRYFPWIIIAKYRRCYAGVAVPQLDWTPEPPVDLLILFGLDKGVIVYICDSRGVRDLNETDFYELPVVMKALMIQPDVFSVCDQASANFFILTICSPVVNKGTASASEILAGALKDNKRAVLYGEPTFWKGKIQSVFQLSDGSGLAVTVARYETPAHTGIDKTIHCLNLFRRMRGVSVAASKTLNLLAT

SEQ ID NO: 2200 - protein, 502 aa, Lotus japonicus
  misc_feature (50)..(473): Pfam Name: Ammonium_transp Pfam Description: Ammonium Transporter Family
  misc_feature (1)..(502): Public GI ID no. 10637893
  misc_feature (1)..(502): Bit score of 1285.0 for HMM based on sequences of Figure 30
  misc_feature (1)..(502): Functional Homolog Of SEQ ID NO. 2196
  misc_feature (1)..(502): in Figure 30
MAALPECSAANLAQLIGPNATDAAAVAGFICDQFTAVGQRFSDTAFAVDSTYLLFSAYLVFSMQLGFAMLCAGSVRAKNTMNIMLTNVLDAAAGGLFYYLFGFAFAFGAPSNGFIGRHFFGLKDVPTVAFDYSYFLYQWAFAIAAAGITSGSIAERTQFVAYLIYSSFLTGFVYPVVSHWFWSGDGWASATNTGNLLFGTGVIDFAGSGVVHMVGGVAGLWGALIEGPRIGRFDHAGRAVSLRGHSASLVVLGTFMLWFGWYGFNPGSFTKILSAYDSGNYYGQWSAIGRTAVTTTLAGCTAALTTLFGKRIISGHWNVTDVCNGLLGGFAAITAGCSVVEPWAAIVCGFVAAVVLIACNMLAEKVRYDDPLEAAQLHGGCGAWGIIFTALFAKEEYVNQVYPGKPGRPYGLFMGGGGKLLGAHVIQILVIIGWVSATMGPLFFILNKMKLLRISTEDELAGMDLTRHGGFAYAYEDDESHKPGIQLRKIEPNSSSTPSAES

SEQ ID NO: 2201 - protein, 502 aa, Citrus sinensis x Poncirus trifoliata
  misc_feature (52)..(474): Pfam Name: Ammonium_transp Pfam Description: Ammonium Transporter Family
  misc_feature (1)..(502): Public GI ID no. 121485994
  misc_feature (1)..(502): Bit score of 1279.0 for HMM based on sequences of Figure 30
  misc_feature (1)..(502): Functional Homolog Of SEQ ID NO. 2196
  misc_feature (1)..(502): in Figure 30
MARATSLSCSADLLAGFLGPNATNASSAASLICSQLEAINNKFTDTAYAVDSTYLLFSAYLVFSMQLGFAMLCAGSVRAKNTMNIKLTNVLDAAAGGLFYYLFGFAFAFGTPSNGFIGRHNFALKSFPTSNFDYSYFLYQWAFAIAAAGITSGSIAERTQFVAYLIYSSFLTGFVYPVVSHWFWSVDGWASASNTGDLLFGSGVIDFAGSGVVHMVGGIAGLWGAYIEGPRIGRFDRSGQSVLRGHSASLVVLGTFMLWFGWYGFNPGSFTKILSAYNTGSYYGQWSAIGRTAVTTTLAGCTAALTTLFGKRILSGHWNVTDVCNGLLGGLAAITAGCSVVEPWAAIVCRFGAAVVLIACNKLAEKAKYDDPLEAAQLHGGCGAWGVIFTALFAKEKFVNEVYPGKPGRPYGLFMGGGGKLLAAHVIQILVVAGWVSATMGPLFFVLHKLKLLRISPEDEMAGMDLTRHGGFAYVYHDDDDVQSNGIQLRKIEPTATTPSSV

SEQ ID NO: 2202 - protein, 502 aa, Vitis vinifera
  misc_feature (46)..(471): Pfam Name: Ammonium_transp Pfam Description: Ammonium Transporter Family
  misc_feature (1)..(502): Public GI ID no. 147805516
  misc_feature (1)..(502): Bit score of 1272.2 for HMM based on sequences of Figure 30
  misc_feature (1)..(502): Functional Homolog Of SEQ ID NO. 2196
  misc_feature (1)..(502): in Figure 30
MASLNCSAEQLAQLLGPNGTAAASFICDRFSAVSNNFTDTNYAVDNTYLLFSAYLVFAMQLGFAMLCAGSVRAKNTMNIMLTNVLDAATGGLFYYLFGFAFAFGSPSNGFIGKHFFALKSIPTKTFDYSNFLYQWAFAIAAAGITSGSIAERTQFVAYLIYSSFLTGFVYPVVSHWFWSSDGWASASNSGNLLFGSGVIDFAGSGVVHMVGGIAGLWGAFIEGPRIGRFGHSGRSLVLRGHSSTLVVLGTFLLWFGWYGFNPGSFLKISVAYSGGGNYYGQWSAVGRTAVTTTLAGCTAALTTLFGKRILSGHWNVTDVCNGLLGGFAAITSGCSVVEPWAAIICGFVAAVVLISCNKLAEKVKFDDPLEATQLHGGCGAWGIIFTALFATKDYVSQVYNSGQPGRPYGLFMGGGGRLLAAHIIQILVITGWVSATMGTLFFILHKLKLLRISAEDEMAGMDLTRHGGFAYMYHEDDDSNKHAFELRKIEPAAPTTIVTTTN

SEQ ID NO: 2203 - DNA, 1473 bp, Solanum lycopersicum
  misc_feature (1)..(1473): Ceres Annot ID no. 8463421
  misc_feature (1)..(1473): Encodes the peptide sequence at SEQ ID NO. 2204
atggcttgttccgtcgatactctcgctccgttcctcggtcctaacaccaccaacgccgtcgccgccgcttcatacatctgcaaccaattttcaggtgtatcggacagattcgtcgataccggttatgcaatcgattctacatatctcctcttctctgcttatctcgttttctccatgcagcttggtttcgctatgctttgcgcgggctctgtccgcgcaaaaaatacaatgaacattatgctcacgaacgtcctcgatgccgccgccggtggacttttttactatctattcggattcgcttttgcttggggtggtccgtctaatggattcatcggccgacattttttcgggcttaaagagatcccgtcaaattcattcgattacagtaatttcctctatcaatgggctttcgccatcgccgccgccggtatcaccagcggttcaatcgccgaacgaacccaatttgttgcctatttgatttattcctcttttctaacgggtttcgtttacccggttgtttctcattggttttggaccccagatgggtgggctagcccgactaattcaaatctattattcggatccggtgtaatcgatttcgccgggtcgggtgtagttcatatggtaggtggaatcgccgggttttacggagctttgattgaaggtccacgaatcgggcggtacgatcatacgggtcgatccgttgcgcttcgtggacatagcgcgtcactcgtggttctaggcacctttttattatggttcggatggtacggatttaaccccggttcatttaataaaatcctagttacttacggtgcatccggagggtattatggtcaatggagcgctgtaggacgtaccgcggttacaactaccctagccggttgcaccgcagccctaacgactcttttcggtaaacgtatcctttcgggtcattggaacgtaaccgatgtatgtaacggtttactaggcggatttgcagcgatcacggctgggtgctcggtcgtcgagccgtgggccgcgattatatgtgggttcgtagcggctttagttttaattggttttaacatgttagcggaaaaatttaaatacgacgatccacttgaagcagcacaattacatgggggttgtggtgcatgggggataatttttaccgggttattcgctaaaggggagtttgtggatcaagtatacccgggtaaaccgggtcgacctcacgggttatttatgggtggtggagggaaactactcggggcgcatataatccagatactcgttataatcgggtgggtcagcgcgacaatgggtccgcttttttatatacttcataaattcaagttgcttcggatatcgtccgaagacgaaatggcgggtatggatctgacccgacatggtgggtttgcttattatcatgaagaggatccgaaattaggaatgcaaatgagaagaattgaaccaacaacctcaacttag

SEQ ID NO: 2204 - protein, 490 aa, Solanum lycopersicum
  misc_feature (46)..(469): Pfam Name: Ammonium_transp Pfam Description: Ammonium Transporter Family
  misc_feature (1)..(490): Ceres Annot ID no. 8463421
  misc_feature (1)..(490): Bit score of 1260.6 for HMM based on sequences of Figure 30
  misc_feature (1)..(490): Functional Homolog Of SEQ ID NO. 2196
  misc_feature (1)..(490): in Figure 30
MACSVDTLAPFLGPNTTNAVAAASYICNQFSGVSDRFVDTGYAIDSTYLLFSAYLVFSMQLGFAMLCAGSVRAKNTMNIMLTNVLDAAAGGLFYYLFGFAFAWGGPSNGFIGRHFFGLKEIPSNSFDYSNFLYQWAFAIAAAGITSGSIAERTQFVAYLIYSSFLTGFVYPVVSHWFWTPDGWASPTNSNLLFGSGVIDFAGSGVVHMVGGIAGFYGALIEGPRIGRYDHTGRSVALRGHSASLVVLGTFLLWFGWYGFNPGSFNKILVTYGASGGYYGQWSAVGRTAVTTTLAGCTAALTTLFGKRILSGHWNVTDVCNGLLGGFAAITAGCSVVEPWAAIICGFVAALVLIGFNMLAEKFKYDDPLEAAQLHGGCGAWGIIFTGLFAKGEFVDQVYPGKPGRPHGLFMGGGGKLLGAHIIQILVIIGWVSATMGPLFYILHKFKLLRISSEDEMAGMDLTRHGGFAYYHEEDPKLGMQMRRIEPTTST

SEQ ID NO: 2205 - DNA, 1545 bp, Gossypium hirsutum
  misc_feature (1)..(1545): Ceres Clone ID no. 1854329
  misc_feature (1)..(1545): Encodes the peptide sequence at SEQ ID NO. 2206
ccaatgactacttgttcagcgaacttagctccgctcctcggcgtcaacggcaccggcgccgccgattacatatgcagcaagttcagtgacgcttcttatgccgtcgacaacacttaccttctcttctcagcctacctcgtcttctccatgcaactcggctttgctatgctctgtgctggctcagtccgagccaaaaacaccatgaacatcatgttaaccaacgtcctcgacgctgccaccggtggtcttttttattacctttttgggttcgcctttgcctttgggtccccttccaatggcttcatcggccgccataactttgctttagaatccatcccttcttcttcgtttgattatagcaatttcctatatcaatgggcttttgctattgcagctgctgggattaccagtggctccattgctgaaagaacccaattcgttgcttatcttatttactcgtctttcttgaccggatttgtttaccccgttgtttcgcattggttttgggcgactgatggttgggctagtgcttttagaacagatgatttcctttttggctccggtgttattgattttgccggctctggtgttgttcatatcgtcggtggtgtcgccggtttatggggtgcgtttattgaaggaccaagaatcggaaggtttgatcattcgggtagatcggtggctttgcgtggtcatagtgcgacgcttgttgttcttggtactttcatgctttggttcggttggtatgggttcaaccccggttcgtttaacaaaatctcgagtttttacacttccggtaactattatggtcagtggagtgcggtgggaagaacggcggtgaccaccactttagccggatgtacagcggcgttgactactcttttttgtaaaaggatgttgaccggccattggaacgtcacagatgtttgcaacggcttacttggtggcttcgccgccatcacatcaggctgctcggtggttgaaccatgggccgctatcatctgcggctgcgtcgccgctctagtcttaatcggatgcaacaaactagccgagaaagtcaagtacgacgaccccttggaggctgcccaattgcacggtggatgcggagcttggggtgtcattttcacaggtttgttcgcgtctgaaaagctcgtgaaacaagtttaccccggcaggccagccaagtacgggctgttcatgggcggcggagggaagctgttcgcggcgcagatcatccagattctggttatcgtcgggtgggtgagtgccacaatgggaaccctgttctatttccttcacaaattcgggcttttaagaatctcagtcgaagatgaaatggctggcatggacttaaccaggcatgggggacttgcttatgtttatcatgatgaagatgaatcccaaaaaatggcattcaaatgaggaaaattgaaagcttcccaactcctccttcagtctaaattttttttttattaaatccaaacttgttcagaatattttatcatattggatagattatatttttatatacatatgaattccttg

SEQ ID NO: 2206 - protein, 472 aa, Gossypium hirsutum
  misc_feature (36)..(458): Pfam Name: Ammonium_transp Pfam Description: Ammonium Transporter Family
  misc_feature (1)..(472): Ceres Clone ID no. 1854329
  misc_feature (1)..(472): Bit score of 1190.4 for HMM based on sequences of Figure 30
  misc_feature (1)..(472): Functional Homolog Of SEQ ID NO. 2196
  misc_feature (1)..(472): in Figure 30
MTTCSANLAPLLGVNGTGAADYICSKFSDASYAVDNTYLLFSAYLVFSMQLGFAMLCAGSVRAKNTMNIMLTNVLDAATGGLFYYLFGFAFAFGSPSNGFIGRHNFALESIPSSSFDYSNFLYQWAFAIAAAGITSGSIAERTQFVAYLIYSSFLTGFVYPVVSHWFWATDGWASAFRTDDFLFGSGVIDFAGSGVVHIVGGVAGLWGAFIEGPRIGRFDHSGRSVALRGHSATLVVLGTFMLWFGWYGFNPGSFNKISSFYTSGNYYGQWSAVGRTAVTTTLAGCTAALTTLFCKRMLTGHWNVTDVCNGLLGGFAAITSGCSVVEPWAAIICGCVAALVLIGCNKLAEKVKYDDPLEAAQLHGGCGAWGVIFTGLFASEKLVKQVYPGRPAKYGLFMGGGGKLFAAQIIQILVIVGWVSATMGTLFYFLHKFGLLRISVEDEMAGMDLTRHGGLAYVYHDEDESQKMAFK

SEQ ID NO: 2207 - protein, 513 aa, Camellia sinensis
  misc_feature (49)..(474): Pfam Name: Ammonium_transp Pfam Description: Ammonium Transporter Family
  misc_feature (1)..(513): Public GI ID no. 50428339
  misc_feature (1)..(513): Bit score of 1239.6 for HMM based on sequences of Figure 30
  misc_feature (1)..(513): Functional Homolog Of SEQ ID NO. 2196
  misc_feature (1)..(513): in Figure 30
MASTLGCSATDLVPHLTGVNNATAVADFICGRLDAVSTKLSDTTYAVDTTYLLFSAYLVFAMQLGFAMLCAGSVRAKNTMNIMLTNVLDAAAGGLSYYLFGFAFAFGSGSRSNAFIGHYSFALTGVPSATHDYSFFLYQWAFAIAAAGITSGSIAERTQFVAYLIYSSFLTAFVYPIVSHWVWSGDGWLSASRTSGALLFSSGAIDFAGSGVVHMVGGIAGLWGALIEGPRIGRFDRSGRSVALRGHSASLVVLGSFLLWFGWYGFNPGSFLTILKSYGTAGTYYGQWSAVGRTAVTTTLAGCTAALTTLFGKRLLDGHWNVVDVCNGLLGGFAAITSGCSVVEPWAAIVCGFVSAWVLIGCNKVAEKLKYDDPLEAAQLHGGCGSWGILFTGLFAKKKYVDEVYSAGRPYGLFMGGGGKLLAAQLIEILVIFGWVSVTMGPLFYGLKKLKLLRISREDEMAGMDLTRHGGFAYIYRDEDDLANRPGFMMRKVEPQNSSPTPDHNSSSPAEAV

SEQ ID NO: 2208 - protein, 498 aa, Zea mays
  misc_feature (36)..(459): Pfam Name: Ammonium_transp Pfam Description: Ammonium Transporter Family
  misc_feature (1)..(498): Public GI ID no. 226508974
  misc_feature (1)..(498): Bit score of 1218.5 for HMM based on sequences of Figure 30
  misc_feature (1)..(498): Functional Homolog Of SEQ ID NO. 2196
  misc_feature (1)..(498): in Figure 30
MSTCAADLAPLLGPAAANATDYLCGQFADTASAVDATYLLFSAYLVFAMQLGFAMLCAGSVRAKNTMNIMLTNVLDAAAGALFYYLFGFAFAFGTPSNGFIGKQFFGLKHLPRTGFDYDFFLYQWAFAIAAAGITSGSIAERTQFVAYLIYSAFLTGFVYPVVSHWFWSADGWAGASRTSGPLLFGSGVIDFAGSGVVHMVGGIAGLWGALIEGPRIGRFDHAGRSVALKGHSASLVVLGTFLLWFGWYGFNPGSFTTILKSYGPAGTVHGQWSAVGRTAVTTTLAGSVAALTTLFGKRLQTGHWNVVDVCNGLLGGFAAITAGCSVVEPWAAVICGFVSAWVLIGANALAARFRFDDPLEAAQLHGGCGAWGVLFTGLFARRKYVEEIYGAGRPYGLFMGGGGKLLAAQIIQILVIAGWVSCTMGPLFYALKKLGLLRISADDEMSGMDLTRHGGFAYVYHDEDPGDKAGVGGFMLKSAQNRVEPAAAVAAATSSQV

SEQ ID NO: 2209 - DNA, 1491 bp, Sorghum bicolor
  misc_feature (1)..(1491): Ceres Annot ID no. 8701853
  misc_feature (1)..(1491): Encodes the peptide sequence at SEQ ID NO. 2210
atgtcgacgtgcgcggcggacctggcgccgctgctgggcccggcggcggcgaacgccacggactacctctgcggccagttcgccgacacggcgtccgcggtggacgccacgtacctgctcttctcggcgtacctcgtcttcgccatgcagctcggcttcgccatgctctgcgccggctccgtccgcgccaagaacaccatgaacatcatgctcaccaacgtgctcgacgccgccgcgggggcgctcttctactacctcttcggcttcgccttcgccttcggcacgccctccaacggcttcatcggcaagcagttcttcggcctccagcacctgcccaagaccggcttcgactacgacttcttcctctaccagtgggccttcgccatcgccgccgcgggcatcacgtcgggctccatcgccgagaggacccagttcgtcgcctacctcatctactccgcgttcctcaccgggttcgtgtaccccgtggtgtcccactggttctggtccgccgacggctgggccgccgccagccgtacctccggcccgctgctcttcgggtccggcgtcatcgacttcgcgggctccggcgtcgtccacatggtcggcggcatcgcggggctgtggggcgcgctcatcgagggcccccgcatcgggcgcttcgaccacgccggccgctccgtggcgctcaagggccacagcgcgtcgctcgtggtgctcggcactttcctgctgtggttcggctggtacggcttcaacccggggtccttcaccaccatcctcaagtcctacggccccgcggggaccgtcaacgggcagtggtcggccgtgggccgcaccgccgtcaccaccaccctcgccggcagcgtcgccgcgctcaccacgctgttcgggaagcggctccagacgggccactggaacgtggtggacgtctgcaacggcctcctcggcgggttcgcggccatcacggccgggtgcagcgtggtggagccgtgggcggccgtcgtctgcgggttcgtgtccgcgtgggtgctcatcggcgccaacgcgctcgccgcgcgcctcaagttcgacgacccgctggaggcggcgcagctgcacggcgggtgcggcgcctggggcgtcctcttcacgggcctcttcgcgagccaaaagtacgtggaggagatctacggctccgggaggccctacgggctgttcatgggcggcggcgggaagctcctcgccgcgcagatcatccagatcctggtgatcgccgggtgggtgagctgcaccatgggcccgctcttctacgcgctcaagaagctggacctgctgcgcatctcggccgacgacgagatgtccggcatggacctcaccaggcacggcggcttcgcctacgtctaccacgacgaggaccccggcgacaagagcggggttggtgggttcatgctcaagtccgcgcagcaccgtgtcgagccggcggcggcgacggcgaccagcaaccaggtgtaa

SEQ ID NO: 2210 - protein, 496 aa, Sorghum bicolor
  misc_feature (36)..(459): Pfam Name: Ammonium_transp Pfam Description: Ammonium Transporter Family
  misc_feature (1)..(496): Ceres Annot ID no. 8701853
  misc_feature (1)..(496): Bit score of 1219.9 for HMM based on sequences of Figure 30
  misc_feature (1)..(496): Functional Homolog Of SEQ ID NO. 2196
  misc_feature (1)..(496): in Figure 30
MSTCAADLAPLLGPAAANATDYLCGQFADTASAVDATYLLFSAYLVFAMQLGFAMLCAGSVRAKNTMNIMLTNVLDAAAGALFYYLFGFAFAFGTPSNGFIGKQFFGLQHLPKTGFDYDFFLYQWAFAIAAAGITSGSIAERTQFVAYLIYSAFLTGFVYPVVSHWFWSADGWAAASRTSGPLLFGSGVIDFAGSGVVHMVGGIAGLWGALIEGPRIGRFDHAGRSVALKGHSASLVVLGTFLLWFGWYGFNPGSFTTILKSYGPAGTVNGQWSAVGRTAVTTTLAGSVAALTTLFGKRLQTGHWNVVDVCNGLLGGFAAITAGCSVVEPWAAVVCGFVSAWVLIGANALAARLKFDDPLEAAQLHGGCGAWGVLFTGLFASQKYVEEIYGSGRPYGLFMGGGGKLLAAQIIQILVIAGWVSCTMGPLFYALKKLDLLRISADDEMSGMDLTRHGGFAYVYHDEDPGDKSGVGGFMLKSAQHRVEPAAATATSNQV

SEQ ID NO: 2211 - protein, 532 aa, Oryza sativa
  misc_feature (36)..(459): Pfam Name: Ammonium_transp Pfam Description: Ammonium Transporter Family
  misc_feature (1)..(532): Public GI ID no. 15705368
  misc_feature (1)..(532): Bit score of 1221.8 for HMM based on sequences of Figure 30
  misc_feature (1)..(532): Functional Homolog Of SEQ ID NO. 2196
  misc_feature (1)..(532): in Figure 30
MATCAADLAPLLGPVAANATDYLCNRFADTTSAVDATYLLFSAYLVFAMQLGFAMLCAGSVRAKNTMNIMLTNVLDAAAGALFYYLFGFAFAFGTPSNGFIGKQFFGLKHMPQTGFDYDFFLFQWAFAIAAAGITSGSIAERTQFVAYLIYSAFLTGFVYPVVSHWIWSADGWASASRTSGPLLFGSGVIDFAGSGVVHMVGGVAGLWGALIEGPRIGRFDHAGRSVALKGHSASLVVLGTFLLWFGWYGFNPGSFTTILKTYGPAGGINGQWSGVGRTAVTTTLAGSVAALTTLFGKRLQTGHWNVVDVCNGLLGGFAAITAGCSVVDPWAAIICGFVSAWVLIGLNALAARLKFDDPLEAAQLHGGCGAWGILFTALFARQKYVEEIYGAGRPYGLFMGGGGKLLAAHVIQILVIFGWVSCTMGPLFYGLKKLGLLRISAEDETSGMDLTRHGGFAYVYHDEDEHDKSGVGGFMLRSAQTRVEPAAAGCLQQQQPSVTNPERTTSQRRKKSRVSLPLRSRSSRHKFDPHI

SEQ ID NO: 2212 - protein, 494 aa, Triticum aestivum
  misc_feature (37)..(460): Pfam Name: Ammonium_transp Pfam Description: Ammonium Transporter Family
  misc_feature (1)..(494): Public GI ID no. 38684027
  misc_feature (1)..(494): Bit score of 1210.7 for HMM based on sequences of Figure 30
  misc_feature (1)..(494): Functional Homolog Of SEQ ID NO. 2196
  misc_feature (1)..(494): in Figure 30
MSATCAADLGPLLGAAAANATDYLCNRFADTTSAVDSTYLLFSAYLVFAMQLGFAMLCAGSVRAKNTMNIMLTNVLDAAAGALFYYLFGFAFAFGTPSNGFIGKHFFGLKDMPQTGFDYSFFLFQWAFAVAAAGITSGSIAERTQFVAYLIYSAFLTGFVYPVVSHWIWSVDGWASAARTSGPLLFKSGVIDFAGSGVVHMVGGIAGFWGALIEGPRIGRFDHAGRSVALKGHSASLVVLGTFLLWFGWYGFNPGSFVTILKSYGPPGSINGQWSGVGRTAVTTTLAGSVAALTTLFGKRLQTGHWNVVDVCNGLLGGFAAITAGCSVVDPWAAVICGFVSAWVLIGLNALAGRLKYDDPLEAAQLHGGCGAWGIIFTALFAKKQYVEEIYGAGRPYGLFLGGGGRLLAAHIVQILAIAGFVSCTMGPLFLALKKLGLLRISAEDEMAGMDLTRHGGFAYVYHDDDEHDKSVGGFMLRSAQTRVEPAAAANSQV

SEQ ID NO: 2213 - DNA, 1712 bp, Panicum virgatum
  misc_feature (1)..(1712): Ceres Clone ID no. 1789833
  misc_feature (1)..(1712): Encodes the peptide sequence at SEQ ID NO. 2214
acgcgccgcgcatcgccatctcccgttgctcatagaagaaaggaagagggggcggcgagcgagcagcgagcagggcaggtcggtccatggcgacgtgcgccgcgagcctcgcgccgctgctgggcccggcggcggcgaacgcgacggactacctgtgcaaccggttcgcggacaccacgtcggcggtggactcgacgtacctgctcttctcggcgtacctcgtgttcgccatgcagctggggttcgccatgctctgcgcgggctccgtccgcgccaagaacaccatgaacatcatgctcaccaacgtgctcgacgccgccgccggcgctctcttctactacctcttcggcttcgccttcgcgtacgggacgccgtccaacggcttcatcggcaagcagttcttcggcctcaagcggctgccccaggtcggcttcgactacgacttcttcctcttccagtgggccttcgccatcgccgccgccgggatcacgtcgggctccatcgccgagcggacccagttcgtggcgtacctcatctactccgccttcctcaccggcttcgtgtacccggtggtctcccactgggtctggtccgccgacgggtgggcctcggcgtcccggacgtcggggaagctgctcttcggctccggcatcatcgacttcgccgggtccagcgtcgtccacatggtcggcggcattgccggcctctggggcgcgctcatcgagggcccccgcatcggccggttcgaccacgccggccgctcggtggcgctgcgcgggcacagcgcgtcgctcgtcgtgctcggcaccttcctgctgtggttcgggtggttcggcttcaacccggggtcgttcctcaccatcctcaagagctacggccccgccggcagcatccgcgggcagtggtccgccgtgggccgcaccgccgtgaccaccaccctcgccggcagcacggcggcgctcacgacgctcttcgggaagcggctccagacggggcactggaacgtgctcgacgtctgcaacggcctcctgggcggcttcgccgcgatcaccgccggctgctcggtcgtggacccctgggcggccatcatctgcgggttcgtgtcggcgtgggtgctcatcgggctcaacgcgctggcggcgaggctccggttcgacgacccgctggaggcggcgcagctccacggcgggtgcggcgcgtggggggtcatcttcacggggctgttcgcgcgccgggagtacgtggagcagatctacggcggcgcgccggggcggccgtacgggctcttcatgggcggcggcgggcggctgctggcggcgaacgtggtgatagtcctggtgatcgcggcgtgggtgagcgccaccatggccccgctgttcctggcgctcaacaagatgggcctgctccgcgtctccgccgaggacgagatggccggcatggaccagacgcggcacggcggcttcgcgtacgcgtaccacgacgacgaggaccccagcggcaggcccaaggggttgcagacctcgcagatcgccaacgcgcccagcggcgagttctagcgacgccgtgccagccgctaccgctatagtaggggtacacatacacacgccctgcagattgcaagcagaccacccttctgtcgagctggatctcaccgtatgatgctacacaagattgtataataacaacgaggcatactattactcttcttgtct

SEQ ID NO: 2214 - protein, 489 aa, Panicum virgatum
  misc_feature (36)..(461): Pfam Name: Ammonium_transp Pfam Description: Ammonium Transporter Family
  misc_feature (1)..(489): Ceres Clone ID no. 1789833
  misc_feature (1)..(489): Bit score of 1197.1 for HMM based on sequences of Figure 30
  misc_feature (1)..(489): Functional Homolog Of SEQ ID NO. 2196
  misc_feature (1)..(489): in Figure 30
MATCAASLAPLLGPAAANATDYLCNRFADTTSAVDSTYLLFSAYLVFAMQLGFAMLCAGSVRAKNTMNIMLTNVLDAAAGALFYYLFGFAFAYGTPSNGFIGKQFFGLKRLPQVGFDYDFFLFQWAFAIAAAGITSGSIAERTQFVAYLIYSAFLTGFVYPVVSHWVWSADGWASASRTSGKLLFGSGIIDFAGSSVVHMVGGIAGLWGALIEGPRIGRFDHAGRSVALRGHSASLVVLGTFLLWFGWFGFNPGSFLTILKSYGPAGSIRGQWSAVGRTAVTTTLAGSTAALTTLFGKRLQTGHWNVLDVCNGLLGGFAAITAGCSVVDPWAAIICGFVSAWVLIGLNALAARLRFDDPLEAAQLHGGCGAWGVIFTGLFARREYVEQIYGGAPGRPYGLFMGGGGRLLAANVVIVLVIAAWVSATMAPLFLALNKMGLLRVSAEDEMAGMDQTRHGGFAYAYHDDEDPSGRPKGLQTSQIANAPSGEF

SEQ ID NO: 2215 - protein, 496 aa, Arabidopsis thaliana
  misc_feature (47)..(470): Pfam Name: Ammonium_transp Pfam Description: Ammonium Transporter Family
  misc_feature (1)..(496): Public GI ID no. 15230090
  misc_feature (1)..(496): Bit score of 1191.2 for HMM based on sequences of Figure 30
  misc_feature (1)..(496): Functional Homolog Of SEQ ID NO. 2196
MSGAITCSAADLSALLGPNATAAADYICGQLGSVNNKFTDAAYAIDNTYLLFSAYLVFAMQLGFAMLCAGSVRAKNTMNIMLTNVLDAAAGGLFYYLFGYAFAFGESSDGFIGRHNFGLQNFPTLTSDYSFFLYQWAFAIAAAGITSGSIAERTKFVAYLIYSSFLTGFVYPVVSHWFWSPDGWASPFRSEDRLFGTGAIDFAGSGVVHMVGGIAGLWGALIEGPRIGRFPDGGHAIALRGHSASLVVLGTFLLWFGWYGFNPGSFTKILIPYNSGSNYGQWSGIGRTAVTTTLSGCTAALTTLFGKRLLSGHWNVTDVCNGLLGGFAAITAGCSVVDPWAAIVCGFVASLVLIGCNKLAELLKYDDPLEAAQLHGGCGAWGLIFVGLFAKEKYINEVYGASPGRHYGLFMGGGGKLLGAQLVQIIVIVGWVSATMGTLFFILKKLNLLRISEQHEMRGMDLAGHGGFAYIYHDNDDDSIGVPGSPVPRAPNPPAV

SEQ ID NO: 2216 - DNA, 1705 bp, Arabidopsis thaliana
  misc_feature (1)..(1705): Ceres Annot ID no. 877376
  misc_feature (1)..(1705): Encodes the peptide sequence at SEQ ID NO. 2217
agcctctctgtttcatcttcttctctaaactctcaacatgtcttgctcggccaccgatctcgctgtcctgttgggtcctaatgccacggcggcggccaactacatctgtggccagttaggcgacgtcaacaacaaatttatcgacaccgctttcgctatagacaacacttaccttctcttctccgcctaccttgtcttctctatgcagcttggcttcgctatgctctgtgccggttccgtgagagccaagaatactatgaacatcatgcttaccaacgtccttgacgctgcagccggtggtctcttctattatctgtttggctacgcctttgcctttggatctccgtccaatggtttcatcggtaaacactactttggtctcaaagacatccccacggcctctgctgactactccaactttctctaccaatgggcctttgcaatcgctgcggctggaatcacaagtggctcgatcgctgaacggacacagttcgtggcttacctaatctattcctctttcttaaccgggtttgtttacccggtcgtctctcactggttctggtcagttgatggatgggccagcccgttccgtaccgatggagatttgcttttcagcaccggagcgatagatttcgctgggtccggtgttgttcatatggtcggaggtatcgctggactctggggtgcgctcatcgaaggtccacgacttggccggttcgataacggaggccgtgccatcgctcttcgtggccactcggcgtcacttgttgtccttggaacattcctcctctggtttggatggtacggatttaaccccggttccttcaacaagatcctagtcacgtacgagacaggcacatacaacggccagtggagcgcggtcggacggacagctgtcacaacaacgttagctggctgcaccgcggcgctgacaaccctatttgggaaacgtctactctcgggacattggaacgtcactgatgtatgcaacggcctcctcggagggtttgcagccataactggtggctgctctgtcgttgagccatgggctgcgatcatctgcgggttcgtggcggccctagtcctcctcggatgcaacaagctcgctgagaagctcaaatacgacgaccctcttgaggcagcacaactacacggtggttgcggtgcgtggggactaatattcacggctctcttcgctcaagaaaagtacttgaaccagatttacggcaacaaacccggaaggccacacggtttgtttatgggcggtggaggaaaactacttggagctcagctgattcagatcattgtgatcacgggttgggtaagtgcgaccatggggacacttttcttcatcctcaagaaaatgaaattgttgcggatatcgtccgaggatgagatggccggtatggatatgaccaggcacggtggttttgcttatatgtactttgatgatgatgagtctcacaaagccattcagcttaggagagttgagccacgatctccttctccttctggtgctaatactacacctactccggtttgatttggatttttacttttattctctattttctagagtattattttaaatgatgttttgtgatacttaaatattgttttggatatttttttgcatttcagtaatgttttagatgtacagtttcatggggttgtgatgataatatctatgtggtcatttgtgttc

SEQ ID NO: 2217 - protein, 501 aa, Arabidopsis thaliana
  misc_feature (43)..(467): Pfam Name: Ammonium_transp Pfam Description: Ammonium Transporter Family
  misc_feature (1)..(501): Ceres Annot ID no. 877376
  misc_feature (1)..(501): Bit score of 1241.6 for HMM based on sequences of Figure 30
  misc_feature (1)..(501): Functional Homolog Of SEQ ID NO. 2196
MSCSATDLAVLLGPNATAAANYICGQLGDVNNKFIDTAFAIDNTYLLFSAYLVFSMQLGFAMLCAGSVRAKNTMNIMLTNVLDAAAGGLFYYLFGYAFAFGSPSNGFIGKHYFGLKDIPTASADYSNFLYQWAFAIAAAGITSGSIAERTQFVAYLIYSSFLTGFVYPVVSHWFWSVDGWASPFRTDGDLLFSTGAIDFAGSGVVHMVGGIAGLWGALIEGPRLGRFDNGGRAIALRGHSASLVVLGTFLLWFGWYGFNPGSFNKILVTYETGTYNGQWSAVGRTAVTTTLAGCTAALTTLFGKRLLSGHWNVTDVCNGLLGGFAAITGGCSVVEPWAAIICGFVAALVLLGCNKLAEKLKYDDPLEAAQLHGGCGAWGLIFTALFAQEKYLNQIYGNKPGRPHGLFMGGGGKLLGAQLIQIIVITGWVSATMGTLFFILKKMKLLRISSEDEMAGMDMTRHGGFAYMYFDDDESHKAIQLRRVEPRSPSPSGANTTPTPV

SEQ ID NO: 2218 - protein, 501 aa, Lotus japonicus
  misc_feature (49)..(472): Pfam Name: Ammonium_transp Pfam Description: Ammonium Transporter Family
  misc_feature (1)..(501): Public GI ID no. 10952510
  misc_feature (1)..(501): Bit score of 1282.3 for HMM based on sequences of Figure 30
  misc_feature (1)..(501): Functional Homolog Of SEQ ID NO. 2196
MALPECSAANLAQLIGPNATDAAAVAGFICDQFTAVGQRFSDTAFAVDSTYLLFSAYLVFSMQLGFAMLCAGSVRAKNTMNIMLTNVLDAAAGGLFYYLFGFAFAFGAPSNGFIGRHFFGLKDVPTVAFDYSYFLYQWAFAIAAAGITSGSIAERTQFVAYLIYSSFLTGFVYPVVSHWFWSGDGWASATNTGNLLFGTGVIDFAGSGVVHMVGGVAGLWGALIEGPRIGRFDHAGRAVSLRGHSASLVVLGTFMLWFGWYGFNPGSFTKILSAYDSGNYYGQWSAIGRTAVTTTLAGCTAALTTLFGKRIISGHWNVTDVCNGLLGGFAAITAGCSVVEPWAAIVCGFVAAVVLIACNMLAEKVRYDDPLEAAQLHGGCGAWGIIFTALFAKEEYVNQVYPGKPGRPYGLFMGGGGKLLGAHVIQILVIIGWVSATMGPLFFILNKMKLLRISTEDELAGMDLTRHGGFAYAYEDDESHKPGIQLRKIEPNSSSTPSAES

SEQ ID NO: 2219 - protein, 502 aa, Vitis vinifera
  misc_feature (46)..(471): Pfam Name: Ammonium_transp Pfam Description: Ammonium Transporter Family
  misc_feature (1)..(502): Public GI ID no. 225433318
  misc_feature (1)..(502): Bit score of 1269.7 for HMM based on sequences of Figure 30
  misc_feature (1)..(502): Functional Homolog Of SEQ ID NO. 2196
MASLDCSAEQLAQLLGPNGTAAASFICDRFSAVSDSFTDTNYAVDNTYLLFSAYLVFAMQLGFAMLCAGSVRAKNTMNIMLTNVLDAATGGLFYYLFGFAFAFGSPSNGFIGKHFFALKSIPTSTFDYSNFLYQWAFAIAAAGITSGSIAERTQFVAYLIYSSFLTGFVYPVVSHWFWSSDGWASASNSGNLLFGSGVIDFAGSGVVHMVGGIAGLWGAFIEGPRIGRFGHSGRSLVLRGHSSTLVVLGTFLLWFGWYGFNPGSFLKISVAYSGGGNYYGQWSAVGRTAVTTTLAGCTAALTTLFGKRILSGHWNVTDVCNGLLGGFAAITSGCSVVEPWAAIICGFVAAVVLISCNKLAEKVKFDDPLEATQLHGGCGAWGIIFTALFATKDYVSQVYNSGQPGRPYGLFMGGGGRLLAAHIIQILVITGWVSATMGTLFFILHKLKLLRISAEDEMAGMDLTRHGGFAYMYHEDDDSNKHAFELRKIEPAAPTTIVTTTN

SEQ ID NO: 2220 - protein, 507 aa, Populus tremula x Populus tremuloides
  misc_feature (45)..(471): Pfam Name: Ammonium_transp Pfam Description: Ammonium Transporter Family
  misc_feature (1)..(507): Public GI ID no. 57283313
  misc_feature (1)..(507): Bit score of 1204.4 for HMM based on sequences of Figure 30
  misc_feature (1)..(507): Functional Homolog Of SEQ ID NO. 2196
MACSASDLAPLLSSTVNSTEAATYLCSQFTSISNHLSDTSYAVNNTYLLFSAYLVFAMQLGFAMLCAGSVRAKNTMNIMLTNVLDAAAGGLSYYLFGYAFAFGSPSNGFIGRHFFGLGDFPSPQADYSFFLYQWAFAIAAAGITSGSIAERTQFVAYLIYSTFLTGFVYPVVSHWLWSGDGWANPAKSDNNLLFGSGAIDFAGSGVVHMVGGIAGLWGALIEGPRIGRFDHNGRSVALRGHSASLVVLGSFLLWFGWYGFNPGSFLIILKSYGGGAGGYYGQWSAVGRTAVTTTLAGSTAALTTLFGKRLLSGHWNVIDVCNGLLRGFAAITAGCSVVEPWAAIICGFVAAWVLIGCNKLAEKLQYDDPLEAAQLHGGCGMWGLLFTGLFAKKAYVNEVYSNKPGRPYGLFMGGGGKLLAAQIIEILVIVGWVSATMGPLFYGLHKLKLLRISSEDEMAGMDLTRHGGFAYAYDAEDDVSGKPSFMMRKVLPANNTTPNENSPSINV

SEQ ID NO: 2221 - DNA, 1521 bp, Populus balsamifera subsp. trichocarpa
  misc_feature (1)..(1521): Ceres Annot ID no. 1478997
  misc_feature (1)..(1521): Encodes the peptide sequence at SEQ ID NO. 2222
atggcctgctcagcctctgacctagctcctctcctctccaccactgtaaactccacagaagctgccacctacttatgctcccagttcaccagcatatccagccagctttcagacacaaactatgcaatcaacaacacttaccttcttttctctgcctacctagtctttgctatgcaacttggctttgccatgctttgtgcaggctctgtgagggccaagaacaccatgaacataatgcttactaatgttcttgatgctgctgctggtggcctttcttactatctctttggctacgcctttgccttcggctctcccggcaatggcttcattggccgccatttatttggtttgagtgactttcctactattcaagctgattatagtttcttcctctatcaatgggcttttgctatagctgctgctggcatcactagtggctccattgctgagagaacccaattcgttgcttacctcatatactcctccttcttgaccggctttgtttaccctgttgtttcacattggctttggtccggtgatggttgggccaatcccgctaaaaccgataacaagctcttattcggttcgggtgcaatcgactttgctggttcaggtgtggttcacatggttggaggtattgcgggtttgtggggcgctctcattgaaggcccacgaattggccggttcgaccagaacggtcggtccgtggccttacgtggtcatagcgcttcgttagtggtgctcggttcattcttgttgtggttcgggtggtatgggttcaaccccggttcgttcttgacaatcttgaagagttatggtggtaacagagtgttttatggtcaatggagtgctgtgggaaggacagctgtcactacaacattggctgggagcacagctgcccttactaccctgtttgggaaaagattgttatctggtcattggaatgtgattgatgtatgtaatggcttattagggggttttgctgcgatcaccgcagggtgttcggtggtggaaccgtgggctgcaatcatatgtggctttgttgcagcttgggttttaattgggtgtaataagctcgcagataaactacaatatgatgacccattggaggcagcccaattgcacggcggatgcggcatgtgggggttgctgttcaccgggctgtttgcgaaggagacgtacgtgaatgaagtgtattcaaacaagccggggcggccgtatgggctgttcatgggtggtggtgggaagctgttggcggcccagataattgaaatcttggtgatagtagggtgggtctcggcgacaatgggcccactgttctatgggctccacaagttaaagttgctgaggatctcagctgaggatgagatggcaggcatggatttgacaaggcacggagggtttgcttatgcatacgatgaggaggatgatgtgtcaggaaagccttcttttatgatgaagaaagtggagcctgcgaagaacacctcacctaatggaaactcaccagctatcaatgtgtga

SEQ ID NO: 2222 - protein, 506 aa, Populus balsamifera subsp. trichocarpa
  misc_feature (45)..(470): Pfam Name: Ammonium_transp Pfam Description: Ammonium Transporter Family
  misc_feature (1)..(506): Ceres Annot ID no. 1478997
  misc_feature (1)..(506): Bit score of 1208.8 for HMM based on sequences of Figure 30
  misc_feature (1)..(506): Functional Homolog Of SEQ ID NO. 2196
MACSASDLAPLLSTTVNSTEAATYLCSQFTSISSQLSDTNYAINNTYLLFSAYLVFAMQLGFAMLCAGSVRAKNTMNIMLTNVLDAAAGGLSYYLFGYAFAFGSPGNGFIGRHLFGLSDFPTIQADYSFFLYQWAFAIAAAGITSGSIAERTQFVAYLIYSSFLTGFVYPVVSHWLWSGDGWANPAKTDNKLLFGSGAIDFAGSGVVHMVGGIAGLWGALIEGPRIGRFDQNGRSVALRGHSASLVVLGSFLLWFGWYGFNPGSFLTILKSYGGNRVFYGQWSAVGRTAVTTTLAGSTAALTTLFGKRLLSGHWNVIDVCNGLLGGFAAITAGCSVVEPWAAIICGFVAAWVLIGCNKLADKLQYDDPLEAAQLHGGCGMWGLLFTGLFAKETYVNEVYSNKPGRPYGLFMGGGGKLLAAQIIEILVIVGWVSATMGPLFYGLHKLKLLRISAEDEMAGMDLTRHGGFAYAYDEEDDVSGKPSFMMKKVEPAKNTSPNGNSPAINV

SEQ ID NO: 2223 - DNA, 1563 bp, Populus balsamifera subsp. trichocarpa
  misc_feature (1)..(1563): Ceres Annot ID no. 1445817
  misc_feature (1)..(1563): Encodes the peptide sequence at SEQ ID NO. 2224
atggcatcatcgcctctatcatgctcagcttctgacctctacccccttctgggcgatggtgccaatgccacggctgctgctgagttcttttgtggccgttttgaggctatctcaaacaaattcgttgatacaggatacgcagtggatagcacataccttcttttttctgcgtacttggtttttgcaatgcagcttggctttgccatgctctgtgctggttctgtccgagaaaagaacacgatgaacatcatgctgacgaatgttcttgacgctgcagccggtggtctgttttactatacttttggttttgctcttgcttttggctcaccatcaaatggattcattggccaacacttctttggcttgagcaagttcccatcgccatcgtttgattatggttatttcctgtatcagtgggcttttgctatagcagtagcaggaatcacaagtggttctatagcagaaagaactcagtttgttgcttatttggtatattcttctttcttgactggtttggtttatcctattgtctcacattggttctggtccgcggatggctgggctagccctgcaagagcagaaaatctcctgtttggttctggtgttattgattttgctggttctggtgtggtccatttggttggtgctgttgctggtttgtggggtgccctcattgaaggtccccgtatcggccggtttgatcatgctggtcgtgctgttactctccgtggacacagtggcacattggttgttttaggtactttcttgttgtggtttggttggtatggattcaatcctggttcgtttatcaacatctcgaaaagttatgaaagtggttcttattatggacaatggagtgctattggtagaactgcagcgaccacaactctagcaggctgcacagctgcattgaccactctatttggcaagaggttgttagctggtcactggaatgttactgatgtttgcaatggcttgcttggtgggtttgctgccataactggtgggtgctccgttgtcgatccatgggctgcagttctttgtggttttgtctctgcttgggttcttattgggtgcaacatgttggctgagaagttccattatgatgatcccttggaggcaacacaacttcatggagggtgtggttcttgggggattatatttactgcattgtttgcaaaggaggcctatgttaatgaggtttatccaggtcaaccagggaggccatatgggctgttcatgggaggtggcgcaaggctcttagctgcacatatagtacagattttggtgattgtggcttgggtgagtgtcactatggggacagtgttttttattctgcataagttgaagcttttgaggatctcagcagaagaagagatggcaggaatggacttgacaagccatggtgggcttgcttatgtgtatactgatcacgaagacgaagtgccgccatgccttgccttgccttcttcaggaggttgctattttatagttcttgttgtggggaatcttttccaaaaatcgcaagcagcagcaattttgaagaaattgcccaaatcttga

SEQ ID NO: 2224 - protein, 520 aa, Populus balsamifera subsp. trichocarpa
  misc_feature (50)..(473): Pfam Name: Ammonium_transp Pfam Description: Ammonium Transporter Family
  misc_feature (1)..(520): Ceres Annot ID no. 1445817
  misc_feature (1)..(520): Bit score of 1153.7 for HMM based on sequences of Figure 30
  misc_feature (1)..(520): Functional Homolog Of SEQ ID NO. 2196
MASSPLSCSASDLYPLLGDGANATAAAEFFCGRFEAISNKFVDTGYAVDSTYLLFSAYLVFAMQLGFAMLCAGSVREKNTMNIMLTNVLDAAAGGLFYYTFGFALAFGSPSNGFIGQHFFGLSKFPSPSFDYGYFLYQWAFAIAVAGITSGSIAERTQFVAYLVYSSFLTGLVYPIVSHWFWSADGWASPARAENLLFGSGVIDFAGSGVVHLVGAVAGLWGALIEGPRIGRFDHAGRAVTLRGHSGTLVVLGTFLLWFGWYGFNPGSFINISKSYESGSYYGQWSAIGRTAATTTLAGCTAALTTLFGKRLLAGHWNVTDVCNGLLGGFAAITGGCSVVDPWAAVLCGFVSAWVLIGCNMLAEKFHYDDPLEATQLHGGCGSWGIIFTALFAKEAYVNEVYPGQPGRPYGLFMGGGARLLAAHIVQILVIVAWVSVTMGTVFFILHKLKLLRISAEEEMAGMDLTSHGGLAYVYTDHEDEVPPCLALPSSGGCYFIVLVVGNLFQKSQAAAILKKLPKS

SEQ ID NO: 2225 - protein, 518 aa, Lotus japonicus
  misc_feature (50)..(477): Pfam Name: Ammonium_transp Pfam Description: Ammonium Transporter Family
  misc_feature (1)..(518): Public GI ID no. 31322044
  misc_feature (1)..(518): Bit score of 1194.6 for HMM based on sequences of Figure 30
  misc_feature (1)..(518): Functional Homolog Of SEQ ID NO. 2196
MASLSCSATDLAPLLTATTNATATAAATYLCNQLDTISRKLSDTTYAVDNTYLLFSAYLVFAMQLGFAMLCAGSVRAKNTMNIMLTNVLDAAAGGLSYYLFGFAFAFGAPSNGFIGRHFFGLKHYPSPTYDYSFFLYQWAFAIAAAGITSGSIAERTQFVAYLIYSSFLTGFVYPVVSHWLWSSDGWASPTRTTGSLLFGSGAIDFAGSGVVHMVGGIAGLWGAFIEGPRIGRFDRTGRSVALRGHSASLVVLGSFLLWFGWYGFNPGSFLTIAKAYGNNGENGNYYGQWSAIGRTAVTTTLAGCTAALTTLFSKRLLEGHWKVLDVCNGLLGGFAAITSGCSVVEPWPAIVCGFVAAWVLIGLNLVAAKMKYDDPLEAAQLHGGCGAWGVLFTGLFAKGEYVAEVYGSAGRPYGLLMGGGGKLLAAQVIEILVVCGWVTATMGPLFYGLHKTKLLRISEDDETAGMDLTRHGGFAYAYHDDDDVSTKRGVMMSRIGPGSSSPSTMNTPAASAAANDC

SEQ ID NO: 2226 - protein, 504 aa, Arabidopsis thaliana
  misc_feature (52)..(478): Pfam Name: Ammonium_transp Pfam Description: Ammonium Transporter Family
  misc_feature (1)..(504): Public GI ID no. 15235398
  misc_feature (1)..(504): Bit score of 1155.4 for HMM based on sequences of Figure 30
  misc_feature (1)..(504): Functional Homolog Of SEQ ID NO. 2196
MASALSCSASDLIPLLSGGANATAAAAAAEYICGRFDTVAGKFTDAAYAIDNTYLLFSAYLVFAMQLGFAMLCAGSVRAKNTMNIMLTNVIDAAAGGLFYYLFGFAFAFGSPSNGFIGKHFFGMYDFPQPTFDYPYFLYQWTFAIAAAGITSGSIAERTQFVAYLIYSSFLTGLVYPIVSHWFWSSDGWASPARSENLLFQSGVIDFAGSGVVHMVGGIAGLWGALIEGPRIGRFGVGGKPVTLRGHSATLVVLGTFLLWFGWYGFNPGSFATIFKAYGETPGSSFYGQWSAVGRTAVTTTLAGCTAALTTLFGKRLIDGYWNVTDVCNGLLGGFAAITSGCSVVEPWAALVCGFVAAWVLMGCNRLAEKLQFDDPLEAAQLHGGCGAWGIIFTGLFAEKRYIAEIFGGDPNRPFGLLMGGGGRLLAAHVVQILVITGWVSVTMGTLFFILHKLKLLRIPAEDEIAGVDPTSHGGLAYMYTEDEIRNGIMVRRVGGDNDPNVGV

SEQ ID NO: 2227 - DNA, 1545 bp, Solanum lycopersicum
  misc_feature (1)..(1545): Ceres Annot ID no. 8462622
  misc_feature (1)..(1545): Encodes the peptide sequence at SEQ ID NO. 2228
atggcctccgccatgacttgctcagctgccgagctcttccctcatctcggcagctcagcaaatgccacagcggccgcagaattcatctgcagccgcttctcagctgtctcagagtacctcacaaacaccacctacgcggtggacaccacatacctcctcttctcggcttacctcgtcttcgccatgcaattgggatttgccatgttgtgcgcgggctctgtccgcgccaaaaacacgatgaatataatgcttacaaacgtgcttgatgctgctgctggtggattgtcttattatctctttggttttgcctttgcctttggagctccttctaatggtttcattggaaaacatttttttggattaaaagagtttccttcacaagcttttgactatagctattttctttatcaatgggcctttgccatagctgctgcaggtatcacaagtgggtccatagctgaaagaacacaatttgtggcttatctcatttactcttcatttttgaccggttttgtgtacccaattgtctcacattggttctggtccggtgatggttgggccagtgcatcaaaaaccgatggtaacttattattcggttcgggtgttatcgattttgccgggtccggtgttgttcatatggttggtggcattgccggtctatggggcgctttcatcgaaggaccacgaatcggtcggtttgatcggtccggtcggtctgttgccctaagaggccatagtgcctcattagttgtattaggtacttttttactatggttcggttggtacggatttaatcctggttcattcttaactattcttaaatcatacgatcataccataagaggtacttattatggtcagtggagcgcgatcggtaggacagctgtcacgactacattggctggttgtaccgccgctctgacaactttgttttgtaagaggcttttagtgggacattggaatgtagttgatgtatgtaacggtttactaggtggatttgcagcaatcacgtcaggttgtgcagttgttgagccatgggcagctatagtttgtggatttatcgcagcttgggttttaattggatttaacgcattggcagctaaattaaaatacgacgatccattagaagcagcacaacttcatggtggttgcggttcatgggggataatatttactggattattcgcgaaaaaagaatatgtcaacgaagtatatccaggatttcctaatagaccatatggattgtttatgggaggtggtggaaaactattaggtgcacaagtaattcaagttgttgtgattattggatgggtgagtgtcacaatgggaccattgttttatttgttacataagtttaagctattgaggatatcgcgagacgatgaaacagcagggatggatttaacaagacatggaggatttgcatatatatatcatgatgaagatgaaggttcatctatgcctggatttaaaatgacaagagttgaaccgactaatacttctacacctgatcatcaaaatagatctgttaatgtggttgtataa

SEQ ID NO: 2228 - protein, 514 aa, Solanum lycopersicum
  misc_feature (49)..(476): Pfam Name: Ammonium_transp Pfam Description: Ammonium Transporter Family
  misc_feature (1)..(514): Ceres Annot ID no. 8462622
  misc_feature (1)..(514): Bit score of 1237.7 for HMM based on sequences of Figure 30
  misc_feature (1)..(514): Functional Homolog Of SEQ ID NO. 2196
MASAMTCSAAELFPHLGSSANATAAAEFICSRFSAVSEYLTNTTYAVDTTYLLFSAYLVFAMQLGFAMLCAGSVRAKNTMNIMLTNVLDAAAGGLSYYLFGFAFAFGAPSNGFIGKHFFGLKEFPSQAFDYSYFLYQWAFAIAAAGITSGSIAERTQFVAYLIYSSFLTGFVYPIVSHWFWSGDGWASASKTDGNLLFGSGVIDFAGSGVVHMVGGIAGLWGAFIEGPRIGRFDRSGRSVALRGHSASLVVLGTFLLWFGWYGFNPGSFLTILKSYDHTIRGTYYGQWSAIGRTAVTTTLAGCTAALTTLFCKRLLVGHWNVVDVCNGLLGGFAAITSGCAVVEPWAAIVCGFIAAWVLIGFNALAAKLKYDDPLEAAQLHGGCGSWGIIFTGLFAKKEYVNEVYPGFPNRPYGLFMGGGGKLLGAQVIQVVVIIGWVSVTMGPLFYLLHKFKLLRISRDDETAGMDLTRHGGFAYIYHDEDEGSSMPGFKMTRVEPTNTSTPDHQNRSVNVVV

SEQ ID NO: 2229 - DNA, 1488 bp, Populus balsamifera subsp. trichocarpa
  misc_feature (1)..(1488): Ceres Annot ID no. 1445818
  misc_feature (1)..(1488): Encodes the peptide sequence at SEQ ID NO. 2230
atggcagctctaacttgctctgcctctgacctccagtccttactaggtggtgctgccaatgccacggcagctgctgagtacatttgtactcgctttgttgcggtttcagaccattttgttgacacagcctatgctgttgacaacacttaccttcttttctctgcctaccttgtctttgccatgcaacttggctttgccatgttgtgtgctgggtctgtacgtgccaaaaataccatgaacattatgctaaccaatgttcttgatgctgccactggtggccttttctattacctttttggttttgcctttgcctttgggagcccttccaatggattcattggcaagcagttctttggccttgaaagttttccatcaccttctttcgactatggctactttctttatcagtgggcttttgccattgcagctgctgggatcactagtggatccattgctgaaagaacacagtttgtttcatatttgatatactcctcattcttgactggtttggtttatcctattgtctctcattggttctggtcagctgatggttgggctagtgctggtagaactgatggtaatcttttatttggatctggggtcattgattttgctggttctggtgttgtacatatggttggagggattgctggactctggggtgctctcattgaaggcccccgaatgggaagattcgaccatgaaggcaagtcgatggctctccgtggacatagtggtacattggttgttttaggcacattcctattgtggttcgggtggtatggtttcaatccaggttcatttctcaacatcctaagaacttatggagatgttggttcttattatggccaatggagtgctattggtagaacagccgtgacaacaacacttgcagggagctctgctgcactaaccactctctttggtaaacgcatgcttgctggaaactggaatgtgactgatgtctgcaatggtttgctaggtggttttgcagcaatcacctctggatgcgcggttgtagatccatgggcagcgatcatttgcggatttgttgcagcttgggtcctaattggctgcaacaaactggcagataaattccattatgatgatcctttggaggcagcacaacttcatggagggtgtggtgcatggggtattatcttcactgcattgtttgcaaaggaaacatatgtcaacgagatttatagtgggaaaccagggaggccatatggactgcttatgggaggtggtggaaggctcttggcagcacacatggtccagattttggtgatcacaggatgggtgagtgtgacaatggggacattgttctggatactgcacaaattcaagcttctgaggatctcagcggacgaggagatggcaggaatggatttgacaagccatggtggattggcatatgcatattatgatgagcatgatgatgcaatgcagaagaaatcatttatgatgacaaaggcggatccctag

SEQ ID NO: 2230 - protein, 495 aa, Populus balsamifera subsp. trichocarpa
  misc_feature (48)..(473): Pfam Name: Ammonium_transp Pfam Description: Ammonium Transporter Family
  misc_feature (1)..(495): Ceres Annot ID no. 1445818
  misc_feature (1)..(495): Bit score of 1178.9 for HMM based on sequences of Figure 30
  misc_feature (1)..(495): Functional Homolog Of SEQ ID NO. 2196
MAALTCSASDLQSLLGGAANATAAAEYICTRFVAVSDHFVDTAYAVDNTYLLFSAYLVFAMQLGFAMLCAGSVRAKNTMNIMLTNVLDAATGGLFYYLFGFAFAFGSPSNGFIGKQFFGLESFPSPSFDYGYFLYQWAFAIAAAGITSGSIAERTQFVSYLIYSSFLTGLVYPIVSHWFWSADGWASAGRTDGNLLFGSGVIDFAGSGVVHMVGGIAGLWGALIEGPRMGRFDHEGKSMALRGHSGTLVVLGTFLLWFGWYGFNPGSFLNILRTYGDVGSYYGQWSAIGRTAVTTTLAGSSAALTTLFGKRMLAGNWNVTDVCNGLLGGFAAITSGCAVVDPWAAIICGFVAAWVLIGCNKLADKFHYDDPLEAAQLHGGCGAWGIIFTALFAKETYVNEIYSGKPGRPYGLLMGGGGRLLAAHMVQILVITGWVSVTMGTLFWILHKFKLLRISADEEMAGMDLTSHGGLAYAYYDEHDDAMQKKSFMMTKADP

SEQ ID NO: 2231 - protein, 488 aa, Solanum lycopersicum
  misc_feature (46)..(467): Pfam Name: Ammonium_transp Pfam Description: Ammonium Transporter Family
  misc_feature (1)..(488): Public GI ID no. 22001520
  misc_feature (1)..(488): Bit score of 1233.0 for HMM based on sequences of Figure 30
  misc_feature (1)..(488): Functional Homolog Of SEQ ID NO. 2196
MACSVDTLAPFLGPNTTNAVAAASYICNQFSGVSDRFVDTGYAIDSTYLLFSAYLVFSMQLGFAMLLAGSVRNTMNIMLTNVLDAAAGGLFYYLFGFAFALGGPSNGFIGRHFFGLKEIPSNSFDYMNFLYQWAFAIAAAGITSGSIAERTQFVAYLIYSSFLTGFVYPVVSHWFWTPDGWASPTNSNLLFGSGVIDFAGSGVVHMVGGIAGFYGALIEGPRIGRYDHTGRSVALRGHSASLVVLGTFLLWFGWYGFNPGSFNKILVTYGASGGYYGQWSAVGRTAVTTTLAGCTAALTTLFGKRILSGHWNVTDVCNGLLGGFAAITAGCSVVEPWAAIICGFVAALVLIGFNMLAEKFKYDDPLEAAQLHGGCGAWGIIFTGLFAKGEFVDQVYPGKPGRPHGLFMGGGGKLLGAHIIQILVIIGWVSATMGPLFYILHKFKLLRISSEDEMAGMDLTRHGGFAYYHEEDPKLGMQMRRIEPTTST

SEQ ID NO: 2232 - protein, 506 aa, Lotus japonicus
  misc_feature (49)..(475): Pfam Name: Ammonium_transp Pfam Description: Ammonium Transporter Family
  misc_feature (1)..(506): Public GI ID no. 46409004
  misc_feature (1)..(506): Bit score of 1139.2 for HMM based on sequences of Figure 30
  misc_feature (1)..(506): Functional Homolog Of SEQ ID NO. 2196
MAAAFTCSAADLHPLLGTGANATAAAEFICSRFGAISNKFTDTAYAVDNTYLLFSAYLVFAMQLGFAMLCAGSVRAKNTMNIMLTNVLDAATGGIFFYIFGFALAFGTPSNGFIGKHFFGLNEFPSPSFDYGFFLYQWAFAIAAAGITSGSIAERTQFVAYLIYSSFLTGLVYPIVAHWFWSSDGWGSPARTENLLFGSGVIDFAGSGVVHLVGAVAGFWGAFIEGPRMGRFDHAGKPVPLRGHSGTLVVLGTFLLWFGWYGFNPGSFITILKSYGESGSGNYYGQWSAIGRTAVTTTLAGCSAALTTLFGKRLQTGHWNVTDVCNGLLGGFAAITSGCSVVDPWAAIICGFVAAWVLIGCNVLAEKFHYDDPLEAAQLHGGCGTWGIIFTALFAKKQYVNEVYAGLPDRPYGLLMGGGWRLLAAHVVQILTIAGWVSVTMGAVFFVLHKLNLLRISPEEEMAGLDMTSHGGLAYEYHEDVGSVQKALKFVFDFYCKGNYYKTLLE

SEQ ID NO: 2233 - DNA, 1846 bp, Arabidopsis thaliana
  misc_feature (1)..(1846): Ceres Annot ID no. 868358
  misc_feature (1)..(1846): Encodes the peptide sequence at SEQ ID NO. 2234
acttaagcaaacacgttccacaatcaagtaccctctctctatctctccctccctccctctccaccatggacaccgcaaccaccacatgctctgccgtagatctatctgccctcctatcctcttcttctaactcaacatcttccctcgccgcggcaacctttttatgttcccaaatttcaaacatctccaacaaactctccgacacaacttatgccgtcgacaacacgtatctcctcttctccgcctaccttgtctttgccatgcagctcggtttcgctatgctttgtgctggatcagtccgagccaagaacactatgaacatcatgcttaccaatgtccttgatgctgccgctggagccatctcttactacctcttcggattcgcattcgcctttggtacaccttccaacggattcatcggtcgccaccatagcttcttcgctttaagctcttaccctgaacgccccggctccgacttcagctttttcctctaccaatgggcttttgccatagccgcggccggaatcactagcggttccatcgccgagcgaacgcaattcgttgcttaccttatctactctactttcttgaccggttttgtttacccgacagtctcgcactggttctggtcaagtgatggatgggctagcgcgtcccggtctgacaacaatctcttgtttggctcaggtgctattgatttcgcaggttcaggagttgttcacatggtaggtggaattgccggtttatgtggagcgttagttgaaggaccaagaataggtagatttgaccggtcaggccggtccgtggctttacgtggtcacagtgcatcccttgtcgtgcttggtaccttcttgttgtggtttggatggtatgggtttaaccctggttcctttttaaccattcttaaaggctacgacaagtctcggccatattatggtcaatggagcgctgtaggtcgcaccgcggtcaccacaacgctttctggctgcaccgctgcgttgactactctattcagtaaacggcttttagcaggtcattggaacgttattgacgtatgcaacggacttctaggcggctttgcagctataacctccggatgtgccgtggtggagccgtgggctgctatagtatgtggctttgtggcatcatgggttttaatcggatttaacttgcttgccaagaaacttaaatatgatgacccactcgaggctgctcagctccacggtggatgtggagcatggggattaatctttaccgggctgttcgcaaggaaagaatacgttaacgagatttactccggtgataggccttacggactgttcatgggcgggggaggaaaactgctcgccgcgcagatcgttcagattattgtgatcgttgggtgggtgacggtaactatgggaccgttgttttatgggttacataagatgaatcttttgaggatatcagcagaagatgagatggcaggaatggacatgacacgtcatggaggatttgcttacgcatacaatgacgaagacgacgtgtcgactaaaccatggggtcatttcgctggaagagtggagcctacaagccggagctcgactcctacaccgaccttgactgtttgatactttgattggagaattgagtggtcccaaacgagtcagttttaatgtggtgaagacaagagttcgggcaccaaacatgttggacgcatctttgtgtattattggtcttcttcttcttctttttttttctcttggttatcgctctgttgtggacagatagtgtggaactgttaacaataacatgatcagtatgtctttttaattaaagtgaacgtttggtatcaaaattaaacatt

SEQ ID NO: 2234 - protein, 514 aa, Arabidopsis thaliana
  misc_feature (53)..(479): Pfam Name: Ammonium_transp Pfam Description: Ammonium Transporter Family
  misc_feature (1)..(514): Ceres Annot ID no. 868358
  misc_feature (1)..(514): Bit score of 1162.7 for HMM based on sequences of Figure 30
  misc_feature (1)..(514): Functional Homolog Of SEQ ID NO. 2196
MDTATTTCSAVDLSALLSSSSNSTSSLAAATFLCSQISNISNKLSDTTYAVDNTYLLFSAYLVFAMQLGFAMLCAGSVRAKNTMNIMLTNVLDAAAGAISYYLFGFAFAFGTPSNGFIGRHHSFFALSSYPERPGSDFSFFLYQWAFAIAAAGITSGSIAERTQFVAYLIYSTFLTGFVYPTVSHWFWSSDGWASASRSDNNLLFGSGAIDFAGSGVVHMVGGIAGLCGALVEGPRIGRFDRSGRSVALRGHSASLVVLGTFLLWFGWYGFNPGSFLTILKGYDKSRPYYGQWSAVGRTAVTTTLSGCTAALTTLFSKRLLAGHWNVIDVCNGLLGGFAAITSGCAVVEPWAAIVCGFVASWVLIGFNLLAKKLKYDDPLEAAQLHGGCGAWGLIFTGLFARKEYVNEIYSGDRPYGLFMGGGGKLLAAQIVQIIVIVGWVTVTMGPLFYGLHKMNLLRISAEDEMAGMDMTRHGGFAYAYNDEDDVSTKPWGHFAGRVEPTSRSSTPTPTLTV

SEQ ID NO: 2235 - protein, 497 aa, Camellia sinensis
  misc_feature (48)..(471): Pfam Name: Ammonium_transp Pfam Description: Ammonium Transporter Family
  misc_feature (1)..(497): Public GI ID no. 51371875
  misc_feature (1)..(497): Bit score of 1214.7 for HMM based on sequences of Figure 30
  misc_feature (1)..(497): Functional Homolog Of SEQ ID NO. 2196
MASLTCSADQLAQLFGSNTTNAAAATYICDHFTAVSQKFSDAASAIDSTYLLFSAYLVFSMQLGFAMLCAGSVRAKNTLNIMLTNVLDAAAGAIFYYLFGFAFAFGSPSNGFIGSHFFALKSIPTSSFDYSFFLFQWAFAIAAAGITSGSIAERTQFAAYLIYSAFLTGFVYPVVSHWFWSGDGWASASNTNHLLFGSGVIDFAGSGVVHMVGGIAGLYGAFIEGPRIGRFANPGQSVTIKGHSASLVVLGTFLLWFGWYGFNPGSFTKIANPYTSGSYYGQWSAVGRTAVTTTLAGSTAALTTLFLNRVVSGHWNVTDVCNGLLGGFAAITAGCSVVEPWAAVICGLVAALVLIGCNKVAERVKFDDPLEAAQLHGGCGAWGVIFTALFASEKYVNEVYPGKSDRPYGLLMGGGGRLLAAHVIQIVVIVGWVSVTMGPLFFVLHKLKLLRISAEDEIAGMDMTRHGGFAYVYQYHDEDESNKLGMQMRKIDPEDKS

SEQ ID NO: 2236 - protein, 514 aa, Arabidopsis thaliana
  misc_feature (53)..(479): Pfam Name: Ammonium_transp Pfam Description: Ammonium Transporter Family
  misc_feature (1)..(514): Public GI ID no. 5880357
  misc_feature (1)..(514): Bit score of 1156.0 for HMM based on sequences of Figure 30
  misc_feature (1)..(514): Functional Homolog Of SEQ ID NO. 2196
MDTATTTCSAVDLSALLSSSSNSTSSLAAATFLCSQISNISNKLSDTTYAVDNTYLLFSAYLVFAMQLGFAMLCAGSVRAKNTMNIMLTNVLDAAAGAISYYLFGFAFAFGTPSNGFIGRHHSFFALSSYPERPGSDFSFFLYQWAFAIAAAGITSGSIAERTQFVAYLIYSTFLTGFVYPTVSHWFWSSDGWASASGSDNNLLFGSGAIDFAGSGVVHMVGGIAGLCGALVEGPRIGRFDRSGRSVALRGHSASLVVLGTFLLWFGWYGFNPGSFLTILKGYDKSRPYYGQWSAVGRTAVTTTLSGCTSALTTLFSKRLLAGHWNVIDVCNGLLGGFAAITSGCAVVEPWAAIVCGFVASWVLIGFNLLAKKLKYDDPLEAAQLHGGCGAWGLIFTGLFARKEYVNEIYSGDRPYGLFMGGGGKLLAAQIVQIIVIIGWVTVTMGPLFYGLHKMNLLRISAEDEMAGMDMTRHGGFAYAYNDEDDVSTKPWGHFAGRVEPTSRSSTPTPTLTV

SEQ ID NO: 2237 - protein, 498 aa, Oryza sativa subsp. japonica
  misc_feature (36)..(459): Pfam Name: Ammonium_transp Pfam Description: Ammonium Transporter Family
  misc_feature (1)..(498): Public GI ID no. 115459360
  misc_feature (1)..(498): Bit score of 1223.3 for HMM based on sequences of Figure 30
  misc_feature (1)..(498): Functional Homolog Of SEQ ID NO. 2196
MATCAADLAPLLGPVAANATDYLCNRFADTTSAVDATYLLFSAYLVFAMQLGFAMLCAGSVRAKNTMNIMLTNVLDAAAGALFYYLFGFAFAFGTPSNGFIGKQFFGLKHMPQTGFDYDFFLFQWAFAIAAAGITSGSIAERTQFVAYLIYSAFLTGFVYPVVSHWIWSADGWASASRTSGPLLFGSGVIDFAGSGVVHMVGGVAGLWGALIEGPRIGRFDHAGRSVALKGHSASLVVLGTFLLWFGWYGFNPGSFTTILKTYGPAGGINGQWSGVGRTAVTTTLAGSVAALTTLFGKRLQTGHWNVVDVCNGLLGGFAAITAGCSVVDPWAAIICGFVSAWVLIGLNALAARLKFDDPLEAAQLHGGCGAWGILFTALFARQKYVEEIYGAGRPYGLFMGGGGKLLAAHVIQILVIFGWVSCTMGPLFYGLKKLGLLRISAEDETSGMDLTRHGGFAYVYHDEDEHDKSGVGGFMLRSAQTRVEPAAAAASNSNNQV

SEQ ID NO: 2238 - protein, 498 aa, Oryza sativa subsp. indica
  misc_feature (36)..(459): Pfam Name: Ammonium_transp Pfam Description: Ammonium Transporter Family
  misc_feature (1)..(498): Public GI ID no. 116311063
  misc_feature (1)..(498): Bit score of 1219.4 for HMM based on sequences of Figure 30
  misc_feature (1)..(498): Functional Homolog Of SEQ ID NO. 2196
MATCAADLAPLLGPVAANATDYLCNRFADTTSAVDATYLLFSAYLVFAMQLGFAMLCAGSVRAKNTMNIMLTNVLDAAAGALFYYLFGFAFAFGTPSNGFIGKQFFGLKHMPQTGFDYDFFLFQWAFAIAAAGITSGSIAERTQFVAYLIYSAFLTGFVYPVVSHWIWSADGWASASRTSGPLLFGSGVIDFAGSGVVHMVGGVAGLWGALIEGPRIGRFDHAGRSVALKGHSASLVVLGTFLLWFGWYGFNPGSFTTILKTYGPAGGINGQWSGVGRTAVTTTLAASVAALTTLFGKRLQTGHWNVVDVCNGLLGGFAAITAGCSVVDPWAAIICGFVSAWVLIGLNALAARLKFDDPLEAAQLHGGCGAWGILFTALFARQKYVEEIYGAGRPYGLFMGGGGKLLAAHVIQILVIFGWVSCTMGPLFYGLKKLGLLRISAEDETSGMDLTRHGGFAYVYHDEDEHDKSGVGGFMLRSAQTRVEPAAAAASNSNNQV

SEQ ID NO: 2239 - protein, 532 aa, Oryza sativa subsp. japonica
  misc_feature (36)..(459): Pfam Name: Ammonium_transp Pfam Description: Ammonium Transporter Family
  misc_feature (1)..(532): Public GI ID no. 52550773
  misc_feature (1)..(532): Bit score of 1216.8 for HMM based on sequences of Figure 30
  misc_feature (1)..(532): Functional Homolog Of SEQ ID NO. 2196
MATCAADLAPLLGPVAANATDYLCNRFADTTSAVDATYLLFSAYLVFAMQLGFAMLCAGSVRAKNTMNIMLTNVLDAAAGALFYYLFGFAFAFGTPSNGFIGKQFFGLKHMPQTGFDYDFFLFQWAFAIAAAGITSGSIAERTQFVAYLIYSAFLTGFVYPVVSHWIWSADGWASASRTSGPLLFGSGVIDFAGSGVVHMVGGVAGLWGALIEGPRIGRFDHAGRSVALKGHSASLVVLGTFLLWFGWYGFNPGSSTTILKTYGPAGGINGQWSGVGRTAVTTTLAGSVAALTTLFGKRLQTGHWNVVDVCNGLLGGFAAITAGCSVVDPWAAIICGFVSAWVLIGLNALAARLKFDDPLEAAQLHGGCGAWGILFTALFARQKYVEEIYGAGRPYGLFMGGGGKLLAAHVIQILVIFGWVSCTMGPLFYGLKKLGLLRISAEDETSGMDLTRHGGFAYVYHDEDEHDKSGVGGFMLRSAQTRVEPAAAGCLQQQQPSVTNPERTTSQRRKKSRVSLPLRSRSSRHKFDPHI

SEQ ID NO: 2240 - protein, 503 aa, Triticum aestivum
  misc_feature (36)..(460): Pfam Name: Ammonium_transp Pfam Description: Ammonium Transporter Family
  misc_feature (1)..(503): Public GI ID no. 188506975
  misc_feature (1)..(503): Bit score of 1186.5 for HMM based on sequences of Figure 30
  misc_feature (1)..(503): Functional Homolog Of SEQ ID NO. 2196
MSTCAASLAPLLGTAAANATDYLCNQFADTTTAIDSTYLLFSAYLVFAMQLGFAMLCAGSVRAKNTMNIMLTNVLDAAAGALFYYLFGFAFAFGTPSNGFIGKHFFGLRDVPQVGFDYSFFLFQWAFAIAAAGITSGSIAERTQFVAYLIYSAFLTGFVYPVVSHWIWSADGWASASRTSGPLLFNSGVIDFAGSGVVHMVGGVAGLWGALIEGPRIGRFDHAGRAVALRGHSASLVVLGTFLLWFGWYGFNPGSFLTILKSYGPPGSIHGQWSAVGRAAVTTTLAGSTAALTTLFGKRLQTGHWNVLDVCNGLLGGFAAVTAGCSVVDPWAAIICGFVSAWVLIGLNKLAARFKFDDPLEAAQLHGGCGAWGVIFTALFARREYVEQIYGAPGRPYGLFMGGGGRLLGAHVVLILVIAAWVSCTMGPLFLALNKLGLLRISAEDEMAGMDQTRHGGFAYAYTDEDSSSRPGRGAGGSVGGFMLKSAQTSQVAADATSPSSSV

SEQ ID NO: 2241 - protein, 489 aa, Zea mays
  misc_feature (36)..(459): Pfam Name: Ammonium_transp Pfam Description: Ammonium Transporter Family
  misc_feature (1)..(489): Public GI ID no. 226500244
  misc_feature (1)..(489): Bit score of 1169.2 for HMM based on sequences of Figure 30
  misc_feature (1)..(489): Functional Homolog Of SEQ ID NO. 2196
MATCATDLAPLLGPAAANATGYLCSQFADTASAVDATYLLFSAYLVFAMQLGFAMLCAGSVRAKNTMNIMLTNVLDAAAGALFYYLFGFAFAFGTPSNGFIGRHFFGLQRLPRTGFDYDFFLYQWAFAIAAAGITSGSIAERTQFVAYLIYSAFLTGFVYPVASHWFWSADGWAAAGRTSGPLLFGSGAIDFAGSGVVHMVGGIAGFWGALVEGPRIGRFDHAGRSVALRGHSASLVVLGTFLLWFGWYGFNPGSFTTILKSYGPAGTVHGQWSAVGRTAVTTTLAGSVAALTTLFGKRLQAGHWNVVDVCNGLLGGFAAITAGCSVVEPWAAVVCGFVSAWVLIGANALAARLRFDDPLEAAQLHGGCGAWGVLFTGLFARQEYVEEIYGAGRPYGLLMGGGGKLLAAQIVQIVVIAGWVSCTMGPLFYALKRLDLLRISADDEMSGMDLTRHGGFAYEDPGDNAGVGEFTLKSAQNRVEPPASSNRV

SEQ ID NO: 2242 - protein, 496 aa, Oryza sativa subsp. japonica
  misc_feature (36)..(460): Pfam Name: Ammonium_transp Pfam Description: Ammonium Transporter Family
  misc_feature (1)..(496): Public GI ID no. 115447353
  misc_feature (1)..(496): Bit score of 1188.1 for HMM based on sequences of Figure 30
  misc_feature (1)..(496): Functional Homolog Of SEQ ID NO. 2196
MATCADTLGPLLGTAAANATDYLCNQFADTTSAVDSTYLLFSAYLVFAMQLGFAMLCAGSVRAKNTMNIMLTNVLDAAAGALFYYLFGFAFAFGAPSNGFIGKHFFGLKQVPQVGFDYSFFLFQWAFAIAAAGITSGSIAERTQFVAYLIYSAFLTGFVYPVVSHWIWSADGWASASRTSGSLLFGSGVIDFAGSGVVHMVGGVAGLWGALIEGPRIGRFDHAGRSVALRGHSASLVVLGSFLLWFGWYGFNPGSFLTILKSYGPPGSIHGQWSAVGRTAVTTTLAGSTAALTTLFGKRLQTGHWNVIDVCNGLLGGFAAITAGCSVVDPWAAIICGFVSAWVLIGLNALAARLKFDDPLEAAQLHGGCGAWGVIFTALFARKEYVDQIFGQPGRPYGLFMGGGGRLLGAHIVVILVIAAWVSFTMAPLFLVLNKLGLLRISAEDEMAGMDQTRHGGFAYAYHDDDASGKPDRSVGGFMLKSAHGTQVAAEMGGHV

SEQ ID NO: 2243 - DNA, 1470 bp, Sorghum bicolor
  misc_feature (1)..(1470): Ceres Annot ID no. 8680294
  misc_feature (1)..(1470): Encodes the peptide sequence at SEQ ID NO. 2244
atggcgacgtgcgccacgaccctcgcgccgcttctgggcccggcggcggcgaacgcgacggagtacctgtgcaaccagttcgcggacaccacgtcggcggtggactcgacgtacctgctcttctcggcgtacctcgtcttcgccatgcagctcgggttcgccatgctctgcgcgggctccgtccgcgccaagaacaccatgaacatcatgctcaccaacgtgctcgacgccgccgccggcgcgctcttctactacctcttcggcttcgccttcgcgtacgggaccccgtccaacggcttcatcggcaagcacttcttcggcctcaagcgacttccccaggtcggcttcgactacgacttcttcctcttccagtgggccttcgccatcgccgccgccgggatcacgtcgggctccatcgccgagcgcacgcagttcgtcgcgtacctcatctactccgccttcctcaccggcttcgtgtacccggtcgtgtcccactgggtctggtccgccgacggctgggcctcgccgacccggacgtcggggaacctgctcttcggctccggcatcatcgacttcgccgggtccagcgtcgtccacatggtcggcggcatcgccggcctctggggcgccctcatcgagggcccacgcattggccggttcgaccacgcaggccgctccgtggcgctgcgcggccacagcgcgtcgctcgtcgtgctcggcaccttcctgctctggttcggctggttcggcttcaaccccgggtcgttcctcaccatcctcaagagctacggccccgccggaagcatccacgggcagtggtcggccgtgggccgcacggcggtcaccaccacgctcgccggcagcacggcggcgctcacgacgctgttcgggaagaggctccagacggggcactggaacgtggtggacgtctgcaacggcctcctgggcggcttcgcggccatcaccgcgggctgctccgtggtcgacccttgggcggccgtcatctgcgggttcgtgtcggcgtgggtgctcatcgggctcaacgcgctggccgccaggctccggttcgacgacccgctggaggccgcgcagctgcacggcgggtgcggcgcgtggggggtgctcttcacggcgctgttcgcgcgcagggagtacgtggagcagatctacggcacgccggggcggccgtacggcctcttcatgggcggcggcgggaggctgctggcggcgaacgtggtgatgatcctggtgatcgcggcgtgggtgagcgtcaccatggccccgctgttcctggcgctcaacaagctgggcctgctccgcgtctcggccgaggacgagatggccggcatggaccagacgcggcacggcgggttcgcgtacgcgtaccacgacgaggacatgagcttgagcagcagacccaagggggctcagagcacgcagatcgcggccgcgtccagcggcgagttctag

SEQ ID NO: 2244 - protein, 489 aa, Sorghum bicolor
  misc_feature (36)..(460): Pfam Name: Ammonium_transp Pfam Description: Ammonium Transporter Family
  misc_feature (1)..(489): Ceres Annot ID no. 8680294
  misc_feature (1)..(489): Bit score of 1184.3 for HMM based on sequences of Figure 30
  misc_feature (1)..(489): Functional Homolog Of SEQ ID NO. 2196
MATCATTLAPLLGPAAANATEYLCNQFADTTSAVDSTYLLFSAYLVFAMQLGFAMLCAGSVRAKNTMNIMLTNVLDAAAGALFYYLFGFAFAYGTPSNGFIGKHFFGLKRLPQVGFDYDFFLFQWAFAIAAAGITSGSIAERTQFVAYLIYSAFLTGFVYPVVSHWVWSADGWASPTRTSGNLLFGSGIIDFAGSSVVHMVGGIAGLWGALIEGPRIGRFDHAGRSVALRGHSASLVVLGTFLLWFGWFGFNPGSFLTILKSYGPAGSIHGQWSAVGRTAVTTTLAGSTAALTTLFGKRLQTGHWNVVDVCNGLLGGFAAITAGCSVVDPWAAVICGFVSAWVLIGLNALAARLRFDDPLEAAQLHGGCGAWGVLFTALFARREYVEQIYGTPGRPYGLFMGGGGRLLAANVVMILVIAAWVSVTMAPLFLALNKLGLLRVSAEDEMAGMDQTRHGGFAYAYHDEDMSLSSRPKGAQSTQIAAASSGEF

SEQ ID NO: 2245 - protein, 488 aa, Zea mays
  misc_feature (35)..(459): Pfam Name: Ammonium_transp Pfam Description: Ammonium Transporter Family
  misc_feature (1)..(488): Public GI ID no. 212276282
  misc_feature (1)..(488): Bit score of 1181.4 for HMM based on sequences of Figure 30
  misc_feature (1)..(488): Functional Homolog Of SEQ ID NO. 2196
MATCATTLAPLLGPAANATEYLCNQFADTTSAVDSTYLLFSAYLVFAMQLGFAMLCAGSVRAKNTMNIMLTNVLDAAAGALFYYLFGFAFAYGTPSNGFIGKHFFGLKRLPQVGFDYDFFLFQWAFAIAAAGITSGSIAERTQFVAYLIYSAFLTGFVYPVVSHWVWSADGWASPSRTSGKLLFGSGIIDFAGSSVVHMVGGIAGLWGALIEGPRIGRFDHAGRSVALRGHSASLVVLGTFLLWFGWFGFNPGSFLTILKSYGPAGSIHGQWSAVGRTAVTTTLAGSTAALTTLFGKRLQTGHWNVVDVCNGLLGGFAAITAGCSVVDPWAAIICGFVSAWVLIGLNALAARLRFDDPLEAAQLHGGCGAWGVLFTGLFARREYVEQIYGTPGRPYGLFMGGGGRLLAANVVMILVIAAWVSVTMAPLFLALNKMGLLRVSAEDEMAGMDQTRHGGFAYAYHDDDLSLSSRPKGMQSTQIADAASGEF

SEQ ID NO: 2246 - protein, 511 aa, Physcomitrella patens subsp. patens
  misc_feature (51)..(477): Pfam Name: Ammonium_transp Pfam Description: Ammonium Transporter Family
  misc_feature (1)..(511): Public GI ID no. 168011841
  misc_feature (1)..(511): Bit score of 1043.7 for HMM based on sequences of Figure 30
  misc_feature (1)..(511): Functional Homolog Of SEQ ID NO. 2196
MSTFGCSAEDVTTLQGFLGNTANAAGLSSFLCKKLDDVSSQLDATTLAVDNTYLLFSAYLVFAMQLGFAMLCAGSVRAKNTMNIMLTNVLDAACGGLSYYIFGFAFAFGIGSKTNGFIGHYNWALRGYPNESFDYSYFLFQWAFAIAAAGITSGSIAERTQFVAYLIYSSVLTGFVYPIVSHWLWSTDGWLSASKSVGPGSLLFGSGAIDFAGSGVVHMVGGIAGFWGAFIEGPRIGRFDKTGNPMVFRGHSATLVVLGTFLLWFGWYGFNPGSFVNILVPYSGNRGAWTGVGRTAVTTTLSGCTAAVTTLFAKRLLHNHWSVLDVCNGLLGGFAAITAGCAVVAPWASIICGFVSAWVLIGLNKLAARVHYDDPLEAAQLHAGCGAWGLIFVGLFAQQNYILQIYDGAGDRPHGLFMGGGGKLLAAQIIEILAIFGWVTVTMGPLFFLLKLFNLLRISPEDEMAGLDLTRHGGTAYIHHDGSDHPMHMHSMNGQKRPNEGPGGNYDGTNV

SEQ ID NO: 2247 - protein, 498 aa, Oryza sativa subsp. japonica
  misc_feature (38)..(462): Pfam Name: Ammonium_transp Pfam Description: Ammonium Transporter Family
  misc_feature (1)..(498): Public GI ID no. 115447351
  misc_feature (1)..(498): Bit score of 1109.0 for HMM based on sequences of Figure 30
  misc_feature (1)..(498): Functional Homolog Of SEQ ID NO. 2196
MATCLDSLGPLLGGAANSTDAANYICNRFTDTSSAVDATYLLFSAYLVFAMQLGFAMLCAGSVRAKNSMNIMLTNVLDAAAGALFYYLFGFAFAFGTPSKGFIGKQFFGLKHMPQTGYDYDFFLFQWAFAIAAAGITSGSIAERTRFSAYLIYSAFLTGFVYPVVSHWFWSTDGWASAGRLTGPLLFKSGVIDFAGSGVVHLVGGIAGLWGAFIEGPRIGRFDAAGRTVAMKGHSASLVVLGTFLLWFGWFGFNPGSFTTISKIYGESGTIDGQWSAVGRTAVTTSLAGSVAALTTLYGKRWLTGHWNVTDVCNGLLGGFAAITAGCSVVDPWASVICGFVSAWVLIGCNKLSLILKFDDPLEATQLHAGCGAWGIIFTALFARREYVELIYGVPGRPYGLFMGGGGRLLAAHIVQILVIVGWVSATMGTLFYVLHRFGLLRVSPATEMEGMDPTCHGGFGYVDEDEGERRVRAKSAAETARVEPRKSPEQAAAGQFV

SEQ ID NO: 2248 - protein, 505 aa, Physcomitrella patens subsp. patens
  misc_feature (51)..(477): Pfam Name: Ammonium_transp Pfam Description: Ammonium Transporter Family
  misc_feature (1)..(505): Public GI ID no. 168067175
  misc_feature (1)..(505): Bit score of 1048.6 for HMM based on sequences of Figure 30
  misc_feature (1)..(505): Functional Homolog Of SEQ ID NO. 2196
MSIFGCQDGDLATIQGFLGAVPNATGLSSFLCDKLNLIDGRLGSTKLAVDNTYLLFSAYLVFAMQLGFAMLCAGSVRAKNTMNIMLTNVLDAACGGISYYVFGFAFAFGLGGKTNGFIGHFNWGLNGFPNGTFDYSFFLFQWAFAIAAAGITSGSIAERTQFVAYLVYSSFLTGFVYPIVSHWLWSADGWLSASKTVGPGGLLFGSGAIDFAGSGVVHMVGGVAGFWGALIEGPRIGRFDKSGNSTNFRGHSATLVVLGTFLLWFGWYGFNPGSFLTILQPYEGVKGHWSGVGRTAVTTTLAGCTAAVTTLFGKRFLDGHWNVLDVCNGLLGGFAAITASCSVVAPWASILCGFGSAWVLIGLNKLAARLHFDDPLEAAQLHGGCGAWGLLFVGLFAEKNYVNQVYQTTFDRPYGLFMGGGGKLLAAQIIEIISIAAWVTVTMGPLFYGLHKFRLLRITPQDEIAGMDVTRHGGTAYIHHDNSEHHLQMHTINGQKRTDNDQMPI

SEQ ID NO: 2249 - protein, 495 aa, Physcomitrella patens subsp. patens
  misc_feature (41)..(467): Pfam Name: Ammonium_transp Pfam Description: Ammonium Transporter Family
  misc_feature (1)..(495): Public GI ID no. 168068394
  misc_feature (1)..(495): Bit score of 1030.6 for HMM based on sequences of Figure 30
  misc_feature (1)..(495): Functional Homolog Of SEQ ID NO. 2196
MERIQGFLGAVSNATGLSIFLCDKLDNIDGRLGYTKLAVDNTYLLFSAYLVFAMQLGFAMLCAGSVRAKNTMNIMLTNVLDAACGGISYYVFGFAFAFGLGGKTNGFIGHFNWGLNGFPNGTFDYSFFLFQWAFAIAAAGITSGSIAERTQFVAYLVYSSFLTGFVYPIVSHWLWSADGWLSASKTVGPGGLLFGSGAIDFAGSGVVHMVGGVAGFWGALIEGPRIGRFDKSGNSTNFRGHSATLVVLGTFLLWFGWYGFNPGSFLTILQPYEGVKGHWSGVGRTAVTTTLAGCTAAVTTLFGKRFLDGHWNVLDVCNGLLGGFAAITASCSVVAPWASILCGFGSAWVLIGLNKLAARLHFDDPLEAAQLHGGCGAWGLLFVGLFAEKNYVNQVYQTTFDSPYGLFMGGGGKLLAAQIIEIISIAAWVTVTMGPLFYGLHKFRLLRITPQDEIAGMDVTRHGGTAYIHHDNSEHHLQMHTINGQKRTDNDQMPI

SEQ ID NO: 2250 - protein, 495 aa, Oryza sativa
  misc_feature (36)..(459): Pfam Name: Ammonium_transp Pfam Description: Ammonium Transporter Family
  misc_feature (1)..(495): Public GI ID no. 15705372
  misc_feature (1)..(495): Bit score of 1128.9 for HMM based on sequences of Figure 30
  misc_feature (1)..(495): Functional Homolog Of SEQ ID NO. 2196
MATCADTLGPLLGTAAANATDYLCNQFADTTSAVDSTYLLFSAYLVFAMQLGFAMLCAGSVRAKNTMNIMLTNVLDAAAGALFYYLFGFAFAFGAPSNGFIGKHFFGLKQVPQVGFDYSFFLFQWAFAIAAAGITSGSIAERTQFVAYLIYSAFLTGFVYPVVSHWIWSADGWASASRTSGSLLFGSGVIDFAGSGVVHMVAACRTLGRPHRGPPHWRFDHAGRSVALRGHSASLVVLGSFLLWFGWYGFNPGSFLTILKSYGPPGSIHGQWSAVGRTAVTTTLAGSTAALTTLFGKRLQTGHWNVIDVCNGLLGGFAAITAGCSVVDPWAAIICGFVSAWVLIGLNALAARLKFDDPLEAAQLHGGCGAWGVIFTALFARKEYVDQIFGQPGRPYGLFMGGGGRLLGAHIVVILVIAAWVSFTMAPLFLVLNKLGLLRISAEDEMAGMDQTRHGGFAYAYHDDDASGKPDRSFGGFMLKSAHGTQVAAEMGGHV

SEQ ID NO: 2251 - protein, 503 aa, Physcomitrella patens subsp. patens
  misc_feature (51)..(477): Pfam Name: Ammonium_transp Pfam Description: Ammonium Transporter Family
  misc_feature (1)..(503): Public GI ID no. 168011817
  misc_feature (1)..(503): Bit score of 1028.1 for HMM based on sequences of Figure 30
  misc_feature (1)..(503): Functional Homolog Of SEQ ID NO. 2196
MTTYGCAAGDLTILQGYLGASGNATGLSEFLCSKLDGIDARLGFTTLAVDNTYLLFSTYLVFAMQLGFAMLCAGSVRAKNTMNIMLTNVLDAACGGISYYVFGFAFAFGQGGKPNGFIGHANWGLQNVPNASFDYSFFLFQWAFAIAAAGITSGSIAERTQFVAYLVYSSVLTGFVYPIVSHWLWSTDGWLSATKSVGPGGLLFGSGAIDFAGSGVVHMVGGLAGFWGAFIEGPRIGRFDKSGNSMNFRGHSATLVVLGTFLLWFGWYGFNPGSFLKILVPYEGVKGNWSGVGRTAVTTTLAGSTAGVTTLFGKRLLDGHWNVLDVCNGVLGGFAAITASCAVVSPWASIICGFGAAWVLIGFNRLAARFHYDDPLEAAQLHAGCGAWGLLFVGLFAEKNYVQQIYGGNADRPFGLFMGGGGRLLAAQIVQILAITGWVTVTMGPLFLALHRFRLLRISSEDEIAGMDLTRHGGTAYIHNDGSEQLVHFTTKGDKNHNGKIPI

SEQ ID NO: 2252 - protein, 504 aa, Physcomitrella patens subsp. patens
  misc_feature (51)..(476): Pfam Name: Ammonium_transp Pfam Description: Ammonium Transporter Family
  misc_feature (1)..(504): Public GI ID no. 168011819
  misc_feature (1)..(504): Bit score of 1024.9 for HMM based on sequences of Figure 30
  misc_feature (1)..(504): Functional Homolog Of SEQ ID NO. 2196
MTTYGCAAGDLTILQGYLGASGNATGLSEFLCSKLDGIDARLGFTTLAVDNTYLLFSTYLVFAMQLGFAMLCAGSVRAKNTMNIMLTNVLDAACGGISYYVFGFAFAFGQGGKPNGFIGHANWGLQNVPNASFDYSFFLFQWAFAIAAAGITSGSIAERTQFVAYLVYSSVLTGFVYPIVSHWLWSTDGWLSATKSVGPGGLLFGSGAIDFAGSGVVHMVGGLAGFWGAFIEGPRIGRFDKSGNSMNFRGHSATLVVLGTFLLWFGWYGFNPGSFLKILVPYEGVKGNWSGVGRTAVTTTLAGSTAGVTTLFGKRLLDGHWNVLDVCNGVLGGFAAITASCAVVSPWASIICGFGAAWVLIGFNRLAARYHYDDPLEAAQLHAGCGAWGLLFVGLFAEKNYVQQIYGGDSRPFGLFMGGGGRLLAAQIVQILAITGWVTVTMGPLFLALHKFRLLRITPEDEIAGMDLTRHGGTAYIHQDGSEHVMHLSTINGDKRNANDQMPI

SEQ ID NO: 2253 - protein, 497 aa, Oryza sativa
  misc_feature (38)..(461): Pfam Name: Ammonium_transp Pfam Description: Ammonium Transporter Family
  misc_feature (1)..(497): Public GI ID no. 15705370
  misc_feature (1)..(497): Bit score of 993.2 for HMM based on sequences of Figure 30
  misc_feature (1)..(497): Functional Homolog Of SEQ ID NO. 2196
MATCLDSLGPLLGGAANSTDAANYICNRFTDTSSAVDATYLLFSAYLVFAMQLGFAMLCAGSVRAKNSMNIMLTNVFDAAAGALFYYLFGFASRRTPSKGFIGKQFFGLKHMPQTGYDYDFFLFQWAFAIAAAGITSGSIAERTRFSAYLIYSAFLTGFVYPVVSHWFWSTDGWASAGRLTGPLLFKSGVIDFAGSGVVHLVGGIAGLWGAFIEGPRIGRFDAAGRTVAMKGHSASLVVLGTFLLWFGWFGFNPGSFTTISKIYGESGTIDGQWSAVGRTAVTTSLAGSVAALNHAVRQEMADGALERDRRLQRSPRRVRAITAGCSVVDPWASVICGFVSAWVLIGCNKLALMLKFDDPLEATQLHGGCGAWGIIFTALFARKEYVELIYGVPGRPYGLFMGGGGRLLAAHIVQILVIVGWVSATMGTLFYVLHRFGLLRVSTSTEMEGMDPSCHGGFGYVDEDEGQRRVRAKSAAETARVEPRKSPEQAAAGQLV

SEQ ID NO: 2254 - protein, 465 aa, Vitis vinifera
  misc_feature (15)..(442): Pfam Name: Ammonium_transp Pfam Description: Ammonium Transporter Family
  misc_feature (1)..(465): Public GI ID no. 225434604
  misc_feature (1)..(465): Bit score of 869.6 for HMM based on sequences of Figure 30
  misc_feature (1)..(465): Functional Homolog Of SEQ ID NO. 2196
MEVSWEASVTDSINTVYLLFSAYLVFVMQLGFAMLCAGSVRAKNAMNIMLTNVVDAVVGSISYYFFGFAFAFGSGSASNPFIGTDYFALKDIPNSTYDYSYFLYQWAFAIAVAGITSGSIAERTQFSAYLIFSFFLTGFVYPVVVHWLWSSNGWLSPSSSNLLFGSGAIDFAGSGVVHLVGGIAGLWGAFIEGPRVGRFDAFGKPVPMRGHNATLVVLGTFLLWFGWFGFNPGSFDKILVSYPTTTDQGNWTAVGRTAVTTTLAGSAAGIATLFGRRLIVGHWDALDVCNGVLGGFVAITSGCSVVEPWAAIVCGFFSAWVLIGLNILALKLGFDDPLEATQLHGGCGAWGLIFTGLFAKEEFVVQAYDSGESGVVRPYGLFMGGGWGLIGCQAVEVLAIICWVSITMGPLFYALHKLKILRISTEEEVAGLDISSHGGYAYVAHPDEGHPRFYADYMRLQDQRT

SEQ ID NO: 2255 - DNA, 1398 bp, Populus balsamifera subsp. trichocarpa
  misc_feature (1)..(1398): Ceres Annot ID no. 1514946
  misc_feature (1)..(1398): Encodes the peptide sequence at SEQ ID NO. 2256
atggaggtctcatgggaacaaagtgtgacagactctatcaataccatttacttgctcttctcagcttacttggtctttgtgatgcaacttggctttgccatgctatgtgctggctcagtcagggccaagaatgccatgaacattatgcttacaaatgttgttgatgctgttgttgggagcatctcttattacctcttcggctttgcttttgcatttggtgatggcaccaattctaaccctttcataggtacaaccttctttgctctcaaagatattcccaacacctcttacgactatagttactttctttaccaatgggcttttgctatagcagttgctggaatcaccagtggctcaatagccgaaagaacccaattcagtgcttatcttgttttctcatttttcctttctggattcgtgtacccaattgtggttcactgggtttggtcatcaaatggttggctgtctcctagttctgatatgttgttcggctctggtgctattgactttgctggcagtggcgtggttcatttggtgggagggattgctggactttggggctctttcatacaaggtcctcgagtgggcaggtttgatgcatttggcaagcccgtgcctatgcgtgggcacaatgcaactcttgtggtgcttgggacattcttgttgtggtttggctggtttgggtttaatcctggttcatttggtaagattcttgtcgcctaccccaatacaacctatcaagggaactggaccggtattggccggactgcggtaacaactacattggctggttcgaccgccggactcacaaccctatttggccggcgattactagtaggccactgggatgcattagatgcttgcaatggattgcttggtggttttgtggccattacttcaggatgttctgtcgtggagccatgggccgcgattgtatgtgggttttgtgcagcttgggtcttgattgggctcaacgtcttggctctaaagctgcaatttgatgacccattagaggcaactcagctgcatggtgggtgtggtgcttggggtttgatattcactggattatttgccaaaaaggaatttgtgatccaagtttataattcaggtgaggcgggagtggtgagaccctatggccttttattgggcggtggatggggtctgatcggatgccaagtggttgagttgttggcaatagtagcctgggttagcataacaatgggaccagttttctttgcacttgataagcttaagatgttgagaatatcaattgatgaagaagtagcgggccttgatatctctagccatggaggctatgcctatactacgcatcctgaagagaaccatcctcgcttctacgcagattatatgcctatccaaggtcgaaatcattcatga

SEQ ID NO: 2256 - protein, 465 aa, Populus balsamifera subsp. trichocarpa
  misc_feature (15)..(441): Pfam Name: Ammonium_transp Pfam Description: Ammonium Transporter Family
  misc_feature (1)..(465): Ceres Annot ID no. 1514946
  misc_feature (1)..(465): Bit score of 860.3 for HMM based on sequences of Figure 30
  misc_feature (1)..(465): Functional Homolog Of SEQ ID NO. 2196
MEVSWEQSVTDSINTIYLLFSAYLVFVMQLGFAMLCAGSVRAKNAMNIMLTNVVDAVVGSISYYLFGFAFAFGDGTNSNPFIGTTFFALKDIPNTSYDYSYFLYQWAFAIAVAGITSGSIAERTQFSAYLVFSFFLSGFVYPIVVHWVWSSNGWLSPSSDMLFGSGAIDFAGSGVVHLVGGIAGLWGSFIQGPRVGRFDAFGKPVPMRGHNATLVVLGTFLLWFGWFGFNPGSFGKILVAYPNTTYQGNWTGIGRTAVTTTLAGSTAGLTTLFGRRLLVGHWDALDACNGLLGGFVAITSGCSVVEPWAAIVCGFCAAWVLIGLNVLALKLQFDDPLEATQLHGGCGAWGLIFTGLFAKKEFVIQVYNSGEAGVVRPYGLLLGGGWGLIGCQVVELLAIVAWVSITMGPVFFALDKLKMLRISIDEEVAGLDISSHGGYAYTTHPEENHPRFYADYMPIQGRNHS

SEQ ID NO: 2257 - protein, 460 aa, Solanum lycopersicum
  misc_feature (15)..(439): Pfam Name: Ammonium_transp Pfam Description: Ammonium Transporter Family
  misc_feature (1)..(460): Public GI ID no. 22001522
  misc_feature (1)..(460): Bit score of 838.9 for HMM based on sequences of Figure 30
  misc_feature (1)..(460): Functional Homolog Of SEQ ID NO. 2196
MDSSWEASVTDSINAIYLLFSAYLVFVMQLGFAMLCAGSVRAKNAMNIMLTNVVDAVVGSLSYYLFGFAFAFGDSNPFIGASYFALKDIPSSSYDYSFFLYQWAFAIAVAGITSGSIAERTQFTAYLVFSFFLTGFVYPVVAHWLWSSNGWLSPNSTYLLFGSGAIDFAGSGVVHLVGGIAGFWGSIVEGPRVGRFDAFGNPVKMRGHNATLVVLGTLLLWFGWFGFNPGSFNKILVAYPHMADQGNWTSVGRTAVTTTLAGSTAGIVTLFGRRLLVGHWDAMDVCNGVLGGFVAITSGCSVVEPWAAILCGFCAAWVLIGLNILALKFKFDDPLEAAQLHGGCGAWGLIFTGLFAKEEFVLQAYNSGKTQIIRPSGLILGGGWGLFGAQIVELLSIVVWVSLTMGPLFYLLQKLGILRISSDEEVAGLDISSHGGYAYDASQEESNARFYGEYLRMQQQ

SEQ ID NO: 2258 - protein, 433 aa, Ostreococcus lucimarinus CCE9901
  misc_feature (10)..(423): Pfam Name: Ammonium_transp Pfam Description: Ammonium Transporter Family
  misc_feature (1)..(433): Public GI ID no. 145356298
  misc_feature (1)..(433): Bit score of 461.1 for HMM based on sequences of Figure 30
  misc_feature (1)..(433): Functional Homolog Of SEQ ID NO. 2196
MAVGDDVDINFMLTNTFLVFFMQAGFAMLCAGSVRSKNTKNILIKNVLDACVGAIAWFLFGYGFAFGATTGKKENAFIGSGNFAMKDVTTASELAMYLFQWSFSAAATTIVSGSVAERTKFEAYLGYSFFLTAFVYPVVVHWTWSGGAGWLGTGYTLGDKVADVGMHDFAGSGVVHMVGGFAGLMGAMIVGPRTGRFASDGRVNPMPGHSAPLVVLGTFVLWLGWYGFNPGSAGGVVDNAETVARCAITTTLSAAAGGVTAMLLNYKLYHVWDLIAVCNGVLAGLVSITAGCAVTEPWAALVCGSLGALVIHFSSKLLLKFQIDDPLEAAPMHGFCGAFGVLWVGFMAKKEYAEAQGARAGAFYEGGGKQLGAQIVGILVIIAWTCGTIGPFFMLMKKFNLLRTTVEEETLGLDESKHGGKAYALELVAPEPA

SEQ ID NO: 2259 - protein, 539 aa, Chlamydomonas reinhardtii
  misc_feature (74)..(509): Pfam Name: Ammonium_transp Pfam Description: Ammonium Transporter Family
  misc_feature (1)..(539): Public GI ID no. 159478831
  misc_feature (1)..(539): Bit score of 508.6 for HMM based on sequences of Figure 30
  misc_feature (1)..(539): Functional Homolog Of SEQ ID NO. 2196
MSGDFGSEPLGSCSVETVTALLGYGLEQDSITALCQPEGGAGCTSTDNCMFQYLMGATADAQSTASDVGVGLDVSFLLFSGYLVFVMQLGFAVLCAGSIRSKNCMNILLKNMLDACVGAIGFYVFGYAFAYGRKYGQNSNGFIGNWNFALSYTTQTSMSGTEFTTFGWHQFFFQWSFCAATTTIVSGAVAERCTFMAYMIYAFFLSSFVYPVIVHWVWDGQGWLSAFNTFQDGYALILKTGAIDFAGSGVVHMTGGIAALMGAWIMGPRVGRFANDGTVNEMRGHSSTLVVMGTFLLWFGWFGFNPGSNLVVASQAAATVVSRVAVTTALAGGAGGISMLFYKFLTVKAWDVVATCNGILAGLVAVTASCSVIEPWAAIITGAIGAIIFSIADYVTLYKLKVDDPVSAFALHGAVGAWGVLFPGFLAAPHYVVEVYGAYGFGMDAREGKRFGLFYGGHGQVLLVQLIEVLAIFGWTGFMMGSFFFILNKAGLLRVPLQEEMAGLDAANYSKSVGSKDPSVHCTVGVDKLEGGALGEGKA

SEQ ID NO: 2260 - protein, 511 aa, Cylindrotheca fusiformis
  misc_feature (50)..(475): Pfam Name: Ammonium_transp Pfam Description: Ammonium Transporter Family
  misc_feature (1)..(511): Public GI ID no. 14028761
  misc_feature (1)..(511): Bit score of 406.0 for HMM based on sequences of Figure 30
  misc_feature (1)..(511): Functional Homolog Of SEQ ID NO. 2196
MAEFDNTFILDFCSGGNESSSDVQALCQVAGLANGTSASAAGLVEGINTFFLLFAGALVFLMQAGFAMLCAGSVRQKNVKNIMLKNMLDACGGAIGFWTIGYAFAYADNSSGDKTFIGGKNFFVNQLDESGGAWIGFFFQFAFAATAATIVAGTVAERCKMSAYLCYSVFLTGFVYPVVVHSIWSADGWLTAFRDDPWKGVGVIDFAGSGVVHMTGGATALVAAIVLGPRKGRFYDEDGNALETPASFPAHSVALQVLGTFLLWFGWYGFNPGSALVIDNAASASTSALCAVTTTLAAASGCVCAMFTDTIIEMMATGEASYDLTMAMNGALGGLVAITAGCSVVTPWASIIIGIIAGWVYIAFSKLLVKLKIDDAVDAVPVHFANGMWGVLAVGFFAEPDAMVTAGYNDVPGVFYKGDGKLLLCQFVAIIWICAWIFFLMTPFFVVLNILGMFRVDPLEEEVGLDISHHRGAAYDMTSAKKEDVEELMEHRSSKHGKVEVPKEVQKEDTA

SEQ ID NO: 2261 - protein, 431 aa, Dictyostelium discoideum AX4
  misc_feature (20)..(427): Pfam Name: Ammonium_transp Pfam Description: Ammonium Transporter Family
  misc_feature (1)..(431): Public GI ID no. 66816227
  misc_feature (1)..(431): Bit score of 320.3 for HMM based on sequences of Figure 30
  misc_feature (1)..(431): Functional Homolog Of SEQ ID NO. 2196
MEYLELNGTKEGLSAAVDDMWVLNATYLVFYMQAGFCMLEAGVVRAKNAKSIIMKSIIDTAIGSLLFWALGFGLAFGNADKASNPVIGTSHFFLINYQNLSFFAFQWAFCATSITIVSGSLAERVHVTSCLVYTIVMSAFIYPLSAHWVWSYNGWLRMIGFNGIIDFSGSIVVHIVGGCIGLVGTYLVGPRIGRFDSESGKPKPLPGHSITIYTLGAFIIWYGFYGFNTGSTLGISGGGIAIASRSAVTMTIIACASCATTLLAIKIKSGKYDVVKSVNSLLGGLVSSAAVCSLIDPWAAFIIGCVTSFVYLGCSHLLIKLRIDDPLDSSAIHLGCGIWGALSVGLFSTQENLSLVLKKSTNVYGLFFGGGFEQLGIQLLGIIIVMAWCFFCASILFTILKKFHLLRIEPTKELMGIDIDSAGGPAYQWDN

SEQ ID NO: 2262 - protein, 492 aa, Nematostella vectensis
  misc_feature (25)..(432): Pfam Name: Ammonium_transp Pfam Description: Ammonium Transporter Family
  misc_feature (1)..(492): Public GI ID no. 156361112
  misc_feature (1)..(492): Bit score of 325.0 for HMM based on sequences of Figure 30
  misc_feature (1)..(492): Functional Homolog Of SEQ ID NO. 2196
MAGDTVDLQSLKQDLESYKANGDQKFLIIMGCLVFFMQCGFAFLEAGSVRAKNTTNILIKNVLDVFIGALGYWLFGYAFAFGAKSNSFIGQWNFALSYLPTSEYSTWFFQFVFAATAATIVSGAMAERTEFNTYLIYSIFLTGFIYPVVSHWGWHDNGWLKKGVYYTDGNITQHVYYQDFAGSGIVHVLGGTCALVGAAIVGPRIGRFVNGDPVTIPGHTVPMTALGGFILFMGFLAFNGGSQGSISNPGDAETVAAAVVNTFISGAAGALTALFIKRIIPGAGRNWSLLTTINGGLTGMVAICAGCDVVYPYGAFVIGILAGVTYILWSGALLKMKIDDPLDSAPVHMGGGTWGLLAAPLFNPKTGVLYHWSTLSFRLWGWNLLGLIAIIAWSSCCAGIMFGFCQLIGQLRVSEDIEIKGLDVPKHGEPAYPVVSYGDGWDTEEALGPEGFLANYGRGKNKKSASYEPVETVAMVKLDENGASADNVEQGP

SEQ ID NO: 2263 - protein, 496 aa, Strongylocentrotus purpuratus
  misc_feature (26)..(433): Pfam Name: Ammonium_transp Pfam Description: Ammonium Transporter Family
  misc_feature (1)..(496): Public GI ID no. 72171193
  misc_feature (1)..(496): Bit score of 310.5 for HMM based on sequences of Figure 30
  misc_feature (1)..(496): Functional Homolog Of SEQ ID NO. 2196
MASNESDLVVMQLQAEFDYLKENTDHFFLVVMSCIIFLMQLGFAFLEAGSVRSKNTTNILLKNMLDVCIGAVAYWGVGYAFAFGKSSNPFIGYRNFFFEDMVPSDYSHFFFHFVFAATAATIVSGAMAERTEFAAYFMYSSLITGFIYPVVTHWAWSSDGWLGNSGIEIADGTYLAFKDFAGSGVVHCVGGTAALVGATILGPRIGRYDANGKLVVIAGHTVPMVSLGGFILFFGFFAFNGGSQGRISGEGDGEVVALAIVNTIISGAFAALTAMICRRVGFSGSYWSLLTTINGGLTGMVAICAGCNVVYAWGAAVIGTIAGVTYILWSSAVIRMRIDDPLDAVAVHLGGGFWGVLAVPIFDMNDGILFNIKSRVPWMHFAWNLLGVVAIFVWTALLSFFMFGIFRCLKILRVDPEIEKKGLDIPKHGEPAYPLASYGNGWEDESVIDASPVRPPPSYKMNGNSHDNKAYSLGETQNSVDHEHIQIDDTPRVQFD

SEQ ID NO: 2264 - protein, 468 aa, Herpetosiphon aurantiacus ATCC 23779
  misc_feature (42)..(444): Pfam Name: Ammonium_transp Pfam Description: Ammonium Transporter Family
  misc_feature (1)..(468): Public GI ID no. 159900308
  misc_feature (1)..(468): Bit score of 281.0 for HMM based on sequences of Figure 30
  misc_feature (1)..(468): Functional Homolog Of SEQ ID NO. 2196
MFRRRRWIVPAAVASLAIPTATFAQEAAPVATETITTQIDIIWLLIAAVLVFFMQAGFALVESGFTRSKNAANILMKNLMDFCVGTVLFFAIGFGLMYGASAGGFIGTDNFFLSDFSPATGSGKDWVGFFFQLVFAATAATIVSGAVAERFKFISYLIYSAVICGIVYPISGHWQWGGGWLFQLGFIDFAGSTIVHSVGGWAAVAGTILLGPRLGKFNKDGSSNVIPGHSLTLGVLGVFILWVGWFGFNPGSTLSGMNESIGYIAVTTNMAAAVGALSALITNWLITGHPDTAVASNGALAGLVAITAGCANVTPVGALFIGLLGGIIFVYGSIFLEKVLKLDDPVGAIPVHCFNGIFGTLAVGLFASPAVGGLTGMGDAAGLFYGGGLGLLGTQAIGVLAVGAWAFTTMFIVFYVLKKTLGIRVSEQEEIEGLDISEHDTVSYPEFGTPVAGVAGARSMMPELSSTK

SEQ ID NO: 2265 - protein, 478 aa, Roseiflexus castenholzii DSM 13941
  misc_feature (45)..(453): Pfam Name: Ammonium_transp Pfam Description: Ammonium Transporter Family
  misc_feature (1)..(478): Public GI ID no. 156741881
  misc_feature (1)..(478): Bit score of 330.5 for HMM based on sequences of Figure 30
  misc_feature (1)..(478): Functional Homolog Of SEQ ID NO. 2196
MVRRRTKLMLGIGALAGLLIGTTGTSFAQEIDPAIAEMGVVTDTMWLLVAAFLVFFMQAGFALVEAGSTQSKNMINIMFKNLMDFCVAALAFWMVGWGIAYGASVGGFFGSDQFFLGDVREAGSVPTLAVWLFQVVFAGTAATIVSGAMAERTKFSAYLIYSVVISVLIYPVVVHWVWSGAGWLNDYDPTTTGDWGFTDFAGSTVVHSVGGWAALMGAWLLGPRMGRYGPDGKPREIPGHSAALAGLGVFILWLGWYGFNPGSQLAFKSQGDADAIALVAVTTTLAAAAGAVGAMIASWLKSGKPELGATLNGVLSGLVAITAGCAYMRPLDAVIVGLVAGPLYVISMKWMESLKIDDPVGAVPVHLVNGVWGTLAVGLFATIEGNTGTVGLFAGGGPQLLIAQIVGVLAIGAWCALTSFLLFFILKRTIGLRVSPEEEELGLDIGEHGTVAYPDIHKMPEPETVRAITGKPLSSAAE

SEQ ID NO: 2266 - protein, 445 aa, Caldicellulosiruptor saccharolyticus DSM 8903
  misc_feature (42)..(434): Pfam Name: Ammonium_transp Pfam Description: Ammonium Transporter Family
  misc_feature (1)..(445): Public GI ID no. 146297474
  misc_feature (1)..(445): Bit score of 301.2 for HMM based on sequences of Figure 30
  misc_feature (1)..(445): Functional Homolog Of SEQ ID NO. 2196
MNRSFKILLGIVLLILALILGFSTAKADQITPEKVATAIDNVWVLITAFLVFFMQAGFAMVEAGFTRAKNASNIVMKNLMDFAIGSVIFWLFGFAFMFGKDAGGFIGTSGFFLSDSFKHLGLSIPLTSFLMFQTVFAATAATIVSGAMAERTKFIAYCIYSAVISFIIYPVVGHWAWGGGWLSKLGFIDFAGSTVVHSVGGWSALIGAAMLGPRIGKYTKDGKVNAIPGHSITLAALGTFILWFGWFGFNPGSTLSSMNDKIGDIAVNTNLAAAMGANLAMIYTWLKYKKPDVSMTLNGALAGLVAITAGCASVNAWGAAIIGGLAGILVVVAVEFIDKKLKIDDPVGAISVHGVCGAFGTLMVGLFATDGGLFYGGGIKQFLVQLAGVASTFIWTTITAFILFAIIKLTVGLRVSEEEEIEGLDVTEHGTAAYGDFVIKSQTVK

SEQ ID NO: 2267 - protein, 446 aa, Thermoanaerobacter ethanolicus ATCC 33223
  misc_feature (43)..(435): Pfam Name: Ammonium_transp Pfam Description: Ammonium Transporter Family
  misc_feature (1)..(446): Public GI ID no. 167038063
  misc_feature (1)..(446): Bit score of 292.9 for HMM based on sequences of Figure 30
  misc_feature (1)..(446): Functional Homolog Of SEQ ID NO. 2196
MNKVKKVFLSFMILIFVITGGICTAKAADQITPEKVATAIDNVWVLVTAFLVFFMQAGFAMVEAGFTRAKNASNIVMKNLMDFAIGSVMFWLIGFAIMFGKDAGGFIGTSGFFFSDSFEHLELSIPLMSFLIFQTVFAATAATIVSGAMAERTKFIAYCIYSAVISLIIYPVVGHWAWGGGWLSKLGFIDFAGSTVVHSVGGWAALIGAAMLGPRIGKYTKDGKVNAIPGHSITLAALGTFILWFGWFGFNPGSTLSGMNGKIGDIAVNTNLAAAMGANLAMIYTWLKYKKPDVSMTLNGALAGLVAITAGCASVSTWGAAIIGGLAGILVVVSVEFIDKKLKIDDPVGAISVHGVCGAFGTLMVGLFATEGGLFYGGGIKQFLVQLAGVASTFVWTTVTAFILFAIIKLTVGLRVSEEEEVEGLDVTEHGATAYGDFVTKSEVVN

SEQ ID NO: 2268 - protein, 471 aa, Chloroflexus aurantiacus J-10-fl
  misc_feature (45)..(453): Pfam Name: Ammonium_transp Pfam Description: Ammonium Transporter Family
  misc_feature (1)..(471): Public GI ID no. 163846579
  misc_feature (1)..(471): Bit score of 303.3 for HMM based on sequences of Figure 30
  misc_feature (1)..(471): Functional Homolog Of SEQ ID NO. 2196
MKLAWRTKIGLGLGFGLGLWLVGTGRAFAQEGPTTAELAVAMNTFFLIVAAALVFFMQAGFAMLTAGLTRSKNTTNILFKNLMDFVMCSIAFWAVGWGIAYGTSAGGFIGTDQFFLSPVTAEGEVPVMASWFFQVVFAGTAATIVAGAMAERTKFAAYLIYSFIISLFIYPVVVHWVWSGAGWLNTYSGSTEGNWGFTDFAGSTVVHSVGGWASLVGAMILGPRLGRFGPDGKPRVIPGHNMSLAALGTFILWLGWFGFNPGSQLAIASQANADAVALVAVTTNLAAAAGALGALFTAWLRYGKPDLGQTLNGVLGGLVAITAGCAYVDPLSSIIIGFIAGPIVVFSAELLEKLKIDDPVGAVPVHLVNGIWGTLAVGLFASVPGNTGTTGLFYGGGLTLLISQFVGVVAIGLWTVATAALMFFAIKATIGLRVSKAEEEAGLDIGEHGMVAYPDLSGAPAGGEVSGALAR

SEQ ID NO: 2269 - protein, 478 aa, Roseiflexus sp. RS-1
  misc_feature (45)..(453): Pfam Name: Ammonium_transp Pfam Description: Ammonium Transporter Family
  misc_feature (1)..(478): Public GI ID no. 148657093
  misc_feature (1)..(478): Bit score of 326.8 for HMM based on sequences of Figure 30
  misc_feature (1)..(478): Functional Homolog Of SEQ ID NO. 2196
MVRRRTKLMLGIGALAGLLIGTTGTSFAQEIDPAIAEMGVVTDTMWLLIAAFLVFFMQAGFALVEAGSTQSKNMINIMFKNFMDFCIAALAFWMIGWGIAYGATVGGFFGTDQFFLGDVREAGSVPTLALWLFQVVFAGTAATIVSGAMAERTKFVAYLIYSLVISILIYPVVVHWVWSGAGWLNDYDPTTTGDWGFTDFAGSTVVHSVGGWAALMGAWLLGPRLGRYGPDGKPREIPGHSAALAGLGVFILWLGWYGFNPGSQLAFKTQDDADAIALVAVTTTLAAAAGAVGAMITSWIKSGKPELGASLNGVLSGLVAITAGCAYMRPIDAVIVGLVAGPLYVISMKWLEALKIDDPVGAVPVHLVNGVWGTLAVGLFATIEGNTGTVGLFAGGGPQLLIAQIVGVLAIGVWSALTSFLLFFIIKRTIGLRVSPEEEELGLDIGEHGTVAYPDIHKMPEPETIRTITGKPASSTAE

SEQ ID NO: 2270 - DNA, 687 bp, Populus balsamifera subsp. trichocarpa
  misc_feature (1)..(687): Ceres Annot ID no. 1440417
  misc_feature (1)..(687): Ceres SEED LINE ID no. CW00584
  misc_feature (1)..(687): Encodes the peptide sequence at SEQ ID NO. 2271
atggactcgacatctggaggagccactgcacccggcccgaatagtggagaaccttgtccatcagcagcaacagcaggatcgtcttcagcatcgcagccacaacagcaaccggagggatcatcaccgccagcaccaccaagtagatacgagtcacagaagaggagagactggaacactttcttacagtacataaagaaccacaagccacctttaaccctagctcgttgcagtggtgcacatgtgattgagttcttgaaatacttggatcaatttggtaagactaaagtccacataacgggttgtccttattttgggcacccgaacccgccagcaccttgttcttgtccactaaagcaggcttggggtagtcttgatgcgctaatcggacggcttagagctgcttatgaagaaaacggtggactgccagaatcaaacccttttggggctagagctgttaggatttatttgagggaagttcgagaaggtcaagctaaagccagagggattccttatgagaagaagaagaagcgaaaaaggcctaatgttgctgtttccgtagcgagtgtgtcggtgaaggcagctgctggtggctctaatagtggcggtggagaagaaagtggtggtggtggtgatagtagtgccgccgctacaagtgctgctgcggctgctgctacaactaccgtatag

SEQ ID NO: 2271 - protein, 228 aa, Populus balsamifera subsp. trichocarpa
  misc_feature (30)..(162): Pfam Name: DUF640 Pfam Description: Protein of unknown function (DUF640)
  misc_feature (1)..(228): Ceres SEED LINE ID no. CW00584
  misc_feature (1)..(228): Ceres Annot ID no. 1440417
  misc_feature (1)..(228): Bit score of 460.7 for HMM based on sequences of Figure 32
  misc_feature (1)..(228): in Figure 32
MDSTSGGATAPGPNSGEPCPSAATAGSSSASQPQQQPEGSSPPAPPSRYESQKRRDWNTFLQYIKNHKPPLTLARCSGAHVIEFLKYLDQFGKTKVHITGCPYFGHPNPPAPCSCPLKQAWGSLDALIGRLRAAYEENGGLPESNPFGARAVRIYLREVREGQAKARGIPYEKKKKRKRPNVAVSVASVSVKAAAGGSNSGGGEESGGGGDSSAAATSAAAAAATTTV

SEQ ID NO: 2272 - DNA, 955 bp, Glycine max
  misc_feature (1)..(955): Ceres Clone ID no. 1245717
  misc_feature (1)..(955): Encodes the peptide sequence at SEQ ID NO. 2273
tttctttccttctcacgaaatctctctccttttctttccttctaacgaaaaagagaacaaaaaccagaaaccctttccccgtgaaaacatctacctcaaacctcaaaccctcatcactctcattcattcatcatactaatcctcgttcctttcacttttctatataccccgaagcaaaaaaagaaaaaaaagtcacataaacctcacttcctcaacctcaatccaacacaacaacaaaaaaaatcaaaaacaaaaaaacctcactttgatcacacagatcacacacacaaaaaaaaagttacctaaattgaacctaccccagtaggttctacaagctcttgatcatggactcagcatcaggggaggcaccaccaccaccccaacccacttcagtagaagctccaccaccatcaggctcttcagctccagccacatcagcaccagcaccaacacaacccgaaggatcatcgccggcgccgccgagtcgctacgaatcgcaaaagcgacgagactggaacactttcttgcagtacctgcagaaccacaggcccccattaacgcttgcacggtgcagtggcgcacacgtcattgagttcttgaagtatttggaccagttcggaaaaaccaaggttcatgtcaccgggtgtccgtacttcgggcaccccaaccctcctgcaccctgcacctgccctttgaagcaggcgtggggaagccttgacgccctcatcgggcgactcagggcggcctacgaggaaaacggaggccgccctgagtccaacccattcggcgccagggccgtcaggacttgcctcagggaggtaagagaaggtcaggctaaagcaagagggatcccttatgagaagaagaagcgaaagaggaccaccatgacggtatccgcggtgagtagtggtggtggtagtagtagtgcagttgctgctacgagtggcggtgggga

SEQ ID NO: 2273 - protein, 203 aa, Glycine max
  misc_feature (30)..(162): Pfam Name: DUF640 Pfam Description: Protein of unknown function (DUF640)
  misc_feature (1)..(203): Ceres Clone ID no. 1245717
  misc_feature (1)..(203): Bit score of 415.3 for HMM based on sequences of Figure 32
  misc_feature (1)..(203): Functional Homolog Of SEQ ID NO. 2271
  misc_feature (1)..(203): in Figure 32
MDSASGEAPPPPQPTSVEAPPPSGSSAPATSAPAPTQPEGSSPAPPSRYESQKRRDWNTFLQYLQNHRPPLTLARCSGAHVIEFLKYLDQFGKTKVHVTGCPYFGHPNPPAPCTCPLKQAWGSLDALIGRLRAAYEENGGRPESNPFGARAVRTCLREVREGQAKARGIPYEKKKRKRTTMTVSAVSSGGGSSSAVAATSGGG

SEQ ID NO: 2274 - protein, 231 aa, Vitis vinifera
  misc_feature (19)..(151): Pfam Name: DUF640 Pfam Description: Protein of unknown function (DUF640)
  misc_feature (1)..(231): Public GI ID no. 147768778
  misc_feature (1)..(231): Bit score of 472.9 for HMM based on sequences of Figure 32
  misc_feature (1)..(231): Functional Homolog Of SEQ ID NO. 2271
  misc_feature (1)..(231): in Figure 32
MDSASGGGAADPSSGEGPSAGGGGGAAEGSSPAPPSRYESQKRRDWNTFLQYLKNHKPPLTLARCSGAHVIEFLKYLDQFGKTKVHISGCPYFGHPNPPAPCACPLKQAWGSLDALIGRLRAAYEENGGRPESNPFGARAVRIYLREVREGQAKARGIPYEKKKRKRPTVTATAVVAATNVSAPAVTQGVEVGGSSSSAAAGGSGDGTGGGGGADTGGAAATTVAPPTTTV

SEQ ID NO: 2275 - DNA, 1258 bp, Gossypium hirsutum
  misc_feature (1)..(1258): Ceres Clone ID no. 1855399
  misc_feature (1)..(1258): Encodes the peptide sequence at SEQ ID NO. 2276
aaatctttcccgtgaaaggatcccatggagcactacttctttcaatgaaccctaaacaccctcaattatcatactcttatttgactgacctaatcaaacagaagcagctaataagggtttgtcaattgtgagtgactgataaatagcttggattttggaatctctccctacacttggatttcagataaaaacaaaatcccaggtgggaaaaattcatcactgcccatcaacagttcatcaccaaaaccccaacagtttcctcttctttttttccaagtcaatggattctgcctccggagggagtgacaatagcatcaaagaggctataccagcaacagcttcagccctgctgtccgcggcttcacaacaaggaggaggaggtggtagtgagtcgtctccttccccagctccaccgagtaggtacgagtcacaaaagcgtcgagactggaacactttcttgcagtacttgaccaaccataaacccccattaacactagctcgttgcagtggcgcacacgtaattgagttcttgaaataccttgaccagttcggcaagactaaggttcacataacggattgtccctatttcggacatgtaaacccacctgctccctgcgcttgcccactgaagcaagcgtggggtagcctcgacgcgctgatcggacggctcagagctgcttatgaagaaaacggtggacgtccagaatccaacccttttggcgcaagggctgtgaggatttatttgagggaagtgagagaagggcaggctaaagctagagggattccttatgagaagaagaagcgaaaaaggcccactgtcacaactacggctgtcggggtcaatgtgtccaggacttccactcaaccagttgatggcggtgggggtcgcggcggcattggtggtggagatgatagtgttggtgctaaaactggggcaaatgttggtagtgccaccgcagttgctgctgctaccactaatagcgtatagttctttttccctattaacaaattcttttcctctttttttgcctttaacagctgttttaaatgtgattacgagttatatatatctggtggttctgtcgggaaattggattgacatcccatgaaccaaatttagaatttaggtagaattctagttttaatctctttcaatcaatctctcctattttcccctttctctactttcttcatcatttcttgctatgcatgtacttgaaaaaggaatataagaagttttaatcttttttccctttct

SEQ ID NO: 2276 - protein, 235 aa, Gossypium hirsutum
  misc_feature (29)..(161): Pfam Name: DUF640 Pfam Description: Protein of unknown function (DUF640)
  misc_feature (1)..(235): Ceres Clone ID no. 1855399
  misc_feature (1)..(235): Bit score of 475.6 for HMM based on sequences of Figure 32
  misc_feature (1)..(235): Functional Homolog Of SEQ ID NO. 2271
  misc_feature (1)..(235): in Figure 32
MDSASGGSDNSIKEAIPATASALLSAASQQGGGGGSESSPSPAPPSRYESQKRRDWNTFLQYLTNHKPPLTLARCSGAHVIEFLKYLDQFGKTKVHITDCPYFGHVNPPAPCACPLKQAWGSLDALIGRLRAAYEENGGRPESNPFGARAVRIYLREVREGQAKARGIPYEKKKRKRPTVTTTAVGVNVSRTSTQPVDGGGGRGGIGGGDDSVGAKTGANVGSATAVAAATTNSV

SEQ ID NO: 2277 - DNA, 1203 bp, Zea mays
  misc_feature (1)..(1203): Ceres Clone ID no. 281322
  misc_feature (1)..(1203): Encodes the peptide sequence at SEQ ID NO. 2278
agcttgattctctctggctggtacgcggtagcctcgctctctctcctacctacacggctacacttaaacggcagcaggcacctgcaggcagggagagctgctaacggaccgatcggggagctgctggccatggagcctggtccggatgcgcccgctggtggtggtggcggaggaggaaccagtattagtgagccagcagaggccgggccgtcgccgtcgtcgtcctcggccgccgcagcagcctcgtcgtcgagccggcagcaggcagagcaggaagcacagcagcaacaaggagcacagcagagggaacagccagcagtaagggcccaggcgcagccgcagccgcagccgcatcagcagcagcctccggcggggctcagccggtacgagtcgcagaagcgccgggactggaacacgttcctgcagtacctgcggaaccacaagccgccgctgacgctggcacgctgcagcggcgcacacgtcatcgagttcctccgctacctggaccagttcggcaagacgaaggtgcacgctgagggctgcgcctacttcgggcagccgaacccgccggcgccctgcacgtgcccgctgcgccaggcctggggtagcctcgacgcgctcatcggccgcctccgcgccgcgtacgaggagtccggcggccgccccgagtccaacccgttcgcggccaaggccgtgcgcatctacctccgcgacgtgcgggaggcgcaggccaaggcccgcggcatcccgtacgagaagaagaagcggaagcgcgggagcgccgccgcgcctccggtcgcgccgcctcctgttgtgactgcagaggccgccgggacgtcgtcaggggccggcggtggtgatgacgaggacgacgacgaaccaccgccatctgcagatgaaccacgacgacagcagaccgccgcgccgactcctcctcctcctgcaagtatgatttccagcactagtgcaagcagtagcagtgtcgccccagtcacgacgacgacgacgacaagcaaggagaaagaaggatccgcgccaagctcgtgataagtttgtagatcatctactagccttctgattcaattctatcatcgccggcctccaaattataatcccaaccgcctccatcttaaatttttagttgctcactattactatatattgttattgtttactggcatatataagagagaggtctaaggg

SEQ ID NO: 2278 - protein, 305 aa, Zea mays
  misc_feature (67)..(199): Pfam Name: DUF640 Pfam Description: Protein of unknown function (DUF640)
  misc_feature (1)..(305): Ceres Clone ID no. 281322
  misc_feature (1)..(305): Bit score of 445.6 for HMM based on sequences of Figure 32
  misc_feature (1)..(305): Functional Homolog Of SEQ ID NO. 2271
  misc_feature (1)..(305): in Figure 32
MEPGPDAPAGGGGGGGTSISEPAEAGPSPSSSSAAAAASSSSRQQAEQEAQQQQGAQQREQPAVRAQAQPQPQPHQQQPPAGLSRYESQKRRDWNTFLQYLRNHKPPLTLARCSGAHVIEFLRYLDQFGKTKVHAEGCAYFGQPNPPAPCTCPLRQAWGSLDALIGRLRAAYEESGGRPESNPFAAKAVRIYLRDVREAQAKARGIPYEKKKRKRGSAAAPPVAPPPVVTAEAAGTSSGAGGGDDEDDDEPPPSADEPRRQQTAAPTPPPPASMISSTSASSSSVAPVTTTTTTSKEKEGSAPSS

SEQ ID NO: 2279 - DNA, 1184 bp, Triticum aestivum
  misc_feature (1)..(1184): Ceres Clone ID no. 1048839
  misc_feature (1)..(1184): Encodes the peptide sequence at SEQ ID NO. 2280
attctctctctctctctcgctgcctggccaggtagcttctctctctcctccacgctcctgccgacaaaaacaagaaacgacgtagcacggtagcagcaaagagaaagagagagagaccactggtagccaagggtgggagagaagcaggagtgccgctgccgatcgaccatggagccgggccccgacgcgcctcgcggcgagggagcgagcgcgccggaggagtctggaccgtcctcatcctcggtggccgtggagaaagctgaagagccacaggcacaagcgcagccgccggaaggaggaggccagcaagtcgcactgcaggagcacctgcagccgcagccgctgtcgcagcagccgccggtgccagcggggctgagccgctacgagtcgcagaagcgccgcgactggaacacgttcctgcagtacctgcgcaaccacaagccgccgctgacactcgcgcggtgcagcggcgcgcacgtcatcgagttcctcaagtacctggaccagttcggcaagaccaaggtgcacgccgacggctgcgcctacttcggccagcccaacccgccggctccgtgcgcgtgcccgctccgacaggcatggggcagcctcgacgcgctcattggccgcctgcgcgccgcctacgaggagtccggcggccgccctgagtccaaccccttcgccgcgcgcgccgtgcgcatctatctgcgcgaggtgcgcgaggcgcaggccaaggcgcgcgggataccctacgagaagaagaagcgcaagcgcggcagcacgtccgcccccgcggcgccgcctcccgttgtcaccgccgcggaggcggcagcgacctccggaggcggcgaggacgacgaggacgagccgtcacagtccgctgagcaacagcacacaacgccagcgtctcctccgactagaattagtagcgccggcgctactagtaccaccgcagcggcggcagccacaacgacgacgacgacaacgagagggaaggagaaggaagcggcagaaggatcagcgtgataagtgtagaccatcaaattacccttttgattattccatcgcatccaaattctaatctctgcaccatcataattttagttgtttgttattataattactgtgctgttatgatttgttggatatatatatatatataagagagaggtctaagtagttcgtac

SEQ ID NO: 2280 - protein, 284 aa, Triticum aestivum
  misc_feature (51)..(185): Pfam Name: DUF640 Pfam Description: Protein of unknown function (DUF640)
  misc_feature (1)..(284): Ceres Clone ID no. 1048839
  misc_feature (1)..(284): Bit score of 457.1 for HMM based on sequences of Figure 32
  misc_feature (1)..(284): Functional Homolog Of SEQ ID NO. 2271
  misc_feature (1)..(284): in Figure 32
MEPGPDAPRGEGASAPEESGPSSSSVAVEKAEEPQAQAQPPEGGGQQVALQEHLQPQPLSQQPPVPAGLSRYESQKRRDWNTFLQYLRNHKPPLTLARCSGAHVIEFLKYLDQFGKTKVHADGCAYFGQPNPPAPCACPLRQAWGSLDALIGRLRAAYEESGGRPESNPFAARAVRIYLREVREAQAKARGIPYEKKKRKRGSTSAPAAPPPVVTAAEAAATSGGGEDDEDEPSQSAEQQHTTPASPPTRISSAGATSTTAAAAATTTTTTTRGKEKEAAEGSA

SEQ ID NO: 2281 - protein, 284 aa, Oryza sativa subsp. japonica
  misc_feature (48)..(181): Pfam Name: DUF640 Pfam Description: Protein of unknown function (DUF640)
  misc_feature (1)..(284): Public GI ID no. 115463333
  misc_feature (1)..(284): Bit score of 444.3 for HMM based on sequences of Figure 32
  misc_feature (1)..(284): Functional Homolog Of SEQ ID NO. 2271
  misc_feature (1)..(284): in Figure 32
MEPSPDAPRAGAAEEQPGPSSSASAPAPAASSNEEEGRHQSQAQQQVQEAQPQPLAQQAPAAAGLSRYESQKRRDWNTFLQYLRNHKPPLTLPRCSGAHVIEFLKYLDQFGKTKVHADGCAYFGEPNPPAPCACPLRQAWGSLDALIGRLRAAYEESGGRPESNPFAARAVRIYLREVREAQAKARGIPYEKKRKRGAAAAAAAPPVVVAPPPVVTAPDDATGTSGGAGEDDDDDEATHSGEQQDTTPAASPTTPPATSVGTTTAAATAAAAKGSAAKGSATSS

SEQ ID NO: 2282 - DNA, 815 bp, Arabidopsis thaliana
  misc_feature (1)..(815): Ceres Clone ID no. 28780
  misc_feature (1)..(815): Encodes the peptide sequence at SEQ ID NO. 2283
aactactaaacactaaattatcaatccgctctcttctcaaaaaaaaaaaatcgactctaaaatcaaactctctcaaagctccccaaaaaaaccctagttctgaatggaatcggcggattccggacgatccgatccggtaaaaggagacgacccgggtccatctttcgtctcttcaccaccagctacacctagcaggtatgagtcacagaagcgacgcgactggaacacgttcttgcagtacctcaagaaccacaagccgcctctcgcgttgtcacggtgtagcggagcgcatgtgatcgagtttctcaagtacctcgaccagttcggtaagaccaaagtccacgtggcggcttgtccttacttcggccatcagcaacctccgtctccttgctcatgccctctcaagcaagcttggggatctctcgatgctttgatcggacggttgagagctgcctacgaggagaacggtggacggccggattctaacccgttcgccgcacgtgcggttcggatttacttgagggaagtcagagagagtcaggcaaaggctcgtgggattccttacgagaaaaagaaacggaaacggccgccaactgtcaccaccgttagagttgacgtcgcttcttcgagacaaagtgacggagacccttgtaacgtcggtgctccatctgttgccgaggccgtaccgccttagatcgaattatatataatattatagttttcttgattaatgatatatatatacttatctctatgtatgtatggaactcacttcatcttttgttccttagtacctaattattaaattttgttcc

SEQ ID NO: 2283 - protein, 196 aa, Arabidopsis thaliana
  misc_feature (13)..(145): Pfam Name: DUF640 Pfam Description: Protein of unknown function (DUF640)
  misc_feature (1)..(196): Ceres Clone ID no. 28780
  misc_feature (1)..(196): Bit score of 422.6 for HMM based on sequences of Figure 32
  misc_feature (1)..(196): Functional Homolog Of SEQ ID NO. 2271
  misc_feature (1)..(196): in Figure 32
MESADSGRSDPVKGDDPGPSFVSSPPATPSRYESQKRRDWNTFLQYLKNHKPPLALSRCSGAHVIEFLKYLDQFGKTKVHVAACPYFGHQQPPSPCSCPLKQAWGSLDALIGRLRAAYEENGGRPDSNPFAARAVRIYLREVRESQAKARGIPYEKKKRKRPPTVTTVRVDVASSRQSDGDPCNVGAPSVAEAVPP

SEQ ID NO: 2284 - DNA, 672 bp, Populus balsamifera subsp. trichocarpa
  misc_feature (1)..(672): Ceres Annot ID no. 1461298
  misc_feature (1)..(672): Encodes the peptide sequence at SEQ ID NO. 2285
atggactcaacatctggagtagcttctgcgcccgacccgaatagtggagaaccgggtccatcagcgggatcatcttcagcatcagcatcactgccacaacaacagcaaccagagggatcatcaccgccagcaccaccaagtagatacgagtcgcagaagaggagagactggaacactttcttacagtacttaaagaaccacaagccaccattaactctagctcgttgcagtggtgcacatgtgatcgagttcttgaaatacttggatcaatttggtaagaccaaagtccacataacgggctgtccttattttgggcacccgaacccgccagcaccttgctcttgtccacttaagcaggcctggggtagtcttgatgcgctaatcggacggcttagagctgcttatgaagaaaacggtggacggccagaatcgaacccttttggggctagagctgtcaggatttacttgagggaagttcgagaaggtcaagctaaagctagagggattccctacgagaagaagaagcgaaaaaggtctaatgttgctgttgctacggtgaatgtgtcggtggaggcagctggtggtggctctactagtggtggcggaggggggagtggtgatgctgatagtagtgctgctgcagcagctgctgctgctacaacaaccgtatag

SEQ ID NO: 2285 - protein, 223 aa, Populus balsamifera subsp. trichocarpa
  misc_feature (30)..(162): Pfam Name: DUF640 Pfam Description: Protein of unknown function (DUF640)
  misc_feature (1)..(223): Ceres Annot ID no. 1461298
  misc_feature (1)..(223): Bit score of 458.5 for HMM based on sequences of Figure 32
  misc_feature (1)..(223): Functional Homolog Of SEQ ID NO. 2271
MDSTSGVASAPDPNSGEPGPSAGSSSASASLPQQQQPEGSSPPAPPSRYESQKRRDWNTFLQYLKNHKPPLTLARCSGAHVIEFLKYLDQFGKTKVHITGCPYFGHPNPPAPCSCPLKQAWGSLDALIGRLRAAYEENGGRPESNPFGARAVRIYLREVREGQAKARGIPYEKKKRKRSNVAVATVNVSVEAAGGGSTSGGGGGSGDADSSAAAAAAAATTTV

SEQ ID NO: 2286 - protein, 231 aa, Vitis vinifera
  misc_feature (19)..(151): Pfam Name: DUF640 Pfam Description: Protein of unknown function (DUF640)
  misc_feature (1)..(231): Public GI ID no. 225434496
  misc_feature (1)..(231): Bit score of 470.9 for HMM based on sequences of Figure 32
  misc_feature (1)..(231): Functional Homolog Of SEQ ID NO. 2271
MDSASGGGAADPSGGEGPSAGGGGGAAEGSSPAPPSRYESQKRRDWNTFLQYLKNHKPPLTLARCSGAHVIEFLKYLDQFGKTKVHISGCPYFGHPNPPAPCACPLKQAWGSLDALIGRLRAAYEENGGRPESNPFGARAVRIYLREVREGQAKARGIPYEKKKRKRPTVTATAVVAATNVSAPAVTQGVEVGGSSSSAAAGGSGDGTGGGGGADTGGAAATTVAPPTTTV

SEQ ID NO: 2287 - DNA, 1159 bp, Gossypium hirsutum
  misc_feature (1)..(1159): Ceres Clone ID no. 1942084
  misc_feature (1)..(1159): Encodes the peptide sequence at SEQ ID NO. 2288
acgtcccacatcatcgatattcctgttcttgctacttggtttttttttctaacatcaattcattttctttccttctttaactcagaatcatatcttcttctctatcaccaataaagagaatacaagcaaatctttcctgtcaccggggggggggggagcctatcacttctttcaatatgaaccctaatactactattttacctaacctaagagcttaggattttgataggtttagtgttcttttttgttttaaatcgatggattctggttccggagccaacccgaatagcatcaacgagggttcatcatcagctacagcaccggtgctgatggattcacaacaaggtggagctggtgaattgtcttcttctccagctcatccaccgagtcgctacgagtcacaaaagcgtcgcgactggaacactttcttgcagtacttgaagaaccacaagcccccactgacgctatctcgttgcagcggcgcacacgtaatcgagttcttgaaatatcttgaccagttcggcaaaactaaggttcacgtaacggcttgtccttatttcggacatgcaaacccgcccgatccttgttcttgtccactcaagcaagcgtggggtagcctcgacgcgttgatcggacggctgagagctgcttatgaagaaaacggtggacgtcgggaatcaaacccttttgggacaagggctgtgaggatttatttgagggaagtgagaggagggcaggctaaagctagagggattccttatgagaaaaagaagcgaaaaaggcctactactacggctgtgtcggcggcttctggtactcaaccacctggtggtgctgccggtgatgatagttctggtggaactacggctaacgtgggtactgtcaccgctgctgctaccactaatagcttatagttgttctcttaattactatttttattttttattttgtcttctaatagctgttttatatgtgattatgatgagttatcacatgaactaagtttagttagcaatcttgtttaatcactttcgacatttttccacttctacagtttcttcatttcttgtcatgcatgaacatgattactatatatataaacacatacatatatatgtataagttgaaataaaaacaataagacgagagttattaatct

SEQ ID NO: 2288 - protein, 218 aa, Gossypium hirsutum
  misc_feature (27)..(159): Pfam Name: DUF640 Pfam Description: Protein of unknown function (DUF640)
  misc_feature (1)..(218): Ceres Clone ID no. 1942084
  misc_feature (1)..(218): Bit score of 413.3 for HMM based on sequences of Figure 32
  misc_feature (1)..(218): Functional Homolog Of SEQ ID NO. 2271
MDSGSGANPNSINEGSSSATAPVLMDSQQGGAGELSSSPAHPPSRYESQKRRDWNTFLQYLKNHKPPLTLSRCSGAHVIEFLKYLDQFGKTKVHVTACPYFGHANPPDPCSCPLKQAWGSLDALIGRLRAAYEENGGRRESNPFGTRAVRIYLREVRGGQAKARGIPYEKKKRKRPTTTAVSAASGTQPPGGAAGDDSSGGTTANVGTVTAAATTNSL

SEQ ID NO: 2289 - DNA, 832 bp, Glycine max
  misc_feature (1)..(832): Ceres Clone ID no. 662149
  misc_feature (1)..(832): Encodes the peptide sequence at SEQ ID NO. 2290
aaaaacatataacctatttcaccaatccaacagggtggttgtgatttttgttgttgttgttgttgttagtgatcatcatggacgctgcatcaggggcagcgcctgcggcgttggcggctccccaatcagagggatcaccggctgcgccgagccgctacgagtcgcagaagcgacgcgactggaacacgttcttgcagtacctgaggaaccacaagccaccattgacgctggcgcggtgcagtggcgcgcacgtgatcgagtttttgaagtacctcgaccagttcgggaagactaaggtacacatcttggggtgcccgtatttcggacaccccaacccacctgccccttgtgcctgtcctcttaaacaggcttggggcagtctggacgccctaattggacgactcagggcggccttcgaagaaaatggaggccgtcctgagtctaatccatttgcaactagggctgtccgaatttacctcagagagataagagaaggtcaggccaaggcaagaggaatcccctacgagaagaagaaacgcaagagaactattgtcaccactactgtcaccgccgcagccaccgttatgtctaccataacgggtagtagtcctaataatactattacaaacggtgctggtagtagcactggtaacactactaacggagctggtgttagtgaaccttctgctgctgctactgctacacctaatgttactactgctgctgccgtatagtataattttaataattttgatcattttttcctattttctgctactatctactatctatctttatttttaaggaaattaattgtggttatggcttatgc

SEQ ID NO: 2290 - protein, 218 aa, Glycine max
  misc_feature (8)..(140): Pfam Name: DUF640 Pfam Description: Protein of unknown function (DUF640)
  misc_feature (1)..(218): Ceres Clone ID no. 662149
  misc_feature (1)..(218): Bit score of 417.4 for HMM based on sequences of Figure 32
  misc_feature (1)..(218): Functional Homolog Of SEQ ID NO. 2271
MDAASGAAPAALAAPQSEGSPAAPSRYESQKRRDWNTFLQYLRNHKPPLTLARCSGAHVIEFLKYLDQFGKTKVHILGCPYFGHPNPPAPCACPLKQAWGSLDALIGRLRAAFEENGGRPESNPFATRAVRIYLREIREGQAKARGIPYEKKKRKRTIVTTTVTAAATVMSTITGSSPNNTITNGAGSSTGNTTNGAGVSEPSAAATATPNVTTAAAV

SEQ ID NO: 2291 - DNA, 1194 bp, Zea mays
  misc_feature (1)..(1194): Ceres Clone ID no. 100901314
  misc_feature (1)..(1194): Encodes the peptide sequence at SEQ ID NO. 2292
gcgtctccactgatccgcacgatcgcgcgctcgcccgcgccccggccccggcggccggccgggtgagcagtagctggagctgcgtctgcgtgcatggatccctcggggccagccgggccgtcctcggcggcggggagcggcgacgacgcgctcgcgccgccgcagcatcaggtccagccgctggctcaggcgcagccgcagccgcagcaggccgctccgcctccgcagctcagcaggtacgaatcgcagaagcggcgggactggaacacgttcctgcagtacctgcggaaccaccggccgccgctcacgctggcgcggtgcagcggcgcgcacgtcatcgagttcctcaagtacctggaccagttcggcaagaccaaggtgcacgccgccgggtgcgcctacttcggccagcctaacccgccggcgccctgcccgtgcccgctgcgccaggcctgggggtccctcgacgcgctcatcggccgcctgcgcgccgcgtacgaggagagcggccacgcgccggagtccaaccccttcgcggcgcgcgccgtgcggatctacctccgcgacgtccgcgacgcgcacgccaaggcgcggggcataccctacgagaagaagagccgcaagcgcaagcagccgccggcggcggccacaggagaagcgtcgtygtyttygtcctcggccgcggcagcgcgggaggccgctgccgccgcgagcgccggggacgggtccagcagtggcagcgtggcggcgaaagctgcaccgacccccggcggcggccagggaagcgccactactacagccgctcctgcaccgaccagcacgtcccgagtacagtagaaccaacttttgaaaatcatgtctatttgctagcttttgcacgtctcgcgctatataacgtcgagcttcaatttgcaacattcgagctagtatattattttttttgccatttggttttggcatcgttcttgctctttacaaaccgcctcgatctctctctttttctttctttccttttgcattttttgtttttcctttttgtttgctgaattagccagctactaggtcagtcagtaataataatatactacatggcaattggcaaaaaaattgtagtatccaggatgggaggaagtgagttaatcaataggtcttattgtaccctgcttgttgcttgcccatgggccatggtgagat

SEQ ID NO: 2292 - protein, 247 aa, Zea mays
  misc_feature (30)..(162): Pfam Name: DUF640 Pfam Description: Protein of unknown function (DUF640)
  misc_feature (1)..(247): Ceres Clone ID no. 100901314
  misc_feature (1)..(247): Bit score of 382.8 for HMM based on sequences of Figure 32
  misc_feature (1)..(247): Functional Homolog Of SEQ ID NO. 2271
  misc_feature (191)..(191): Xaa is any aa, unknown, or other
  misc_feature (192)..(192): Xaa is any aa, unknown, or other
  misc_feature (193)..(193): Xaa is any aa, unknown, or other
MDPSGPAGPSSAAGSGDDALAPPQHQVQPLAQAQPQPQQAAPPPQLSRYESQKRRDWNTFLQYLRNHRPPLTLARCSGAHVIEFLKYLDQFGKTKVHAAGCAYFGQPNPPAPCPCPLRQAWGSLDALIGRLRAAYEESGHAPESNPFAARAVRIYLRDVRDAHAKARGIPYEKKSRKRKQPPAAATGEASXXXSSAAAAREAAAAASAGDGSSSGSVAAKAAPTPGGGQGSATTTAAPAPTSTSRVQ

SEQ ID NO: 2293 - DNA, 639 bp, Oryza sativa
  misc_feature (1)..(639): Ceres Annot ID no. 1373087
  misc_feature (1)..(639): Encodes the peptide sequence at SEQ ID NO. 2294
atggatccgtctggccccggtccgtcctctgcggcggctggcggcgcgccggccgtggcggcggcgccgcagccgccggcgcagctgagcaggtacgagtcgcagaagcggagggactggaacacgttcctgcagtacctgcggaaccaccggccgccgctgacgctggcgcggtgcagcggcgcgcacgtgatcgagttcctgaggtacctggaccagttcgggaagaccaaggtgcacgcgtcggggtgcgccttctacggccagcccagcccgccggggccgtgcccgtgcccgctgcgtcaggcgtggggatccctcgacgcgctcatcggccgcctccgcgccgcgtacgaggagagcggcggcacgcccgagtccaacccgttcgccgcgcgcgccgtccggatctacctccgcgaggtgcgggactcgcaggccaaggcgcgcggcatcccgtacgagaagaagaagcgcaagcgctcgcaggcggcgcagcccgccggcgtcgagccgtccggctcgtcttctgctgcagctgcagctgccggtggtggagacgcgggcagcggtggcggtgcagctgctactaccacagctcaacctggagggagtggcactgcaccaagcgcctcctga

SEQ ID NO: 2294 - protein, 212 aa, Oryza sativa
  misc_feature (13)..(145): Pfam Name: DUF640 Pfam Description: Protein of unknown function (DUF640)
  misc_feature (1)..(212): Ceres Annot ID no. 1373087
  misc_feature (1)..(212): Bit score of 396.2 for HMM based on sequences of Figure 32
  misc_feature (1)..(212): Functional Homolog Of SEQ ID NO. 2271
MDPSGPGPSSAAAGGAPAVAAAPQPPAQLSRYESQKRRDWNTFLQYLRNHRPPLTLARCSGAHVIEFLRYLDQFGKTKVHASGCAFYGQPSPPGPCPCPLRQAWGSLDALIGRLRAAYEESGGTPESNPFAARAVRIYLREVRDSQAKARGIPYEKKKRKRSQAAQPAGVEPSGSSSAAAAAAGGGDAGSGGGAAATTTAQPGGSGTAPSAS

SEQ ID NO: 2295 - DNA, 799 bp, Brassica napus
  misc_feature (1)..(799): Ceres Clone ID no. 1118987
  misc_feature (1)..(799): Encodes the peptide sequence at SEQ ID NO. 2296
aaattctcgattcgcttatattctcaaaaccaacgctaaataaaaacactctcaaagaaaaacaaaaaaaaaaccctagttttgatggaatcgactgattcggggtcacaacaacatggaggtgacccaggtccgtcctccgtaacgccctcttcacctccggcgacgccgcctagcaggtacgagtcgcaaaaacgacgtgactggaacacgttcttgcagtacctcaagaaccacaagccgcctctcgcgttatcacgatgtagcggagcgcacgtgatcgagttcctcaagtacctagatcagttcggtaagaccaaagtccacgtggcgacctgcccttacttcggacatcagcagcctccctctccttgcgcttgtcctctcaagcaagcctggggatctctcgatgctctgatcggacggttgagagctgcgtacgaggagcacggtgggaggcctgattccaaccctttcgccgcacgtgcggtcaggatttacttgagagaagtcagagaaagtcaagccaaggcacgtgggattccatacgagaagaagaaacggaaacgggcaccaactgtcactaccgctagaattgacgttgctccgtcgagacaaagtgaaggaggtggtggttgtaacgacagtgatccgtctgtcgccgaagctgtaccgccttaaattaaattattatatcatattaattagttttcttgttatattaagcatggaactcacacctttcgtactataatgtattttatttttctatatgaactattaagagttttcttttgcc

SEQ ID NO: 2296 - protein, 198 aa, Brassica napus
  misc_feature (14)..(146): Pfam Name: DUF640 Pfam Description: Protein of unknown function (DUF640)
  misc_feature (1)..(198): Ceres Clone ID no. 1118987
  misc_feature (1)..(198): Bit score of 407.4 for HMM based on sequences of Figure 32
  misc_feature (1)..(198): Functional Homolog Of SEQ ID NO. 2271
MESTDSGSQQHGGDPGPSSVTPSSPPATPPSRYESQKRRDWNTFLQYLKNHKPPLALSRCSGAHVIEFLKYLDQFGKTKVHVATCPYFGHQQPPSPCACPLKQAWGSLDALIGRLRAAYEEHGGRPDSNPFAARAVRIYLREVRESQAKARGIPYEKKKRKRAPTVTTARIDVAPSRQSEGGGGCNDSDPSVAEAVPP

SEQ ID NO: 2297 - protein, 212 aa, Oryza sativa subsp. indica
  misc_feature (13)..(145): Pfam Name: DUF640 Pfam Description: Protein of unknown function (DUF640)
  misc_feature (1)..(212): Public GI ID no. 125543059
  misc_feature (1)..(212): Bit score of 396.6 for HMM based on sequences of Figure 32
  misc_feature (1)..(212): Functional Homolog Of SEQ ID NO. 2271
MDPSGPGPSSAAAGGAPAVAAAPQPPAQLSRYESQKRRDWNTFLQYLRNHRPPLTLARCSGAHVIEFLRYLDQFGKTKVHASGCAFYGQPSPPGPCPCPLRQAWGSLDALIGRLRAAYEESGGTPESNPFAARAVRIYLREVRDSQAKARGIPYEKKKRKRSQAAQPAGVEPSGSSSAAAAAAGGGDTGSGGGAAATTTAQPGGSGTAPSAS

SEQ ID NO: 2298 - DNA, 828 bp, Brassica napus
  misc_feature (1)..(828): Ceres Clone ID no. 1073674
  misc_feature (1)..(828): Encodes the peptide sequence at SEQ ID NO. 2299
acactctttctctcaatttctctctcttttaaaacactaatcactaaaatcttgattcactatatcgtcaaaaccaacgctaaatcaattaaactctctcaaagaaaacaagacaaagccctacttttgatggattcagggtcacaacgaccggggcctgttagcgaaggcgatccgggtccgtccatcgtaaccccctcttcaccgcctgcgacgcctagcaggtacgagtcgcagaaacgacgtgactggaccacgttcttgcagtacctcaagaaccacaagccgcctctttccttgtcacggtgtagcggagcacatgccatcgagttcctcaagtacttagatcagttcggtaagaccaaagtccacgtggcggcatgtccttactttggccatcagcaacctccgtctccttgcgcttgtcctctcaagcaagcctgggggtctctcgatgccctgatcggacggttgagagcagcctacgaagagaacggtggacggcccgagtcgaacccgttcgcggcacgtgcggttaggatttacttgagggaagtcagagaaagtcaagccaaggcccgtgggagaccctacgagaaaaagaaacggaaacggccaacaactgttaccaccgtgagagttgacgttgcttcgtcgagacaaagtgaaggagatggttgtaacatcggtgatccgtcgtatgtggccgaggctgtacctccttaattaagttattattattgtcatgatatattaaatacattatatatgtctggaactcacatcaccttcttgagttaactattgaaaatatttttgttctagttc

SEQ ID NO: 2299 - protein, 198 aa, Brassica napus
  misc_feature (14)..(146): Pfam Name: DUF640 Pfam Description: Protein of unknown function (DUF640)
  misc_feature (1)..(198): Ceres Clone ID no. 1073674
  misc_feature (1)..(198): Bit score of 397.2 for HMM based on sequences of Figure 32
  misc_feature (1)..(198): Functional Homolog Of SEQ ID NO. 2271
MDSGSQRPGPVSEGDPGPSIVTPSSPPATPSRYESQKRRDWTTFLQYLKNHKPPLSLSRCSGAHAIEFLKYLDQFGKTKVHVAACPYFGHQQPPSPCACPLKQAWGSLDALIGRLRAAYEENGGRPESNPFAARAVRIYLREVRESQAKARGRPYEKKKRKRPTTVTTVRVDVASSRQSEGDGCNIGDPSYVAEAVPP

SEQ ID NO: 2300 - DNA, 1204 bp, Zea mays
  misc_feature (1)..(1204): Ceres Clone ID no. 100846865
  misc_feature (1)..(1204): Encodes the peptide sequence at SEQ ID NO. 2301
tcccatcgcgaaccaaccccgcgcccgccccggacggtgcgcgtctccactgacccgcacgatcgcgctctcgcccgcgccccggccccggccggccgggtgagcagcagctgcgtgcatggatccctcggggccagccggcgccggggccgggccgtcctcggcggcgggggcgggcggcgacgacgcgcacgcgcacgcgccgccgcagcagcaccagatccagccgcttgctcaggcgcaggcgcagccgcagccgcatcagctgagcaggtacgagtcgcagaagcggcgggactggaacacgttcctgcagtacctgcagaaccaccggccgccgctgacgctggcgcggtgcagcggcgcgcacgtcatcgagttcctcaagtacctggaccagttcggcaagaccaaggtgcacgccgccgggtgcgcccacttcggccagcccagcccgccggcgccgtgcccgtgcccgctgcaccaggcctggggctccctcgacgcgctcatcggccgcctgcgcgccgcgtacgaggagagcggccacgcgcccgagtccaaccccttcgccgcccgcgccgtgcggatctacctccgcgacgtccgcgacgcgcaggccaaggcgcggggcataccctacgagaagaagagccgcaagcgcaagcagccgccgccggccgccgctgcgggggaggcggcggcggcgtcgttgttttcggccgcggcagcacgggtggccgccgggagcgccggggacgggtcgtccgccagtggcagcgcggcggcgaaagctgcaccgaccaccgcccagggaagcgccgctgctgatgcagcgaccagcacatcccgagtacagtagaggacctcgagctttagtttgcagcacttgagctagctatattttttttttgccattcgggttcagcatcgttcttgcctttcttcctttcctttttgtttgctggatttcttcctgctcgccacttgagccattttaattatttcactatttgctgaactagccagctactgggtcagtcgaccagtaataatatcatgcgcatggcaattggcaaaaatttgtagtatatccaggagatcgagggagaagtgaattaatgaataggtcttgtacgtactcttgttgcttagcttgcccatgcatgcatacccgagataaaagagcaagctttattaattt

SEQ ID NO: 2301 - protein, 247 aa, Zea mays
  misc_feature (34)..(166): Pfam Name: DUF640 Pfam Description: Protein of unknown function (DUF640)
  misc_feature (1)..(247): Ceres Clone ID no. 100846865
  misc_feature (1)..(247): Bit score of 379.6 for HMM based on sequences of Figure 32
  misc_feature (1)..(247): Functional Homolog Of SEQ ID NO. 2271
MDPSGPAGAGAGPSSAAGAGGDDAHAHAPPQQHQIQPLAQAQAQPQPHQLSRYESQKRRDWNTFLQYLQNHRPPLTLARCSGAHVIEFLKYLDQFGKTKVHAAGCAHFGQPSPPAPCPCPLHQAWGSLDALIGRLRAAYEESGHAPESNPFAARAVRIYLRDVRDAQAKARGIPYEKKSRKRKQPPPAAAAGEAAAASLFSAAAARVAAGSAGDGSSASGSAAAKAAPTTAQGSAAADAATSTSRVQ

SEQ ID NO: 2302 - DNA, 1514 bp, Zea mays
  misc_feature (1)..(1514): Ceres Clone ID no. 240797
  misc_feature (1)..(1514): Encodes the peptide sequence at SEQ ID NO. 2303
aagaaatgatgcttattcttcttcctcgtgttgtgttgccttgctaatgagtgagagtcacatatagcagggagcgcagctggaaccaagcggctaaggatcgatggatcaccaccaccatcatcaccaccaccatcaccatcacatgatcccgggacaagagccgtcggcgacggacggcgcagcccctgacagcttcttcctgggccccgccgcagccgtcatcttctccggaggcgccggggccggttcgtcgtcgtcgggcgccgcggccctcggatcctccgccgggggaggcggtgggccatctccgtccagctcgtcgccgtcgctgagccggtacgagtcccagaagcgccgggactggaacactttcgggcagtatctgcgcaaccaccggccgccgctgtcgttgtcgcggtgcagcggcgcgcacgtgctggagttcctcaagtacatggatcagttcggcaagaccaaggtgcacacgccggtgtgccccttctacgggcaccccaacccgcccgcgccatgcccgtgcccgctgcgccaggcatggggctccctcgacgcgctcatcggccgcctccgcgccgcctacgaggagaacggcggcacgcccgagatgaaccccttcggcgcgcgggccgtgcggctctacctgcgcgaggtgcgcgagacgcaggcgcgggccagggggatcagctacgagaagaagaagcgcaagaagccgtcggcggcttcggccgcggccgcggggccgtcgtccgagggaagcccaccaccggggccgtccagcggcggtggaggacccgacacgtcgtcgccgcagttcatcatgccgtgagttttttgttcctagctagctagttaagtgatccatcgccatttgccatctacaatccttcccttgatcgtccatctgatgagctagccaacacacagcagcgcgagttggagttcgttccggtgctgctggtctaggccgttgttctttgtcttcttctccagtggcttgcattttgcaaaagatttctcgacctcccccacacccacaccccccaccttcttttctctgtttcattcacttgaatcatcactgtgcgcgtgcgtgagtactggtttaatcgtcgtcgctgttttgyttagctttcatcaacccattggcagcaggcagagtttatgttagttttgcttggtttgttattctcctcccgaggtacgacatgatgcaaacttgcaagaacagtttgagattccctaccaatgcagctgttgtgtgcttatgcatgtcatggcatggtgtgggagaagttttagtttgcagctagcaacaacagtgacaaaagctgtagctgtatagctagctagtagcatctttcagaatttgttcttgtatgcaacttgcaagcaactagtagtttggttctgctgcagaagccagcagccaaactagcttgctgtgctattcattatattggcagaacagaaatataatccttctacatcacacc

SEQ ID NO: 2303 - protein, 247 aa, Zea mays
  misc_feature (61)..(193): Pfam Name: DUF640 Pfam Description: Protein of unknown function (DUF640)
  misc_feature (1)..(247): Ceres Clone ID no. 240797
  misc_feature (1)..(247): Bit score of 348.0 for HMM based on sequences of Figure 32
  misc_feature (1)..(247): Functional Homolog Of SEQ ID NO. 2271
MDHHHHHHHHHHHHMIPGQEPSATDGAAPDSFFLGPAAAVIFSGGAGAGSSSSGAAALGSSAGGGGGPSPSSSSPSLSRYESQKRRDWNTFGQYLRNHRPPLSLSRCSGAHVLEFLKYMDQFGKTKVHTPVCPFYGHPNPPAPCPCPLRQAWGSLDALIGRLRAAYEENGGTPEMNPFGARAVRLYLREVRETQARARGISYEKKKRKKPSAASAAAAGPSSEGSPPPGPSSGGGGPDTSSPQFIMP

SEQ ID NO: 2304 - DNA, 1224 bp, Panicum virgatum
  misc_feature (1)..(1224): Ceres Clone ID no. 1797203
  misc_feature (1)..(1224): Encodes the peptide sequence at SEQ ID NO. 2305
atcgcgacccaaccgcgcgggccggacggtgccctggtgccgcgcgtctccactgatccgcgcgggctcgcccggcgccccggccgggtgagctagcgagcgagctgcatggatcccccggggccagccggggcgtcctcggcgccgggcggcgacgcgcaggcgccgcagcaccatgtgcagccgctggcccaggcgcagccgcaggtcgcgccggcgccggcgccgccgcagcagctgagcaggtacgagtcgcagaagcggcgggactggaacacgttcctgcagtacctgcggaaccaccggccgccgctgacgctggcgaggtgcagcggcgcgcacgtcatcgagttcctcaagtacctggaccagttcggcaagaccaaggtgcacgccgccgggtgcgcctacttcggccaccccagcccgccggcgccgtgcccgtgcccgctgcgccaggcctggggctccctcgacgcgctcatcggccgcctccgcgccgcctacgaggagagcggacacccgcccgagtccaaccccttcgcggcccgcgccgtgcggatctacctccgcgaggtccgcgactcgcaggccaaggcgcggggcataccctacgagaagaaccgcaagcgcaagcagcccgcgccgccggccccaggggaggcggcgccgtcgtcgtcgtcatcgtcatcggcggccgccgcggcggcacgggaggcggcccccccgccacgagcggcggtgacgggtccagtggcaccgcggcggcggcggcggcagctgcaccgacgactggccaggcgggagggagtggcggcgctgctgcaccggccagcacatcatcccgagtatagtagaatcactttgcaaaccatggtctatttgcttctgtacgtctcgctagctatacctcgagctttgcaacatttgagctgctatttctttcttctgccatttggttttcggcgtccttacatcttgctccttagaaattgcctctcctgcttgctgctgtttttttccctcttcctttggctggattatattcttcctgctcccttattgagctagtcattttcactatgctgaattatccagcagctactaggtcagtaataataataatacatggaaatttggcaaaaactgaatgataatatgggcctttctgtttgctcatgtcccatgcatacccatggtgagatcagagcaagatttgaggct

SEQ ID NO: 2305 - protein, 320 aa, Panicum virgatum
  misc_feature (28)..(160): Pfam Name: DUF640 Pfam Description: Protein of unknown function (DUF640)
  misc_feature (1)..(320): Ceres Clone ID no. 1797203
  misc_feature (1)..(320): Bit score of 366.0 for HMM based on sequences of Figure 32
  misc_feature (1)..(320): Functional Homolog Of SEQ ID NO. 2271
MDPPGPAGASSAPGGDAQAPQHHVQPLAQAQPQVAPAPAPPQQLSRYESQKRRDWNTFLQYLRNHRPPLTLARCSGAHVIEFLKYLDQFGKTKVHAAGCAYFGHPSPPAPCPCPLRQAWGSLDALIGRLRAAYEESGHPPESNPFAARAVRIYLREVRDSQAKARGIPYEKNRKRKQPAPPAPGEAAPSSSSSSSAAAAAAREAAPPPRAAVTGPVAPRRRRRQLHRRLARREGVAALLHRPAHHPEYSRITLQTMVYLLLYVSLAIPRALQHLSCYFFLLPFGFRRPYILLLRNCLSCLLLFFSLFLWLDYILPAPLLS

SEQ ID NO: 2306 - DNA, 1068 bp, Sorghum bicolor
  misc_feature (1)..(1068): Ceres Annot ID no. 8733177
  misc_feature (1)..(1068): Encodes the peptide sequence at SEQ ID NO. 2307
atggatccctcggggccagccgccgggccgtcgtcctcggcggcgaggggcggtggcgacgacgacgcgcacgcgccgccgccgcctcagcagcagcaccatcaggtccagccgctggctcaggcgcagccgcagcaggccgccgccgcccagccccaccaggcgccgccgccgccgcagcagcagctcagcaggtacgagtcgcagaagcgtcgggactggaacacgttcctgcagtacctgcggaaccaccggccgccgctgacgctggcgcgctgcagcggcgcgcacgtcatcgagttcctcaagtacctggaccagttcggcaagaccaaggtgcacgccgccgggtgcgcctacttcggccagcctaacccgccggcgccgtgcccgtgcccgctgcgccaggcctggggatccctcgacgcgctcatcggccgcctccgcgccgcgtacgaggagagcggacacgcgccggagtccaaccctttcgcggcacgcgccgtgcggatctacctccgcgacgtccgcgacgcgcaggccaaggcaaggggcataccctacgagaagaagagccgcaagcgcaagcagccggcggcgggctcaggggaggcgtcgtcgtcttcggccgcagcagcagcacgggaggctgcgcggcggcgacgaaagctgcaccgaccaccggccagggaagcggcaccactgctgctgctgctgctgcaccgaccagcacatcccgagtatagtagaatcacttttgcaaaccatgtctatttgcttctgtacgtctctcgctatacctcgagctttaatttgcaacatttgagctatatatttcttctgccatttggtttcaccatcgttcttgctctttacaaaccgcatctgggcctgggctcatgcttttttttctcccttttgtttaatttgctggatttcttgctgcatgctctctactcgagccattttcactatgctgaattagacggctactatggtcagtcagtaataataatacatgtcaattggcaaaagtttgtagtatctatccaggatcggaggaagtga

SEQ ID NO: 2307 - protein, 355 aa, Sorghum bicolor
  misc_feature (47)..(179): Pfam Name: DUF640 Pfam Description: Protein of unknown function (DUF640)
  misc_feature (1)..(355): Ceres Annot ID no. 8733177
  misc_feature (1)..(355): Bit score of 355.6 for HMM based on sequences of Figure 32
  misc_feature (1)..(355): Functional Homolog Of SEQ ID NO. 2271
MDPSGPAAGPSSSAARGGGDDDAHAPPPPQQQHHQVQPLAQAQPQQAAAAQPHQAPPPPQQQLSRYESQKRRDWNTFLQYLRNHRPPLTLARCSGAHVIEFLKYLDQFGKTKVHAAGCAYFGQPNPPAPCPCPLRQAWGSLDALIGRLRAAYEESGHAPESNPFAARAVRIYLRDVRDAQAKARGIPYEKKSRKRKQPAAGSGEASSSSAAAAAREAARRRRKLHRPPAREAAPLLLLLLHRPAHPEYSRITFANHVYLLLYVSRYTSSFNLQHLSYIFLLPFGFTIVLALYKPHLGLGSCFFFSLLFNLLDFLLHALYSSHFHYAELDGYYGQSVIIIHVNWQKFVVSIQDRRK

SEQ ID NO: 2308 - DNA, 648 bp, Sorghum bicolor
  misc_feature (1)..(648): Ceres Annot ID no. 8669372
  misc_feature (1)..(648): Encodes the peptide sequence at SEQ ID NO. 2309
atggatccctccgggcctggcccgtcgtcggtcatgggggcagcaggcggcggcgaggcaccggccgtggcgccgccgcgtccggcgcagctgagcaggtacgagtcgcagaagcggagggactggaacacgttcctgcagtacctgcgaaaccaccggccgccgctgacgctggcgcggtgcagcggcgcgcacgtgatcgagttcctccggtacctggaccagttcggcaagaccaaggtgcacgccgccgggtgcgcctactacggccagccggcaccgccggggccctgcccgtgcccgctgcgccaggcgtggggctccctcgacgcgctcatcggccgcctgcgcgcggcgtacgaggagagcggcggcacgcccgagtccaaccccttcgccgcgcgcgccgtgcggatctacctccgcgaggtgcgcgactcgcaggccaaggcgcgcggcatcccctacgagaagaagaagcgcaagcgcgcgcagcagcagcaggccgccgccgccgcggatcctgcttcgacgagctcgtccgctgctgctgccggcgggagcgggactagcggcagggctgctgctgcagctgccgcgtccgccgctcaggccggagggagtagcgctgcaccgagcaccacttga

SEQ ID NO: 2309 - protein, 215 aa, Sorghum bicolor
  misc_feature (15)..(147): Pfam Name: DUF640 Pfam Description: Protein of unknown function (DUF640)
  misc_feature (1)..(215): Ceres Annot ID no. 8669372
  misc_feature (1)..(215): Bit score of 392.0 for HMM based on sequences of Figure 32
  misc_feature (1)..(215): Functional Homolog Of SEQ ID NO. 2271
MDPSGPGPSSVMGAAGGGEAPAVAPPRPAQLSRYESQKRRDWNTFLQYLRNHRPPLTLARCSGAHVIEFLRYLDQFGKTKVHAAGCAYYGQPAPPGPCPCPLRQAWGSLDALIGRLRAAYEESGGTPESNPFAARAVRIYLREVRDSQAKARGIPYEKKKRKRAQQQQAAAAADPASTSSSAAAAGGSGTSGRAAAAAAASAAQAGGSSAAPSTT

SEQ ID NO: 2310 - DNA, 1337 bp, Zea mays
  misc_feature (1)..(1337): Ceres Clone ID no. 100867501
  misc_feature (1)..(1337): Encodes the peptide sequence at SEQ ID NO. 2311
ccatctccagagcttcatgctgactcccaaggatggcttgaccacctgagctgctgagcgtcagagagcatggcatagcatttcttggtgtcgctggatggatggggatgactggatcactcatcaagaggcggatcacaaaagagtactagctaaccactgccaagattccgccgcgcgcacgcatgcatctgtgttgagcttcttacacgccgcagagaaaactagatcacggcgctgcacataccgcagcgcgcgcaggaagcaagcggctaaggatcgatggatcaccatcaccaccaccaccatcacatgatcccgggccaagagccaccggcggcggatagctcagccccggacagcttcttcctcggccccgcgggagccatcatattctccggaggcgccggggtgtcgggggccggctcgtcgtcgggcgccgcggccctcggatcatccgcgggggcaggaggtgggccgtcgccgtccagctcgtcaccgtcgctgagccggtacgagtcccagaagcgccgggactggaacacgttcgggcagtacctccgaaaccaccggccgccactgtcgttgtcgcggtgcagcggtgcacacgtgctggagttcctcaaatatatggatcagttcggcaagaccaaggtgcacacgccggtgtgccccttctacgggcaccccaacccgcccgcgccgtgcccgtgcccgctgcgccaggcctggggttccctcgacgcgctcatcggccgcctccgcgccgcctacgaggagaacggcggcacgcccgagatgaacccgttcggcgcgcgcgccgtgcggctctacctgcgcgaggtgcgcgagtcgcaggcgcgtgccagggggatcagctacgagaagaagaagcgcaagaagccgtcggcagcctcggccgcggcccctgggccgtcgtccgagggaagcccaccaccaggaccgtccggcggaggaggaggattcggcacgtcggcgtcgccgcggttcatcatgccgtgagtttttttttttcctggctagctagccaagtgatccatcgccggcatctacaccccttgatcgtctattttaatctgatgagctagccaggacagcacagctggagttggaattcttgcatggaacgccattgttctggtagtagagcaaacaaaagtctaagccattgttctttgcctcctcctcctccttcggtggcttgcatttcgggaaaaaaaattctcgatccccttttcttttctttcctttttcttttctctgtttcatccgtgcgtgagtactggtttaatcgtggatgttttatttagctttca

SEQ ID NO: 2311 - protein, 246 aa, Zea mays
  misc_feature (59)..(191): Pfam Name: DUF640 Pfam Description: Protein of unknown function (DUF640)
  misc_feature (1)..(246): Ceres Clone ID no. 100867501
  misc_feature (1)..(246): Bit score of 349.1 for HMM based on sequences of Figure 32
  misc_feature (1)..(246): Functional Homolog Of SEQ ID NO. 2271
MDHHHHHHHHMIPGQEPPAADSSAPDSFFLGPAGAIIFSGGAGVSGAGSSSGAAALGSSAGAGGGPSPSSSSPSLSRYESQKRRDWNTFGQYLRNHRPPLSLSRCSGAHVLEFLKYMDQFGKTKVHTPVCPFYGHPNPPAPCPCPLRQAWGSLDALIGRLRAAYEENGGTPEMNPFGARAVRLYLREVRESQARARGISYEKKKRKKPSAASAAAPGPSSEGSPPPGPSGGGGGFGTSASPRFIMP

SEQ ID NO: 2312 - DNA, 1457 bp, Panicum virgatum
  misc_feature (1)..(1457): Ceres Clone ID no. 2012696
  misc_feature (1)..(1457): Encodes the peptide sequence at SEQ ID NO. 2313
gtcctcgcctccactgtctagctagctctagcagcctcccagctatatacgcgccccccacccaccctaccgcctccccacacccgtcctcctcgctcctcgaccaccgccgccgctcgcctcctgctgcaggctctcgccagaaagggaaaccgcatctgctgcttcggcgcgccgcccctgatcgacggccagagcggggggtgtggtgacgagacgaggtcggccggccggccggcgcgcagatctgaggcgtgagcagctagcgcggagggagctgaggtgcgtcatgcagggcggaggcgcggccgacagccccggcgcggcggcgggcgggaacgcgccgcggccgagccggtacgagtcgcagaagcgccgggactggcacaccttcgggcagtacctgcgcaaccaccggccgccgctggagctggcgcgctgcagcggcgcgcacgtcctcgagttcctgcgctacctcgaccagttcggcaagaccaaggtccacgcgccgggctgccccttcttcggccacccgtcgccgcccgcgccgtgcccgtgcccgctccgccaggcgtggggcagcctcgacgcgctcgtcggccgcctccgcgccgccttcgaggagcacgggggtcgccccgaggccaaccccttcggcgcgcgcgccgtgcgcctctacctccgcgaggtccgcgacagccaggccaaggcgcgcggcatcgcctacgagaagaagcgccggaagcgcccctcctcctcgtcccagcactcccagcagcagcagcaagccgccgcgactcccccgccccaggctgccgctcccgcctcctcgccggctctgtcggacgaggcgactgagagggccacggccaccgaagcgcgggcgcacgccgtgcaccagcaccaccacttcctgcacggcttcatcccgcacccgcagttcctgcacggcttcagcctggtgccgggcggccaccccaaagcggtcgctgctggcaatggcagcagcagcggcagcagcgccggcgccggcgccggcagcggggacgagatagcgctggcgatggcggcggcggcggaggcgcacgcggcggggtgcatgctgccgctctcagtgttcaactagccgtgtagccgaatcgaggtactaggtcttaaacaatggatgaattactcatcgtcggaggtttatctagtgttaagatcgatctcgtcgtgatagatcgatcaacacgcgtacttgctgcagctgttcttaaggattttctacccgatctcttttggttggttacatgcatttcctgctgttctagctgctcagctctgctgggaaatagtagtaggtgtacttggtactgtagggtttcctggatcctgcttggtttgtgtatgcaatgcaatgaagatgggagataatataatggaaggcttaattaccaggcttctctttctggact

SEQ ID NO: 2313 - protein, 278 aa, Panicum virgatum
  misc_feature (5)..(137): Pfam Name: DUF640 Pfam Description: Protein of unknown function (DUF640)
  misc_feature (1)..(278): Ceres Clone ID no. 2012696
  misc_feature (1)..(278): Bit score of 333.0 for HMM based on sequences of Figure 32
  misc_feature (1)..(278): Functional Homolog Of SEQ ID NO. 2271
MQGGGAADSPGAAAGGNAPRPSRYESQKRRDWHTFGQYLRNHRPPLELARCSGAHVLEFLRYLDQFGKTKVHAPGCPFFGHPSPPAPCPCPLRQAWGSLDALVGRLRAAFEEHGGRPEANPFGARAVRLYLREVRDSQAKARGIAYEKKRRKRPSSSSQHSQQQQQAAATPPPQAAAPASSPALSDEATERATATEARAHAVHQHHHFLHGFIPHPQFLHGFSLVPGGHPKAVAAGNGSSSGSSAGAGAGSGDEIALAMAAAAEAHAAGCMLPLSVFN

SEQ ID NO: 2314 - protein, 238 aa, Oryza sativa subsp. japonica
  misc_feature (12)..(144): Pfam Name: DUF640 Pfam Description: Protein of unknown function (DUF640)
  misc_feature (1)..(238): Public GI ID no. 51038155
  misc_feature (1)..(238): Bit score of 380.5 for HMM based on sequences of Figure 32
  misc_feature (1)..(238): Functional Homolog Of SEQ ID NO. 2271
MEGGGGGADGQAQPVAQAPPAMQPMQQLSRYESQKRRDWNTFLQYLKNHRPPLTLARCSGAHVIEFLKYLDQFGKTKVHASGCAYYGQPSPPAPCPCPLRQAWGSLDALIGRLRAAYEESGHAPESNPFAARAVRIYLREVRDAQAKARGIPYEKKKRKRTQQQQPPPPPPPPPQHQPGAAAGEASSSSSAAAAAVAAEGSGSSAAAAAATSQTGGGGGGSTTTTTASAAAPTTATRV

SEQ ID NO: 2315 - DNA, 1062 bp, Panicum virgatum
  misc_feature (1)..(1062): Ceres Clone ID no. 2004419
  misc_feature (1)..(1062): Encodes the peptide sequence at SEQ ID NO. 2316
actcatcgcgatcgatcgctgctagctagctcccagctgcgattctgatccttcgtgctccctcagttgtcgtcgtcgctggctcgctcgcttgcttgccagctctctctctcatagtagctagctgcttgcatggatccgtccgggcccggcccgtcgccggtcgttggcggaggaggcggcggtgacgcgccggccgtggtgccgcagcagcggccggcgcagctgagcaggtacgagtcgcagaagcggcgggactggaacacgttcctgcagtacctgcggaaccaccgcccgccgctgacgctggcgcggtgcagcggcgcgcacgtgatcgagttcctcaggtacctggaccagttcggcaagaccaaggtgcacgccgccgggtgcgcctactacggccagcccgcgccgccggggccctgcccgtgcccactgcggcaggcctggggctccctcgacgcgctcatcggccgcctgcgcgccgcgtacgaggagagcggcggcacgcccgagtccaaccccttcgccgcgcgcgccgtgcggatctacctccgcgaggtgcgcgactcgcaggccaaggcgcgcggcatcccctacgagaagaagaagcgcaagcgcgcgcagcaggccgccgagccgtcgtcgagctcgtccgccgccccggccggtgggagcgggagcatcagcagagctgctgcgacggccgccgctcatcaggctggagggagcagcgctgcaccgagcaacacctgagtacagtagatctgcagatcttgtttaattatcgtctccgcatcgcaagatttgagcttagctttctactgcttttgctatatatatgtgctttgcgttgcttcttttctctgcccatttcatccttttcttaccagggttttggatccccctttttttttttccggtttattaggtcaagtatatggctagatattggagtagtagtagctgaaaggggaagaagttggcgattaatcggtgcaagggcaactgtgtgttcatgatctgatacatatatattaatatatatatgttcttggt

SEQ ID NO: 2316 - protein, 208 aa, Panicum virgatum
  misc_feature (16)..(148): Pfam Name: DUF640 Pfam Description: Protein of unknown function (DUF640)
  misc_feature (1)..(208): Ceres Clone ID no. 2004419
  misc_feature (1)..(208): Bit score of 381.5 for HMM based on sequences of Figure 32
  misc_feature (1)..(208): Functional Homolog Of SEQ ID NO. 2271
MDPSGPGPSPVVGGGGGGDAPAVVPQQRPAQLSRYESQKRRDWNTFLQYLRNHRPPLTLARCSGAHVIEFLRYLDQFGKTKVHAAGCAYYGQPAPPGPCPCPLRQAWGSLDALIGRLRAAYEESGGTPESNPFAARAVRIYLREVRDSQAKARGIPYEKKKRKRAQQAAEPSSSSSAAPAGGSGSISRAAATAAAHQAGGSSAAPSNT

SEQ ID NO: 2317 - protein, 239 aa, Oryza sativa subsp. indica
  misc_feature (14)..(146): Pfam Name: DUF640 Pfam Description: Protein of unknown function (DUF640)
  misc_feature (1)..(239): Public GI ID no. 125552681
  misc_feature (1)..(239): Bit score of 381.9 for HMM based on sequences of Figure 32
  misc_feature (1)..(239): Functional Homolog Of SEQ ID NO. 2271
MEGGGGGADAQAQAQPVAQAPPAMQPMQQLSRYESQKRRDWNTFLQYLRNHRPPLTLARCSGAHVIEFLKYLDQFGKTKVHASGCAYYGQPSPPAPCPCPLRQAWGSLDALIGRLRAAYEESGHAPESNPFAARAVRIYLREVRDAQAKARGIPYEKKKRKRTQQQQPPPQPPLPPQHQPGAAAGEASSSSSAAAAAVAAEGSGSSAATAAATSQTGGGGGSTTTTTASAAAPTTATRV

SEQ ID NO: 2318 - protein, 248 aa, Oryza sativa subsp. japonica
  misc_feature (62)..(194): Pfam Name: DUF640 Pfam Description: Protein of unknown function (DUF640)
  misc_feature (1)..(248): Public GI ID no. 115449465
  misc_feature (1)..(248): Bit score of 350.0 for HMM based on sequences of Figure 32
  misc_feature (1)..(248): Functional Homolog Of SEQ ID NO. 2271
MDRHHHHHHHHHHHMMSGGGQDPAAGDGGAGGATQDSFFLGPAAAAMFSGAGSSSSGAGTSAGGGGGGPSPSSSSPSLSRYESQKRRDWNTFGQYLRNHRPPLSLSRCSGAHVLEFLKYMDQFGKTKVHTPVCPFYGHPNPPAPCPCPLRQAWGSLDALIGRLRAAYEENGGTPEMNPFGARAVRLYLREVRETQARARGISYEKKKRKKPSSAGAGAGPSSEGSPPPPGGSASGGGDTSASPQFIIP

SEQ ID NO: 2319 - DNA, 1223 bp, Triticum aestivum
  misc_feature (1)..(1223): Ceres Clone ID no. 773100
  misc_feature (1)..(1223): Encodes the peptide sequence at SEQ ID NO. 2320
gtgccacggctatctacccacctatatacacgcacccccgcccaccctactgcccctcctccctctcctcctcccctcgccaccacacccaatcgcccgctcgctcccccggctcggcaacgatcgatctctccttctccccgagctgctccgtcgtccggacggcgccgtcgaccgcgcgcttgccagatctgaagtcaaaggaggacaggacggacatgcagggagcgccggtggacagcccgggggcggcggaggcagcggcgcggccgagccggtacgagtcgcagaagcgccgggactggcacactttcgggcagtaccttcgcaaccaccgcccgccgctggagctctcgcggtgcagcggcgcccacgtcctcgagttcctccgctacctcgaccagttcggcaagaccaaggtccacgctccaggctgccccttcttcggccacccttccccgccggcgccctgcccgtgcccgctccgccaggcctggggcagcctggacgcgctcgtcggccgcctgcgcgccgccttcgaggagcacggcgggcggcccgaggccaacccgttcggcgcgcgcgccgtccgcctctacctccgcgaggtgcgcgactcccaggccaaggcacgcggcatcgcctacgagaagaagcgccggaagcgcccgccgccgtcgtcgtcccagaaagcggccaaggccgcgccgtccccacccccacccgcctcctcccatgtagcagcgccgcccccagagagcgcgccggaggtcctcgtcgcgcgggccgtacccgcgcaggggcactacttcatcccgcacccgcagcactacatgcacgcgcatttcctgatgccaggcggccacgacgcagacgccgccgtcccgaacagctccagcggcaacagcaacggccacagcaatggccacagcggcggcaccggcgacgagatggccatagcgatggcggcagcggcggaggcgcacgcggcggggtgcatgctgccgctctccgtgttcaactagcgagctttccggccgcacccatggatgcgatcctagcaaaagcaatcgcaaggtagggcttaagtaagttaattcggaggtctatatatctagccgtaatcttgatcgatcattgtaacgatggaaggatgagtgtcatcgatcgatcgatgaacgtactattgttcttcttaccaacactattcacccttttggctg

SEQ ID NO: 2320 - protein, 268 aa, Triticum aestivum
  misc_feature (2)..(134): Pfam Name: DUF640 Pfam Description: Protein of unknown function (DUF640)
  misc_feature (1)..(268): Ceres Clone ID no. 773100
  misc_feature (1)..(268): Bit score of 325.0 for HMM based on sequences of Figure 32
  misc_feature (1)..(268): Functional Homolog Of SEQ ID NO. 2271
MQGAPVDSPGAAEAAARPSRYESQKRRDWHTFGQYLRNHRPPLELSRCSGAHVLEFLRYLDQFGKTKVHAPGCPFFGHPSPPAPCPCPLRQAWGSLDALVGRLRAAFEEHGGRPEANPFGARAVRLYLREVRDSQAKARGIAYEKKRRKRPPPSSSQKAAKAAPSPPPPASSHVAAPPPESAPEVLVARAVPAQGHYFIPHPQHYMHAHFLMPGGHDADAAVPNSSSGNSNGHSNGHSGGTGDEMAIAMAAAAEAHAAGCMLPLSVFN

SEQ ID NO: 2321 - DNA, 849 bp, Sorghum bicolor
  misc_feature (1)..(849): Ceres Annot ID no. 8670506
  misc_feature (1)..(849): Encodes the peptide sequence at SEQ ID NO. 2322
atgcaggtcggaggaggagcggccgacagccccggcgcggcggcgggcgcggaggcgccccgcccgagccgctacgagtcgcagaagcggcgggactggcacacgttcgggcagtacctgcgcaaccaccggccgccgctggagctggcgcggtgcagcggcgcgcacgtgctcgagttcctgcgctacctggaccagttcggcaagaccaaggtccacgcgccggggtgccccttcttcggccacccgtcgccgccggccccgtgcccgtgcccgctgcgccaggcctggggcagcctcgacgcgctcgtcggccgcctgcgcgccgccttcgaggagcacgggggacggcctgaggccaaccccttcggcgcgcgcgccgtgcgcctatacctccgcgaggtccgcgacagccaggccaaggcgcgcggcatcgcctacgagaagaagcgccggaagcggccgtccgcttcgtcgtcccagtcgtcgccgcaggccgcgacgaccccgccgcagcaggctcctcccgtctcctcgccggccctgtcggacgtggtggccgagagggccgacgtgcgggcgcacgtgccggacgccgggcatcagcagcaccatcacctgcaccagcaccagcaccagcatcacttcttcatgccacacccgcagttcctgcacgggttcagcctgctgccgggcaaccccgaagcggtggctgccaatggcaacggcggcggcagcagcagcgctagcgtcgctgccggcaacggtgacgagatagcgctggcgatggcggcggcggcggaggcgcacgcggcggggtgcatgctgccgctgtcggtgttcaactag

SEQ ID NO: 2322 - protein, 282 aa, Sorghum bicolor
  misc_feature (6)..(138): Pfam Name: DUF640 Pfam Description: Protein of unknown function (DUF640)
  misc_feature (1)..(282): Ceres Annot ID no. 8670506
  misc_feature (1)..(282): Bit score of 340.2 for HMM based on sequences of Figure 32
  misc_feature (1)..(282): Functional Homolog Of SEQ ID NO. 2271
MQVGGGAADSPGAAAGAEAPRPSRYESQKRRDWHTFGQYLRNHRPPLELARCSGAHVLEFLRYLDQFGKTKVHAPGCPFFGHPSPPAPCPCPLRQAWGSLDALVGRLRAAFEEHGGRPEANPFGARAVRLYLREVRDSQAKARGIAYEKKRRKRPSASSSQSSPQAATTPPQQAPPVSSPALSDVVAERADVRAHVPDAGHQQHHHLHQHQHQHHFFMPHPQFLHGFSLLPGNPEAVAANGNGGGSSSASVAAGNGDEIALAMAAAAEAHAAGCMLPLSVFN

SEQ ID NO: 2323 - DNA, 1368 bp, Zea mays
  misc_feature (1)..(1368): Ceres Clone ID no. 298827
  misc_feature (1)..(1368): Encodes the peptide sequence at SEQ ID NO. 2324
atcagtagtaaccactcctcgtcgtctctctcgcggtctcgcctcctgcagctagcgctcgccagaaagggaaaccgcatctgctccagcctcccgtcccgtctcggcgccgccgcctgatcgaccagagcccagcgcggggcgtcgaggccgtccggggcgggtccggcgctcagatctgaggcgagtagcaagcgaagaacatgcagatgcaggtcggaggaggcgcggccgacagcccgggcgctgcggcggcggcgggcgcggaggcgccgcgcccgagccgctacgagtcgcagaagcggcgggactggcacacgttcgggcagtacctgcgcaaccaccggccgccgctggagctggcgcggtgcagcggcgcgcacgtgctcgagttcctgcgctacctcgaccagttcggcaagaccaaggtccacgcgccggggtgccccttcttcggccacccgtcgccgcccgcgccgtgcccgtgcccgctgcggcaggcctggggcagcctcgacgcgctcatcggccgcctgcgcgccgccttcgaggagcacgggggccggcccgaggccaaccccttcggcgcccgcgccgtgcgcctctacctccgcgaggtccgcgacagccaggccaaggcccgcggcatcgcctacgagaagaagcgccggaagcggccgtccgcctcgtcccagtcgtcgccgcaggccgcgacgaccccgtcgttgcaggcccctcccgtctccacgccggccctctcggacgcggcggccgagagggccgacgtgcgggcgcacgtccccgacgccgggcacgggcaccagcaccagcaccacttcttcatgccacacccgcagttcctgcacgggttccgactgctgccaggcaaccccgaagcggtggctggcaatggtaatggcgatggcagcagcagcagcgctagcgtcgctgccggcagtggggacgagatagcgctggcgatggcggcggcggcggaggcgcacgcggcggggtgcatgctgccgctgtcggtgttcaactaggcaggcgtatagccgagcgaggtagggcttaaacaatagattaatccgggtgcttatctagtgttaagatcgatctcattgtcgcgatggagatgaaccgatcaacacacacgtacgtgctgctgttcttcaggatttcctattcctattctcatatctccccccttttggttacatgatgctcatgcatttcctgctgcgctgctgggaaatggtactagtagctgtgcttggtactgtagggtttgcagaatcctgcttgttttgtgtatgcagtgcaatgatgatggagatataatataatggaatgcttaatttccaggtc

(The sequence listing continues in the following parts.)

What is claimed is:

1. A method of producing a plant, said method comprising:
    growing a plant cell comprising an exogenous nucleic acid, said exogenous nucleic acid comprising a regulatory region operably linked to a nucleotide sequence encoding a polypeptide having 95 percent or greater sequence identity to SEQ ID NO:1592, and
    producing a plant from said plant cell, wherein said plant has at least a 5% increase in grain yield as compared to the corresponding level of a control plant that does not comprise said nucleic acid,
    wherein said plant is a monocot plant selected from the genera *Elaeis, Festuca, Hordeum, Lolium, Orvza, Panicum, Pennisetum, Phleum, Poa, Saccharum, Secale, Sorghum, Triticosecale, Triticum*, or *Zea*.

2. A method of increasing the grain yield in a plant, said method comprising:
    growing a plant cell comprising an exogenous nucleic acid, said exogenous nucleic acid comprising a regulatory region operably linked to a nucleotide sequence encoding a polypeptide having 95 percent or greater sequence identity to SEQ ID NO:1592, and
    producing a plant from said plant cell, wherein said plant has at least a 5% increase in grain yield as compared to the corresponding level of a control plant that does not comprise said nucleic acid,
    wherein said plant is a monocot plant selected from the genera *Elaeis, Festuca, Hordeum, Lolium, Oryza, Panicum, Pennisetum, Phleum, Poa, Saccharum, Secale, Sorghum, Triticosecale, Triticum*, or *Zea*.

3. The method of claim 2, wherein said polypeptide comprises SEQ ID NO: 1592.

4. A method of producing a plant, said method comprising:
    growing a plant cell comprising an exogenous nucleic acid, said exogenous nucleic acid comprising a regulatory region operably linked to a nucleotide sequence encoding a polypeptide having 95 percent or greater sequence identity to SEQ ID NO:1592, and
    producing a plant from said plant cell, wherein said plant has an increase in plant height as compared to a corresponding level of a control plant that does not comprise said nucleic acid,
    wherein said plant is a monocot plant selected from the genera *Elaeis, Festuca, Hordeum, Lolium, Orvza, Panicum, Pennisetum, Phleum, Poa, Saccharum, Secale, Sorghum, Triticosecale, Triticum*, or *Zea*.

5. A method of producing a plant, said method comprising:
    growing a plant cell comprising an exogenous nucleic acid, said exogenous nucleic acid comprising a regulatory region operably linked to a nucleotide sequence having 95 percent or greater sequence identity to SEQ ID NO:1591, and
    producing a plant from said plant cell, wherein said plant has at least a 5% increase in grain yield as compared to the corresponding level of a control plant that does not comprise said nucleic acid,
    wherein said plant is a monocot plant selected from the genera *Elaeis, Festuca, Hordeum, Lolium, Orvza, Panicum, Pennisetum, Phleum, Poa, Saccharum, Secale, Sorghum, Triticosecale, Triticum*, or *Zea*.

6. The method of claim 1, wherein said polypeptide comprises residues 32 to 190 of SEQ ID NO: 1592.

7. The method of claim 6, wherein said polypeptide comprises SEQ ID NO: 1592.

8. The method of claim 4, wherein said polypeptide comprises residues 32 to 190 of SEQ ID NO: 1592.

9. The method of claim 8, wherein said polypeptide comprises SEQ ID NO: 1592.

* * * * *